(12) United States Patent
Maor et al.

(10) Patent No.: US 10,184,131 B2
(45) Date of Patent: Jan. 22, 2019

(54) ISOLATED POLYNUCLEOTIDES EXPRESSING OR MODULATING MICRORNAS OR TARGETS OF SAME, TRANSGENIC PLANTS COMPRISING SAME AND USES THEREOF

(71) Applicant: A.B. Seeds Ltd., Lod (IL)

(72) Inventors: Rudy Maor, Rechovot (IL); Iris Nesher, Tel-Aviv (IL); Orly Noivirt-Brik, Givataim (IL); Osnat Yanai-Azulay, Rishon-LeZion (IL)

(73) Assignee: A.B. Seeds Ltd. (IL)

( * ) Notice: Subject to any disclaimer, the term of this patent is extended or adjusted under 35 U.S.C. 154(b) by 530 days.

(21) Appl. No.: 14/376,879

(22) PCT Filed: Feb. 6, 2013

(86) PCT No.: PCT/IL2013/050112
§ 371 (c)(1),
(2) Date: Aug. 6, 2014

(87) PCT Pub. No.: WO2013/118120
PCT Pub. Date: Aug. 15, 2013

(65) Prior Publication Data
US 2015/0007364 A1 Jan. 1, 2015

Related U.S. Application Data

(60) Provisional application No. 61/595,213, filed on Feb. 6, 2012.

(51) Int. Cl.
C12N 15/82 (2006.01)

(52) U.S. Cl.
CPC ..... *C12N 15/8271* (2013.01); *C12N 15/8218* (2013.01); *C12N 15/8243* (2013.01); *C12N 15/8261* (2013.01); *C12N 15/8273* (2013.01); *Y02A 40/146* (2018.01)

(58) Field of Classification Search
None
See application file for complete search history.

(56) References Cited

U.S. PATENT DOCUMENTS

| | | | |
|---|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,666,828 A | 5/1987 | Gusella |
| 4,683,202 A | 7/1987 | Mullis |
| 4,801,531 A | 1/1989 | Frossard |
| 4,855,237 A | 8/1989 | Morinaga et al. |
| 4,879,219 A | 11/1989 | Wands et al. |
| 4,945,050 A | 7/1990 | Sanford |
| 5,011,771 A | 4/1991 | Bellet et al. |
| 5,035,323 A | 7/1991 | Daniels et al. |
| 5,192,659 A | 3/1993 | Simons |
| 5,268,463 A | 12/1993 | Jefferson |
| 5,272,057 A | 12/1993 | Smulson et al. |
| 5,281,521 A | 1/1994 | Trojanowski et al. |
| 5,283,185 A | 2/1994 | Epand et al. |
| 5,316,931 A | 5/1994 | Donson et al. |
| 5,399,680 A | 3/1995 | Zhu et al. |
| 5,464,765 A | 11/1995 | Coffee et al. |
| 5,466,785 A | 11/1995 | de Framond |
| 5,569,597 A | 10/1996 | Grimsley et al. |
| 5,604,121 A | 2/1997 | Hilder et al. |
| 5,608,142 A | 3/1997 | Barton et al. |
| 5,608,144 A | 3/1997 | Baden et al. |
| 5,608,149 A | 3/1997 | Barry et al. |
| 5,659,026 A | 8/1997 | Baszczynski et al. |
| 5,693,507 A | 12/1997 | Daniell et al. |
| 5,759,829 A | 6/1998 | Shewmaker et al. |
| 5,952,657 A | 9/1999 | Alexander et al. |
| 5,987,071 A | 11/1999 | Iwamatsu et al. |
| 6,656,805 B2 | 12/2003 | Kamath et al. |
| 2002/0058815 A1 | 5/2002 | Liu et al. |

(Continued)

FOREIGN PATENT DOCUMENTS

| WO | WO 87/06261 A1 | 10/1987 |
|---|---|---|
| WO | WO 93/07278 A1 | 4/1993 |

(Continued)

OTHER PUBLICATIONS

Emery et al. (Current Biology 13:1768-1774, 2003).*
Cheng et al. (Plant Mol. Biol. Rep. 28:41-48, 2010).*
International Preliminary Report on Patentability dated Aug. 21, 2014 From the International Bureau of WIPO Re. Application No. PCT/IL2013/050112.
International Search Report and the Written Opinion dated Aug. 2, 2013 From the International Searching Authority Re. Application No. PCT/IL2013/050112.
International Search Report and the Written Opinion dated Oct. 21, 2013 From the International Searching Authority Re. Application No. PCT/IL2013/050112.
Invitation to Pay Additional Fees dated May 30, 2013 From the International Searching Authority Re. Application No. PCT/IL2013/050112.

(Continued)

*Primary Examiner* — Vinod Kumar
(74) *Attorney, Agent, or Firm* — Amanda Carmany-Rampey; David Marsh; Arnold & Porter Kaye Scholer LLP

(57) ABSTRACT

Isolated polynucleotides expressing or modulating microRNAs or targets of same are provided. Also provided are transgenic plants comprising same and uses thereof in improving nitrogen use efficiency, abiotic stress tolerance, biomass, vigor or yield of a plant.

1 Claim, 3 Drawing Sheets

Specification includes a Sequence Listing.

(56) References Cited

U.S. PATENT DOCUMENTS

| | | |
|---|---|---|
| 2003/0175965 A1 | 9/2003 | Lowe et al. |
| 2003/0180955 A1 | 9/2003 | Ozasa et al. |
| 2007/0089192 A1 | 4/2007 | Huang et al. |
| 2008/0311659 A1 | 12/2008 | Huynh et al. |
| 2011/0099667 A1 | 4/2011 | Aukerman et al. |

FOREIGN PATENT DOCUMENTS

| | | | |
|---|---|---|---|
| WO | WO 99/53050 A1 | 10/1999 | |
| WO | WO 99/59029 A1 | 11/1999 | |
| WO | WO 99/61631 A1 | 12/1999 | |
| WO | WO 00/59035 A1 | 10/2000 | |
| WO | WO 02/00905 A2 | 1/2002 | |
| WO | WO 2004/081173 A2 | 9/2004 | |
| WO | WO 2011/132127 | 10/2011 | |
| WO | WO 2011132127 A1 * | 10/2011 | ......... C12N 15/8218 |
| WO | WO 2013/118120 | 8/2013 | |

OTHER PUBLICATIONS

Lindow et al. "Intragenomic Matching Reveals a Huge Potential for MiRNA-Mediated Regulation in Plants", PLoS Computational Biology, 3(11/e238): 2379-2390, Nov. 2007. Abstract.
Lindow et al. "Oeyza Sativa. Osa-MRIfI 1996-Akr. Stem-Loop Information. Stem Loop Structure Computed Using [Vienna RNA Package]", The miRNA Database [Online], 3 p., 2007.
Zhao et al. "Deep Sequencing Identifies Novel and Conserved MicroRNAs in Peanuts (*Arachis hypogaea* L.)", BMC Plant Biology, 10(3): 1-12, 2010. Abstract, p. 4-5, Table 1, 2.
Bartel, "MicroRNAs: Genomics, Biogenesis, Mechanism, and Function," *Cell*, 116:281-297 (2004).
Boutros et al., "Genome-Wide RNAi Analysis of Growth and Viability in *Drosophila* Cells," *Science*, 303:832-835 (2004).
Dietzl et al., "A genome-wide transgenic RNAi library for conditional gene inactivation in *Drosophila*," *Nature*, 448:151-156 (2007).
Kuromori et al., "A trial of phenome analysis using 4000 Ds-insertional mutants in gene-coding regions of *Arabidopsis*," *Plant Journal*, 47:640-651 (2006).
Lee et al., "A systematic RNAi screen identifies a critical role for mitochondria in C. elegans longevity," *Nature Genetics*, 33:40-48 (2002).
Ni et al., "Overexpression of gma-MIR394a confers tolerance to drought in transgenic *Arabidopsis thaliana*," *Biochem Biophys Res Commun*, 427:330-335 (2012).
Schwab et al., "Specific Effects of MicroRNAs on the Plant Transcriptome," *Developmental Cell*, 8:517-527 (2005).
Covarrubias et al., "Post-transcriptional gene regulation of salinity and drought responses by plant microRNAs," *Plant, Cell & Environment*, 33:481-489 (2010).
Ochman et al., "Genetic Applications of an Inverse Polymerase Chain Reaction," *Genetics*, 120:621-623 (1988).
Rhoades et al., "Prediction of Plant MicroRNA Targets," *Cell*, 110:513-520 (2002).
Schmutz et al., "Genome sequence of the palaeopolyploid soybean," *Nature*, 463:178-183 (2010).
Zhang, "miRU: an automated plant miRNA target prediction server," *Nucleic Acids Research*, 33:W701-W704 (2005).
Albani et al., "The Wheat Transcriptional Activator Spa: A Seed-Specific bZIP Protein That Recgnizes the GCN4-Like Motif in the Bifactorial Endosperm Box of Prolamin Genes," *The Plant Cell*, 9(2):171-184 (1997).
Altenbach et al., "Accumulation of a Brazil nut albumin in seeds of transgenic canola results in enhanced levels of seed protein methionine," *Plant Molecular Biology*, 18:235-245 (1992).
An et al., "Strong, constitutive expression of the *Arabidopsis* ACT2/ACT8 actin subclass in vegetative tissues," *The Plant Journal*, 10(1):107-121 (1996).

Anderson et al., "Nucleotide sequences of the two high-molecular-weight glutenin genes from the D-genome of a hexaploid bread wheat, *Triticum aestivum* L. cv Cheyenne," *Nucleic Acids Research*, 17(1):461-461 (1989).
Angell et al ., "Consistent gene silencing in transgenic plants expressing a replicating potato virus X RNA," *EMBO J.*, 16(12):3675-3684 (1997).
Angell et al., "Potato virus X amplicon-mediated silencing of nuclear genes," *The Plant Journal*, 20(3):357-362 (1999).
Aufsatz et al., "RNA-directed DNA methylation in *Arabidopsis*," *PNAS*, 99(4):1699-16506 (2002).
Baszczynski et al., "Isolation and nucleotide sequence of a genomic clone encoding a new *Brassica napus* napin gene," *Plant Molecular Biology*, 14:633-635 (1990).
Broin et al., "The Plastidic 2-Cysteine Peroxiredoxin Is a Target for a Thioredoxin Involved in the Protection of the Photosynthetic Apparatus against Oxidative Damage," *The Plant Cell*, 14:1417-1432 (2002).
Buchholz et al., "Cyclophilins are encoded by a small gene family in rice," *Plant Molecular Biology*, 25:837-843 (1994).
Chen et al., "Real-time quantification of microRNAs by stem-loop RT-PCR," *Nucleic Acids Research*, 33(20):e179 (2005).
Cho et al., "Inheritance of tissue-specific expression of barley hordein promoter-uidA fusions in transgenic barley plants," *Theor Appl Genet*, 98:1253-1262 (1999).
Christensen et al., "Maize polyubiquitin genes: structure, thermal perturbation of expression and transcript splicing, and promoter activity following transfer to protoplasts by electroporation," *Plant Molecular Biology*, 18:675-689 (1992).
Chuang et al., "Specific and heritable genetic interference by double-stranded RNA in *Arabidopsis*," *PNAS*, 97(9):4985-4990 (2000).
Clough et al., "Floral dip: a simplified method for *Agrobacterium*-mediated transformation of *Arabidopsis thaliana*," *The Plant Journal*, 16(6):735-743 (1998).
Colot et al., "Molecular Characterization of an active wheat LMW glutenin gene and its relation to other wheat and barley prolamin genes," *Mol Gen Genet*, 216:81-90 (1989).
Cummins et al., "cDNA sequence of a sunflower oleosin and transcript tissue specificity," *Plant Molecular Biology*, 19:873-876 (1992).
Dawson et al., "A Tobacco Mosaic Virus-Hybrid Expresses and Loses an Added Gene," *Virology*, 172:285-292 (1989).
De Pater et al., "The promoter of the rice gene GOS2 is active in various different monocot tissues and binds rice nuclear factor ASF-1," *The Plant Journal*, 2(6):837-844 (1992).
DeRose et al., "Analysis of kafirin promoter activity in transgenic tobacco seeds," *Plant Molecular Biology*, 32:1029-1035 (1996).
Desfeux et al., "Female Reproductive Tissues Are the Primary Target of *Agrobacterium*-Mediated Transformation by the *Arabidopsis* Floral-Dip Method," *Plant Physiology*, 123(3):895-904 (2000).
Ellis et al., "Tissue-specific expression of a pea legumin gene in seeds of *Nicotiana plumbaginifolia*," *Plant Molecular Biology*, 10:203-214 (1988).
French et al., "Bacterial Gene Inserted in an Engineered RNA Virus: Efficient Expression in Monocotyledonous Plant Cells," *Science*, 231(4743):1294-1297 (1986).
Gotor et al., "Analysis of three tissue-specific elements from the wheat Cab-1 enhancer," *The Plant Journal*, 3(4):509-518 (1993).
Fromm et al., "Stable transformation of maize after gene transfer by electroporation," *Nature*, 319:791-793 (1986).
Han et al., "Molecular Basis for the Recognition of Primary microRNAs by the DROSHA-DGCR8 Complex," *Cell* 125:887-901 (2006).
Helliwell et al., "Constructs and methods for high-throughput gene silencing in plants," *Methods*, 30:289-295 (2003).
Johansen et al., "Silencing on the Spot. Induction and Suppression of RNA Silencing in the *Agrobacterium*-Mediated Transient Expression System," *Plant Physiol*, 126:930-938 (2001).
Jorgensen et al., "Chalcone synthase cosuppression phenotypes in petunia flowers: comparison of sense vs. antisense constructs and single-copy vs. complex T-DNA sequences," *Plant Mol Biol*, 31(5):957-973 (1996).

(56) References Cited

OTHER PUBLICATIONS

Klee et al., "*Agrobacterium*-Mediated Plant Transformation and Its Further Applications to Plant Biology," *Ann Rev Plant Physiol*, 38:467-486 (1987).
Klein et al., "Factors Influencing Gene Delivery Into *Zea mays* Cells by High-Velocity Microprojectiles," *Nature*, 6:559-563 (1988).
Kurihara et al., "Cross-protection in *Arabidopsis* against crucifer tobamovirus Cg by an attenuated strain of the virus," *Molecular Plant Pathology*, 4(4):259-269 (2003).
Kwon et al., "Identification of a Light-Responsive Region of the Nuclear Gene Encoding of the B Subunit of Chloroplast Glyceraldehyde 3-Phosphate Dehydrogenase from *Arabidopsis thaliana*," *Plant Physiol.*, 105:357-367 (1994).
Last et al., "pEmu: an improved promoter for gene expression in cereal cells," *Theor Appl Genet*, 81:581-588 (1991).
Lepetit et al., "A plant histone gene promoter can direct both replication-dependent and -independent gene expression in transgenic plants," *Mol Gen Genet*, 231:276-285 (1992).
Matsuoka et al., "Tissue-specific light-regulated expression directed by the promoter of a $C_4$ gene, maize pyruvate, orthophosphate dikinase, in a $C_3$ plant, rice," *PNAS USA*, 90:9586-9590 (1993).
Matzke et al., "Deletion analysis of a zein gene promoter in transgenic tobacco plants," *Plant Molecular Biology*, 14:323-332 (1990).
McCabe et al., "Stable Transformation of Soybean (*Glycine max*) by Particle Acceleration," *Bio/Technology*, 6:923-926 (1988).
McElroy et al., "Isolation of an Efficient Actin Promoter for Use in Rice Transformation," *The Plant Cell*, 2:163-171 (1990).
Mena et al., "An endosperm-specific DOF protein from barley, highly conserved in wheat, binds to and activates transcription from the prolamin-box of a native B-hordein promoter in barley endosperm," *The Plant Journal*, 16(1):53-62 (1998).
Mette et al., "Transcriptional silencing and promoter methylation triggered by double-stranded RNA," *EMBO J.*, 19(19):5194-5201 (2000).
Miiller et al., "The nitrogen response of a barley C-hordein promoter is controlled by positive and negative regulation of the GCN4 and endosperm box," *The Plant Journal*, 4(2):343-355 (1993).
Murray et al., "Codon usage in plant genes," *Nucleic Acids Research*, 17(2):477-498 (1989).
Nakase et al., "Characterization of a novel bZIP protein which binds to the α-globulin promoter," *Plant Molecular Biology*, 33:513-522 (1997).
Neuhaus et al., "Transgenic rapeseed plants obtained by the microinjection of DNA into microspore-derived embryoids," *Theor Appl Genet*, 75:30-36 (1987).
Neuhaus et al., "Plant transformation by microinjection techniques," *Physiologia Plantarum*, 79(1):213-217 (1990).
Ni et al., "Strength and tissue specificity of chimeric promoters derived from the octopine and mannopine synthase genes," *The Plant Journal*, 7(4):661-676 (1995).
Nilsson et al., "The *Agrobacterium rhizogenes* rolB and rolC promoters are expressed in pericycle cells competent to serve as root initials in transgenic hybrid aspen," *Physiologia Plantarum*, 100(3):456-462 (1997).
Odell et al., "Identification of DNA sequences required for activity of the cauliflower mosaic virus 35S promoter," *Nature*, 313:810-812 (1985).
Ohta, Y. "High-efficiency transformation of maize by a mixture of pollen and exogenous DNA," *PNAS*, 83:715-719 (1986).
Opsahl-Ferstad et al., "ZmEsr, a novel endosperm-specific gene expressed in a restricted region around the maize embryo," *The Plant Journal*, 12(1):235-246 (1997).
Orozco et al., "Localization of light-inducible and tissue-specific regions of the spinach ribulose bisphosphate carboxylase/oxygenase (rubisco) activase promoter in transgenic tobacco plants," *Plant Molecular Biology*, 23:1129-1138 (1993).

Pandolfini et al., "Expression of self-complementary hairpin RNA under the control of the rolCpromoter confers systemic disease resistance to plum pox virus without preventing local infection," *BMC Biotechnology*, 3:7 (2003).
Panstruga et al., "Testing the efficiency of dsRNAi constructs in vivo: A transient expression assay based on two fluorescent proteins," *Molecular Biology Reports*, 30:135-140 (2003).
Postma-Haarsma et al., "Characterization of the KNOX class homeobox genes Oskn2 and Oskn3 identified in a collection of cDNA libraries covering the early stages of rice embryogenesis," *Plant Molecular Biology*, 39(2):257-271 (1999).
Potiykus, I., "Gene Transfer to Plants: Assessment of Published Approaches and Results," *Annu Rev Plant Physiol Plant Mol Biol*, 42:205-225 (1991).
Purcell et al. "Total Nitrogen Determination in Plant Material by Persulfate Digestion," *Agronomy Journal*, 88(1):111-113 (1996).
Quesada et al., "Genetic Architecture of NaCl Tolerance in *Arabidopsis*," *Plant Physiology*, 130:951-963 (2002).
Rafalski et al., "Developmentally regulated plant genes: the nucleotide sequence of a wheat gliadin genomic clone," *The EMBO Journal*, 3(6):1409-1415 (1984).
Rosenfeld et al., "MicroRNAs accurately identify cancer tissue origin," *Nature Biotechnology*, 26:462-469 (2008).
Russell et al., "Tissue-specific expression in transgenic maize of four endosperm promoters from maize and rice," *Transgenic Research*, 6:157-168 (1997).
Samonte et al., "Nitrogen utilization efficiency: Relationships with grain yield, grain protein, and yield-related traits in rice," *Agron J*, 98:168-176 (2006).
Sanford, J., "Biolistic plant transformation," *Physiologia Plantarum*, 79(1):206-209 (1990).
Sardana et al., "Construction and rapid testing of synthetic and modified toxin gene sequences CryIA (b&c) by expression in maize endosperm culture," *Plant Cell Reports*, 15(9):677-681 (1996).
Sato et al., "A rice homeobox gene, OSH1, is expressed before organ differentiation in a specific region during early embryogenesis," *PNAS*, 93:8117-8122 (1996).
Scofield et al., "Nucleotide Sequence of a Member of the Napin Storage Protein Family from *Brassica napus*," *J Biol. Chem.*, 262(25):12202-12208 (1987).
Shimamoto et al., "Fertile transgenic rice plants regenerated from transformed protoplasts," *Nature*, 338:274-276 (1989).
Simon et al., "Nucleotide sequence of a cDNA clone of *Brassica napus* 12S storage protein shows homology with legumin from *Pisum sativum*," *Plant Molecular Biology*, 5:191-201 (1985).
Smith et al., "Total silencing by intron-spliced hairpin RNAs," *Nature*, 407:319-320 (2000).
Sorensen et al., "Hordein promoter methylation and transcriptional activity in wild-type and mutant barley endosperm," *Mol Gen Genet*, 250:750-760 (1996).
Stålberg et al., "Disruption of an overlapping E-box/ABRE motif abolished high transcription of the napA storage-protein promoter in transgenic *Brassica napus* seeds," *Planta*, 199:515-519 (1996).
Stoutjesdijk et al., "hpRNA-Mediated Targeting of the *Arabidopsis* FAD2 Gene Gives Highly Efficient and Stable Silencing," *Plant Physiol*, 129:1723-1731 (2002).
Takaiwa et al., "A rice glutelin gene family—A major type of glutelin mRNAs can be divided into two classes," *Mol Gen Genet*, 208:15-22 (1987).
Takaiwa et al., "Nucleotide sequence of a rice glutelin gene," *FEBS Letters*, 221:43-47 (1987).
Takamatsu et al., "Expression of bacterial chloramphenicol acetyltransferase gene in tobacco plants mediated by TMV-RNA," *The EMBO Journal*, 6(2):307-311 (1987).
Takamatsu et al., "Production of encephalin in tobacco protoplasts using tobacco mosaic virus RNA vector," *FEBS Letters*, 269(1):73-76 (1990).
Toriyama et al., "Transgenic Rice Plants After Direct Gene Transfer Into Protoplasts," *Bio/Technology*, 6:1072-1074 (1988).
Twell et al., "Isolation and expression of an anther-specific gene from tomato," *Mol Gen Genet*, 217:240-245 (1989).

(56) References Cited

OTHER PUBLICATIONS

Van der Meer et al., "Promoter analysis of the chalcone synthase (chsA) gene of *Petunia hybrid*: a 67 bp promoter region directs flower-specific expression," *Plant Molecular Biology*, 15:95-109 (1990).

Vissenberg et al., "Differential Expression of AtXTH17, AtXTH18, AtXTH19, and AtXTH20 Genes in *Arabidopsis* Roots. Physiological Roles in Specification in Cell Wall Construction," *Plant Cell Physiol*, 46(1):192-200 (2005).

Yamamoto et al., "Light-responsive elements of the tobacco PSI-D gene are located both upstream and within the transcribed region," *The Plant Journal*, 12(2):255-265 (1997).

Yamamoto et al., "The Promoter of a Pine Photosynthetic Gene Allows Expression of a β-Glucuronidase Reporter Gene in Transgenic Rice Plants in a Light-Independent but Tissue-Specific Manner," *Plant Cell Physiol.*, 35(5):773-778 (1994).

Yanagisawa et al., "Metabolic engineering with Dof1 transcription factor in plants: Improved nitrogen assimilation and growth under low-nitrogen conditions," *PNAS* 101(20):7833-7838 (2004).

Yu et al., "Metabolic engineering to increase isoflavone biosynthesis in soybean seed," *Phytochemistry*, 63:753-763 (2003).

Varkonyi-Gasic et al., "Protocol: a highly sensitive RT-PCR method for detection and quantification of microRNAs," *Plant Methods*, 3:12 (2007).

Vicente-Carbajosa et al., "Barley BLZ1: a bZIP transcriptional activator that interacts with endosperm-specific gene promoters," *The Plant Journal*, 13(5):629-640 (1998).

Vodovotz, Y. "Modified microassay for serum nitrite and nitrate," *Biotechniques*, 20(3):390-392 (1996).

Wang et al., "Application of gene silencing in plants," *Current Opinion in Plant Biology*, 5:146-150 (2001).

Waterhouse et al., "Virus resistance and gene silencing in plants can be induced by simultaneous expression of sense and antisense RNA," *PNAS*, 95:13959-13964 (1998).

Waterhouse et al., "Exploring Plant Genomes by RNA-Induced Gene Silencing," *Nature Reviews—Genetics*, 4:29-38 (2003).

Wesley et al., "Construct design for efficient, effective and high-throughput gene silencing in plants," *The Plant Journal*, 27(6):581-590 (2001).

Wu et al., "Genomic Cloning of 18 kDa Oleosin and Detection of Triacylglycerols and Oleosin Isoforms in Maturing Rice and Postgerminative Seedlings," *J. Biochem*, 123:386-391 (1998).

Wu et al., "Promoters of Rice Seed Storage Protein Genes Direct Endosperm-Specific Gene Expression in Transgenic Rice," *Plant Cell Physiol*, 39(8):885-889 (1998).

Zhang et al., "Transgenic rice plants produced by electroporation-mediated plasmid uptake into protoplasts," *Plant Cell Reports*, 7:379-384 (1988).

\* cited by examiner

ISOLATED POLYNUCLEOTIDES EXPRESSING OR MODULATING MICRORNAS OR TARGETS OF SAME, TRANSGENIC PLANTS COMPRISING SAME AND USES THEREOF

RELATED APPLICATIONS

This application is a National Phase of PCT Patent Application No. PCT/IL2013/050122 having International filing date of Feb. 6, 2013, which claims the benefit of priority under 35 USC § 119(e) of U.S. Provisional Patent Application No. 61/595,213 filed on Feb. 6, 2012. The contents of the above applications are all incorporated by reference as if fully set forth herein in their entirety.

SEQUENCE LISTING STATEMENT

The ASCII file, entitled 59933SequenceListing.txt, created on Jul. 17, 2014, comprising 18,690,790 bytes, submitted concurrently with the filing of this application is incorporated herein by reference.

FIELD AND BACKGROUND OF THE INVENTION

The present invention, in some embodiments thereof, relates to isolated polynucleotides expressing or modulating microRNAs or targets of same, transgenic plants comprising same and uses thereof in improving nitrogen use efficiency, abiotic stress tolerance, biomass, vigor or yield of a plant.

Consumption of soybean for food production is increasing worldwide because of its reported beneficial health effects. Soybean is also viewed as an attractive crop for the production of biodiesel. Importantly, it has the ability to fix atmospheric nitrogen, which in turn may cut the input of nitrogen fertilizer that often accounts for the single largest energy input in agriculture.

With a growing world population, increasing demand for food, fuel and fiber, and a changing climate, agriculture faces unprecedented challenges. In general, shortage in water supply is one of the most severe global agricultural problems affecting plant growth and crop yield. Excessive efforts are made to alleviate the harmful effects of desertification of the world's arable land. Farmers are seeking advanced, biotechnology-based solutions to enable them to obtain stable high yields and give them the potential to reduce irrigation costs or to grow crops in areas where potable water is a limiting factor. It should be noted that improved abiotic stress (ABST) tolerance will confer plants with improved vigor also under non-stress conditions, resulting in crops having improved biomass and/or yield.

ABST is a collective term for numerous extreme environmental parameters such as drought, high or low salinity, high or low temperature/light, and nutrient imbalances. The major agricultural crops (corn, rice, wheat, canola and soybean) account for over half of total human caloric intake, giving their overall yield and quality vast importance. ABST causes more than 50% yield loss of the above mentioned major crops. Among the various ABSTs, drought is the major factor that limits crop productivity worldwide. Short-term conditions of reduced environmental water content typically occur during the life cycle of most crop plants. Although most plants have evolved strategies to survive these conditions, when the severity and duration of drought become too great, major alterations to the plant metabolism take place. As a result, the plant development, growth and yield profoundly diminish. Furthermore, drought is associated with increased susceptibility to various diseases. ABST-induced dehydration or osmotic stress, in the form of reduced availability of water and disruption of turgor pressure, cause irreversible cellular damage. A water-limiting environment at various plant developmental stages may activate various physiological changes.

In soybean, drought, for instance, reduces yield by approximately 40%, with the most critical period for water deprivation being the flowering stage and the period following flowering. Water deficit, salinity and low/high temperatures are stresses that cause plant cellular dehydration, due to transpiration rate that exceeds water uptake. Water use efficiency (WUE), defined as the amount of biomass accumulated per unit of water used, plays an important role in determining a plant's ability to tolerate drought stress. The higher the WUE of a plant, the higher the crop productivity and total biomass yield under drought conditions. Thus, efforts are made worldwide to increase the WUE of the most important crops and reach the best yield performance under extreme water deficiency conditions.

Studies have shown that plant adaptations to drought and other adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits. However, generation of transgenic plants expressing full-length genes is typically hampered by the selection of optimal regulatory sequences and identification of those rare transformation events that exhibit sufficient levels of gene products expression.

SUMMARY OF THE INVENTION

According to an aspect of some embodiments of the present invention there is provided a method of improving abiotic stress tolerance, nitrogen use efficiency, biomass, vigor or yield of a plant, the method comprising expressing within the plant an exogenous polynucleotide which down-regulates an activity or expression of a gene encoding an RNAi molecule having a nucleic acid sequence at least 90% identical to SEQ ID NOs: 139, 57-79, 202-219, 126-138, 140-161, 236-255, 169-173, 260-261, 3953-5114, 5117-6277, 6278, 11905-11909, 11940-11955, 11959-11961, wherein the RNAi molecule regulates abiotic stress tolerance of the plant, thereby improving abiotic stress tolerance, nitrogen use efficiency, biomass, vigor or yield of the plant.

According to an aspect of some embodiments of the present invention there is provided a method of improving abiotic stress tolerance, nitrogen use efficiency, biomass, vigor or yield of a plant, the method comprising expressing within the plant an exogenous polynucleotide having a nucleic acid sequence at least 90% identical to SEQ ID NOs: 1-56, 174-201, 80-125, 220-235, 162-168, 256-259, 262-2086, 2087-3910, 3911, 11616, 11615, 11874, 11875-11904, 11910-11939, 11956, 11957 or 11958, wherein the nucleic acid sequence is capable of regulating abiotic stress tolerance of the plant, thereby improving abiotic stress tolerance, nitrogen use efficiency, biomass, vigor or yield of the plant.

According to an aspect of some embodiments of the present invention there is provided a transgenic plant exogenously expressing a polynucleotide having a nucleic acid sequence at least 90% identical to SEQ ID NOs: SEQ ID NOs: 1-56, 174-201, 80-125, 220-235, 162-168, 256-259, 262-2086, 2087-3910, 3911, 11616, 11615, 11874, 11875-11904, 11910-11939, 11956, 11957 or 11958, wherein the nucleic acid sequence is capable of regulating abiotic stress tolerance of the plant.

According to some embodiments of the invention, the exogenous polynucleotide encodes a precursor of the nucleic acid sequence.

According to some embodiments of the invention, the precursor of the nucleic acid sequence is at least 60% identical to SEQ ID NO: 174-201, 220-235, 256-259, 2087-3910, 3911, 11910-11939, 11615, 11956, 11957 or 11958.

According to some embodiments of the invention, the precursor of the nucleic acid sequence is at least 60% identical to SEQ ID NO: 174-201, 220-235, 256-259, 2087-3910, 3911, 11875-11904, 11910-11939, 11615, 11956, 11957 or 11958.

According to some embodiments of the invention, the exogenous polynucleotide encodes a mature miRNA.

According to some embodiments of the invention, the exogenous polynucleotide is selected from the group consisting of SEQ ID NO: 1-56, 174-201, 80-125, 220-235, 162-168, 256-259, 262-2086, 2087-3910, 3911, 11616, 11615, 11874, 11875-11904, 11910-11939, 11956, 11957 or 11958.

According to an aspect of some embodiments of the present invention there is provided a nucleic acid construct comprising a nucleic acid sequence being at least 90% identical to SEQ ID NO: 139, 1-201, 202-235, 236-3910, 3911, 11616, 11615, 11874, 11875-11904, 11910-11939, 11956, 11957, 11958, 11940-11955, 11905-11909, 11959-11961, wherein the nucleic acid sequence is capable of regulating abiotic stress tolerance of a plant and wherein the nucleic acid sequence is under the regulation of a cis-acting regulatory element.

According to some embodiments of the invention, the nucleic acid sequence is selected from the group consisting of SEQ ID NOs: 1-56, 174-201, 80-125, 220-235, 162-168, 256-259, 262-2086, 2087-3910, 3911, 11616, 11615, 11874, 11875-11904, 11910-11939, 11956, 11957 or 11958.

According to some embodiments of the invention, the nucleic acid sequence is selected from the group consisting of SEQ ID NOs: 139, 57-79, 202-219, 126-138, 140-161, 236-255, 169-173, 260-261, 3953-5114, 5117-6277, 6278, 11905-11909, 11959-11961, 11940-11955.

According to an aspect of some embodiments of the present invention there is provided a transgenic plant exogenously expressing a polynucleotide which downregulates an activity or expression of a gene encoding an RNAi molecule having a nucleic acid sequence at least 90% identical to SEQ ID NOs: 139, 57-79, 202-219, 126-138, 140-161, 236-255, 169-173, 260-261, 3953-5114, 5117-6277, 6278 11905-11909, 11940-11955, 11959-11961.

According to an aspect of some embodiments of the present invention there is provided a transgenic plant exogenously expressing a polynucleotide which downregulates an activity or expression of a gene encoding an RNAi molecule having a nucleic acid sequence at least 90% identical to SEQ ID NOs: 139, 1-201, 202-235, 236-3910, 3911, 11616, 11615, 11874, 11875-11904, 11910-11939, 11956, 11957, 11958, 11905-11909, 11940-11955, 11959-11961.

According to an aspect of some embodiments of the present invention there is provided an isolated polynucleotide which downregulates an activity or expression of a gene encoding an RNAi molecule having a nucleic acid sequence selected from the group consisting of SEQ ID NOs: 139, 57-79, 202-219, 126-138, 140-161, 236-255, 169-173, 260-261, 3953-5114, 5117-6277, 6278, 11905-11909, 11940-11955, 11959-11961.

According to an aspect of some embodiments of the present invention there is provided a transgenic plant exogenously expressing a polynucleotide which downregulates an activity or expression of a gene encoding an RNAi molecule having a nucleic acid sequence at least 90% identical to SEQ ID NOs: 139, 57-79, 202-219, 126-138, 140-161, 236-255, 169-173, 260-261, 3953-5114, 5117-6277, 6278, 11905-11909, 11940-11955, 11959-11961.

According to an aspect of some embodiments of the present invention there is provided an isolated polynucleotide which downregulates an activity or expression of a gene encoding an RNAi molecule having a nucleic acid sequence selected from the group consisting of SEQ ID NOs: 139, 57-79, 202-219, 126-138, 140-161, 236-255, 169-173, 260-261, 3953-5114, 5117-6277, 6278, 11905-11909, 11940-11955, 11959-11961.

According to an aspect of some embodiments of the present invention there is provided an isolated polynucleotide which downregulates an activity or expression of a gene encoding an RNAi molecule having a nucleic acid sequence selected from the group consisting of SEQ ID NOs: 139, 1-201, 202-235, 236-3910, 3911, 3953-5114, 5117-6277, 6278, 11616, 11615, 11874, 11875-11904, 11910-11939, 11956, 11957, 11958, 11905-11909, 11940-11955, 11959-11961.

According to an aspect of some embodiments of the present invention there is provided an isolated polynucleotide which downregulates an activity or expression of a gene encoding an RNAi molecule having a nucleic acid sequence selected from the group consisting of SEQ ID NOs: 139, 1-201, 202-235, 236-3910, 3911, 11616, 11615, 11874, 11875-11904, 11910-11939, 11956, 11957, 11958, 11905-11909, 11940-11955, 11959-11961.

According to some embodiments of the invention, the polynucleotide encodes a miRNA-Resistant Target as set forth in SEQ ID NO: 11258-11359.

According to some embodiments of the invention, the polynucleotide encodes a miRNA-Resistant Target as set forth in SEQ ID NO: 11091-11257.

According to some embodiments of the invention, the isolated polynucleotide encodes a target mimic as set forth in SEQ ID NO: 11564-11613.

According to some embodiments of the invention, the polynucleotide encodes a target mimic as set forth in SEQ ID NO: 11437-11513.

According to an aspect of some embodiments of the present invention there is provided a nucleic acid construct comprising the isolated polynucleotide under the regulation of a cis-acting regulatory element.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to an aspect of some embodiments of the present invention there is provided a method of improving abiotic stress tolerance, nitrogen use efficiency, biomass, vigor or yield of a plant, the method comprising expressing within the plant an exogenous polynucleotide encoding a polypeptide having an amino acid sequence at least 80% homologous or identical to SEQ ID NOs: 9591-10364, wherein the polypeptide is capable of regulating abiotic stress tolerance of the plant, thereby improving abiotic stress tolerance, nitrogen use efficiency, biomass, vigor or yield of the plant.

According to an aspect of some embodiments of the present invention there is provided a transgenic plant exogenously expressing a polynucleotide encoding a polypeptide having an amino acid sequence at least 80% homologous or identical to SEQ ID NOs: 9591-10364, wherein the polypeptide is capable of regulating abiotic stress tolerance of the plant.

According to an aspect of some embodiments of the present invention there is provided a nucleic acid construct comprising a polynucleotide encoding a polypeptide having an amino acid sequence at least 80% homologous to SEQ ID NOs: 9591-10364, wherein the polypeptide is capable of regulating abiotic stress tolerance of the plant, and wherein the polynucleotide is under a transcriptional control of a cis-acting regulatory element.

According to some embodiments of the invention, the polynucleotide is selected from the group consisting of SEQ ID NO: 10365-10963.

According to some embodiments of the invention, the polypeptide is selected from the group consisting of SEQ ID NO: 9591-10364.

According to some embodiments of the invention, the cis-acting regulatory element comprises a promoter.

According to some embodiments of the invention, the promoter comprises a tissue-specific promoter.

According to some embodiments of the invention, the tissue-specific promoter comprises a root specific promoter.

According to some embodiments of the invention, the method further comprises growing the plant under limiting nitrogen conditions.

According to some embodiments of the invention, the method further comprises growing the plant under abiotic stress.

According to some embodiments of the invention, the abiotic stress is selected from the group consisting of salinity, drought, water deprivation, flood, etiolation, low temperature, high temperature, heavy metal toxicity, anaerobiosis, nutrient deficiency, nutrient excess, atmospheric pollution and UV irradiation.

According to some embodiments of the invention, the plant is a monocotyledon.

According to some embodiments of the invention, the plant is a dicotyledon.

According to an aspect of some embodiments of the present invention there is provided a method of improving abiotic stress tolerance, nitrogen use efficiency, biomass, vigor or yield of a plant, the method comprising expressing within the plant an exogenous polynucleotide which downregulates an activity or expression of a polypeptide having an amino acid sequence at least 80% homologous or identical to SEQ ID NOs: 6315-8129, wherein the polypeptide is capable of regulating abiotic stress tolerance of the plant, thereby improving abiotic stress tolerance, nitrogen use efficiency, biomass, vigor or yield of the plant.

According to an aspect of some embodiments of the present invention there is provided a transgenic plant exogenously expressing a polynucleotide which downregulates an activity or expression of a polypeptide having an amino acid sequence at least 80% homologous or identical to SEQ ID NOs: 6315-8129, wherein the polypeptide is capable of regulating abiotic stress tolerance of the plant.

According to an aspect of some embodiments of the present invention there is provided a nucleic acid construct comprising a polynucleotide which downregulates an activity or expression of a polypeptide having an amino acid sequence at least 80% homologous to SEQ ID NOs: 6315-8129, wherein the polypeptide is capable of regulating abiotic stress tolerance of a plant, the nucleic acid sequence being under the regulation of a cis-acting regulatory element.

According to some embodiments of the invention, the polynucleotide acts by a mechanism selected from the group consisting of sense suppression, antisense suppression, ribozyme inhibition, gene disruption.

According to some embodiments of the invention, the cis-acting regulatory element comprises a promoter.

According to some embodiments of the invention, the promoter comprises a tissue-specific promoter.

According to some embodiments of the invention, the tissue-specific promoter comprises a root specific promoter.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings.

DESCRIPTION OF SPECIFIC EMBODIMENTS OF THE INVENTION

Figure 1:
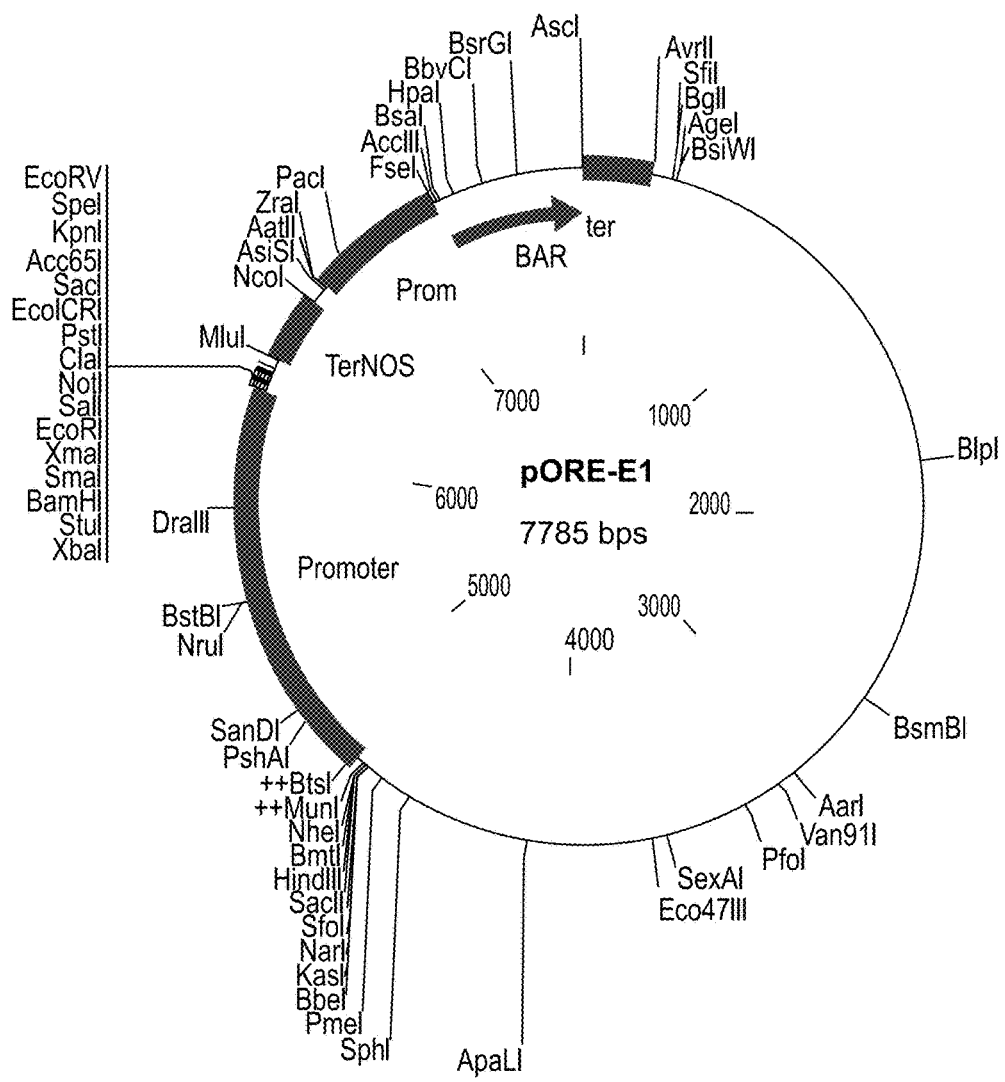
FIG. 1 is a schematic illustration of a plasmid map of the binary vector pORE-E1 used for plant transformation according to some embodiments of the invention.

The present invention, in some embodiments thereof, relates to isolated polynucleotides expressing or modulating microRNAs or targets of same, transgenic plants comprising same and uses thereof in improving nitrogen use efficiency, abiotic stress tolerance, biomass, vigor or yield of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

Environmental stresses represent the most limiting factors for agricultural productivity. Apart from biotic stress caused by plant pathogens, there are a number of abiotic stresses such as extremes in temperature, drought, salinity, heavy metals and radiation which all have detrimental effects on plant growth and yield. Abiotic stresses lead to dehydration or osmotic stress through reduced availability of water for vital cellular functions and maintenance of turgor pressure. Stomata closure, reduced supply of $CO_2$ and slower rate of biochemical reactions during prolonged periods of dehydration, high light intensity, high and low temperatures lead to high production of Reactive Oxygen Intermediates (ROI) in the chloroplasts causing irreversible cellular damage and photo inhibition.

Understanding the molecular mechanism for providing protection against biotic and abiotic stresses may lead to the identification of genes associated with stress tolerance. Optimum homeostasis is always a key to living organisms for adjusted environments.

While reducing the present invention to practice, the present inventors have uncovered dsRNA sequences that are differentially expressed in soy plants grown under abiotic stress conditions including, salt stress, heat stress and drought, versus soy plants grown under optimal conditions (see Example 1 of the Examples section which follows). Following extensive experimentation and screening, the present inventors have uncovered miRNA sequences that are upregulated or downregulated in leaf samples, and suggest using same or sequences controlling same in the generation of transgenic plants having improved abiotic stress tolerance.

Each of the above mechanisms may affect water uptake as well as salt absorption and therefore embodiments of the invention further relate to enhancement of abiotic stress tolerance, nitrogen use efficiency, biomass, vigor or yield of the plant.

Example 5 of the Examples section below, validates the present results by showing that some miRs (e.g., gma-miR4376-5p, zma-miR396b-3p, aly-miR396b-3p, gma-miR156g, ma-miRf10687-akr-omolog gma-miR159d, aly-miR396b-3p, gma-miR4416a, aly-miR396a-3p, zma-miR396b-3p, gma-miR4412-3p, csi-miR162-5p, ath-miRf10279-akr) according to specific embodiment of the invention are indeed differentially expressed under abiotic stress conditions as was initially identified by microarray analysis. The present inventors were also capable of generating transgenic plants which overexpress the indicated miRs (see Example 7).

Thus, according to an aspect of the invention there is provided a method of improving abiotic stress tolerance, nitrogen use efficiency, biomass, vigor or yield of a plant, the method comprising expressing within the plant an exogenous polynucleotide having a nucleic acid sequence at least 80%, 85%, 90% or 95% identical to SEQ ID NOs: 1-56, 174-201, 80-125, 220-235, 162-168, 256-259, 262-2086, 11616, 11615, 2087-3910, 3911, 11910-11939, 11874-11904, 11956, 11957 or 11958 wherein the nucleic acid sequence is capable of regulating abiotic stress tolerance of the plant, thereby improving abiotic stress tolerance, nitrogen use efficiency, biomass, vigor or yield of the plant.

According to a specific embodiment the exogenous polynucleotide has a nucleic acid sequence at least 90% identical to SEQ ID NOs: 1-56, 174-201, 80-125, 220-235, 162-168, 256-259, 262-2086, 11616, 11615, 2087-3910, 3911, 11910-11939, 11874-11904, 11956, 11957 or 11958.

According to a specific embodiment the exogenous polynucleotide has a nucleic acid sequence at least 95% identical to SEQ ID NOs: 1-56, 174-201, 80-125, 220-235, 162-168, 256-259, 262-2086, 11616, 11615, 2087-3910, 3911, 11910-11939, 11874-11904, 11956, 11957 or 11958.

According to a specific embodiment the exogenous polynucleotide has a nucleic acid sequence as set forth in SEQ ID NOs: 1-56, 174-201, 80-125, 220-235, 162-168, 256-259, 262-2086, 11616, 11615, 2087-3910, 3911, 11910-11939, 11874-11904, 11956, 11957 or 11958.

The phrase "abiotic stress" as used herein refers to any adverse effect on metabolism, growth, viability and/or reproduction of a plant. Abiotic stress can be induced by any of suboptimal environmental growth conditions such as, for example, water deficit or drought, flooding, freezing, low or high temperature, strong winds, heavy metal toxicity, anaerobiosis, high or low nutrient levels (e.g. nutrient deficiency), high or low salt levels (e.g. salinity), atmospheric pollution, high or low light intensities (e.g. insufficient light) or UV irradiation. Abiotic stress may be a short term effect (e.g. acute effect, e.g. lasting for about a week) or alternatively may be persistent (e.g. chronic effect, e.g. lasting for example 10 days or more). The present invention contemplates situations in which there is a single abiotic stress condition or alternatively situations in which two or more abiotic stresses occur.

According to an exemplary embodiment the abiotic stress refers to salinity.

According to another exemplary embodiment the abiotic stress refers to drought.

According to another exemplary embodiment the abiotic stress refers to a temperature stress.

As used herein the phrase "abiotic stress tolerance" refers to the ability of a plant to endure an abiotic stress without exhibiting substantial physiological or physical damage (e.g. alteration in metabolism, growth, viability and/or reproducibility of the plant).

As used herein the phrase "nitrogen use efficiency (NUE)" refers to a measure of crop production per unit of nitrogen fertilizer input. Fertilizer use efficiency (FUE) is a measure of NUE. Crop production can be measured by biomass, vigor or yield. The plant's nitrogen use efficiency is typically a result of an alteration in at least one of the uptake, spread, absorbance, accumulation, relocation (within the plant) and use of nitrogen absorbed by the plant. Improved NUE is with respect to that of a non-transgenic plant (i.e., lacking the transgene of the transgenic plant) of the same species and of the same developmental stage and grown under the same conditions.

As used herein the phrase "nitrogen-limiting conditions" refers to growth conditions which include a level (e.g., concentration) of nitrogen (e.g., ammonium or nitrate) applied which is below the level needed for optimal plant metabolism, growth, reproduction and/or viability.

As used herein the term/phrase "biomass", "biomass of a plant" or "plant biomass" refers to the amount (e.g., measured in grams of air-dry tissue) of a tissue produced from the plant in a growing season. An increase in plant biomass can be in the whole plant or in parts thereof such as aboveground (e.g. harvestable) parts, vegetative biomass, roots and/or seeds or contents thereof (e.g., oil, starch etc.).

As used herein the term/phrase "vigor", "vigor of a plant" or "plant vigor" refers to the amount (e.g., measured by weight) of tissue produced by the plant in a given time. Increased vigor could determine or affect the plant yield or the yield per growing time or growing area. In addition, early vigor (e.g. seed and/or seedling) results in improved field stand.

As used herein the term/phrase "yield", "yield of a plant" or "plant yield" refers to the amount (e.g., as determined by weight or size) or quantity (e.g., numbers) of tissues or organs produced per plant or per growing season. Increased yield of a plant can affect the economic benefit one can obtain from the plant in a certain growing area and/or growing time.

According to an exemplary embodiment the yield is measured by cellulose content, oil content, starch content and the like.

According to another exemplary embodiment the yield is measured by oil content.

According to another exemplary embodiment the yield is measured by protein content.

According to another exemplary embodiment, the yield is measured by seed number per plant or part thereof (e.g., kernel, bean).

A plant yield can be affected by various parameters including, but not limited to, plant biomass; plant vigor; plant growth rate; seed yield; seed or grain quantity; seed or grain quality; oil yield; content of oil, starch and/or protein in harvested organs (e.g., seeds or vegetative parts of the plant); number of flowers (e.g. florets) per panicle (e.g. expressed as a ratio of number of filled seeds over number of primary panicles); harvest index; number of plants grown per area; number and size of harvested organs per plant and per area; number of plants per growing area (e.g. density); number of harvested organs in field; total leaf area; carbon assimilation and carbon partitioning (e.g. the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the term "improving" or "increasing" refers to at least about 2%, at least about 3%, at least about 4%, at least about 5%, at least about 10%, at least about 15%, at least about 20%, at least about 25%, at least about 30%, at least about 35%, at least about 40%, at least about 45%, at least about 50%, at least about 60%, at least about 70%, at least about 80%, at least about 90% or greater increase in NUE, in tolerance to abiotic stress, in yield, in biomass or in vigor of a plant, as compared to a native or wild-type plants [i.e., plants not genetically modified to express the biomolecules (polynucleotides) of the invention, e.g., a non-transformed plant of the same species or a transformed plant transformed with a control vector, either of which being of the same developmental stage and grown under the same growth conditions as the transformed plant].

Improved plant NUE is translated in the field into either harvesting similar quantities of yield, while implementing less fertilizers, or increased yields gained by implementing the same levels of fertilizers. Thus, improved NUE or FUE has a direct effect on plant yield in the field.

The term "plant" as used herein encompasses whole plants, ancestors and progeny of the plants and plant parts, including seeds, shoots, stems, roots (including tubers), and isolated plant cells, tissues and organs. The plant may be in any form including suspension cultures, embryos, meristematic regions, callus tissue, leaves, gametophytes, sporophytes, pollen, and microspores.

As used herein the phrase "plant cell" refers to plant cells which are derived and isolated from disintegrated plant cell tissue or plant cell cultures.

As used herein the phrase "plant cell culture" refers to any type of native (naturally occurring) plant cells, plant cell lines and genetically modified plant cells, which are not assembled to form a complete plant, such that at least one biological structure of a plant is not present. Optionally, the plant cell culture of this aspect of the present invention may comprise a particular type of a plant cell or a plurality of different types of plant cells. It should be noted that optionally plant cultures featuring a particular type of plant cell may be originally derived from a plurality of different types of such plant cells.

Any commercially or scientifically valuable plant is envisaged in accordance with some embodiments of the invention. Plants that are particularly useful in the methods of the invention include all plants which belong to the super family Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Cryptomeria japonica*, *Cymbopogon* spp., *Cynthea dealbata*, *Cydonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalyptus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, *eucalyptus*, a tree, an ornamental plant, a perennial grass and a forage crop. Alternatively algae and other non-Viridiplantae can be used for the methods of the present invention.

According to some embodiments of the invention, the plant used by the method of the invention is a crop plant including, but not limited to, cotton, *Brassica* vegetables, oilseed rape, sesame, olive tree, palm oil, banana, wheat, corn or maize, barley, alfalfa, peanuts, sunflowers, rice, oats, sugarcane, soybean, turf grasses, barley, rye, sorghum, sugar cane, chicory, lettuce, tomato, zucchini, bell pepper, eggplant, cucumber, melon, watermelon, beans, hibiscus, okra, apple, rose, strawberry, chili, garlic, pea, lentil, canola, mums, *arabidopsis*, broccoli, cabbage, beet, *quinoa*, spinach, squash, onion, leek, tobacco, potato, sugarbeet, *papaya*, pineapple, mango, *Arabidopsis thaliana*, and also plants used in horticulture, floriculture or forestry, such as, but not limited to, poplar, fir, *eucalyptus*, pine, an ornamental plant, a perennial grass and a forage crop, coniferous plants, moss, algae, as well as other plants listed in World Wide Web (dot) nationmaster (dot) com/encyclopedia/Plantae.

According to a specific embodiment of the present invention, the plant comprises soy.

As used herein, the phrase "exogenous polynucleotide" refers to a heterologous nucleic acid sequence which may not be naturally expressed within the plant or which overexpression [i.e., expression above that found in the control non-transformed plant (e.g., wild type) grown under the same conditions and being of the same developmental stage] in the plant is desired. The exogenous polynucleotide may be introduced into the plant in a stable or transient manner, so as to produce a ribonucleic acid (RNA) molecule. It should be noted that the exogenous polynucleotide may comprise a nucleic acid sequence which is identical or partially identical (homologous) to an endogenous nucleic acid sequence of the plant.

As mentioned, the present teachings are based on the identification of miRNA sequences which regulate the tolerance of plants to abiotic stress.

According to some embodiments the exogenous polynucleotide encodes a miRNA or a precursor thereof.

As used herein, the phrase "microRNA (also referred to herein interchangeably as "miRNA" or "miR") or a precursor thereof" refers to a microRNA (miRNA) molecule acting as a post-transcriptional regulator. Typically, the miRNA molecules are RNA molecules of about 20 to 22 nucleotides in length which can be loaded into a RISC complex and which direct the cleavage of another RNA molecule, wherein the other RNA molecule comprises a nucleotide sequence essentially complementary to the nucleotide sequence of the miRNA molecule.

Typically, a miRNA molecule is processed from a "pre-miRNA" or as used herein a precursor of a pre-miRNA molecule by proteins, such as DCL proteins, present in any plant cell and loaded onto a RISC complex where it can guide the cleavage of the target RNA molecules.

Pre-microRNA molecules are typically processed from pri-microRNA molecules (primary transcripts). The single stranded RNA segments flanking the pre-microRNA are important for processing of the pri-miRNA into the pre-miRNA. The cleavage site appears to be determined by the distance from the stem-ssRNA junction (Han et al. 2006, Cell 125, 887-901, 887-901).

As used herein, a "pre-miRNA" molecule is an RNA molecule of about 100 to about 200 nucleotides, preferably about 100 to about 130 nucleotides which can adopt a secondary structure comprising a double stranded RNA stem and a single stranded RNA loop (also referred to as "hairpin") and further comprising the nucleotide sequence of the miRNA (and its complement sequence) in the double stranded RNA stem.

According to a specific embodiment, the miRNA and its complement are located about 10 to about 20 nucleotides from the free ends of the miRNA double stranded RNA stem. The length and sequence of the single stranded loop region are not critical and may vary considerably, e.g. between 30 and 50 nt in length. The complementarity between the miRNA and its complement need not be perfect and about 1 to 3 bulges of unpaired nucleotides can be tolerated. The secondary structure adopted by an RNA molecule can be predicted by computer algorithms conventional in the art such as mFOLD. The particular strand of the double stranded RNA stem from the pre-miRNA which is released by DCL activity and loaded onto the RISC complex is determined by the degree of complementarity at the 5' end, whereby the strand which at its 5' end is the least involved in hydrogen bounding between the nucleotides of the different strands of the cleaved dsRNA stem is loaded onto the RISC complex and will determine the sequence specificity of the target RNA molecule degradation. However, if empirically the miRNA molecule from a particular synthetic pre-miRNA molecule is not functional (because the "wrong" strand is loaded on the RISC complex), it will be immediately evident that this problem can be solved by exchanging the position of the miRNA molecule and its complement on the respective strands of the dsRNA stem of the pre-miRNA molecule. As is known in the art, binding between A and U involving two hydrogen bounds, or G and U involving two hydrogen bounds is less strong that between G and C involving three hydrogen bounds. Exemplary hairpin sequences are provided in Tables 1-8, below.

Naturally occurring miRNA molecules may be comprised within their naturally occurring pre-miRNA molecules but they can also be introduced into existing pre-miRNA molecule scaffolds by exchanging the nucleotide sequence of the miRNA molecule normally processed from such existing pre-miRNA molecule for the nucleotide sequence of another miRNA of interest. The scaffold of the pre-miRNA can also be completely synthetic. Likewise, synthetic miRNA molecules may be comprised within, and processed from, existing pre-miRNA molecule scaffolds or synthetic pre-miRNA scaffolds. Some pre-miRNA scaffolds may be preferred over others for their efficiency to be correctly processed into the designed microRNAs, particularly when expressed as a chimeric gene wherein other DNA regions, such as untranslated leader sequences or transcription termination and polyadenylation regions are incorporated in the primary transcript in addition to the pre-microRNA.

According to the present teachings, the miRNA molecules may be naturally occurring or synthetic.

Thus, the present teachings contemplate expressing an exogenous polynucleotide having a nucleic acid sequence at least 90%, 91%, 92%, 93%, 94%, 95%, 96%, 97%, 98% 99% or 100% identical to—NOs: 1-56, 80-125, 11874, 262-2086, 11616, (mature), provided that they regulate ABST.

Alternatively or additionally, the present teachings contemplate expressing an exogenous polynucleotide having a nucleic acid sequence at least 65%, 50%, 75%, 80%, 85%, 90%, 91%, 92%, 93%, 94%, 95%, 96%, 97%, 98% 99% or 100% identical to SEQ ID NOs: 1-56, 174-201, 80-125, 220-235, 162-168, 256-259, 262-2086, 11616, 11615, 2087-

3910, 3911, 11910-11939, 11874-11904, 11956, 11957 or 11958 (mature and precursors Tables 1, 3, 5, 7), provided that they regulate abiotic stress tolerance of the plant.

Tables 1, 3, 5 and 7 below illustrate exemplary miRNA sequences and precursors thereof which over expression are associated with modulation of abiotic stress tolerance. It is noted that Tables 1-17 below are incorporated into the specification and are considered an integral part thereof.

The present invention envisages the use of homologous and orthologous sequences of the above miRNA molecules. At the precursor level use of homologous sequences can be done to a much broader extent. Thus, in such precursor sequences the degree of homology may be lower in all those sequences not including the mature miRNA segment therein.

As used herein, the phrase "stem-loop precursor" refers to stem loop precursor RNA structure from which the miRNA can be processed.

Pre-microRNA molecules are typically processed from pri-microRNA molecules (primary transcripts). The single stranded RNA segments flanking the pre-microRNA are important for processing of the pri-miRNA into the pre-miRNA. The cleavage site appears to be determined by the distance from the stem-ssRNA junction (Han et al. 2006, Cell 125, 887-901, 887-901).

As used herein, a "pre-miRNA" molecule is an RNA molecule of about 100 to about 200 nucleotides, preferably about 100 to about 130 nucleotides which can adopt a secondary structure comprising a double stranded RNA stem and a single stranded RNA loop (also referred to as "hairpin") and further comprising the nucleotide sequence of the miRNA (and its complement sequence) in the double stranded RNA stem. According to a specific embodiment, the miRNA and its complement are located about 10 to about 20 nucleotides from the free ends of the miRNA double stranded RNA stem. The length and sequence of the single stranded loop region are not critical and may vary considerably, e.g. between 30 and 50 nt in length. The complementarity between the miRNA and its complement need not be perfect and about 1 to 3 bulges of unpaired nucleotides can be tolerated. The secondary structure adopted by an RNA molecule can be predicted by computer algorithms conventional in the art such as mFOLD. The particular strand of the double stranded RNA stem from the pre-miRNA which is released by DCL activity and loaded onto the RISC complex is determined by the degree of complementarity at the 5' end, whereby the strand which at its 5' end is the least involved in hydrogen bounding between the nucleotides of the different strands of the cleaved dsRNA stem is loaded onto the RISC complex and will determine the sequence specificity of the target RNA molecule degradation. However, if empirically the miRNA molecule from a particular synthetic pre-miRNA molecule is not functional (because the "wrong" strand is loaded on the RISC complex), it will be immediately evident that this problem can be solved by exchanging the position of the miRNA molecule and its complement on the respective strands of the dsRNA stem of the pre-miRNA molecule. As is known in the art, binding between A and U involving two hydrogen bounds, or G and U involving two hydrogen bounds is less strong that between G and C involving three hydrogen bounds.

Thus, according to a specific embodiment, the exogenous polynucleotide encodes a stem-loop precursor of the nucleic acid sequence. Such a stem-loop precursor can be at least about 60%, at least about 65%, at least about 70%, at least about 75%, at least about 80%, at least about 85%, at least about 90%, at least about 95% or more identical to SEQ ID NOs: SEQ ID NO: 174-201, 220-235, 256-259, 2087-3910, 3911, 11910-11939, 11615, 11875-11904, 11956, 11957 or 11958 (homologs precursor), provided that it regulates abiotic stress tolerance.

Identity (e.g., percent identity) can be determined using any homology comparison software, including for example, the BlastN software of the National Center of Biotechnology Information (NCBI) such as by using default parameters.

Homology (e.g., percent homology, identity+similarity) can be determined using any homology comparison software, including for example, the TBLASTN software of the National Center of Biotechnology Information (NCBI) such as by using default parameters.

According to some embodiments of the invention, the term "homology" or "homologous" refers to identity of two or more nucleic acid sequences; or identity of two or more amino acid sequences.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor joining tree (Hypertext Transfer Protocol://en (dot) wikipedia (dot) org/wiki/Neighbor-joining) which helps visualizing the clustering.

As mentioned, the present inventors have also identified RNAi sequences which are down regulated under abiotic stress conditions.

Thus, according to an aspect of the invention there is provided a method of improving abiotic stress tolerance, nitrogen use efficiency, biomass, vigor or yield of a plant, the method comprising expressing within the plant an exogenous polynucleotide which downregulates an activity or expression of a gene encoding a miRNA molecule having a nucleic acid sequence at least 80%, 85% or preferably 90%, 95% or even 100% identical to the sequence selected from the group consisting of SEQ ID NOs: 57-79, 202-219, 126-161, 236-255, 169-173, 260-261, 3953-5114, 11905-11909, 11940-11955, 11959-11961, 5117-6277 or 6278 (Tables 2, 4, 6 and 8), thereby improving abiotic stress tolerance, nitrogen use efficiency, biomass, vigor or yield of a plant.

There are various approaches to down regulate miRNA sequences.

As used herein the term "down-regulation" refers to reduced activity or expression of the miRNA (at least 10%, 20%, 30%, 50%, 60%, 70%, 80%, 90% or 100% reduction in activity or expression) as compared to its activity or expression in a plant of the same species and the same developmental stage not expressing the exogenous polynucleotide.

Nucleic acid agents that down-regulate miR activity include, but are not limited to, a target mimic, a micro-RNA resistant gene and a miRNA inhibitor.

The target mimic or micro-RNA resistant target is essentially complementary to the microRNA provided that one or more of following mismatches are allowed:

(a) a mismatch between the nucleotide at the 5' end of the microRNA and the corresponding nucleotide sequence in the target mimic or micro-RNA resistant target;

(b) a mismatch between any one of the nucleotides in position 1 to position 9 of the microRNA and the corresponding nucleotide sequence in the target mimic or micro-RNA resistant target; or (c) three mismatches between any one of the nucleotides in position 12 to position 21 of the microRNA and the corresponding nucleotide sequence in the target mimic or micro-RNA resistant target provided that there are no more than two consecutive mismatches.

The target mimic RNA is essentially similar to the target RNA modified to render it resistant to miRNA induced cleavage, e.g. by modifying the sequence thereof such that a variation is introduced in the nucleotide of the target mimic sequence complementary to the nucleotides 10 or 11 of the miRNA resulting in a mismatch.

Alternatively, a microRNA-resistant target may be implemented. Thus, a silent mutation may be introduced in the microRNA binding site of the target gene so that the DNA and resulting RNA sequences are changed in a way that prevents microRNA binding, but the amino acid sequence of the protein is unchanged. Thus, a new sequence can be synthesized instead of the existing binding site, in which the DNA sequence is changed, resulting in lack of miRNA binding to its target.

Tables 14-17 below provide non-limiting examples of target mimics and target resistant sequences that can be used to down-regulate the activity of the miRs of the invention. According to a specific embodiment, the target mimic is listed in any one of the sequences of Table 7. According to a specific embodiment, the mir-resistant target sequence is listed in any one of the sequences of Table 15.

According to a specific embodiment, the target mimic or micro-RNA resistant target is linked to the promoter naturally associated with the pre-miRNA recognizing the target gene and introduced into the plant cell. In this way, the miRNA target mimic or micro-RNA resistant target RNA will be expressed under the same circumstances as the miRNA and the target mimic or micro-RNA resistant target RNA will substitute for the non-target mimic/micro-RNA resistant target RNA degraded by the miRNA induced cleavage.

Non-functional miRNA alleles or miRNA resistant target genes may also be introduced by homologous recombination to substitute the miRNA encoding alleles or miRNA sensitive target genes.

Recombinant expression is effected by cloning the nucleic acid of interest (e.g., miRNA, target gene, silencing agent etc) into a nucleic acid expression construct under the expression of a plant promoter, as further described hereinbelow.

In other embodiments of the invention, synthetic single stranded nucleic acids are used as miRNA inhibitors. A miRNA inhibitor is typically between about 17 to 25 nucleotides in length and comprises a 5' to 3' sequence that is at least 90% complementary to the 5' to 3' sequence of a mature miRNA. In certain embodiments, a miRNA inhibitor molecule is 17, 18, 19, 20, 21, 22, 23, 24, or 25 nucleotides in length, or any range derivable therein. Moreover, a miRNA inhibitor has a sequence (from 5' to 3') that is or is at least 90, 91, 92, 93, 94, 95, 96, 97, 98, 99, 99.1, 99.2, 99.3, 99.4, 99.5, 99.6, 99.7, 99.8, 99.9 or 100% complementary, or any range derivable therein, to the 5' to 3' sequence of a mature miRNA, particularly a mature, naturally occurring miRNA.

While further reducing the present invention to practice, the present inventors have identified gene targets for the differentially expressed miRNA molecules. It is therefore contemplated, that gene targets of those miRNAs that are down regulated during stress should be overexpressed in order to confer tolerance, while gene targets of those miRNAs that are up regulated during stress should be down-regulated in the plant in order to confer tolerance.

Thus, according to an aspect of the invention there is provided a method of improving abiotic stress tolerance, nitrogen use efficiency, biomass, vigor or yield of a plant, the method comprising expressing within the plant an exogenous polynucleotide encoding a polypeptide having an amino acid sequence at least 80%, 82%, 84%, 85%, 86%, 88%, 90%, 92%, 94%, 95%, 96%, 97%, 98%, 99% or 100% homologous to SEQ ID NOs: 9591-10364 (gene targets of down regulated miRNAs, see Table 10), wherein the polypeptide is capable of regulating abiotic stress tolerance of the plant, thereby improving abiotic stress tolerance, nitrogen use efficiency, biomass, vigor or yield of the plant.

Nucleic acid sequences (also referred to herein as polynucleotides) of the polypeptides of some embodiments of the invention may be optimized for expression in a specific plant host. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization tables such as those provided on-line at the Codon Usage Database through the NIAS (National Institute of Agrobiological Sciences) DNA bank in Japan (www(dot)kazusa(dot)or(dot)jp/codon/). The Codon Usage Database contains codon usage tables for a number of different species, with each codon usage table having been statistically determined based on the data present in Genbank.

By using the above tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Target genes which are contemplated according to the present teachings are provided in the polynucleotide sequences which comprise nucleic acid sequences as set forth in the soy polynucleotides listed in Table 10). However the present teachings also relate to orthologs or homologs at least about 60%, at least about 65%, at least about 70%, at least about 75%, at least about 80%, at least about 85%, at least about 90%, or at least about 95% or more identical or similar to SEQ ID NO: 10365-10963 (polynucleotides listed in Table 10). Parameters for determining the level of identity are provided hereinbelow.

Alternatively or additionally, target genes which are contemplated according to the present teachings are provided in the polypeptide sequences which comprise amino acid sequences as set forth in the soy polypeptides of Table 10). However the present teachings also relate to orthologs or homologs at least about 60%, at least about 65%, at least about 70%, at least about 75%, at least about 80%, at least about 85%, at least about 90%, or at least about 95% or more identical or similar to SEQ ID NO: 9591-10364 (Table 10).

As mentioned the present inventors have also identified genes which down-regulation may be done in order to improve their abiotic stress tolerance, NUE, biomass, vigor and yield.

Thus, according to an aspect of the invention there is provided a method of improving abiotic stress tolerance, nitrogen use efficiency, biomass, vigor or yield of a plant, the method comprising expressing within the plant an exogenous polynucleotide which downregulates an activity or expression of a polypeptide having an amino acid sequence at least 80%, 85%, 90%, 95%, or 100% homologous to SEQ ID NOs: 6315-8129 (polypeptides of Table 9), wherein the polypeptide is capable of regulating abiotic stress tolerance of the plant, thereby improving abiotic stress tolerance, nitrogen use efficiency, biomass, vigor or yield of the plant.

Down regulation of activity or expression is by at least 10%, 20%, 30%, 40%, 50%, 60%, 70%, 80%, 90% or even complete (100%) loss of activity or expression. Assays for measuring gene expression can be effected at the protein level (e.g., Western blot, ELISA) or at the mRNA level such as by RT-PCR.

According to a specific embodiment the amino acid sequence of the target gene is as set forth in SEQ ID NOs: 6315-8129 of Table 9.

Alternatively or additionally, the amino acid sequence of the target gene is encoded by a polynucleotide sequence as set forth in SEQ ID NOs: 8130-9590 of Table 9.

Examples of polynucleotide downregulating agents that inhibit (also referred to herein as inhibitors or nucleic acid (downregulating) agents) the expression of a target gene are given below.

1. Polynucleotide-Based Inhibition of Gene Expression.

It will be appreciated, that any of these methods when specifically referring to downregulating expression/activity of the target genes can be used, at least in part, to downregulate expression or activity of endogenous RNA molecules.

i. Sense Suppression/Cosuppression

In some embodiments of the invention, inhibition of the expression of target gene may be obtained by sense suppression or cosuppression. For cosuppression, an expression cassette is designed to express an RNA molecule corresponding to all or part of a messenger RNA encoding a target gene in the "sense" orientation. Over-expression of the RNA molecule can result in reduced expression of the native gene. Accordingly, multiple plant lines transformed with the cosuppression expression cassette are screened to identify those that show the greatest inhibition of target gene expression.

The polynucleotide used for cosuppression may correspond to all or part of the sequence encoding the target gene, all or part of the 5' and/or 3' untranslated region of a target transcript, or all or part of both the coding sequence and the untranslated regions of a transcript encoding the target gene. In some embodiments where the polynucleotide comprises all or part of the coding region for the target gene, the expression cassette is designed to eliminate the start codon of the polynucleotide so that no protein product will be transcribed.

Cosuppression may be used to inhibit the expression of plant genes to produce plants having undetectable protein levels for the proteins encoded by these genes. See, for example, Broin, et al., (2002) Plant Cell 15:1517-1532. Cosuppression may also be used to inhibit the expression of multiple proteins in the same plant. Methods for using cosuppression to inhibit the expression of endogenous genes in plants are described in Flavell, et al., (1995) Proc. Natl. Acad. Sci. USA 91:3590-3596; Jorgensen, et al., (1996) Plant Mol. Biol. 31:957-973; Johansen and Carrington, (2001) Plant Physiol. 126:930-938; Broin, et al., (2002) Plant Cell 15:1517-1532; Stoutjesdijk, et al., (2002) Plant Physiol. 129:1723-1731; Yu, et al., (2003) Phytochemistry 63:753-763; and U.S. Pat. Nos. 5,035,323, 5,283,185 and 5,952,657; each of which is herein incorporated by reference. The efficiency of cosuppression may be increased by including a poly-dt region in the expression cassette at a position 3' to the sense sequence and 5' of the polyadenylation signal. See, US Patent Publication Number 20020058815, herein incorporated by reference. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity. See, U.S. Pat. Nos. 5,283,185 and 5,035,323; herein incorporated by reference.

Transcriptional gene silencing (TGS) may be accomplished through use of hpRNA constructs wherein the inverted repeat of the hairpin shares sequence identity with the promoter region of a gene to be silenced. Processing of the hpRNA into short RNAs which can interact with the homologous promoter region may trigger degradation or methylation to result in silencing. (Aufsatz, et al., (2002) PNAS 99(4):16499-16506; Mette, et al., (2000) EMBO J. 19(19):5194-5201)

ii. Antisense Suppression

In some embodiments of the invention, inhibition of the expression of the target gene may be obtained by antisense suppression. For antisense suppression, the expression cassette is designed to express an RNA molecule complementary to all or part of a messenger RNA encoding the target gene. Over-expression of the antisense RNA molecule can result in reduced expression of the native gene. Accordingly, multiple plant lines transformed with the antisense suppression expression cassette are screened to identify those that show the greatest inhibition of target gene expression.

The polynucleotide for use in antisense suppression may correspond to all or part of the complement of the sequence encoding the target gene, all or part of the complement of the 5' and/or 3' untranslated region of the target gene transcript, or all or part of the complement of both the coding sequence and the untranslated regions of a transcript encoding the target gene. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. Furthermore, portions of the antisense nucleotides may be used to disrupt the expression of the target gene. Generally, sequences of at least 50 nucleotides, 100 nucleotides, 200 nucleotides, 300, 500, 550 or greater may be used. Methods for using antisense suppression to inhibit the expression of endogenous genes in plants are described, for example, in Liu, et al., (2002) Plant Physiol. 129:1732-1753 and U.S. Pat. No. 5,759,829, which is herein incorporated by reference. Efficiency of antisense suppression may be increased by including a poly-dT region in the expression cassette at a position 3' to the antisense sequence and 5' of the polyadenylation signal. See, US Patent Publication Number 20020058815.

iii. Double-Stranded RNA Interference

In some embodiments of the invention, inhibition of the expression of a target gene may be obtained by double-stranded RNA (dsRNA) interference. For dsRNA interference, a sense RNA molecule like that described above for cosuppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the expression cassette to comprise both a sense sequence and an antisense sequence. Alternatively, separate expression cassettes may be used for the sense and antisense sequences. Multiple plant lines transformed with the dsRNA interference expression cassette or expression cassettes are then screened to identify plant lines that show the greatest inhibition of target gene expression. Methods for using dsRNA interference to inhibit the expression of endogenous plant genes are described in Waterhouse, et al., (1998) Proc. Natl. Acad. Sci. USA 95:13959-13965, Liu, et al., (2002) Plant Physiol. 129:1732-1753, and WO 99/59029, WO 99/53050, WO 99/61631, and WO 00/59035.

iv. Hairpin RNA Interference and Intron-Containing Hairpin RNA Interference

In some embodiments of the invention, inhibition of the expression of one or more target gene may be obtained by hairpin RNA (hpRNA) interference or intron-containing hairpin RNA (ihpRNA) interference. These methods are highly efficient at downregulating the expression of endogenous genes. See, Waterhouse and Helliwell, (2003) Nat. Rev. Genet. 5:29-38 and the references cited therein.

For hpRNA interference, the expression cassette is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited, and an antisense sequence that is fully or partially complementary to the sense sequence. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz, (2000) Proc. Natl. Acad. Sci. USA 97:5985-5990; Stoutjesdijk, et al., (2002) Plant Physiol. 129:1723-1731; and Waterhouse and Helliwell, (2003) Nat. Rev. Genet. 5:29-38. Methods for using hpRNA interference to inhibit or silence the expression of genes are described, for example, in Chuang and Meyerowitz, (2000) Proc. Natl. Acad. Sci. USA 97:5985-5990; Stoutjesdijk, et al., (2002) Plant Physiol. 129:1723-1731; Waterhouse and Helliwell, (2003) Nat. Rev. Genet. 5:29-38; Pandolfini, et al., BMC Biotechnology 3:7, and US Patent Publication Number 20030175965; each of which is herein incorporated by reference. A transient assay for the efficiency of hpRNA constructs to silence gene expression in vivo has been described by Panstruga, et al., (2003) Mol. Biol. Rep. 30:135-150, herein incorporated by reference.

For ihpRNA, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) Nature 507:319-320. In fact, Smith, et al., show 100% suppression of endogenous gene expression using ihpRNA-mediated interference. Methods for using ihpRNA interference to inhibit the expression of endogenous plant genes are described, for example, in Smith, et al., (2000) Nature 507:319-320; Wesley, et al., (2001) Plant J. 27:584, 1-3, 590; Wang and Waterhouse, (2001) Curr. Opin. Plant Biol. 5:156-150; Waterhouse and Helliwell, (2003) Nat.

Rev. Genet. 5:29-38; Helliwell and Waterhouse, (2003) Methods 30:289-295, and US Patent Publication Number 20030180955, each of which is herein incorporated by reference.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 02/00905, herein incorporated by reference.

v. Amplicon-Mediated Interference

Amplicon expression cassettes comprise a plant virus-derived sequence that contains all or part of the target gene but generally not all of the genes of the native virus. The viral sequences present in the transcription product of the expression cassette allow the transcription product to direct its own replication. The transcripts produced by the amplicon may be either sense or antisense relative to the target sequence (i.e., the messenger RNA for target gene). Methods of using amplicons to inhibit the expression of endogenous plant genes are described, for example, in Angell and Baulcombe, (1997) EMBO J. 16:3675-3685, Angell and Baulcombe, (1999) Plant J. 20:357-362, and U.S. Pat. No. 6,656,805, each of which is herein incorporated by reference.

vi. Ribozymes

In some embodiments, the polynucleotide expressed by the expression cassette of the invention is catalytic RNA or has ribozyme activity specific for the messenger RNA of target gene. Thus, the polynucleotide causes the degradation of the endogenous messenger RNA, resulting in reduced expression of the target gene. This method is described, for example, in U.S. Pat. No. 5,987,071, herein incorporated by reference.

2. Gene Disruption

In some embodiments of the present invention, the activity of a miRNA or a target gene is reduced or eliminated by disrupting the gene encoding the target polypeptide. The gene encoding the target polypeptide may be disrupted by any method known in the art. For example, in one embodiment, the gene is disrupted by transposon tagging. In another embodiment, the gene is disrupted by mutagenizing plants using random or targeted mutagenesis, and selecting for plants that have reduced response regulator activity.

Any of the nucleic acid agents described herein (for overexpression or downregulation of either the target gene or the miRNA) can be provided to the plant as naked RNA or expressed from a nucleic acid expression construct, where it is operably linked to a regulatory sequence.

According to a specific embodiment of the invention, there is provided a nucleic acid construct comprising a nucleic acid sequence encoding a nucleic acid agent (e.g., miRNA or a precursor thereof as described herein, gene target or silencing agent), the nucleic acid sequence being under a transcriptional control of a regulatory sequence such as a tissue specific promoter.

An exemplary nucleic acid construct which can be used for plant transformation include, the pORE E2 binary vector (FIG. 1) in which the relevant nucleic acid sequence is ligated under the transcriptional control of a promoter.

A coding nucleic acid sequence is "operably linked" or "transcriptionally linked to a regulatory sequence (e.g., promoter)" if the regulatory sequence is capable of exerting a regulatory effect on the coding sequence linked thereto.

Thus, the regulatory sequence controls the transcription of the miRNA or precursor thereof, gene target or silencing agent.

The term "regulatory sequence", as used herein, means any DNA, that is involved in driving transcription and controlling (i.e., regulating) the timing and level of transcription of a given DNA sequence, such as a DNA coding for a miRNA, precursor or inhibitor of same. For example, a 5' regulatory region (or "promoter region") is a DNA sequence located upstream (i.e., 5') of a coding sequence and which comprises the promoter and the 5'-untranslated leader sequence. A 3' regulatory region is a DNA sequence located downstream (i.e., 3') of the coding sequence and which comprises suitable transcription termination (and/or regulation) signals, including one or more polyadenylation signals.

For the purpose of the invention, the promoter is a plant-expressible promoter. As used herein, the term "plant-expressible promoter" means a DNA sequence which is capable of controlling (initiating) transcription in a plant cell. This includes any promoter of plant origin, but also any promoter of non-plant origin which is capable of directing transcription in a plant cell, i.e., certain promoters of viral or bacterial origin. Thus, any suitable promoter sequence can be used by the nucleic acid construct of the present invention. According to some embodiments of the invention, the promoter is a constitutive promoter, a tissue-specific promoter or an inducible promoter (e.g. an abiotic stress-inducible promoter).

Suitable constitutive promoters include, for example, hydroperoxide lyase (HPL) promoter, CaMV 35S promoter (Odell et al, Nature 313:810-812, 1985); *Arabidopsis* At6669 promoter (see PCT Publication No. WO04081173A2); *Arabidopsis* new At6669 promoter; maize Ubi 1 (Christensen et al., Plant Sol. Biol. 18:675-689, 1992); rice actin (McElroy et al., Plant Cell 2:163-171, 1990); pEMU (Last et al, Theor. Appl. Genet. 81:584, 1-3, 588, 1991); CaMV 19S (Nilsson et al, Physiol. Plant 100: 456-462, 1997); GOS2 (de Pater et al, Plant J Nov; 2(6): 837-44, 1992); ubiquitin (Christensen et al, Plant MoI. Biol. 18: 675-689, 1992); Rice cyclophilin (Bucholz et al, Plant MoI Biol. 25(5):837-43, 1994); Maize H3 histone (Lepetit et al, MoI. Gen. Genet. 231:276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant MoI. Biol. 23:1129-1138, 1993; and Matsuoka et al., Proc. Natl. Acad. Sci. USA 90:9586-9590, 1993], seed-preferred promoters [e.g., from seed specific genes (Simon, et al., Plant MoI. Biol. 5. 191, 1985; Scofield, et al., J. Biol. Chem. 262: 12202, 1987; Baszczynski, et al., Plant MoI. Biol. 14: 633, 1990), Brazil Nut albumin (Pearson' et al., Plant MoI. Biol. 18: 235-245, 1992), legumin (Ellis, et al. Plant MoI. Biol. 10: 203-214, 1988), Glutelin (rice) (Takaiwa, et al., MoI. Gen. Genet. 208: 15-22, 1986; Takaiwa, et al., FEBS Letts. 221:43-47, 1987), Zein (Matzke et al., Plant MoI Biol, 143)323-32 1990), napA (Stalberg, et al., Planta 199: 515-519, 1996), Wheat SPA (Albanietal, Plant Cell, 9: 171-184, 1997), sunflower oleosin (Cummins, et al, Plant MoI. Biol. 19: 873-876, 1992)], endosperm specific promoters [e.g., wheat LMW and HMW, glutenin-1 (Mol Gen Genet 216:81-90, 1989; NAR 17:461-2), wheat a, b and g gliadins (EMBO3: 1409-15, 1984), Barley ltrl promoter, barley Bl, C, D hordein (Theor Appl Gen 98:1253-62, 1999; Plant J 4:343-55, 1993; Mol Gen Genet 250:750-60, 1996), Barley DOF (Mena et al., The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin GIb-I (Wu et al., Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorghum gamma-kafirin (PMB 32:1029-35, 1996); e.g., the Napin promoter], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al., Mol. Gen Genet. 217:240-245; 1989), apetala-3]. Also contemplated are root-specific promoters such as the ROOTP promoter described in Vissenberg K, et al. Plant Cell Physiol. 2005 January; 46(1):192-200.

The nucleic acid construct of some embodiments of the invention can further include an appropriate selectable marker and/or an origin of replication.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

When naked RNA or DNA is introduced into a cell, the polynucleotides may be synthesized using any method known in the art, including either enzymatic syntheses or solid-phase syntheses. These are especially useful in the case of short polynucleotide sequences with or without modifications as explained above. Equipment and reagents for executing solid-phase synthesis are commercially available from, for example, Applied Biosystems. Any other means for such synthesis may also be employed; the actual synthesis of the oligonucleotides is well within the capabilities of one skilled in the art and can be accomplished via established methodologies as detailed in, for example: Sambrook, J. and Russell, D. W. (2001), "Molecular Cloning: A Laboratory Manual"; Ausubel, R. M. et al., eds. (1994, 1989), "Current Protocols in Molecular Biology," Volumes I-III, John Wiley & Sons, Baltimore, Md.; Perbal, B. (1988), "A Practical Guide to Molecular Cloning," John Wiley & Sons, New York; and Gait, M. J., ed. (1984), "Oligonucleotide Synthesis"; utilizing solid-phase chemistry, e.g. cyanoethyl phosphoramidite followed by deprotection, desalting, and purification by, for example, an automated trityl-on method or HPLC.

There are various methods of introducing foreign genes into both monocotyledonous and dicotyledonous plants (Potrykus, L, Annu. Rev. Plant. Physiol, Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer (e.g., T-DNA using *Agrobacterium tumefaciens* or *Agrobacterium rhizogenes*); see for example, Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

According to a specific embodiment of the present invention, the exogenous polynucleotide is introduced into the plant by infecting the plant with bacteria, such as using a floral dip transformation method (as described in further detail in Example 7, of the Examples section which follows).

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. For this reason it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

Although stable transformation is presently preferred, transient transformation of leaf cells, meristematic cells or the whole plant is also envisaged by the present invention.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261. According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Galon et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al, Virology (1989) 172: 285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat proteins which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral nucleic acid is provided in which the native coat protein coding sequence has been deleted from a viral nucleic acid, a non-native plant viral coat protein coding sequence and a non-native promoter, preferably the subgenomic promoter of the non-native coat protein coding sequence, capable of expression in the plant host, packaging of the recombinant plant viral nucleic acid, and ensuring a systemic infection of the host by the recombinant plant viral nucleic acid, has been inserted. Alternatively, the coat protein gene may be inactivated by insertion of the non-native nucleic acid sequence within it, such that a protein is produced. The recombinant plant viral nucleic acid may contain one or more additional non-native subgenomic promoters. Each non-native subgenomic promoter is capable of transcribing or expressing adjacent genes or nucleic acid sequences in the plant host and incapable of recombination with each other and with native subgenomic promoters. Non-native (foreign) nucleic acid sequences may be inserted adjacent the native plant viral subgenomic promoter or the native and a non-native plant viral subgenomic promoters if more than one nucleic acid sequence is included. The non-native nucleic acid sequences are transcribed or expressed in the host plant under control of the subgenomic promoter to produce the desired products.

In a second embodiment, a recombinant plant viral nucleic acid is provided as in the first embodiment except that the native coat protein coding sequence is placed adjacent one of the non-native coat protein subgenomic promoters instead of a non-native coat protein coding sequence.

In a third embodiment, a recombinant plant viral nucleic acid is provided in which the native coat protein gene is adjacent its subgenomic promoter and one or more non-native subgenomic promoters have been inserted into the viral nucleic acid. The inserted non-native subgenomic promoters are capable of transcribing or expressing adjacent genes in a plant host and are incapable of recombination with each other and with native subgenomic promoters. Non-native nucleic acid sequences may be inserted adjacent to the non-native subgenomic plant viral promoters such that the sequences are transcribed or expressed in the host plant under control of the subgenomic promoters to produce the desired product.

In a fourth embodiment, a recombinant plant viral nucleic acid is provided as in the third embodiment except that the native coat protein coding sequence is replaced by a non-native coat protein coding sequence.

The viral vectors are encapsidated by the coat proteins encoded by the recombinant plant viral nucleic acid to produce a recombinant plant virus. The recombinant plant viral nucleic acid or recombinant plant virus is used to infect appropriate host plants. The recombinant plant viral nucleic acid is capable of replication in the host, systemic spread in the host, and transcription or expression of foreign gene(s) (isolated nucleic acid) in the host to produce the desired sequence.

In addition to the above, the nucleic acid molecule of the present invention can also be introduced into a chloroplast genome thereby enabling chloroplast expression.

A technique for introducing exogenous nucleic acid sequences to the genome of the chloroplasts is known. This technique involves the following procedures. First, plant cells are chemically treated so as to reduce the number of chloroplasts per cell to about one. Then, the exogenous nucleic acid is introduced via particle bombardment into the cells with the aim of introducing at least one exogenous nucleic acid molecule into the chloroplasts. The exogenous nucleic acid is selected such that it gets integrated into the chloroplast's genome via homologous recombination which is readily effected by enzymes inherent to the chloroplast. To this end, the exogenous nucleic acid includes, in addition to a gene of interest, at least one nucleic acid stretch which is derived from the chloroplast's genome. In addition, the exogenous nucleic acid includes a selectable marker, which serves by sequential selection procedures to ascertain that all or substantially all of the copies of the chloroplast genomes following such selection will include the exogenous nucleic acid. Further details relating to this technique are found in U.S. Pat. Nos. 4,945,050; and 5,693,507 which are incorporated herein by reference.

Regardless of the method of transformation, propagation or regeneration, the present invention also contemplates a transgenic plant exogenously expressing the polynucleotide/nucleic acid agent of the invention.

According to a specific embodiment, the transgenic plant exogenously expresses a polynucleotide having a nucleic acid sequence at least, 80%, 85%, 90%, 95% or even 100% identical to SEQ ID NOs: 1-56, 11874, 174-201, 80-125, 220-235, 162-168, 256-259, 262-2086, 2087-3910 11616, 11615, 11910-11939, 11956-11958, 11875-11904 or 3911 (Tables 1, 3, 5 and 7), wherein the nucleic acid sequence is capable of regulating abiotic stress tolerance of the plant.

According to further embodiments, the exogenous polynucleotide encodes a precursor of the nucleic acid sequence.

According to yet further embodiments, the stem-loop precursor is at least 60%, 65%, 70%, 75%, 80%, 85%, 90%, 95% or even 100% identical to SEQ ID NOs: 1-56, 11874, 174-201, 80-125, 220-235, 162-168, 256-259, 262-2086, 2087-3910 11616, 11615, 11910-11939, 11956-11958, 11875-11904 or 3911 (Tables 1, 3, 5 and 7). More specifically the exogenous polynucleotide is selected from the group consisting of SEQ ID NO: 1-56, 11874, 174-201, 80-125, 220-235, 162-168, 256-259, 262-2086, 2087-3910 11616, 11615, 11910-11939, 11956-11958, 11875-11904 or 3911 (precursor and mature sequences of unregulated Tables 1, 3, 5 and 7).

Alternatively, there is provided a transgenic plant exogenously expressing a polynucleotide which downregulates an activity or expression of a gene encoding a miRNA molecule having a nucleic acid sequence selected from the group consisting of SEQ ID NOs: 57-79, 202-219, 126-161, 236-255, 169-173, 260-261, 3953-5114, 5117-6277, 11905-11909, 11940-11955, 11959-11961 or 6278 (downregulated Tables 2, 4, 6, 8) or homologs thereof which are at least at least 80%, 85%, 90% or 95% identical to SEQ ID NOs: 57-79, 202-219, 126-161, 236-255, 169-173, 260-261, 3953-5114, 5117-6277, 11905-11909, 11940-11955, 11959-11961 or 6278 (downregulated Tables 2, 4, 6 and 8).

More specifically, the transgenic plant expresses the nucleic acid agent of Tables 14 or 16. Alternatively, the transgenic plant expresses the nucleic acid agent of Tables 15 or 17.

It will be appreciated that the present teachings also relate to nucleic acid constructs and transgenic plants expressing same which comprise a nucleic acid sequence at least 80%, 85%, 90%, 95% or even 100% identical to SEQ ID NOs: 57-79, 202-219, 126-161, 236-255, 169-173, 260-261, 3953-5114, 5117-6277, 11905-11909, 11940-11955, 11959-11961 or 6278 (Tables 2, 4, 6 and 8), wherein the nucleic acid sequence is capable of regulating abiotic stress tolerance of the plant.

Alternatively or additionally there is provided a transgenic plant exogenously expressing a polynucleotide encoding a polypeptide having an amino acid sequence at least 80%, 85%, 90%, 95% or even 100% homologous to SEQ ID NOs: 9591-10364 (polypeptides of Table 10), wherein the polypeptide is capable of regulating abiotic stress tolerance of the plant.

Alternatively or additionally there is provided a transgenic plant exogenously expressing a polynucleotide encoding a polypeptide having an amino acid sequence at least 80%, 85%, 90%, 95% or even 100% homologous to SEQ ID NOs: 6315-8129 (polypeptides of Table 9), wherein the polypeptide is capable of regulating abiotic stress tolerance of the plant.

Alternatively or additionally there is provided a transgenic plant exogenously expressing a polynucleotide which downregulates an activity or expression of a polypeptide having an amino acid sequence at least 80%, 85%, 90%, 95% or even 100% homologous to SEQ ID NOs: 6315-10963 (targets of Tables 9 and 10), wherein the polypeptide is capable of regulating abiotic stress tolerance of the plant.

Also contemplated are hybrids of the above described transgenic plants. A "hybrid plant" refers to a plant or a part thereof resulting from a cross between two parent plants, wherein one parent is a genetically engineered plant of the invention (transgenic plant expressing an exogenous miRNA sequence or a precursor thereof). Such a cross can occur naturally by, for example, sexual reproduction, or artificially by, for example, in vitro nuclear fusion. Methods of plant breeding are well-known and within the level of one of ordinary skill in the art of plant biology.

Since abiotic stress tolerance, nitrogen use efficiency as well as yield, vigor or biomass of the plant can involve multiple genes acting additively or in synergy (see, for example, in Quesda et al., Plant Physiol. 130:951-063, 2002), the invention also envisages expressing a plurality of exogenous polynucleotides in a single host plant to thereby achieve superior effect on the efficiency of nitrogen use, yield, vigor and biomass of the plant.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove. Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. Alternatively, the construct can include several promoter sequences each linked to a different exogenous polynucleotide sequence.

The plant cell transformed with the construct including a plurality of different exogenous polynucleotides can be regenerated into a mature plant, using the methods described hereinabove.

Alternatively, expressing a plurality of exogenous polynucleotides can be effected by introducing different nucleic acid constructs, including different exogenous polynucleotides, into a plurality of plants. The regenerated transformed plants can then be cross-bred and resultant progeny selected for superior yield or tolerance traits as described above, using conventional plant breeding techniques.

Expression of the miRNAs of the present invention or precursors thereof can be qualified using methods which are well known in the art such as those involving gene amplification e.g., PCR or RT-PCR or Northern blot or in-situ hybridization.

According to some embodiments of the invention, the plant expressing the exogenous polynucleotide(s) is grown under stress (nitrogen or abiotic) or normal conditions (e.g., biotic conditions and/or conditions with sufficient water, nutrients such as nitrogen and fertilizer). Such conditions, which depend on the plant being grown, are known to those skilled in the art of agriculture, and are further, described above.

According to some embodiments of the invention, the method further comprises growing the plant expressing the exogenous polynucleotide(s) under abiotic stress or nitrogen limiting conditions. Non-limiting examples of abiotic stress conditions include, water deprivation, drought, excess of water (e.g., flood, waterlogging), freezing, low temperature, high temperature, strong winds, heavy metal toxicity, anaerobiosis, nutrient deficiency, nutrient excess, salinity, atmospheric pollution, intense light, insufficient light, or UV irradiation, etiolation and atmospheric pollution.

Thus, the invention encompasses plants exogenously expressing the polynucleotide(s), the nucleic acid constructs of the invention.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-m situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., tolerance to abiotic stress). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides described hereinabove can be used in a wide range of economical plants, in a safe and cost effective manner.

Plant lines exogenously expressing the polynucleotide of the invention can be screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct; and (b) evaluating a trait of a plant as compared to a wild type plant of the same type; thereby evaluating the trait of the plant.

Thus, the effect of the transgene (the exogenous polynucleotide) on different plant characteristics may be determined any method known to one of ordinary skill in the art.

Thus, for example, tolerance to limiting nitrogen conditions may be compared in transformed plants {i.e., expressing the transgene) compared to non-transformed (wild type) plants exposed to the same stress conditions (other stress conditions are contemplated as well, e.g. water deprivation, salt stress e.g. salinity, suboptimal temperatureosmotic stress, and the like), using the following assays.

Methods of qualifying plants as being tolerant or having improved tolerance to abiotic stress or limiting nitrogen levels are well known in the art and are further described hereinbelow.

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 millimolar (mM, nitrogen deficient conditions) or 10, 6-9 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Tolerance to abiotic stress (e.g. tolerance to drought or salinity) can be evaluated by determining the differences in physiological and/or physical condition, including but not limited to, vigor, growth, size, or root length, or specifically, leaf color or leaf area size of the transgenic plant compared to a non-modified plant of the same species grown under the same conditions. Other techniques for evaluating tolerance to abiotic stress include, but are not limited to, measuring chlorophyll fluorescence, photosynthetic rates and gas exchange rates. Further assays for evaluating tolerance to abiotic stress are provided hereinbelow and in the Examples section which follows.

Drought tolerance assay—Soil-based drought screens are performed with plants overexpressing the polynucleotides detailed above. Seeds from control *Arabidopsis* plants, or other transgenic plants overexpressing nucleic acid of the invention are germinated and transferred to pots. Drought stress is obtained after irrigation is ceased. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as drought stress tolerant plants Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution with added salt), or by culturing the plants in a hyperosmotic growth medium [e.g., 50 Murashige-Skoog medium (MS medium) with added salt]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 150 mM, 300 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of chlorosis and overall success to reach maturity and yield progeny are compared between control and transgenic plants. Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and PEG assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress experiments, the medium is supplemented for example with 50 mM, 100 mM, 200 mM NaCl or 15%, 20% or 25% PEG.

Cold stress tolerance—One way to analyze cold stress is as follows. Mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between control and transgenic plants, by measuring plant weight (wet and dry), and by comparing growth rates measured as time to flowering, plant size, yield, and the like.

Heat stress tolerance—One way to measure heat stress tolerance is by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

The biomass, vigor and yield of the plant can also be evaluated using any method known to one of ordinary skill in the art. Thus, for example, plant vigor can be calculated by the increase in growth parameters such as leaf area, fiber length, rosette diameter, plant fresh weight, oil content, seed yield and the like per time.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture. Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Thus, the present invention is of high agricultural value for increasing tolerance of plants to nitrogen deficiency or abiotic stress as well as promoting the yield, biomass and vigor of commercially desired crops.

According to another embodiment of the present invention, there is provided a food or feed comprising the plants or a portion thereof of the present invention.

In a further aspect the invention, the transgenic plants of the present invention or parts thereof are comprised in a food or feed product (e.g., dry, liquid, paste). A food or feed product is any ingestible preparation containing the transgenic plants, or parts thereof, of the present invention, or preparations made from these plants. Thus, the plants or preparations are suitable for human (or animal) consumption, i.e. the transgenic plants or parts thereof are more readily digested. Feed products of the present invention further include an oil or a beverage adapted for animal consumption.

It will be appreciated that the transgenic plants, or parts thereof, of the present invention may be used directly as feed products or alternatively may be incorporated or mixed with feed products for consumption. Furthermore, the food or feed products may be processed or used as is. Exemplary feed products comprising the transgenic plants, or parts thereof, include, but are not limited to, grains, cereals, such as oats, e.g. black oats, barley, wheat, rye, sorghum, corn, vegetables, leguminous plants, especially soybeans, root vegetables and cabbage, or green forage, such as grass or hay.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Differential Expression of miRNAs in Soybean Plant Under Abiotic Stress Versus Optimal Conditions Plant Material

*Glycine max* seeds (soy) were obtained from Taam-Teva shop (Israel). Plants were grown at 28° C. under a 16 hours light:8 hours dark regime.

Drought Induction

Plants were grown under standard conditions as described above until seedlings were four weeks old. Next, plants were divided into two groups: control plants were irrigated with tap water twice a week and drought-treated plants received no irrigation. The experiment continued for five days, after which plants were harvested for RNA extraction.

Salt Induction

For salinity induction, irrigation with regular water was substituted by irrigation with 300 mM NaCl solution in the stress group, for an overall of 3 irrigations for a ten-day period.

Heat Shock Induction

For induction of heat shock, the stress group plants were exposed to a high temperature (37° C.) for one hour.

Total RNA Extraction

Total RNA of leaf samples from eight biological repeats were extracted using the mirVana™ kit (Ambion, Austin, Tex.) by pooling tissues from 2-4 plants to one biological repeat. RNA analysis was performed on plant tissue samples from both experimental and control groups.

Microarray Design

Custom microarrays were manufactured by Agilent Technologies by in situ synthesis. A microarray based on Sanger version 16 was designed and consisted of a total 4602 non-redundant DNA 45-nucleotide long probes for all known plant small RNAs, with 1875 sequences (40.7%) from miRBase (http://wwwDOTmirbaseDOTorg/index-DOTshtml) and 2678 sequences (58DOT2%) from PMRD (http://bioinformaticsDOTcauDOTeduDOTcn/PMRD/), with each probe being printed in triplicate. Control and spike probes account for the remaining sequences on the microarray.

Results

Wild type soybean plants were allowed to grow at standard, optimal conditions or stress conditions for a period of time as specified above, at the end of which they were evaluated for stress tolerance. Three to four plants from each group were grouped as a biological repeat. Four to eight biological repeats were obtained for each group, and RNA was extracted from leaf tissue. The expression level of the soybean small RNAs was analyzed by high throughput microarray to identify small RNAs that were differentially expressed between the experimental groups.

Tables 1-6 below present sequences that were found to be differentially expressed in soybean grown under drought conditions (lasting five days), high salt conditions (lasting ten days) or heat shock conditions (lasting one hour), compared to optimal growth conditions. To clarify, the sequence of an up-regulated miRNA is induced under stress conditions and the sequence of a down-regulated miRNA is repressed under stress conditions.

TABLE 1

Differentially Expressed (Up-regulated) Small RNAs in Soybean Plants Growing under Drought (5 days) versus Optimal Conditions.

| miR Name | Mature Sequence (SEQ ID NO) | Stem Loop Sequence (SEQ ID NO) | p-value | Fold-Change |
|---|---|---|---|---|
| ahy-miR3514-5p | AGGATTCTGTAT TAACGGTGGA (1) | ACAATAGAAGGATTCTGTATTAAC GGTGGACATGATTTATCTCGTTTTT AAAGATATCTTTGCATTTCATATG AGATTTAAAGTTTTTATTGGTAAT ATAAATCTCACATGAAATTTAAAT TTATATTTTAAAGTTAAGATAAAG TCATGTCACCGTTAATACAGAATC CTTCAATTATATTTAGTCAGGGG (174) | 5.90E-06 | 1.97 (+) |
| aly-miR831-5p | AGAAGAGGTAC AAGGAGATGAG A (2) | AAGTGCTACAAGAATGTATAGTCT TAGAGTCTCAAGAAGAGGTACAA GGAGATGAGAAGTGAATCACTGA AACAAGTGGTTCTGGTTTGTGGAT CAGTATGGTTTACCCAAAACACGT GTTTGGTGCTTCACTTCTAAACTCC TCGTACTCTTCTTGGGATTCTATGA CTTACACTTGTTGATTT (175) | 1.10E-05 | 1.88 (+) |
| aqc-miR159 | TTTGGACTGAA GGGAGCTCTA (3) | GGAGTCTTTCCAGCCCAAAACAGC TTCTTGATCTTCTTGAAAACTTCTG TTTGGACTGAAGGGAGCTCTAA (176) | 3.00E-03 | 1.51 (+) |
| ath-miR157a | TTGACAGAAGA TAGAGAGCAC (4) | GTGTTGACAGAAGATAGAGAGCA CAGATGATGAGATACAATTCGGAG CATGTTCTTTGCATCTTACTCCTTT GTGCTCTCTAGCCTTCTGTCATCAC C (177) | 1.00E-03 | 1.70 (+) |
| ath-miR159b | TTTGGATTGAAG GGAGCTCTT (5) | GGAAGAGCTCCTTGAAGTTCAATG GAGGGTTTAGCAGGGTGAAGTAA AGCTGCTAAGCTATGGATCCCATA AGCCTTATCAAATTCAATATAATT GATGATAAGGTTTTTTTTATGGAT GCCATATCTCAGGAGCTTTCACTT ACCCCTTTAATGGCTTCACTCTTCT TTGGATTGAAGGGAGCTCTTCATC TCTC (178) | 6.80E-03 | 1.63 (+) |
| ath-miR159c | TTTGGATTGAAG GGAGCTCCT (6) | GTGTAACAGAAGGAGCTCCCTTCC TCCAAAACGAAGAGGACAAGATT TGAGGAACTAAAATGCAGAATCTA AGAGTTCATGTCTTCCTCATAGAG AGTGCGCGGTGTTAAAAGCTTGAA GAAAGCACACTTTAAGGGGATTGC ACGACCTCTTAGATTCTCCCTCTTT CTCTACATATCATTCTCTTCTCTTC GTTTGGATTGAAGGGAGCTCCTTT TCTTCTTC (179) | 1.20E-03 | 1.65 (+) |
| ath-miRf10068-akr | CACCGGTGGAG GAGTGAGAG (7) | GGACTTCTCATCTTCTTTCTTAGCC GCCGGTGCTCCAGCTCCACCACCG TGTCCTCCAACATTACCGTGGCTT CCAGTTCCACCGGTGGAGGAGTGA GAGTGGGAAGTTT (11875) | 2.00E-08 | 2.09 (+) |
| ath-miRf10240-akr | ATCGAAGGAGA TGGAGGACG (8) | GATTTCTCGTCCTCCGGCAATCCTT CGAACTCATCTTCATCCCAGTAAT CGAAGGAGATGGAGGACGAAGGC TTC (11876) | 1.90E-05 | 1.90 (+) |
| ath-miRf10451-akr | AAGAAGGAGGA ACAACCTGTTG (9) | CTCTAGATCTCAACAGGTTTCCTC CTCCTTCTTTCTATTTAGCTACTTG GTTTCAATTGTTTCAAGCCTAGGT AAGCATATGTAAAAAAGAGACAA TTGAAACCAAGTAACTAAATAGAA AGAAGGAGGAACAACCTGTTGAG ATCTAGAG (11877) | 2.30E-07 | 2.19 (+) |

TABLE 1-continued

Differentially Expressed (Up-regulated) Small RNAs in Soybean Plants Growing under Drought (5 days) versus Optimal Conditions.

| miR Name | Mature Sequence (SEQ ID NO) | Stem Loop Sequence (SEQ ID NO) | p-value | Fold-Change |
|---|---|---|---|---|
| ath-miRf10687-akr | TTAGCTGAAGAAGCAGAGGAG (10) | TTTGTTTGTTTAGCTGAAGAAGCAGAGGAGTCGGCATTGGGGCACAGTCACTCATCGATGCTGCAATGGGTAAGTCCTCTGCATACTTTTGCTGAGATAGGAATAGA (11878) | 3.70E-06 | 1.84 (+) |
| ath-miRf10701-akr | TGCAGTTCCTGGAGGTGGAGGA (11) | GGTGCCGCTGCAGTTCCTGGAGGTGGAGGAGGTGGTGGTGGGGCCACTGCAGCTCTTGGAGGTGGAGGCGGTGGAGGTGGAGCCGCTATAGTTGTTGGAAGTGGAGGAGGTGGCGGTGGTGGT (11879) | 1.30E-08 | 2.49 (+) |
| ath-miRf10751-akr | CTTGTGGAGAGGAAGCAAGA (12) | TTGTAATTTCTTGTGGAGAGGAAGCAAGAGGATGTGCTTGGTTGTGGAAATATAGGGCCCTTAAAATATATTCATCGTATTCACTCACATAACAAAAATTCCACAAGTAAGCACATCATCTTGCTTCCTCCACAAGAAATTACAA (11880) | 7.80E-08 | 2.10 (+) |
| ath-miRf10924-akr | TGAGGCGTATCAGGAGGTAGT (13) | TGAGGCGTATCAGGAGGTAGTGTTCTTGGTGGGACAATTTGTGTTGTATGTTTCA (11881) | 5.70E-04 | 1.73 (+) |
| ath-miRf11021-akr | GAGGTTTGCGATGAGAAAGAG (14) | GATGTTGGAGGTTTGCGATGAGAAAGAGATTGGCCGGAAGAATTATCAGCCATCAACATCGAGATTGTGAGATAATCGGAAGACCTGTAATTGTGAAGGTAACTCTTTCTCATCTGCAAATCTCAACTGTC (11882) | 1.80E-04 | 1.60 (+) |
| ath-miRf11037-akr | TCATCGGAGAAACAGAGGAGC (15) | TTGTCTCTGTTCATCGGAGAAACAGAGGAGCAAGACGTTTCAAACGGTTCTTGGCTCATAATTTGCTTCTCTGTTACCTTGGATGACAAGAAAGACAA (11883) | 1.30E-07 | 2.78 (+) |
| ath-miRf11042-akr | GGAAGAGGCAGTGCATGGGTA (16) | AGGGAGCCAGGGAAGAGGCAGTGCATGGGTAGAGACAAAACAGAGTCGTTTAATGTTTTAGTAAACTCAATCCATGCTCTGCTTGTTCCCTGTCTCTCT (11884) | 2.20E-03 | 1.56 (+) |
| ath-miRf11045-akr | TTTCTTGTGGAGGAAGCAAGAT (17) | TTGTAATTTCTTGTGGAGGAAGCAAGATGATGTGCTTACTTGTGGAATTTTTGTTATGTGAGTGAATACGATGAATATATTTTAAGGGCCCTATATTTCCACAACCAAGCACATCCTCTTGCTTCCTCTCCACAAGAAATTACAA (11885) | 8.60E-11 | 3.85 (+) |
| csi-miR3946 | TTGTAGAGAAAGAGAAGAGAGCAC (18) | ATAAAGATGATGATGACAATGAATTTTGTAGAGAAAGAGAAGAGAGCACAAACTTTTTGCTGAAAGTAGCTTTGATTCGATGTGTATCGGTTCATAGATAATGAGTTTTCAAGTCTATTTTAATAGAATACTAAAAGTTAGCTCTAAAAATC (180) | 1.80E-04 | 1.68 (+) |
| gma-miR156g | ACAGAAGATAGAGAGCACAG (19) | TGAACAATATCTTGAACAGTTTGTTGACAGAAGATAGAGAGCACAGGTGATCATACCCAAAAAAGCTTTTGTGTGTGAGCAGTTTTGTGCTCTCTACTTCTGTCAATGTACTTCTCA (181) | 2.00E-04 | 1.76 (+) |
| gma-miR157c | TGACAGAAGACTAGAGAGCAC (20) | TGACAGAAGACTAGAGAGCACAAAGGAGTGAGATGCCATTCCCTTTCATGCATTTCATCATCAGTGCTCTCTATCTTCTGTCAA (182) | 3.90E-04 | 1.58 (+) |
| gma-miR159a-3p | TTTGGATTGAAGGGAGCTCTA (21) | AATTAAAGGGGATTATGAAGTGGAGCTCCTTGAAGTCCAATTGAGGATCTTACTGGGTGAATTGAGCTGCT | 8.40E-03 | 1.59 (+) |

TABLE 1-continued

Differentially Expressed (Up-regulated) Small RNAs in Soybean Plants Growing under Drought (5 days) versus Optimal Conditions.

| miR Name | Mature Sequence (SEQ ID NO) | Stem Loop Sequence (SEQ ID NO) | p-value | Fold-Change |
|---|---|---|---|---|
| | | TAGCTATGGATCCCACAGTTCTAC CCATCAATAAGTGCTTTTGTGGTA GTCTTGTGGCTTCCATATTTGGGG AGCTTCATTTGCCTTTATAGTATTA ACCTTCTTTGGATTGAAGGGAGCT CTACACCCTTCTCTTCTTTTCT (183) | | |
| iba-miR157 | TTGACAGAAGA TAGAGAGCAT (22) | TTGACAGAAGATAGAGAGCATGCT AGAAATTACATTGATAAGCTATGT GGTTCAGAGACCAATCTTCTTATG AGTTCCAATAAGGAGTTGGTTTGT CCCCCCACTGGTATTATGTCTTCA GGTTGACCCTTCACCATGAGAATC ATATGTAATTCTCCGGCGGCGCTC ATTGTGACCTGCCAATCGCCTCCG GCAACTCCTCTTAGCTTCATCAAA CTGGGCTAATTCATGAAACCTGCT GCATTGCTGACAGAAGCGCTGTTG AACTCCATTTATAAGTACT (184) | 6.40E-04 | 1.60 (+) |
| mdm-miR482a-5p | GGAATGGGCTG TTTGGGAACA (23) | GAGAAGAGGGAAAGGGAGATTGG AGCTGCTGGAAGTTTTAGGAATGG GCTGTTTGGGAACAAGGAAATTAC CACAATAATTGTCTTGTGGGGTTT CTTCCCAAGCCCGCCCATTCCTAT GATTTCCAGCTGTTCCTCCCTTTCC CTTGTCTC (185) | 1.50E-04 | 1.62 (+) |
| mtr-miR2119 | TCAAAGGGAGG TGTGGAGTAG (24) | TTTATTTTTTTTACACTAAGATACT CCCTACTTTCCTTTGATTGGAAATA AAGAGAGACAAAAAGGTAAATTT AATTTCTCTTCTTATGTCAATCAAA GGGAGGTGTGGAGTAGGGTGTAA AAAGTAAA (186) | 2.20E-07 | 2.64 (+) |
| osa-miR159e | ATTGGATTGAA GGGAGCTCCT (25) | GATGAAGAAGAAGAGCTCCCTTTC GATCCAATTCAGGAGAGGAAGTG GTAGGATGCAGCTGCCGGTTCATG GATACCTCTGGAGTGCAGGGCAAA TAGTCCTACCCTTTCATGGGTTTGC ATGACTCGGGAGATGAACCCGCCA TTGTCTTCCTCTATTGATTGGATTG AAGGGAGCTCCTCTAGCTACAT (187) | 1.40E-03 | 1.67 (+) |
| osa-miR159f | CTTGGATTGAA GGGAGCTCTA (26) | GAAGAAGAAGACGAGCTCCCTTC GATCCAATCCAGGAGAGGAAGTG GTAGGATGCAGCTGCCGGTTCATG GATACCTCTGCAGTGCATGTCGTA GGCTTGCACTTGCATGGGTTTGCA TGACCCGGGAGATGAACCCACCAT TGTCTTCCTCTTATGCTTGGATTGA AGGGAGCTCTACACCTCTCTC (188) | 5.10E-03 | 1.75 (+) |
| osa-miR1858a | GAGAGGAGGAC GGAGTGGGGC (27) | TCCCGTCATCGCTGCCGGCAAAGG GAGGGGGGTGCCGCAACAAGGA GAGGAGGACGGAGTGGGGCGAGT GGAGCGTCAAAGGGGATGTCATC GCCGCCGAATCTGCTCGTGGGACA TCCCCTTCGATGCTCCACTCGCCCC AATCCGTCCTCCTCTCCTTGTTGCG GCACCCCCTTCGCTGGCAGCGAC GACGGCCTC (189) | 3.90E-04 | 1.63 (+) |
| osa-miR1874-3p | TATGGATGGAG GTGTAACCCGA TG (28) | CCATAATCATCTATTAGTACAGTG GTGAAGACATAGGGCTACTACACC ATCCATAAGGGTTCGAATCTTCGA TGTGCCTAGATAGGGTACAGTTGG ATCCCATATGGATGGAGGTGTAAC CCGATGCCTTTTACAAATAGATGG TTATTTT (190) | 7.80E-10 | 4.36 (+) |

TABLE 1-continued

Differentially Expressed (Up-regulated) Small RNAs in Soybean Plants Growing under Drought (5 days) versus Optimal Conditions.

| miR Name | Mature Sequence (SEQ ID NO) | Stem Loop Sequence (SEQ ID NO) | p-value | Fold-Change |
|---|---|---|---|---|
| osa-miR1879 | GTGTTTGGTTTA GGGATGAGGTG G (29) | TCCAACCCATCCCACCTCGTCCCC AAACCAAACACATGCACGCAAAT GGCTTGTTGAGGAATAAACATCTT GCTCCCTTGCATTCTAAACTATGA TATTCTTCAAGCATATGTGTTTGGT TTAGGGATGAGGTGGGATGGGTTA GGTCCA (191 (ATCCAACCCATCCCA CCTCGTCCCCAAACCAAACACATG CACGCAAATGGCTTGTTGAGGAAT AAACATCTTGCTCCCTTGCATTCTA AACTATGATATTCTTCAAGCATAT GTGTTTGGTTTAGGGATGAGGTGG GATGGGTTAGGTCCA (201) | 5.50E-06 | 1.91 (+) |
| osa-miRf10839-akr | CCTGTGACGTTG GTGAAGGTG (30) | CTGCGAGCCTCCAGCAGCGGCACA GGAGGAGGCCATTGCAGCTGTCAA GGACGTTGAGAAACTCGCACTTGG GCAGGAAGGGGAGCGAGGGGTCA ACAAACGGGCGGCCTTCCCCTGTG ACGTTGGTGAAGGTGTCGGAG (11886) | 1.90E-11 | 7.36 (+) |
| osa-miRf11013-akr | GGTTTGCCGGA GTTGGAGGAGA (31) | CCAGCCATCCCTCTAGAGCCGGCG AACTCCTCCCCTCCCCCCTCCCCCT TCCACTCCCACCCCACCCCACCCC GGGACCCTAACCCGTAGGGTCCTC GCCGGCGCCAGAGAAGAAGAGGT TTGCCGGAGTTGGAGGAGATGACA TGG (11887) | 7.70E-07 | 2.11 (+) |
| osa-miRf11352-akr | AGGGATTTTGG AAGGAGGTGAC A (32) | TATAATATAAGGGATTTTGGAAGG AGGTGACATATTCTAGGACTATGT ATCTGGATCCAGAGATACTAGGAT GTGTTACCTCCCTCTAAAATCCCTT ATATTATG (11888) | 1.20E-06 | 1.64 (+) |
| osa-miRf11355-akr | GGTGGAGGTGG AGCTGTGCCAA A (33) | GGTGGAGGTGGAGGTGGAGCTGT GCCAAATAGGCCCTGAGTTGTATG CACCACCAGTTCAACCCAATAGCT TAAGGGTCTGCTTGGCACAGCTCC AGCTCCACGCAGCC (11889) | 7.60E-09 | 2.57 (+) |
| osa-miRf11595-akr | CATCGGTGTTGG AGGTGGC (34) | CATCGGTGTTGGAGGTGGCGGGGA CGAGGTGCTTCTCTAGAGCGGTGC CACTACTGCCACCACCGTGGAATT GACGAGGCACAATGCCCACCTCAC CCTCCGCTGCCACTCTGCTGCCAC CGATG (11890) | 2.70E-06 | 2.10 (+) |
| osa-miRf11649-akr | AAACCGTGCAA AGGAGGTCCC (35) | TTACTTAAACCGTGCAAAGGAGGT CCCATGGCAGTATTTGCACCCGTT TTTACTAACGTGGCATCCTGTTGT ACGGTTTTTTTTGACGCAAATACT GCCATGGGACCTCTTTTGCATGGT TTGAGTAA (11891) | 1.50E-09 | 4.07 (+) |
| osa-miRf11829-akr | ACGCGGAGGAG GTGGTGTTCT (36) | GCACGCGGAGGAGGTGGTGTTCTC GCCGGAGTACGAGGAGTTCGCCGT CAGGAACGCCGCCCTCTGCGTCC (11892) | 2.80E-04 | 1.51 (+) |
| ppt-miR895 | GTAGCTTAGCG AGGTGTTGGTA (37) | GATTCATGTAATTATTGTTAACCTC TTTGTGTTCCGAGCTTTTATGATTG GTAGCTTAGCGAGGTGTTGGTATG ATACCAATCCCTGGTTTGCTTGTTC CTAATTGAGTTATGCTTGCACTCA AATCTAGGGGAGCGGTATTTTGGC TCACTCGCAATGCTTTCATGTACC CTTCCCGCATTATGAGTGCCACTT GGCTCCATGGTGTGATATATAAGT TTC (192) | 6.90E-13 | 12.97 (+) |
| psi-miR159 | CTTGGATTGAA GGGAGCTTCCA (38) | TGGAGCTCCCTTCAGTCCAACCAA AGCTTGTGCGGCGGTGGTTCAGCT | 9.90E-04 | 1.60 (+) |

TABLE 1-continued

Differentially Expressed (Up-regulated) Small RNAs in Soybean Plants Growing under Drought (5 days) versus Optimal Conditions.

| miR Name | Mature Sequence (SEQ ID NO) | Stem Loop Sequence (SEQ ID NO) | p-value | Fold-Change |
|---|---|---|---|---|
| | | GCTGATTCATGCATTCGACTGCCC TGTCCGTGACTTTCCAGCAGCCTG AATCAATCAATCTATCTCCATGAC AGGATAGTGGTGTGCATGACGCAG GAGATGTATTGTCACTGGACACGC ATTCCTTGGATTGAAGGGAGCTCC A (193) | | |
| pta-miR156a | CAGAAGATAGA GAGCACATC (39) | GATGACGAAGATAGAGAGCACA TCCGCTCACATGCCGGGACTCTGC GTTTGAGGTGTATGTGGTCTCCAT GATTCTGTCATC (194) | 3.50E-04 | 1.58 (+) |
| pta-miR156b | CAGAAGATAGA GAGCACAAC (40) | GATGACAGAAGATAGAGAGCACA ACCGCTCAGATGCCGGCACTCTGC GTTTGAGGTGTATGTGCTCTCGTT GATTTTGTCATC (195) | 1.80E-04 | 1.65 (+) |
| ptc-miRf10148-akr | TGGTGCACCTG GTGGTGGAG (41) | CTAGTTCCGGAGCCCGGTGAACTT TATCACCACTTCCTGCTCCTCTTGG CAAGCTTCCAGGTGGAGGAGGTG GACGAGGTGGTCCACCAGGTGGA GGAGGTGGTGGTGGTGCACCT GGTGGTGGAGGTGG (11893) | 7.40E-06 | 2.02 (+) |
| ptc-miRf10226-akr | TCCTTTGGGGAG ATGGAGAGCTT (42) | ATGGTTGGAGAAGCTTCCGATCTC CCTCAAAGGCTTCCTCTATAATTG CCTTACATGATGGCATTAGTGGAC TCCTTTGGGGAGATGGAGAGCTTA CTCCCCAT (11894) | 1.70E-06 | 1.88 (+) |
| ptc-miRf10271-akr | TTGGATTGAAG GGAGCTCTAA (43) | GGGAGTGGAGCTCCTTGAAGTCCA ATAGAGGTTCTTGCTGGGTAGATT AAGCTGCTAAGCTATGGATCCACA GTCCTATCTATCAACCGAAGGATA GGTTTGCGGCTTGCATATCTCAGG AGCTTTATTGCCTAATGTTAGATC CCTTTTTGGATTGAAGGGAGCTCT AAACCC (11895) | 6.60E-03 | 1.65 (+) |
| ptc-miRf10300-akr | TTTGGAAAGCA AGTGAGGTG (44) | TATACATATATCTCACTTGCTTTCT CAACTATCTCACTTTTCTTTTCAGA TTTCAAAAAAACGACATCATGAGA CAGTTTGGAAAGCAAGTGAGGTGT GTGTATA (11896) | 2.70E-06 | 2.38 (+) |
| ptc-miRf10522-akr | TTGGGGAGCTG GACTCTGGA (45) | TGACGGATTCGGAGAACAGCTGTC GGTGTTGATGGTGGCTGTGGGCAG AGGACATTTCAGAATTTGGGGAGC TGGACTCTGGAGCAGTGG (11897) | 1.20E-04 | 3.58 (+) |
| ptc-miRf10619-akr | GTTGGGCTTGCT GCTGGAGGA (46) | TCTGCTTCGGGTGGCAGGTCTGGC GGTTGTAGAGGGGGCAGCGACGTT GATGATCTTCGCTCCTGTTGGTTGC CGTGGCGGTTGGGCTTGCTGCTGG AGGAAGA (11898) | 8.80E-07 | 2.47 (+) |
| ptc-miRf10985-akr | CAGAAGATAGA GAGCACTGA (47) | GTTGACAGAAGATAGAGAGCACT GACGATGAAATGCATGGAGCTTAA TTGCATCTCACTCCTTTGTGCTCTC TAGTCTTCTGTCATC (11899) | 3.20E-04 | 1.70 (+) |
| ptc-miRf11757-akr | CTTGGTGAATG GTTGGGAGGAA T (48) | TGGGACAGCTTGGTGAATGGTTGG GAGGAATGTCTTTAATGTGGTTAT GCATCAGTGAAACTCTAGTAAGAT TCTCTGTCCACTCCTCTGCATCCGG CACTTCTCTTAACCGTGCACCTGCT TTAACCA (11900) | 3.70E-07 | 1.84 (+) |
| ptc-miRf11844-akr | CCCAACTTGGA GGTGGGTGTGG (49) | GCGTCCAGACCCAACTTGGAGGTG GGTGTGGACGCGTCCAACCCCAAG TTGGGCGTGGATGCGTCCAGGCCT AATTTCGAGTTGGGCGTAGACGC (11901) | 8.30E-04 | 1.73 (+) |

TABLE 1-continued

Differentially Expressed (Up-regulated) Small RNAs in Soybean Plants Growing under Drought (5 days) versus Optimal Conditions.

| miR Name | Mature Sequence (SEQ ID NO) | Stem Loop Sequence (SEQ ID NO) | p-value | Fold-Change |
| --- | --- | --- | --- | --- |
| ptc-miRf11847-akr | GAAAGTGTGGA GAAGGTTGCC (50) | ACTTTTCTACGAAAGTGTGGAGAA GGTTGCCCCTAAAAAATCTTTTAT GGCGACTTTCTCGACATTTTGGTA GAAAAGT (11902) | 4.30E-07 | 2.28 (+) |
| ptc-miRf11855-akr | GGCAGAGCATG GATGGAGCTA (51) | CGGGGAACAGGCAGAGCATGGAT GGAGCTACTAACAGAAGTACTTGT TTTGGCTCTACCCATGCACTGCCTC TTCCCTG (11903) | 5.90E-05 | 3.96 (+) |
| sbi-miR159a | TTTGGATTGAAG GGAGCTCTG (52) | AGCGAAGCTCCTATCATTCCAATG AAGGGCCCTTTTCATGGGTGGTTC CGCTGCTCGTTCATGGTTCCCACT ATCCTATCTCATCATGTATGTGTGT ATGTACTCTAGAGGGCCCGAGAAG AGATTCATGTGGTCGTCAGTCTTT GAGATAGGCTTGTGGTTTGCATGA CCGAGGAGCTGCACCGTCCCCTTG CTGGCCGCTCTTTGGATTGAAGGG AGCTCTGCA (196) | 1.20E-02 | 1.59 (+) |
| smo-miR1103-3p | TGGAAAAAGGA GGTGCATTCTTG T (53) | GCCCATGAACAAGAGTGCACCCCC TTTCCAATCGGTTAAAGGTCTTAG GATAGTTGGAGTTTAAGCGTCCTT GGGTTTGAATAGTACTGGGCTGGG TGACCTCCCGGGAAGTCCAAATTC AGGAGCTTACATTAACCCCAAGTA TTCCAAAACGCTTAATCGATTGGA AAAAGGAGGTGCATTCTTGTTCAT AGGCCC (197) | 7.50E-10 | 3.98 (+) |
| smo-miR156b | CTGACAGAAGA TAGAGAGCAC (54) | TGGACTGCTGCTGACAGAAGATAG AGAGCACAGACGTTTGGCTGCAAG AGCGGAATCCATATCCAGCAGCTC TGCGTTCGTGCTCTCTATTCTTCTG TCATCAATCTTTCGA (198) | 2.50E-04 | 1.62 (+) |
| tae-miR2003 | CGGTTGGGCTGT ATGATGGCGA (55) | CATTCGGATTCGCCATCATACGTC CAACCGTGCATTTGATATGCATAT ATATGCATCACGAGCAACGGTTGG GCTGTATGATGGCGATACCGATTG (199) | 7.90E-05 | 2.99 (+) |
| zma-miR482-5p | TGGGAGATGAA GGAGCCTTT (11874) | AGTGGGAGATGAAGGAGCCTTGC ATCGATGTCACCGCCGGAGGAGCG CTCGCCTTCTTCGCGCACCGCCGC AATAGCCGCCCTCGGACCCCTCGC CTCGCTCTTCCTTGTTCCTCCCATT TT (11904) | 7.80E-06 | 2.19 (+) |

* NA = not available

TABLE 2

Differentially Expressed (Down-regulated) Small RNAs in Soybean Plants Growing under Drought (5 days) versus Optimal Conditions.

| miR Name | Mature Sequence (SEQ ID NO:) | Stem Loop Sequence (SEQ ID NO:) | p-Value | Fold-Change |
| --- | --- | --- | --- | --- |
| aly-miR396a-3p | GTTCAATAAAGCT GTGGGAAG (57) | TCTACGTGACCCTCTCTGTATTCTTCCACA GCTTTCTTGAACTGCAAAACTTCTTCAGAT TTGTTTTTTTTATATATATGTCTTACGCAT AAAATAGTGTTTTTGTTCACATCTCTGCTC GATTGATTTGCGGTTCAATAAAGCTGTGG GAAGATACGGACAGAGTCAAAGA (202) | 7.20E-08 | 2.93 (−) |
| aly-miR396b-3p | GCTCAAGAAAGCT GTGGGAAA (58) | GAAGAAGAAGAAGAAGATCCTGGTCATA TTTTTCCACAGCTTTCTTGAACTTTCTTTTT CATTTCCATTGTTTTTTTTTTTCTAAACCAA | 2.10E-08 | 4.25 (−) |

TABLE 2-continued

Differentially Expressed (Down-regulated) Small RNAs in Soybean Plants Growing under Drought (5 days) versus Optimal Conditions.

| miR Name | Mature Sequence (SEQ ID NO:) | Stem Loop Sequence (SEQ ID NO:) | p-Value | Fold-Change |
|---|---|---|---|---|
| | | AAAAAAAGATCTCTAAAATTTAGCATTTT GGAAACAAAGAAGAAGCTCAAGAAAGCT GTGGGAAAACATGACAATTCAGGGTTTTA CTCCATTGATTC (203) | | |
| bdi-miR2508 | ATTGAGTGCAGCG TTGATGAAC (59) | GCAAAGGCATCATTGAGTGCAGCGTTGAT GAACAGGGGCCAGGCGACCGGCGGCCGG TCCGGTTCGGTTCACCGGCGCTGCACACA GTGACGCCCTTGC (204) | 1.60E-02 | 1.73 (−) |
| ctr-miR171 | TTGAGCCGCGTCA ATATCTCC (60) | ATCGACGGTTGAAGGGGAGAGTTGTAAAA TGAAATCATCAAGGTATTGGCGCGCCTCA ATTTAAAGACGTGGTTAAATGGGCATGAT TAGCCATGTATTTTCATTGAGCCGCGTCAA TATCTCCTTAATTATTTTGTAACTCTCTCCT CTATATCCTCGCCTTCGGTATGCAGCTGCT CCTCGATACATATGAGGATTCAGAAACAG ACAAAGGCGGTAGAAGTAATCTTCATCAA TATTATTGAAGCAGGAAACATAACGGCAA GTTTTAAGACCCGTTTGGGGCATGTGGGG TCTCATTTTGATGTTAATGAAGTGAAAACT TGTATTTTCCCTCAAACATTCACTCACTCC AGGCCGGCAGGAACAAC (205) | 7.00E-04 | 1.90 (−) |
| gma-miR1507a | TCTCATTCCATACA TCGTCTGA (61) | CAGTGTTTGGCAGAGGTGTATGGAGTGAG AGAAGGGAAAGGGTATTTTCCGATTCTGT CGTTACTCTCTTCCCTCTCTCATTCCATAC ATCGTCTGACGAACGTATC (206) | 3.20E-03 | 1.61 (−) |
| gma-miR159d | AGCTGCTTAGCTAT GGATCCC (62) | GGGTGAATTGAGCTGCTTAGCTATGGATC CCACAGTTCTACCCATCAATAAGTGCTTTT GTGGTAGTCTTGTGGCTTCCATATCTGGGG AGCTTCATTTGCCT (207) | 7.30E-07 | 2.63 (−) |
| gma-miR396d | AAGAAAGCTGTGG GAGAATATGGC (63) | GGTCATGCTTTTCCACAGCTTTCTTGAACT TCTTATGCATCTTATATCTCTCCACTTCCA GCATTTTAAGCCCTAGAAGCTCAAGAAAG CTGTGGGAGAATATGGCAA (208) | 8.90E-06 | 2.12 (−) |
| gma-miR4371b | AAGTGATGACGTG GTAGACGGAGT (64) | TTGTTAGTTGCCTTTCGTTAAGTGATGACG TGGTAGACGGAGTGCCGTGTCATTATGCC TTGTCACAGACACCTCATTGCTACATCATC ACCGCTAATGATATGGCACTGACGTGTTA GTGATTGGTGTGATGACGTGACACTCTAT CTGCCACATCATCACCTAACGAAGACAA CTAACGA (209) | 2.10E-03 | 1.86 (−) |
| gma-miR4376-5p | TACGCAGGAGAGA TGACGCTGT (65) | AAGGTTTGCTACGCAGGAGAGATGACGCT GTCCCTTGCACCCATCCTAGCTTCCCTTGA GTAGGTAAGAGCAAGGCCAGCCAGCATC ATATCTCCTGCATAGTAAACCTT (210) | 6.10E-05 | 2.57 (−) |
| gma-miR4416a | ACGGGTCGCTCTCA CCTAGG (66) | CTTTGATCTGGGTGAGAGAAACGCGTATC GATGGATTGGGTTCAGTTCTGGTCTCACA CGGTTTGTTCTAACAATTTGTACTGACTGT GTTTTGATCGATACGGGTCGCTCTCACCTA GGCCAGAGTTGC (211 | 1.40E-03 | 3.07 (−) |
| gma-miR482a-3p | TCTTCCCAATTCCG CCCATTCCTA (67 | TCAGAATTTGTGGGAATGGGCTGATTGGG AAGCAATGTGTGCTGGTGCAATGCATTTA ATTTCTTCCCAATTCCGCCCATTCCTATGA TTTCTGA (212) | 1.30E-05 | 2.05 (−) |
| gma-miR482b-5p | TATGGGGGATTG GGAAGGAAT (68) | GGTATGGGGGATTGGGAAGGAATATCCA TAAGCAAAATATGCTATTTCTTCCCTACAC CTCCCATACC (213) | 3.20E-08 | 1.71 (−) |
| gso-miR169g* | TCGGCAAGTTGGC CTTGGCT (69) | AGCCAAGGAUGACUUGCCGGCAUUAGCC AAGUGAAUGAGCAUCAUAUAUAUAUA UAUAUAUAUGACUCAUGUUCUUGUCG GCAAGUUGGCCUUGGCU (11905) | 1.20E-05 | 2.46 (−) |

TABLE 2-continued

Differentially Expressed (Down-regulated) Small RNAs in Soybean Plants Growing under Drought (5 days) versus Optimal Conditions.

| miR Name | Mature Sequence (SEQ ID NO:) | Stem Loop Sequence (SEQ ID NO:) | p-Value | Fold-Change |
| --- | --- | --- | --- | --- |
| gso-miR482a | TCTTCCCTACACCT CCCATAC (70 | GGGGAAGGCATGGGTATGGGGGGATTGG GAAGGAATATCCATAAGCAAAATATGCTA TTTCTTCCCTACACCTCCCATACCACTGTT TTTCCT (214) | 1.60E-02 | 1.74 (-) |
| osa-miRf11996-akr | GTCTTATAACCTGA AACGGGGG (71) | TACTACCTCCATTTCAGGTTATAAGACTTT CTAGTGTTGCTCACATTCATATATATGTTA ATAAATTCATTAACATATAGAAAGTCTTA TAACCTGAAACGGGGGAAGTA (11906) | 2.10E-02 | 1.84 (-) |
| ppt-miR166m | TCGGACCAGGCAT CATTCCTT (72) | GCCGAGAACAGAGATTGTGTAGCTCAGCT GTAAGGAATGTGGCATGGCTCGATGCTGT TTGAGCATGTCAAGTTCAGCCTCGGACCA GGCATCATTCCTTTCATCTCAGTTACACAT TTGACATCCAGGA (215) | 2.20E-05 | 1.77 (-) |
| pta-miR166c | CCGGACCAGGCTT CATCCCAG (73) | ACCAATCGAATCCGGACCAGGCTTCATCC CAGGCATCTGGACCCAATCGACAGCAGCT CCTTTAGCCTTTGAAAGGAACTCTGTCAA GGTCTCCTCTGCTATAGACAGGAGTCCAG CGGGGCTAGCATCTCTTGGGGGATGCTGA GGTGTTGGATTATGTTGGT (216) | 8.30E-04 | 1.59 (-) |
| ptc-miR166p ptc- | TCGGACCAGGCTC CATTCCTT (74) | TAAGGTTGAGAGGAACGCTGTCTGGGTCG AGGTCATGGAGGCCATGATTATACATAAA TGGCATTATCTGATGACAGCCCAGATAAT CGATGCACCTGTCTTGAACCTAAATGATT CTCGGACCAGGCTCCATTCCTTCCAACCAT (217) | 4.70E-05 | 1.77 (-) |
| miRf11079-akr | AAGATGGAGAAGC AGGGCACGTGC (75) | GTGTGTGAGCAAGATGGAGAAGCAGGGC ACGTGCACTACTAACTCATGCACACAGAG AGGGAGACGCATTTCTTGCTGGAGTTACG AGTTACGACTCTTACCTACTATTGATTTTG TTAGCTCCAGTGAGTTAGTTATTCATGTGC CTGTCTTCCTCATCATGATCACTAC (11907) | 6.10E-04 | 1.56 (-) |
| ptc-miRf11396-akr | CAAGGCTCTGATA CCATGTCAA (76) | CTTGGTCATCAAGGCTCTGATACCATGTC AAAGAATACATATTTTGAGACCTTATCTAA CAGCTTAAGCTATTGGGTTGAGATGGTTC CTTGACATGATATCAGAGCCTTGATGACG AAG (11908) | 1.70E-05 | 1.81 (-) |
| ptc-miRf11669-akr | CAAGGCTCTGATA CCATGTT (77) | GCTTGGTCATCAAGGCTCTGATACCATGTT AAAGAACCATCTCAACCTAATACCATGTT AGAGAATAATATAAATCATATCTAGAGAC TTTACCTAACAGCTTAAGCTATTGGCCTAT TGGATTAGTATGGTTCTTTGACATGGTATC AGAGCCTTGATAACCAAGT (11909) | 2.30E-04 | 1.63 (-) |
| vvi-miR394b | TTGGCATTCTGTCC ACCTCC (78) | ACAGAGTTTATTGGCATTCTGTCCACCTCC CATCTCTTGAAAATCTCTCTTTTCTCTCTG TGGAGGTGGGCATACTGCCAACCAAGCTC TGTT (218) | 6.70E-03 | 1.55 (-) |
| zma-miR396b-3p | GTTCAATAAAGCT GTGGGAAA (79) | AGATGGCCTTCTTTGTGATCTTCCACAGCT TTCTTGAACTGCATCTCTCAGAGGAGCGG CAGCTTCAACTCCTCCACCCGCATCAGCA GGTGCATGCAGTTCAATAAAGCTGTGGGA AACTGCAGAGAGAGGCCAG (219) | 2.10E-08 | 4.76 (-) |

TABLE 3

Differentially Expressed (Up-regulated) Small RNAs in Soybean Plants Growing under High Salt (10 days) versus Optimal Conditions.

| miR Name | Mature Sequence (SEQ ID NO:) | Stem Loop Sequence (SEQ ID NO:) | p-Value | Fold-Change |
|---|---|---|---|---|
| ppt-miR895 | GTAGCTTAGC GAGGTGTTGG TA (80) | GATTCATGTAATTATTGTTAACCTCTTTGTG TTCCGAGCTTTTATGATTGGTAGCTTAGCGA GGTGTTGGTATGATACCAATCCCTGGTTTGC TTGTTCCTAATTGAGTTATGCTTGCACTCAA ATCTAGGGGAGCGGTATTTTGGCTCACTCG CAATGCTTTCATGTACCCTTCCCGCATTATG AGTGCCACTTGGCTCCATGGTGTGATATAT AAGTTTC (220) | 7.20E-10 | 9.36 (+) |
| ptc-miRf10300-akr | TTTGGAAAGC AAGTGAGGTG (81) | TATACATATATCTCACTTGCTTTCTCAACTA TCTCACTTTTCTTTTCAGATTTCAAAAAAAC GACATCATGAGACAGTTTGGAAAGCAAGTG AGGTGTGTGTATA (11910) | 1.40E-07 | 6.02 (+) |
| osa-miRf10839-akr | CCTGTGACGTT GGTGAAGGTG (82) | CTGCGAGCCTCCAGCAGCGGCACAGGAGGA GGCCATTGCAGCTGTCAAGGACGTTGAGAA ACTCGCACTTGGGCAGGAAGGGGAGCGAG GGGTCAACAAACGGGCGGCCTTCCCCTGTG ACGTTGGTGAAGGTGTCGGAG (11911) | 6.20E-09 | 5.21 (+) |
| smo-miR1103-3p | TGGAAAAAGG AGGTGCATTCT TGT (83) | GCCCATGAACAAGAGTGCACCCCCTTTCCA ATCGGTTAAAGGTCTTAGGATAGTTGGAGT TTAAGCGTCCTTGGGTTTGAATAGTACTGG GCTGGGTGACCTCCCGGGAAGTCCAAATTC AGGAGCTTACATTAACCCCAAGTATTCCAA AACGCTTAATCGATTGGAAAAAGGAGGTGC ATTCTTGTTCATAGGCCC (221) | 6.50E-08 | 5.20 (+) |
| osa-miRf11649-akr | AAACCGTGCA AAGGAGGTCC C (84) | TTACTTAAACCGTGCAAAGGAGGTCCCATG GCAGTATTTGCACCCGTTTTTACTAACGTGG CATCCTGTTGTACGGTTTTTTTTGACGCAAA TACTGCCATGGGACCTCTTTTGCATGGTTTG AGTAA (11912) | 9.70E-08 | 5.10 (+) |
| osa-miR1874-3p | TATGGATGGA GGTGTAACCC GATG (85) | CCATAATCATCTATTAGTACAGTGGTGAAG ACATAGGGCTACTACACCATCCATAAGGGT TCGAATCTTCGATGTGCCTAGATAGGGTAC AGTTGGATCCCATATGGATGGAGGTGTAAC CCGATGCCTTTTACAAATAGATGGTTATTTT (222) | 6.50E-09 | 4.75 (+) |
| ptc-miRf10619-akr | GTTGGGCTTGC TGCTGGAGGA (86) | TCTGCTTCGGGTGGCAGGTCTGGCGGTTGT AGAGGGGGCAGCGACGTTGATGATCTTCGC TCCTGTTGGTTGCCGTGGCGGTTGGGCTTGC TGCTGGAGGAAGA (11913) | 2.00E-08 | 3.70 (+) |
| osa-miRf10362-akr | GCTGGAGGAT GCGACGGTGC T (87) | GCCGGCTAGTACAATCGAATCCACTAGCAC CGAGGCTTGGGTCACTAGATCCCGTGGCCC TAGCCTAATTGCTGGAGGATGCGACGGTGC TTGTGAGC (11914) | 7.50E-08 | 3.48 (+) |
| ahy-miR3514-5p | AGGATTCTGT ATTAACGGTG GA (88) | ACAATAGAAGGATTCTGTATTAACGGTGGA CATGATTTATCTCGTTTTTAAAGATATCTTT GCATTTCATATGAGATTTAAAGTTTTTATTG GTAATATAAATCTCACATGAAATTTAAATTT ATATTTTAAAGTTAAGATAAAGTCATGTCA CCGTTAATACAGAATCCTTCAATTATATTTA GTCAGGGG (223) | 2.40E-08 | 3.43 (+) |
| mtr-miR2119 | TCAAAGGGAG GTGTGGAGTA G (89) | TTTATTTTTTTTACACTAAGATACTCCCTAC TTTCCTTTGATTGGAAATAAAGAGAGACAA AAAGGTAAATTTAATTTCTCTTCTTATGTCA ATCAAAGGGAGGTGTGGAGTAGGGTGTAA AAAGTAAA (224) | 2.00E-07 | 2.89 (+) |
| osa-miRf11355-akr | GGTGGAGGTG GAGCTGTGCC AAA (90) | GGTGGAGGTGGAGGTGGAGCTGTGCCAAAT AGGCCCTGAGTTGTATGCACCACCAGTTCA ACCCAATAGCTTAAGGGTCTGCTTGGCACA GCTCCAGCTCCACGCAGCC (11915) | 2.40E-07 | 2.85 (+) |

TABLE 3-continued

Differentially Expressed (Up-regulated) Small RNAs in Soybean Plants Growing under High Salt (10 days) versus Optimal Conditions.

| miR Name | Mature Sequence (SEQ ID NO:) | Stem Loop Sequence (SEQ ID NO:) | p-Value | Fold-Change |
|---|---|---|---|---|
| osa-miRf11595-akr | CATCGGTGTTGGAGGTGGC (91) | CATCGGTGTTGGAGGTGGCGGGGACGAGGT GCTTCTCTAGAGCGGTGCCACTACTGCCAC CACCGTGGAATTGACGAGGCACAATGCCCA CCTCACCCTCCGCTGCCACTCTGCTGCCACC GATG (11916) | 8.90E-06 | 2.77 (+) |
| ptc-miRf11844-akr | CCCAACTTGG AGGTGGGTGT GG (92) | GCGTCCAGACCCAACTTGGAGGTGGGTGTG GACGCGTCCAACCCCAAGTTGGGCGTGGAT GCGTCCAGGCCTAATTTCGAGTTGGGCGTA GACGC (11916) | 1.20E-05 | 2.75 (+) |
| ptc-miRf11847-akr | GAAAGTGTGG AGAAGGTTGC C (93) | ACTTTTCTACGAAAGTGTGGAGAAGGTTGC CCCTAAAAAATCTTTTATGGCGACTTTCTCG ACATTTTGGTAGAAAAGT (11917) | 2.50E-06 | 2.70 (+) |
| ath-miRf11045-akr | TTTCTTGTGGA GGAAGCAAGA T (94) | TTGTAATTTCTTGTGGAGGAAGCAAGATGA TGTGCTTACTTGTGGAATTTTTGTTATGTGA GTGAATACGATGAATATATTTTAAGGGCCC TATATTTCCACAACCAAGCACATCCTCTTGC TTCCTCTCCACAAGAAATTACAA (11918) | 4.40E-07 | 2.59 (+) |
| ath-miRf10702-akr | GTGGGAGGAC TCCAAGTGTG (95) | AAACATGTGGGAGGACTCCAAGTGTGGTTA TATCCTCGGTATTATCTCGATGTGAACCACA CTTGGAGTCCTCCCACATGTTT (11919) | 8.90E-07 | 2.51 (+) |
| ath-miRf10701-akr | TGCAGTTCCTG GAGGTGGAGG A (96) | GGTGCCGCTGCAGTTCCTGGAGGTGGAGGA GGTGGTGGTGGGGCCACTGCAGCTCTTGGA GGTGGAGGCGGTGGAGGTGGAGCCGCTATA GTTGTTGGAAGTGGAGGAGGTGGCGGTGGT GGT (11920) | 1.40E-06 | 2.40 (+) |
| osa-miR1869 | TGAGAACAAT AGGCATGGGA GGTA (97) | AAGGAACACCTGAGAACAATAGGCATGGG AGGTATTGGGAAAACACAGGAACATATTGT GACCCCTAATTTTAAAGGGAAATAATGGTT GAGGCTTTCCTCCATGTTCCCATGCCTAATG CTCTTAGGTGCTCTTTTT (225) | 2.20E-05 | 2.27 (+) |
| ptc-miRf10148-akr | TGGTGCACCT GGTGGTGGAG (98) | CTAGTTCCGGAGCCCGGTGAACTTTATCAC CACTTCCTGCTCCTCTTGGCAAGCTTCCAGG TGGAGGAGGTGGACGAGGTGGTCCACCAG GTGGAGGAGGTGGTGGTGGTGGTGCACCTG GTGGTGGAGGTGG (11921) | 2.80E-05 | 2.22 (+) |
| osa-miR1879 | GTGTTTGGTTT AGGGATGAGG TGG (99) | TCCAACCCATCCCACCTCGTCCCCAAACCA AACACATGCACGCAAATGGCTTGTTGAGGA ATAAACATCTTGCTCCCTTGCATTCTAAACT ATGATATTCTTCAAGCATATGTGTTTGGTTT AGGGATGAGGTGGGATGGGTTAGGTCCA (226) ATCCAACCCATCCCACCTCGTCCCCAAAC CAAACACATGCACGCAAATGGCTTGTTGAG GAATAAACATCTTGCTCCCTTGCATTCTAAA CTATGATATTCTTCAAGCATATGTGTTTGGT TTAGGGATGAGGTGGGATGGGTTAGGTCCA (235) | 5.80E-05 | 2.21 (+) |
| ath-miRf10148-akr | GGTGGTGGAA AGATCAAGAT (100) | TAGGGAATATCTTGATCTTTCCACCATCTAC AAAGAATAAAAAAAAGCTTCCAATATTAC TAGGTATTTGGTGGTGGAAAGATCAAGATA TTCCTTA (11922) | 4.90E-06 | 2.21 (+) |
| osa-miRf11013-akr | GGTTTGCCGG AGTTGGAGGA GA (101) | CCAGCCATCCCTCTAGAGCCGGCGAACTCC TCCCCTCCCCCCTCCCCCTTCCACTCCCACC CCACCCCACCCCGGGACCCTAACCCGTAGG GTCCTCGCCGGCGCCAGAGAAGAAGAGGTT TGCCGGAGTTGGAGGAGATGACATGG (11923) | 4.70E-06 | 2.21 (+) |
| ath-miRf10209-akr | ATGGTGGTAC TCGGCCAGGT GGT (102) | TCCTCGACTTCCTGGTAGAGTGGTGTGATCG AGTGATGGTCAGGTGTGGAGGTGATGATAC TCGACCAGGTGGTCAAGTGAAGTGATCAAG TGACTCTCATGGTGGTACTCGGCCAGGTGG TCGAGTGG (11924) | 8.60E-05 | 2.18 (+) |

TABLE 3-continued

Differentially Expressed (Up-regulated) Small RNAs in Soybean Plants Growing under High Salt (10 days) versus Optimal Conditions.

| miR Name | Mature Sequence (SEQ ID NO:) | Stem Loop Sequence (SEQ ID NO:) | p-Value | Fold-Change |
|---|---|---|---|---|
| ath-miRf10924-akr | TGAGGCGTATCAGGAGGTAGT (103) | TGAGGCGTATCAGGAGGTAGTGTTCTTGGTGGGACAATTTGTGTTGTATGTTTCA (11925) | 1.50E-04 1.90E-06 | 2.18 (+) 2.15 (+) |
| ppt-miR1220a | TTCCGGTGGTGAGGAAGATAG (104) | ACTTCTTGCACTCCTCTATCTCCCTCGGCACCTGCACAGTGATTTTCTCAATATCTTCACGTTGGTGGCCACGTTCGAACATATCCCATGCGGGCAACTCCGGCGTAGGTGTACACGGCCAGCGTTGCTTACCATCTGGAGGATACCCTTGCTCAAACCTACGACTCTGTTCCGGTGGTGAGGAAGATAGAGGAGTTCAAGAAGT (227) | | |
| osa-miRf11341-akr | CGCGCCGACGATGACGGTGGAGT (105) | CGCCGTCTCCCTCGCCGTCGCCGGCGTCGCCGGAGATGACGAGAAGACGTGCCCCGGCGCGCCGACGATGACGGTGGAGTCGGCG (11926) | 5.40E-06 | 2.12 (+) |
| osa-miRf11352-akr | AGGGATTTTGGAAGGAGGTGACA (106) | TATAATATAAGGGATTTTGGAAGGAGGTGACATATTCTAGGACTATGTATCTGGATCCAGAGATACTAGGATGTGTTACCTCCCTCTAAAATCCCTTATATTATG (11927) | 2.30E-06 | 2.11 (+) |
| osa-miR2055 | TTTCCTTGGGAAGGTGGTTTC (107) | AGAAGATGGAGGCACCAGCCCAAGGAAACACAGACATTGACACGCAATTCAAGGAGAAGATTGCGTCCTACTTTTTCCTTGGGAAGGTGGTTTCTCTTCT (228) | 7.20E-04 | 2.09 (+) |
| ath-miRf10240-akr | ATCGAAGGAGATGGAGGACG (108) | GATTTCTCGTCCTCCGGCAATCCTTCGAACTCATCTTCATCCCAGTAATCGAAGGAGATGGAGGACGAAGGCTTC (11928) | 9.80E-07 | 2.03 (+) |
| ath-miRf10068-akr | CACCGGTGGAGGAGTGAGAG (109) | GGACTTCTCATCTTCTTTCTTAGCCGCCGGTGCTCCAGCTCCACCACCGTGTCCTCCAACATTACCGTGGCTTCCAGTTCCACCGGTGGAGGAGTGAGAGTGGGAAGTTT (11929) | 6.30E-07 | 1.99 (+) |
| ghr-miR2950 | TGGTGTGCAGGGGGTGGAATA (110) | CATGGGTTTATGTTATATTCCATCTCTTGCACACTGGACTAGCCAGCTTTTTGTTGGCTTCAGCTTCAGGTTGGTGTGCAGGGGGTGGAATACATCATTGATATCATG (229) | 5.70E-06 | 1.98 (+) |
| ath-miRf10368-akr | ACTTGGGTGGTGCTGATTAT (111) | TGGTAAGTGATAATCATTACCACCCAAGCTAACATTCAAACCAAAAACCAGTTTAAGTTAACTTGGGTGGTGCTGATTATCACTTGTCG (11930) | 7.90E-04 | 1.98 (+) |
| ath-miRf10763-akr | GGTGGTGAAGAAGCATGGTT (112) | GGCGGTGGTGAAGAAGCATGGTTTGGAAATCTCACAGCCTGGATTAGAGCCATATGAAGGGCTCACATGGGAGATGACCAAGAAAAGAGACGACACTGAAGTCCACAAGTTAGAATTATATAGTGAAGTTTCTACATTATTTTCTCACCACCGCT (11931) | 9.30E-05 | 1.93 (+) |
| ptc-miRf10734-akr | CATCTAGGTGGTGGTCCAGTG (113) | TCTTACCATTGGACCACCTACTAGATGATTAAAAACTACATCATCTAACCATCTAGGTGGTGGTCCAGTGGTAAGA (11932) | 4.30E-04 | 1.92 (+) |
| osa-miRf11829-akr | ACGCGGAGGAGGTGGTGTTCT (114) | GCACGCGGAGGAGGTGGTGTTCTCGCCGGAGTACGAGGAGTTCGCCGTCAGGAACGCCGCCCTCTGCGTCC (11933) | 4.10E-05 | 1.90 (+) |
| zma-miR482-5p | TGGGAGATGAAGGAGCCTT (115) | AGTGGGAGATGAAGGAGCCTTGCATCGATGTCACCGCCGGAGGAGCGCTCGCCTTCTTCGCGCACCGCCGCAATAGCCGCCCTCGGACCCCTCGCCTCGCTCTTCCTTGTTCCTCCCATTTT (230) | 4.20E-05 | 1.88 (+) |
| osa-miR1850.1 | TGGAAAGTTGGGAGATTGGGG (116) | ATGTGATGGAGATGCGATGGAAAGTTGGGAGATTGGGGGAAGTTGTGTGTGAACTAAACGTGGATTGGGGCCCTGTTTAGTTCACATCAATCTTCCTCCAAATTCCCAACTTTTCATCACATCACAATCACAT (231) | 1.30E-05 | 1.86 (+) |

TABLE 3-continued

Differentially Expressed (Up-regulated) Small RNAs in Soybean Plants Growing under High Salt (10 days) versus Optimal Conditions.

| miR Name | Mature Sequence (SEQ ID NO:) | Stem Loop Sequence (SEQ ID NO:) | p-Value | Fold-Change |
|---|---|---|---|---|
| osa-miR1881 | AATGTTATTGT AGCGTGGTGG TGT (117) | AACCAAGTTAAAATGCTCATAGGTATGAAC AAGCATCAATGTTATTGTAGCGTGGTGGTG TGACCTCTGTGCACGTAAGCTTGAGGCAGC AAGTTCGACTCCTTCAAAAGGAAGATTTGT ACCGCTGGGGAAGTGCCAGAAGAAAAGAA CAAGGAAGACTTGCTAGCAGGACAAAAGG ACGGTAAACTTGGAAAAAAAAAGGTCCAG AAGAAAAGAACAAAGAAGAACTGCTTGAA GGAGTCGAACTTGCTACCTCAAGCTTGCGT GCACATAGGTCACACCACTACGCTACAATA ACGTTGATGCTTGTTCAGACCTGTGAGCATT TTAACTTGGTT (232) | 2.00E-03 | 1.76 (+) |
| ptc-miRf10226-akr | TCCTTTGGGGA GATGGAGAGC TT (118) | ATGGTTGGAGAAGCTTCCGATCTCCCTCAA AGGCTTCCTCTATAATTGCCTTACATGATGG CATTAGTGGACTCCTTTGGGGAGATGGAGA GCTTACTCCCCAT (11934) | 9.60E-05 | 1.74 (+) |
| ptc-miRf11757-akr | CTTGGTGAAT GGTTGGGAGG AAT (119) | TGGGACAGCTTGGTGAATGGTTGGGAGGAA TGTCTTTAATGTGGTTATGCATCAGTGAAAC TCTAGTAAGATTCTCTGTCCACTCCTCTGCA TCCGGCACTTCTCTTAACCGTGCACCTGCTT TAACCA (11935) | 3.90E-05 | 1.73 (+) |
| ath-miRf11021-akr | GAGGTTTGCG ATGAGAAAGA G (120) | GATGTTGGAGGTTTGCGATGAGAAAGAGAT TGGCCGGAAGAATTATCAGCCATCAACATC GAGATTGTGAGATAATCGGAAGACCTGTAA TTGTGAAGGTAACTCTTTCTCATCTGCAAAT CTCAACTGTC (11936) | 1.50E-03 | 1.66 (+) |
| ath-miRf10633-akr | TGGCGGTGGA TACTTCTTGAT CGG (121) | GTGGATACTGTTCTGGTGGAGGATACTTCA CCGGCGGATGAGGGTAAGTCTTGATCGGTG GTGGATACTTCACCGGTGGATGCTCGTATG GTGGCGGTGGATACTTCTTGATCGGTGGTG GATAC (11937) | 6.50E-04 | 1.65 (+) |
| ptc-miRf10132-akr | TTGGCGGTGA TTGAACGGAG GGT (122) | GAGAAACGCTCTAATTAATCATCGTTATGC CACGTGTCTATTTACGGATAACGCAACGCT ACTAAATCGCGAATTTTAGTTTGAGTGGAA GATCTTGGCCGTTGGATTGGCGGTGATTGA ACGGAGGGTTGATC (11938) | 1.90E-04 | 1.63 (+) |
| ptc-miRf11315-akr | CAACTTAGAG TTGGGGGTGG (123) | GCCCTTAACCAACTTAGAGTTGGGGGTGGG CACGTCATGGGTCAACCTAGGGTTGGTCTC GGACTCGCCCTTGCTCAACTTAGAGTTGGG TACGGGC (11939) | 5.20E-03 | 1.61 (+) |
| aly-miR831-5p | AGAAGAGGTA CAAGGAGATG AGA (124) | AAGTGCTACAAGAATGTATAGTCTTAGAGT CTCAAGAAGAGGTACAAGGAGATGAGAAG TGAATCACTGAAACAAGTGGTTCGGTTTG TGGATCAGTATGGTTTACCCAAAACACGTG TTTGGTGCTTCACTTCTAAACTCCTCGTACT CTTCTTGGGATTCTATGACTTACACTTGTTG ATTT (233) | 1.60E-03 | 1.61 (+) |
| csi-miR3948 | TGGAGTGGGA GTGGGAGTAG GGTG (125) | AGGAGTGTGGAGTGGGAGTGGGAGTAGGG TGTTTACTTAGACTAAATGAAAGTATGGAT TATCAATCAGAATCCTAATTATTTGTTTACT TTGTCTTGGATTGGGAGTAAATTATTTAAA TTATAATTTTATCCTTATGTACAAAATTATA A (234) | 7.10E-05 | 1.55 (+) |

TABLE 4

Differentially Expressed (Down-regulated) Small RNAs in Soybean Plants Growing under High Salt (10 days) versus Optimal Conditions.

| miR Name | Mature Sequence (SEQ ID NO:) | Stem Loop Sequence (SEQ ID NO:) | p-Value | Fold-Change |
|---|---|---|---|---|
| aly-miR160c-3p | GCGTACAAGGAG CCAAGCATG (126) | CATATAATAGTTTGTCGTCGTTATGCCTGGCT CCCTGTATGCCACGAGTGGATACCGATTTTGT TATAAAATCGGCTGCCGGTGGCGTACAAGGA GCCAAGCATGACCATAAGCATATG (236) | 7.60E-04 | 1.59 (-) |
| aly-miR396a-3p | GTTCAATAAAGCT GTGGGAAG (127) | TCTACGTGACCCTCTCTGTATTCTTCCACAGC TTTCTTGAACTGCAAAACTTCTTCAGATTTGT TTTTTTTATATATATGTCTTACGCATAAAATA GTGTTTTTGTTCACATCTCTGCTCGATTGATT TGCGGTTCAATAAAGCTGTGGGAAGATACGG ACAGAGTCAAAGA (237) | 1.20E-09 | 5.50 (-) |
| aly-miR396b-3p | GCTCAAGAAAGC TGTGGGAAA (128) | GAAGAAGAAGAAGAAGATCCTGGTCATATTT TTCCACAGCTTTCTTGAACTTTCTTTTTCATTT CCATTGTTTTTTTTTTCTAAACCAAAAAAAA AGATCTCTAAAATTTAGCATTTTGGAAACAA AGAAGAAGCTCAAGAAAGCTGTGGGAAAAC ATGACAATTCAGGGTTTTACTCCATTGATTC (238) | 9.00E-07 | 3.80 (-) |
| ath-miRf10197-akr | CACTCGACCAAG GGGGTCGAGTGA (129) | GGTGAAGACACTCGACCTCGTGGTCGAGTGA TGTGATCGAGTGGTGGTCAGAAGATGGAGAT GAAGTCACTCGACCAAGGGGGTCGAGTGATG TGATC (11940) | 2.90E-07 | 3.71 (-) |
| ath-miRf10239-akr | CGCCTTGCATCAA CTGAATC (130) | TCGGGCTCGGATTCGCTTGGTGCAGGTCGGG AACCAATTCGGCTGACACAGCCTCGGACTT TTAAACCTTTATTGGTTTGTGAGCAGGGATTG GATCCCGCCTTGCATCAACTGAATCGGATCC TCGA (11941) | 1.00E-03 | 2.17 (-) |
| ath-miRf10279-akr | ACTCAGCCTGGG GGTCGAGTGAT (131) | TGATGGTGATACTCGACATCCAGGTAGAGTG ATGAGGTCGAGTAGAGGTCTGGCAATGGGAT GAAGTCACTCAGCCTGGGGGTCGAGTGATGT GATCG (11942) | 7.80E-06 | 4.99 (-) |
| bna-miR2111b-5p | TAATCTGCATCCT GAGGTTTA (132) | GCACTTGATGAGGAACTGGTAATCTGCATCC TGAGGTTTAAAAATACATAGGCACATGCAAA TGTGTGTATTATAGTTTTTAATCCTCGGGATA CAGATTACCTCTTCCTTTTACTGAA (239) | 4.40E-04 | 2.55 (-) |
| bra-miR160a-3p | GCGTATGAGGAG CCATGCATA (133) | TATGTGTAGTTGTATAAGATGTGTATGCCTGG CTCCCTGTATGCCATCCTCTAAGCTCATCGAC CATTGATGACCTCCGTGAATGGCTATGAGG AGCCATGCATATTTTCATATACATTTACATAC (240) | 1.90E-04 | 1.94 (-) |
| csi-miR162-5p | TGGAGGCAGCGG TTCATCGATC (134) | AAACTGTTTACACTGATCTGTGCTGCTGATAA ATCTTAATTTTTTTTTTGAATTTTTATTTAAC AGAAAATAGAGAGAGTGAAGTCACTGGAGG CAGCGGTTCATCGATCACTTTGTGCAAATTTT GTTGTGAAAAATAACACAAAATACATGAATC GATCGATAAACCTCTGCATCCAGCGCTCACT CCAACTCTATTC (241) | 1.60E-03 | 1.95 (-) |
| gma-miR1524 | CGAGTCCGAGGA AGGAACTCC (135) | GCGACTTATTGGAGTTCATTCTTCGCACTCTC TCGGAAACCACTTGTTTCCAATCATCTAATCA GACGATAGCAGACTCAAGAAAGACGTTTCCT TCCCAGATCCTTCTAGACCATTTGCAAACCGT CTCCTTCCCCGAATCCATTCTCCAAACCCTCG ATCCTTGAGGAGCTCCACCACCGTGACGGCG CTCCGGTCTCCGCCGTCAATTGTGCCGTCGCG GTGGAGCATGAGCGTCTTCATGAGTCTGAAA GGGAATTATAGGAACTACTTTCCTGATTAGG TTATTGGAAACAAGTGGTTTCCGAGTCCGAG GAAGGAACTCCAACGCCCAAC (242) | 3.30E-03 | 1.73 (-) |
| gma-miR159d | AGCTGCTTAGCTA TGGATCCC (136) | GGGTGAATTGAGCTGCTTAGCTATGGATCCC ACAGTTCTACCCATCAATAAGTGCTTTTGTG TAGTCTTGTGGCTTCCATATCTGGGGAGCTTC ATTTGCCT (243) | 3.20E-06 | 3.24 (-) |
| gma-miR2119 | TCAAAGGGAGTT GTAGGGGAA (137) | ATACTTCATTTTTTATACTTTAATTTCCTCTAT ACCTCACTTTTATTGGAGAAAAAAGAGAATA | 2.70E-03 | 1.54 (-) |

TABLE 4-continued

Differentially Expressed (Down-regulated) Small RNAs in Soybean Plants Growing under High Salt (10 days) versus Optimal Conditions.

| miR Name | Mature Sequence (SEQ ID NO:) | Stem Loop Sequence (SEQ ID NO:) | p-Value | Fold-Change |
|---|---|---|---|---|
| | | GAAAATAGTGGATTTCTCTTCTTTTTTTCAAT CAAAGGGAGTTGTAGGGGAAAGTTTAGAAA ATGGCGTGT (244) | | |
| gma-miR396d | AAGAAAGCTGTG GGAGAATATGGC (138) | GGTCATGCTTTTCCACAGCTTTCTTGAACTTC TTATGCATCTTATATCTCTCCACTTCCAGCAT TTTAAGCCCTAGAAGCTCAAGAAAGCTGTGG GAGAATATGGCAA (245) | 4.60E-08 | 2.76 (-) |
| gma-miR4412-3p | AGTGGCGTAGAT CCCCACAAC (139) | AACTGTTGCGGGTATCTTTGCCTCTGAAGGA AAGTTGTGCCTATTATTATGGCTTATTGCTTT AGTGGCGTAGATCCCCACAACAGTT (246) | 9.80E-05 | 3.03 (-) |
| gma-miR4416a | ACGGGTCGCTCTC ACCTAGG (140) | CTTTGATCTGGGTGAGAGAAACGCGTATCGA TGGATTGGGTTCAGTTCTGGTCTCACACGGTT TGTTCTAACAATTTGTACTGACTGTGTTTTGA TCGATACGGGTCGCTCTCACCTAGGCCAGAG TTGC (247) | 9.20E-06 | 4.30 (-) |
| gma-miR482b-5p | TATGGGGGGATT GGGAAGGAAT (141) | GGTATGGGGGGATTGGGAAGGAATATCCATA AGCAAAATATGCTATTTCTTCCCTACACCTCC CATACC (248) | 2.30E-10 | 2.74 (-) |
| osa-miR162a | TCGATAAACCTCT GCATCCAG (142) | GGTGATGCCTGGGCGCAGTGGTTTATCGATC CCTTCCCTGCCTTGTGGCGCTGATCCAGGAGC GGCGAATTTCTTTGAGAGGGTGTTCTTTTTTT TTCTTCCTTTTGGTCCTTGTTGCAGCCAACGA CAACGCGGGAATCGATCGATAAACCTCTGCA TCCAGTTCTCGCC (249) | 4.00E-04 | 1.52 (-) |
| osa-miR1846e | CAACGAGGAGGC CGGGACCA (143) | CGCATCCGCCAACGAGGAGGCCGGGACCACC GGATCCGGTGACTCCGGCCTCCTCGCCGGCA GATCCGG (250) | 4.30E-04 | 1.90 (-) |
| osa-miR2104 | GCGGCGAGGGGA TGCGAGCGTG (144) | ACGGGCGCTCACGGTGGCTTCGACCCTCGTC TCGGCCGCGTGCGGTAGTGCGGGAGGCATGC CGTGTGTACCGGCGGCGAGGGGATGCGAGCG TGAGTGCCTCGG (251) | 3.90E-02 | 1.51 (-) |
| osa-miRf10849-akr | TGGACTGTTTGGG GGAGCTTCT (145) | GCTGGACTGTTTGGGGGAGCTTCTGATTTTGG GAGAAACGGCTATAGCTAGAAGCTCCCCGAA ACAGGCCCAAC (11943) | 1.80E-03 | 1.52 (-) |
| osa-miRf11415-akr | GAGAGCAGGATG CAGCCAAGG (146) | GAAGAGGCAGAGAGCAGGATGCAGCCAAGG ATGACTTGCCGGCCGGCGATGGCCGACGGCG AGGTTAATTAATTGGCCGGAGACTGGCAGTC CTTCTCTGTTGATCCGGCAAGTTTGTCCTTGG CTACACCTTGCTCTCTTCTCGTC (11944) | 6.70E-03 | 1.55 (-) |
| osa-miRf11996-akr | GTCTTATAACCTG AAACGGGGG (147) | TACTACCTCCATTTCAGGTTATAAGACTTTCT AGTGTTGCTCACATTCATATATATGTTAATAA ATTCATTAACATATAGAAAGTCTTATAACCT GAAACGGGGGAAGTA (11945) | 7.20E-03 | 2.01 (-) |
| ppt-miR533b-5p | GAGCTGTCCAGG CTGTGAGGG (148) | GGAGGACCGATATGGAGAGCTGTCCAGGCTG TGAGGGGAGCACTCGTATTCTTTTGACCTTTG CTAGAAGAGGGAATACAGCGCTCTCCCTCAC AGTCTGTACAGCTCTCTGTATCTCTTCCTCT (252) | 7.90E-04 | 3.23 (-) |
| ptc-miRf10007-akr | CATTGACAGGGA AACTCACCA (149) | TTGCTGTGGTGAGTTTCCCTGTCAGTGCTCAC TACGATATTTAATGAAGAAGAAAAATAAAGC AAGAGATAAAAAAGGCATTTCCTCGATTCAG ATTTCAGGGTGCAGCATTGCATTGAGCATTG ACAGGGAAACTCACCACGGCAA (11946) | 3.90E-02 | 1.77 (-) |
| ptc-miRf10976-akr | TGGGAACGTGGC TGTGGCTA (150) | GCCCTGTTTGGGAACGTGGCTGTGGCTACAC TGATGCTTCTGGTTTGGAAATGGAGGTGCAA CTGAAGTTATGGGAACGTTCCCAAACAGGGC (11947) | 2.30E-04 | 1.81 (-) |
| ptc-miRf11018-akr | CTGCAAACCTAA GGGAGCGG (151) | CTGCAAACCTAAGGGAGCGGTTTTGCAGACC CCAAGCGCACAAGTCTGCAGACCCGCTCGCT TGGGTCTGCAG (11948) | 1.10E-02 | 1.79 (-) |

TABLE 4-continued

Differentially Expressed (Down-regulated) Small RNAs in Soybean Plants Growing under High Salt (10 days) versus Optimal Conditions.

| miR Name | Mature Sequence (SEQ ID NO:) | Stem Loop Sequence (SEQ ID NO:) | p-Value | Fold-Change |
| --- | --- | --- | --- | --- |
| ptc-miRf11079-akr | AAGATGGAGAAGCAGGGCACGTGC (152) | GTGTGTGAGCAAGATGGAGAAGCAGGGCACGTGCACTACTAACTCATGCACACAGAGAGGGAGACGCATTTCTTGCTGGAGTTACGAGTTACGACTCTTACCTACTATTGATTTTGTTAGCTCCAGTGAGTTAGTTATTCATGTGCCTGTCTTCCTCATCATGATCACTAC (11949) | 2.30E-05 | 2.43 (-) |
| ptc-miRf11324-akr | CTTGTCGCAGGAGAGATGGCGCT (153) | TTGGGGGTTTCTTGTCGCAGGAGAGATGGCGCTAGCTAACCATGGTCATATCATATATATCATATGGCAAGTATTACTTGCTCTTTGTATGTATCAGCTGTAAAGATAGCTCAGCTAAAGCCATCCTCCTGCGACTGGACACCCTGCAA (11950) | 5.90E-05 | 1.73 (-) |
| ptc-miRf11396-akr | CAAGGCTCTGATACCATGTCAA (154) | CTTGGTCATCAAGGCTCTGATACCATGTCAAAGAATCATATTTTGAGACCTTATCTAACAGCTTAAGCTATTGGGTTGAGATGGTTCCTTGACATGATATCAGAGCCTTGATGACGAAG (11951) | 4.10E-04 | 1.51 (-) |
| ptc-miRf11953-akr | GTAATCTGCATCCTGAGGTT (155) | AGGATTGGGTAATCTGCATCCTGAGGTTTGGATCACCACATGTTTTGATCTAGTCCTTGGGTTGCAGATTACCTCTTCCT (11952) | 1.90E-04 | 2.74 (-) |
| ptc-miRf12069-akr | GGAGGGGCTGCAAGACCCAAG (156) | CTTGGGCCAGGAGGGGCTGCAAGACCCAAGTGACTTGGGTCTGCGCTCTTGCCACACCCAAGCAACTTGGGTCAGACGCCCTTCCAAGCCCCAAG (11953) | 3.90E-07 | 3.81 (-) |
| ptc-miRf12389-akr | GTCGACCTGGCGAGTCAACCGGG (157) | TGAGTCGACCTGGCGAGTCAACCGGGTTTGATTGTTTTTTTATCCTTGCTAGTCTTTCACCTTACTAGGACCGGTCCAGCCACCGGGTTAATCGAGTCCCGGGTTGACTTGCTGGGCCGTCTGG (11954) | 1.00E-02 | 1.75 (-) |
| vvi-miR2111-5p | TAATCTGCATCCTGAGGTCTA (158) | GCAATATTGGGTCAGGATCGGGTAATCTGCATCCTGAGGTCTAGATAAGTATATCTCCGTTGCAGCTAGTCCTCTGGTTGCAGATTACTTCTTCCTCACTGCCAATGC (253) | 3.10E-04 | 2.82 (-) |
| zma-miR167u | TGAAGCTGCCACATGATCTG (159) | TGAAGCTGCCACATGATCTGATGACGCAGAGTCATGCATATGCATTGCATCCAGCAAGCTCCATGCGTGCGTGCATGGCCGAATGGCCGAAGAGACTAGCTAGTCCATCTCTCCAAGGCCATCCACGTGTGAGAATTCAATTCCTCGTGGATCAGATCAGGCTGTTGTTGACAACTGCATGCCGCACCTGCACTACAGCAACCCAAGGCATAGGTAGCTAGCTAGGTTTCGGTGGTCAGATCAGATCAGGCTGGCAGCTTCA (254) | 2.20E-05 | 1.57 (-) |
| zma-miR396b-3p | GTTCAATAAAGCTGTGGGAAA (160) | AGATGGCCTTCTTTGTGATCTTCCACAGCTTTCTTGAACTGCATCTCTCAGAGGAGCGGCAGCTTCAACTCCTCCACCCGCATCAGCAGGTGCATGCAGTTCAATAAAGCTGTGGGAAACTGCAGAGAGAGGCCAG (255) | 7.90E-09 | 6.05 (-) |
| zma-miR398a-5p | GGGGCGAACTGAGAACACATG (161) | GGGGGCGAACUGAGAACACAUGAGAAUAAUGAGAUGAGAUUGCUCGCCUCGCGGUACGGUUCGUGCUGGCCUGGACCACCGUCGUCGCCGUUCAUCUUGUACGCAUAAUAAUGCUGCAUGUGUUCUCAGGUCGCCCCCGC (11955) | 3.00E-04 | 1.89 (-) |

TABLE 5

Differentially Expressed (Up-regulated) Small RNAs in Soybean Plants Growing under Heat Shock (1 hour) versus Optimal Conditions.

| miR Name | Mature Sequence (SEQ ID NO:) | Stem Loop Sequence (SEQ ID NO:) | p-Value | Fold-Change |
|---|---|---|---|---|
| aly-miR831-5p | AGAAGAGGTACAAGGAGATGAGA (162) | AAGTGCTACAAGAATGTATAGTCTTAGAG TCTCAAGAAGAGGTACAAGGAGATGAGA AGTGAATCACTGAAACAAGTGGTTCTGGT TTGTGGATCAGTATGGTTTACCCAAAACA CGTGTTTGGTGCTTCACTTCTAAACTCCTC GTACTCTTCTTGGGATTCTATGACTTACAC TTGTTGATTT (256) | 4.20E-05 | 1.73 (+) |
| ath-miRf10687-akr | TTAGCTGAAGAAGCAGAGGAG (163) | TTTGTTTGTTTAGCTGAAGAAGCAGAGGA GTCGGCATTGGGGCACAGTCACTCATCGA TGCTGCAATGGGTAAGTCCTCTGCATACTT TTGCTGAGATAGGAATAGA (11956) | 2.10E-05 | 1.76 (+) |
| ath-miRf11021-akr | GAGGTTTGCGATGAGAAAGAG (164) | GATGTTGGAGGTTTGCGATGAGAAAGAGA TTGGCCGGAAGAATTATCAGCCATCAACA TCGAGATTGTGAGATAATCGGAAGACCTG TAATTGTGAAGGTAACTCTTTCTCATCTGC AAATCTCAACTGTC (11957) | 2.10E-07 | 1.82 (+) |
| far-miR1134 | CGACAACAACAACAAGAAGAAGAG (165) | ACGGCAATCCCAGCTTCAACGGGCCGGTG CCAGGCGTGCCTCCCGGCGATGCCCATCG GTCGCCGACGCCTCCTAGCACGCCAGCTG GCTCACAAGGTGTCTCTCCCGGCGGCGAC AACAACAACAAGAAGAAGAGATCAGGTC TGGTGCTGGCTACTACCATCCCGGTCTCA GTCAGTGTGGTGGCGCTCATCTCGCTGGG TGCCGTGCTGCTCTTCCGCAAGAAAAACA ACGGGTCCG (257) | 2.80E-04 | 1.63 (+) |
| osa-miRf10105-akr | TTGGCCTCGTCGAAGAAGGAGA (166) | TCTCGTTCTTGGAGAGGCCCTTGCCGACCT TGGCGATGCGCTTGCCGGCCCTGGACCAG CGGGACGCCGCGGTCTCCTGCTTGGCCTC GTCGAAGAAGGAGA (11958) | 1.90E-06 | 2.01 (+) |
| pab-miR3711 | TGGCGCTAGAAGGAGGGCCT (167) | AAATGGCGCTAGAAGGAGGGCCTGAAAA TTATTAATGGCACGAGGCAGTCGTAAGAC TCCTCCACCACCCAACCACTCACCTATAGT GAAAAGAAGTCATTAAAATGATAACATCA CCCCTCAAATAGAACCA (258) | 6.60E-05 | 1.68 (+) |
| zma-miR482-5p | TGGGAGATGAAGGAGCCTT (168) | AGTGGGAGATGAAGGAGCCTTGCATCGAT GTCACCGCCGGAGGAGCGCTCGCCTTCTT CGCGCACCGCCGCAATAGCCGCCCTCGGA CCCCTCGCCTCGCTCTTCCTTGTTCCTCCC ATTTT (259) | 8.20E-07 | 2.05 (+) |

TABLE 6

Differentially Expressed (Down-regulated) Small RNAs in Soybean Plants Growing under Heat Shock (1 hour) versus Optimal Conditions.

| miR Name | Mature Sequence (SEQ ID NO:) | Stem Loop Sequence (SEQ ID NO:) | p-Value | Fold-Change |
|---|---|---|---|---|
| ath-miRf10279-akr | ACTCAGCCTGGGGGTCGAGTGAT (169) | TGATGGTGATACTCGACATCCAGGTAGA GTGATGAGGTCGAGTAGAGGTCTGGCAA TGGGATGAAGTCACTCAGCCTGGGGGTC GAGTGATGTGATCG (11959) | 1.30E-02 | 2.56 (−) |
| csi-miR162-5p | TGGAGGCAGCGGTTCATCGATC (170) | AAACTGTTTACACTGATCTGTGCTGCTG ATAAATCTTAATTTTTTTTTTTGAATTTTT ATTTAACAGAAAATAGAGAGAGTGAAG TCACTGGAGGCAGCGGTTCATCGATCAC TTTGTGCAAATTTTGTTGTGAAAAATAA CACAAAATACATGAATCGATCGATAAAC CTCTGCATCCAGCGCTCACTCCAACTCTA TTC (260) | 4.10E-05 | 1.71 (−) |

TABLE 6-continued

Differentially Expressed (Down-regulated) Small RNAs in Soybean Plants Growing under Heat Shock (1 hour) versus Optimal Conditions.

| miR Name | Mature Sequence (SEQ ID NO:) | Stem Loop Sequence (SEQ ID NO:) | p-Value | Fold-Change |
| --- | --- | --- | --- | --- |
| gma-miR4412-3p | AGTGGCGTAGATC CCCACAAC (171) | AACTGTTGCGGGTATCTTTGCCTCTGAA GGAAAGTTGTGCCTATTATTATGGCTTAT TGCTTTAGTGGCGTAGATCCCCACAACA GTT (261) | 1.60E-05 | 1.81 (−) |
| osa-miRf10151-akr | TGGCTATATTTTGG GACGGAG (172) | GTATACTACCTCCGTCCCAAAATATAGC CACTTTTAGATTCATAAACAAAAGTGGC TATATTTTGGGACGGAGGGAGTATAT (11960) | 3.60E-03 | 2.06 (−) |
| ptc-miRf12069-akr | GGAGGGGCTGCAA GACCCAAG (173) | CTTGGGCCAGGAGGGGCTGCAAGACCCA AGTGACTTGGGTCTGCGCTCTTGCCACA CCCAAGCAACTTGGGTCAGACGCCCTTC CAAGCCCCAAG (11961) | 1.90E-03 | 2.03 (−) |

Example 2

Identification of Homologous and Orthologous Sequences of Differential Small RNAs Associated with Enhanced Abiotic Stress Tolerance The miRNA sequences of the invention that were either down- or up-regulated under abiotic stress conditions were examined for homologous and orthologous sequences using the miRBase database (http://wwwDOTmirbaseDOTorg/) and the Plant MicroRNA Database (PMRD, http://bioinformaticsDOTcauDOTeduDOTcn/PMRD). The mature miRNA sequences that are homologous or orthologous to the soy miRNAs listed in Tables 1-6 above, were found using miRNA public databases, having at least 75% identity of the entire mature miRNA length of the original soy sequence listed in Tables 1-6 and are summarized in Tables 7-8 below.

TABLE 7

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
| --- | --- | --- | --- | --- |
| far-miR1134 | tae-miR1134 | CAACAACAACAAGAAG AAGAAGAT (262) | 0.88 | 2087 |
| mtr-miR2119 | gma-miR2119 | TCAAAGGGAGTTGTAG GGGAA (263) | 0.76 | 2088 |
|  | pvu-miR2119 | TCAAAGGGAGTTGTAG GGGAA (264) | 0.76 | 2089 |
| ppt-miR1220a | ppt-miR1220b | TTCCGGTGGTGAGGAAG ATAG (265) | 1 | 2090 |
| aqc-miR159 | acb-miR159 | TTGGACTGAAGGGAGCT CCCT (266) | 0.86 | 2091 |
|  | aha-miR159 | TTGGACTGAAGGGAGCT CCCT (267) | 0.86 | 2092 |
|  | ahi-miR159 | TTGGACTGAAGGGAGCT CCCT (268) | 0.86 | 2093 |
|  | ahy-miR159 | TTTGGATTGAAGGGAGC TCTA (269) | 0.95 | 2094 |
|  | aly-miR159a | TTTGGATTGAAGGGAGC TCTA (270) | 0.95 | 2095 |
|  | aly-miR159b | TTTGGATTGAAGGGAGC TCTT (271) | 0.9 | 2096 |
|  | aly-miR159c | TTTGGATTGAAGGGAGC TCCT (272) | 0.86 | 2097 |
|  | ape-miR159 | TTGGACTGAAGGGAGCT CCCT (273) | 0.86 | 2098 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ath-miR159a | TTTGGATTGAAGGGAGCTCTA (274) | 0.95 | 2099 |
| | ath-miR159b | TTTGGATTGAAGGGAGCTCTT (275) | 0.9 | 2100 |
| | ath-miR159c | TTTGGATTGAAGGGAGCTCCT (276) | 0.86 | 2101 |
| | bdi-miR159 | CTTGGATTGAAGGGAGCTCT (277) | 0.86 | 2102 |
| | bna-miR159 | TTTGGATTGAAGGGAGCTCTA (278) | 0.95 | 2103 |
| | bra-miR159a | TTTGGATTGAAGGGAGCTCTA (279) | 0.95 | 2104 |
| | bvl-miR159 | TTGGACTGAAGGGAGCTCCCT (280) | 0.86 | 2105 |
| | cmi-miR159 | TTGGACTGAAGGGAGCTCCCT (281) | 0.86 | 2106 |
| | cor-miR159 | TTGGACTGAAGGGAGCTCCCT (282) | 0.86 | 2107 |
| | crb-miR159 | TTGGACTGAAGGGAGCTCCCT (283) | 0.86 | 2108 |
| | csi-miR159 | TTTGGATTGAAGGGAGCTCTA (284) | 0.95 | 2109 |
| | dso-miR159 | TTGGACTGAAGGGAGCTCCCT (285) | 0.86 | 2110 |
| | ech-miR159 | TTGGACTGAAGGGAGCTCCCT (286) | 0.86 | 2111 |
| | fal-miR159 | TTGGACTGAAGGGAGCTCCCT (287) | 0.86 | 2112 |
| | far-miR159 | TTTGGATTGAAGGGAGCTCTG (288) | 0.9 | 2113 |
| | gma-miR159a-3p | TTTGGATTGAAGGGAGCTCTA (289) | 0.95 | 2114 |
| | gma-miR159b | ATTGGAGTGAAGGGAGCTCCA (290) | 0.86 | 2115 |
| | gma-miR159c | ATTGGAGTGAAGGGAGCTCCG (291) | 0.81 | 2116 |
| | hvu-miR159a | TTTGGATTGAAGGGAGCTCTG (292) | 0.9 | 2117 |
| | hvu-miR159b | TTTGGATTGAAGGGAGCTCTG (293) | 0.9 | 2118 |
| | hvv-miR159a | TTTGGATTGAAGGGAGCTCTG (294) | 0.9 | 2119 |
| | hvv-miR159b | TTTGGATTGAAGGGAGCTCTG (295) | 0.9 | 2120 |
| | ltu-miR159 | TTTGGATTGAAGGGAGCTCTA (296) | 0.95 | 2121 |
| | mma-miR159 | TTGGACTGAAGGGAGCTCCCT (297) | 0.86 | 2122 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | mtr-miR159a | TTTGGATTGAAGGGAGCTCTA (298) | 0.95 | 2123 |
| | mtr-miR159b | ATTGAATTGAAGGGAGCAACT (299) | 0.67 | 2124 |
| | mtr-miR159c | TTTGGATTGAAGGGAGCTCTA (300) | 0.95 | 2125 |
| | nof-miR159 | TTGGACTGAAGGGAGCTCCCT (301) | 0.86 | 2126 |
| | oru-miR159 | TTTGGATTGAAGGGAGCTCTG (302) | 0.9 | 2127 |
| | osa-miR159a | TTTGGATTGAAGGGAGCTCTG (303) | 0.9 | 2128 |
| | osa-miR159a.1 | TTTGGATTGAAGGGAGCTCTG (304) | 0.9 | 2129 |
| | osa-miR159b | TTTGGATTGAAGGGAGCTCTG (305) | 0.9 | 2130 |
| | osa-miR159c | ATTGGATTGAAGGGAGCTCCA (306) | 0.86 | 2131 |
| | osa-miR159d | ATTGGATTGAAGGGAGCTCCG (307) | 0.81 | 2132 |
| | osa-miR159e | ATTGGATTGAAGGGAGCTCCT (308) | 0.81 | 2133 |
| | osa-miR159f | CTTGGATTGAAGGGAGCTCTA (309) | 0.9 | 2134 |
| | osa-miR159m | TTTGGATTGAAGGGAGCTCTG (310) | 0.9 | 2135 |
| | pgl-miR159 | TTTGGATTGAAGGGAGCTCTG (311) | 0.9 | 2136 |
| | psi-miR159 | CTTGGATTGAAGGGAGCTCCA (312) | 0.86 | 2137 |
| | pta-miR159a | TTGGATTGAAGGGAGCTCCA (313) | 0.86 | 2138 |
| | pta-miR159b | TTGGATTGAAGAGAGCTCCC (314) | 0.76 | 2139 |
| | pta-miR159c | CTTGGATTGAAGGGAGCTCCC (315) | 0.81 | 2140 |
| | ptc-miR159a | TTTGGATTGAAGGGAGCTCTA (316) | 0.95 | 2141 |
| | ptc-miR159b | TTTGGATTGAAGGGAGCTCTA (317) | 0.95 | 2142 |
| | ptc-miR159c | TTTGGATTGAAGGGAGCTCTA (318) | 0.95 | 2143 |
| | ptc-miR159d | CTTGGATTGAAGGGAGCTCCT (319) | 0.81 | 2144 |
| | ptc-miR159e | CTTGGGGTGAAGGGAGCTCCT (320) | 0.76 | 2145 |
| | ptc-miR159f | ATTGGAGTGAAGGGAGCTCGA (321) | 0.86 | 2146 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | pvu-miR159 | TTTGGATTGAAGGGAGCTCTA (322) | 0.95 | 2147 |
| | pvu-miR159a.1 | TTTGGATTGAAGGGAGCTCTA (323) | 0.95 | 2148 |
| | rco-miR159 | TTTGGATTGAAGGGAGCTCTA (324) | 0.95 | 2149 |
| | rin-miR159 | TTGGACTGAAGGGAGCTCCCT (325) | 0.86 | 2150 |
| | sar-miR159 | TTTGGATTGAAGGGAGCTCTG (326) | 0.9 | 2151 |
| | sbi-miR159a | TTTGGATTGAAGGGAGCTCTG (327) | 0.9 | 2152 |
| | sbi-miR159b | CTTGGATTGAAGGGAGCTCCT (328) | 0.81 | 2153 |
| | sly-miR159 | TTTGGATTGAAGGGAGCTCTA (329) | 0.95 | 2154 |
| | smo-miR159 | CTTGGATTGAAGGGAGCTCCC (330) | 0.81 | 2155 |
| | sof-miR159a | TTTGGATTGAAGGGAGCTCTG (331) | 0.9 | 2156 |
| | sof-miR159b | TTTGGATTGAAGGGAGCTCTG (332) | 0.9 | 2157 |
| | sof-miR159c | CTTGGATTGAAGGGAGCTCCT (333) | 0.81 | 2158 |
| | sof-miR159d | TTTGGATTGAAGGGAGCTCTG (334) | 0.9 | 2159 |
| | sof-miR159e | TTTGGATTGAAAGGAGCTCTT (335) | 0.86 | 2160 |
| | spr-miR159 | TTTGGATTGAAGGGAGCTCTG (336) | 0.9 | 2161 |
| | ssp-miR159a | TTTGGATTGAAGGGAGCTCTG (337) | 0.9 | 2162 |
| | svi-miR159 | TTGGACTGAAGGGAGCTCCCT (338) | 0.86 | 2163 |
| | tae-miR159a | TTTGGATTGAAGGGAGCTCTG (339) | 0.9 | 2164 |
| | tae-miR159b | TTTGGATTGAAGGGAGCTCTG (340) | 0.9 | 2165 |
| | tar-miR159 | TTGGACTGAAGGGAGCTCCCT (341) | 0.86 | 2166 |
| | vvi-miR159a | CTTGGAGTGAAGGGAGCTCTC (342) | 0.86 | 2167 |
| | vvi-miR159b | CTTGGAGTGAAGGGAGCTCTC (343) | 0.86 | 2168 |
| | vvi-miR159c | TTTGGATTGAAGGGAGCTCTA (344) | 0.95 | 2169 |
| | zma-miR159a | TTTGGATTGAAGGGAGCTCTG (345) | 0.9 | 2170 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | zma-miR159b | TTTGGATTGAAGGGAGCTCTG (346) | 0.9 | 2171 |
| | zma-miR159c | CTTGGATTGAAGGGAGCTCCT (347) | 0.81 | 2172 |
| | zma-miR159d | CTTGGATTGAAGGGAGCTCCT (348) | 0.81 | 2173 |
| | zma-miR159e | ATTGGTTTGAAGGGAGCTCCA (349) | 0.81 | 2174 |
| | zma-miR159f | TTTGGATTGAAGGGAGCTCTG (350) | 0.9 | 2175 |
| | zma-miR159g | TTTGGAGTGAAGGGAGTTCTG (351) | 0.86 | 2176 |
| | zma-miR159h | TTTGGAGTGAAGGGAGCTCTG (352) | 0.9 | 2177 |
| | zma-miR159i | TTTGGAGTGAAGGGAGCTCTG (353) | 0.9 | 2178 |
| | zma-miR159j | TTTGGATTGAAGGGAGCTCTG (354) | 0.9 | 2179 |
| | zma-miR159k | TTTGGATTGAAGGGAGCTCTG (355) | 0.9 | 2180 |
| | zma-miR159m | TTTGGATTGAAGGGAGCTCTG (356) | 0.9 | 2181 |
| ath-miR159b | acb-miR159 | TTGGACTGAAGGGAGCTCCCT (357) | 0.81 | 2182 |
| | aha-miR159 | TTGGACTGAAGGGAGCTCCCT (358) | 0.81 | 2183 |
| | ahi-miR159 | TTGGACTGAAGGGAGCTCCCT (359) | 0.81 | 2184 |
| | ahy-miR159 | TTTGGATTGAAGGGAGCTCTA (360) | 0.95 | 2185 |
| | aly-miR159a | TTTGGATTGAAGGGAGCTCTA (361) | 0.95 | 2186 |
| | aly-miR159b | TTTGGATTGAAGGGAGCTCTT (362) | 1 | 2187 |
| | aly-miR159c | TTTGGATTGAAGGGAGCTCCT (363) | 0.95 | 2188 |
| | ape-miR159 | TTGGACTGAAGGGAGCTCCCT (364) | 0.81 | 2189 |
| | aqc-miR159 | TTTGGACTGAAGGGAGCTCTA (365) | 0.9 | 2190 |
| | ath-miR159a | TTTGGATTGAAGGGAGCTCTA (366) | 0.95 | 2191 |
| | ath-miR159c | TTTGGATTGAAGGGAGCTCCT (367) | 0.95 | 2192 |
| | bdi-miR159 | CTTGGATTGAAGGGAGCTCT (368) | 0.9 | 2193 |
| | bna-miR159 | TTTGGATTGAAGGGAGCTCTA (369) | 0.95 | 2194 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | bra-miR159a | TTTGGATTGAAGGGAGCTCTA (370) | 0.95 | 2195 |
| | byl-miR159 | TTGGACTGAAGGGAGCTCCCT (371) | 0.81 | 2196 |
| | cmi-miR159 | TTGGACTGAAGGGAGCTCCCT (372) | 0.81 | 2197 |
| | cor-miR159 | TTGGACTGAAGGGAGCTCCCT (373) | 0.81 | 2198 |
| | crb-miR159 | TTGGACTGAAGGGAGCTCCCT (374) | 0.81 | 2199 |
| | csi-miR159 | TTTGGATTGAAGGGAGCTCTA (375) | 0.95 | 2200 |
| | dso-miR159 | TTGGACTGAAGGGAGCTCCCT (376) | 0.81 | 2201 |
| | ech-miR159 | TTGGACTGAAGGGAGCTCCCT (377) | 0.81 | 2202 |
| | fal-miR159 | TTGGACTGAAGGGAGCTCCCT (378) | 0.81 | 2203 |
| | far-miR159 | TTTGGATTGAAGGGAGCTCTG (379) | 0.95 | 2204 |
| | gma-miR159a-3p | TTTGGATTGAAGGGAGCTCTA (380) | 0.95 | 2205 |
| | gma-miR159b | ATTGGAGTGAAGGGAGCTCCA (381) | 0.81 | 2206 |
| | gma-miR159c | ATTGGAGTGAAGGGAGCTCCG (382) | 0.81 | 2207 |
| | hvu-miR159a | TTTGGATTGAAGGGAGCTCTG (383) | 0.95 | 2208 |
| | hvu-miR159b | TTTGGATTGAAGGGAGCTCTG (384) | 0.95 | 2209 |
| | hvv-miR159a | TTTGGATTGAAGGGAGCTCTG (385) | 0.95 | 2210 |
| | hvv-miR159b | TTTGGATTGAAGGGAGCTCTG (386) | 0.95 | 2211 |
| | ltu-miR159 | TTTGGATTGAAGGGAGCTCTA (387) | 0.95 | 2212 |
| | mma-miR159 | TTGGACTGAAGGGAGCTCCCT (388) | 0.81 | 2213 |
| | mtr-miR159a | TTTGGATTGAAGGGAGCTCTA (389) | 0.95 | 2214 |
| | mtr-miR159b | ATTGAATTGAAGGGAGCAACT (390) | 0.76 | 2215 |
| | mtr-miR159c | TTTGGATTGAAGGGAGCTCTA (391) | 0.95 | 2216 |
| | nof-miR159 | TTGGACTGAAGGGAGCTCCCT (392) | 0.81 | 2217 |
| | oru-miR159 | TTTGGATTGAAGGGAGCTCTG (393) | 0.95 | 2218 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | osa-miR159a | TTTGGATTGAAGGGAGCTCTG (394) | 0.95 | 2219 |
| | osa-miR159a.1 | TTTGGATTGAAGGGAGCTCTG (395) | 0.95 | 2220 |
| | osa-miR159b | TTTGGATTGAAGGGAGCTCTG (396) | 0.95 | 2221 |
| | osa-miR159c | ATTGGATTGAAGGGAGCTCCA (397) | 0.86 | 2222 |
| | osa-miR159d | ATTGGATTGAAGGGAGCTCCG (398) | 0.86 | 2223 |
| | osa-miR159e | ATTGGATTGAAGGGAGCTCCT (399) | 0.9 | 2224 |
| | osa-miR159f | CTTGGATTGAAGGGAGCTCTA (400) | 0.9 | 2225 |
| | osa-miR159m | TTTGGATTGAAGGGAGCTCTG (401) | 0.95 | 2226 |
| | pgl-miR159 | TTTGGATTGAAGGGAGCTCTG (402) | 0.95 | 2227 |
| | psi-miR159 | CTTGGATTGAAGGGAGCTCCA (403) | 0.86 | 2228 |
| | pta-miR159a | TTGGATTGAAGGGAGCTCCA (404) | 0.86 | 2229 |
| | pta-miR159b | TTGGATTGAAGAGAGCTCCC (405) | 0.81 | 2230 |
| | pta-miR159c | CTTGGATTGAAGGGAGCTCCC (406) | 0.86 | 2231 |
| | ptc-miR159a | TTTGGATTGAAGGGAGCTCTA (407) | 0.95 | 2232 |
| | ptc-miR159b | TTTGGATTGAAGGGAGCTCTA (408) | 0.95 | 2233 |
| | ptc-miR159c | TTTGGATTGAAGGGAGCTCTA (409) | 0.95 | 2234 |
| | ptc-miR159d | CTTGGATTGAAGGGAGCTCCT (410) | 0.9 | 2235 |
| | ptc-miR159e | CTTGGGGTGAAGGGAGCTCCT (411) | 0.81 | 2236 |
| | ptc-miR159f | ATTGGAGTGAAGGGAGCTCGA (412) | 0.81 | 2237 |
| | pvu-miR159 | TTTGGATTGAAGGGAGCTCTA (413) | 0.95 | 2238 |
| | pvu-miR159a.1 | TTTGGATTGAAGGGAGCTCTA (414) | 0.95 | 2239 |
| | rco-miR159 | TTTGGATTGAAGGGAGCTCTA (415) | 0.95 | 2240 |
| | rin-miR159 | TTGGACTGAAGGGAGCTCCCT (416) | 0.81 | 2241 |
| | sar-miR159 | TTTGGATTGAAGGGAGCTCTG (417) | 0.95 | 2242 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | sbi-miR159a | TTTGGATTGAAGGGAGCTCTG (418) | 0.95 | 2243 |
| | sbi-miR159b | CTTGGATTGAAGGGAGCTCCT (419) | 0.9 | 2244 |
| | sly-miR159 | TTTGGATTGAAGGGAGCTCTA (420) | 0.95 | 2245 |
| | smo-miR159 | CTTGGATTGAAGGGAGCTCCC (421) | 0.86 | 2246 |
| | sof-miR159a | TTTGGATTGAAGGGAGCTCTG (422) | 0.95 | 2247 |
| | sof-miR159b | TTTGGATTGAAGGGAGCTCTG (423) | 0.95 | 2248 |
| | sof-miR159c | CTTGGATTGAAGGGAGCTCCT (424) | 0.9 | 2249 |
| | sof-miR159d | TTTGGATTGAAGGGAGCTCTG (425) | 0.95 | 2250 |
| | sof-miR159e | TTTGGATTGAAAGGAGCTCTT (426) | 0.95 | 2251 |
| | spr-miR159 | TTTGGATTGAAGGGAGCTCTG (427) | 0.95 | 2252 |
| | ssp-miR159a | TTTGGATTGAAGGGAGCTCTG (428) | 0.95 | 2253 |
| | svi-miR159 | TTGGACTGAAGGGAGCTCCCT (429) | 0.81 | 2254 |
| | tae-miR159a | TTTGGATTGAAGGGAGCTCTG (430) | 0.95 | 2255 |
| | tae-miR159b | TTTGGATTGAAGGGAGCTCTG (431) | 0.95 | 2256 |
| | tar-miR159 | TTGGACTGAAGGGAGCTCCCT (432) | 0.81 | 2257 |
| | vvi-miR159a | CTTGGAGTGAAGGGAGCTCTC (433) | 0.86 | 2258 |
| | vvi-miR159b | CTTGGAGTGAAGGGAGCTCTC (434) | 0.86 | 2259 |
| | vvi-miR159c | TTTGGATTGAAGGGAGCTCTA (435) | 0.95 | 2260 |
| | zma-miR159a | TTTGGATTGAAGGGAGCTCTG (436) | 0.95 | 2261 |
| | zma-miR159b | TTTGGATTGAAGGGAGCTCTG (437) | 0.95 | 2262 |
| | zma-miR159c | CTTGGATTGAAGGGAGCTCCT (438) | 0.9 | 2263 |
| | zma-miR159d | CTTGGATTGAAGGGAGCTCCT (439) | 0.9 | 2264 |
| | zma-miR159e | ATTGGTTTGAAGGGAGCTCCA (440) | 0.81 | 2265 |
| | zma-miR159f | TTTGGATTGAAGGGAGCTCTG (441) | 0.95 | 2266 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | zma-miR159g | TTTGGAGTGAAGGGAGTTCTG (442) | 0.86 | 2267 |
| | zma-miR159h | TTTGGAGTGAAGGGAGCTCTG (443) | 0.9 | 2268 |
| | zma-miR159i | TTTGGAGTGAAGGGAGCTCTG (444) | 0.9 | 2269 |
| | zma-miR159j | TTTGGATTGAAGGGAGCTCTG (445) | 0.95 | 2270 |
| | zma-miR159k | TTTGGATTGAAGGGAGCTCTG (446) | 0.95 | 2271 |
| | zma-miR159m | TTTGGATTGAAGGGAGCTCTG (447) | 0.95 | 2272 |
| ath-miR159c | acb-miR159 | TTGGACTGAAGGGAGCTCCCT (448) | 0.86 | 2273 |
| | aha-miR159 | TTGGACTGAAGGGAGCTCCCT (449) | 0.86 | 2274 |
| | ahi-miR159 | TTGGACTGAAGGGAGCTCCCT (450) | 0.86 | 2275 |
| | ahy-miR159 | TTTGGATTGAAGGGAGCTCTA (451) | 0.9 | 2276 |
| | aly-miR159a | TTTGGATTGAAGGGAGCTCTA (452) | 0.9 | 2277 |
| | aly-miR159b | TTTGGATTGAAGGGAGCTCTT (453) | 0.95 | 2278 |
| | aly-miR159c | TTTGGATTGAAGGGAGCTCCT (454) | 1 | 2279 |
| | ape-miR159 | TTGGACTGAAGGGAGCTCCCT (455) | 0.86 | 2280 |
| | aqc-miR159 | TTTGGACTGAAGGGAGCTCTA (456) | 0.86 | 2281 |
| | ath-miR159a | TTTGGATTGAAGGGAGCTCTA (457) | 0.9 | 2282 |
| | ath-miR159b | TTTGGATTGAAGGGAGCTCTT (458) | 0.95 | 2283 |
| | bdi-miR159 | CTTGGATTGAAGGGAGCTCT (459) | 0.86 | 2284 |
| | bna-miR159 | TTTGGATTGAAGGGAGCTCTA (460) | 0.9 | 2285 |
| | bra-miR159a | TTTGGATTGAAGGGAGCTCTA (461) | 0.9 | 2286 |
| | byl-miR159 | TTGGACTGAAGGGAGCTCCCT (462) | 0.86 | 2287 |
| | cmi-miR159 | TTGGACTGAAGGGAGCTCCCT (463) | 0.86 | 2288 |
| | cor-miR159 | TTGGACTGAAGGGAGCTCCCT (464) | 0.86 | 2289 |
| | crb-miR159 | TTGGACTGAAGGGAGCTCCCT (465) | 0.86 | 2290 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | csi-miR159 | TTTGGATTGAAGGGAGCTCTA (466) | 0.9 | 2291 |
| | dso-miR159 | TTGGACTGAAGGGAGCTCCCT (467) | 0.86 | 2292 |
| | ech-miR159 | TTGGACTGAAGGGAGCTCCCT (468) | 0.86 | 2293 |
| | fal-miR159 | TTGGACTGAAGGGAGCTCCCT (469) | 0.86 | 2294 |
| | far-miR159 | TTTGGATTGAAGGGAGCTCTG (470) | 0.9 | 2295 |
| | gma-miR159a-3p | TTTGGATTGAAGGGAGCTCTA (471) | 0.9 | 2296 |
| | gma-miR159b | ATTGGAGTGAAGGGAGCTCCA (472) | 0.86 | 2297 |
| | gma-miR159c | ATTGGAGTGAAGGGAGCTCCG (473) | 0.86 | 2298 |
| | hvu-miR159a | TTTGGATTGAAGGGAGCTCTG (474) | 0.9 | 2299 |
| | hvu-miR159b | TTTGGATTGAAGGGAGCTCTG (475) | 0.9 | 2300 |
| | hvv-miR159a | TTTGGATTGAAGGGAGCTCTG (476) | 0.9 | 2301 |
| | hvv-miR159b | TTTGGATTGAAGGGAGCTCTG (477) | 0.9 | 2302 |
| | ltu-miR159 | TTTGGATTGAAGGGAGCTCTA (478) | 0.9 | 2303 |
| | mma-miR159 | TTGGACTGAAGGGAGCTCCCT (479) | 0.86 | 2304 |
| | mtr-miR159a | TTTGGATTGAAGGGAGCTCTA (480) | 0.9 | 2305 |
| | mtr-miR159b | ATTGAATTGAAGGGAGCAACT (481) | 0.81 | 2306 |
| | mtr-miR159c | TTTGGATTGAAGGGAGCTCTA (482) | 0.9 | 2307 |
| | nof-miR159 | TTGGACTGAAGGGAGCTCCCT (483) | 0.86 | 2308 |
| | oru-miR159 | TTTGGATTGAAGGGAGCTCTG (484) | 0.9 | 2309 |
| | osa-miR159a | TTTGGATTGAAGGGAGCTCTG (485) | 0.9 | 2310 |
| | osa-miR159a.1 | TTTGGATTGAAGGGAGCTCTG (486) | 0.9 | 2311 |
| | osa-miR159b | TTTGGATTGAAGGGAGCTCTG (487) | 0.9 | 2312 |
| | osa-miR159c | ATTGGATTGAAGGGAGCTCCA (488) | 0.9 | 2313 |
| | osa-miR159d | ATTGGATTGAAGGGAGCTCCG (489) | 0.9 | 2314 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | osa-miR159e | ATTGGATTGAAGGGAGCTCCT (490) | 0.95 | 2315 |
| | osa-miR159f | CTTGGATTGAAGGGAGCTCTA (491) | 0.86 | 2316 |
| | osa-miR159m | TTTGGATTGAAGGGAGCTCTG (492) | 0.9 | 2317 |
| | pgl-miR159 | TTTGGATTGAAGGGAGCTCTG (493) | 0.9 | 2318 |
| | psi-miR159 | CTTGGATTGAAGGGAGCTCCA (494) | 0.9 | 2319 |
| | pta-miR159a | TTGGATTGAAGGGAGCTCCA (495) | 0.9 | 2320 |
| | pta-miR159b | TTGGATTGAAGAGAGCTCCC (496) | 0.86 | 2321 |
| | pta-miR159c | CTTGGATTGAAGGGAGCTCCC (497) | 0.9 | 2322 |
| | ptc-miR159a | TTTGGATTGAAGGGAGCTCTA (498) | 0.9 | 2323 |
| | ptc-miR159b | TTTGGATTGAAGGGAGCTCTA (499) | 0.9 | 2324 |
| | ptc-miR159c | TTTGGATTGAAGGGAGCTCTA (500) | 0.9 | 2325 |
| | ptc-miR159d | CTTGGATTGAAGGGAGCTCCT (501) | 0.95 | 2326 |
| | ptc-miR159e | CTTGGGGTGAAGGGAGCTCCT (502) | 0.86 | 2327 |
| | ptc-miR159f | ATTGGAGTGAAGGGAGCTCGA (503) | 0.81 | 2328 |
| | pvu-miR159 | TTTGGATTGAAGGGAGCTCTA (504) | 0.9 | 2329 |
| | pvu-miR159a.1 | TTTGGATTGAAGGGAGCTCTA (505) | 0.9 | 2330 |
| | rco-miR159 | TTTGGATTGAAGGGAGCTCTA (506) | 0.9 | 2331 |
| | rin-miR159 | TTGGACTGAAGGGAGCTCCCT (507) | 0.86 | 2332 |
| | sar-miR159 | TTTGGATTGAAGGGAGCTCTG (508) | 0.9 | 2333 |
| | sbi-miR159a | TTTGGATTGAAGGGAGCTCTG (509) | 0.9 | 2334 |
| | sbi-miR159b | CTTGGATTGAAGGGAGCTCCT (510) | 0.95 | 2335 |
| | sly-miR159 | TTTGGATTGAAGGGAGCTCTA (511) | 0.9 | 2336 |
| | smo-miR159 | CTTGGATTGAAGGGAGCTCCC (512) | 0.9 | 2337 |
| | sof-miR159a | TTTGGATTGAAGGGAGCTCTG (513) | 0.9 | 2338 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | sof-miR159b | TTTGGATTGAAGGGAGCTCTG (514) | 0.9 | 2339 |
| | sof-miR159c | CTTGGATTGAAGGGAGCTCCT (515) | 0.95 | 2340 |
| | sof-miR159d | TTTGGATTGAAGGGAGCTCTG (516) | 0.9 | 2341 |
| | sof-miR159e | TTTGGATTGAAAGGAGCTCTT (517) | 0.9 | 2342 |
| | spr-miR159 | TTTGGATTGAAGGGAGCTCTG (518) | 0.9 | 2343 |
| | ssp-miR159a | TTTGGATTGAAGGGAGCTCTG (519) | 0.9 | 2344 |
| | svi-miR159 | TTGGACTGAAGGGAGCTCCCT (520) | 0.86 | 2345 |
| | tae-miR159a | TTTGGATTGAAGGGAGCTCTG (521) | 0.9 | 2346 |
| | tae-miR159b | TTTGGATTGAAGGGAGCTCTG (522) | 0.9 | 2347 |
| | tar-miR159 | TTGGACTGAAGGGAGCTCCCT (523) | 0.86 | 2348 |
| | vvi-miR159a | CTTGGAGTGAAGGGAGCTCTC (524) | 0.81 | 2349 |
| | vvi-miR159b | CTTGGAGTGAAGGGAGCTCTC (525) | 0.81 | 2350 |
| | vvi-miR159c | TTTGGATTGAAGGGAGCTCTA (526) | 0.9 | 2351 |
| | zma-miR159a | TTTGGATTGAAGGGAGCTCTG (527) | 0.9 | 2352 |
| | zma-miR159b | TTTGGATTGAAGGGAGCTCTG (528) | 0.9 | 2353 |
| | zma-miR159c | CTTGGATTGAAGGGAGCTCCT (529) | 0.95 | 2354 |
| | zma-miR159d | CTTGGATTGAAGGGAGCTCCT (530) | 0.95 | 2355 |
| | zma-miR159e | ATTGGTTTGAAGGGAGCTCCA (531) | 0.86 | 2356 |
| | zma-miR159f | TTTGGATTGAAGGGAGCTCTG (532) | 0.9 | 2357 |
| | zma-miR159g | TTTGGAGTGAAGGGAGTTCTG (533) | 0.81 | 2358 |
| | zma-miR159h | TTTGGAGTGAAGGGAGCTCTG (534) | 0.86 | 2359 |
| | zma-miR159i | TTTGGAGTGAAGGGAGCTCTG (535) | 0.86 | 2360 |
| | zma-miR159j | TTTGGATTGAAGGGAGCTCTG (536) | 0.9 | 2361 |
| | zma-miR159k | TTTGGATTGAAGGGAGCTCTG (537) | 0.9 | 2362 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | zma-miR159m | TTTGGATTGAAGGGAGCTCTG (538) | 0.9 | 2363 |
| ath-miRf10687-akr | gma-miRf10687-akr-homolog | TTAGCCGCAGAGGCAGAGGAG (11616) | 0.86 | 11615 |
| ghr-miR2950 | vvi-miR2950* | TGGTGTGCACGGGATGGAATA (539) | 0.9 | 2364 |
| gma-miR156g | ahy-miR156a | TGACAGAAGAGAGAGAGCAC (540) | 0.85 | 2365 |
| | ahy-miR156b-5p | TTGACAGAAGATAGAGAGCAC (541) | 0.9 | 2366 |
| | ahy-miR156c | TTGACAGAAGAGAGAGAGCAC (542) | 0.85 | 2367 |
| | aly-miR156a | TGACAGAAGAGAGTGAGCAC (543) | 0.8 | 2368 |
| | aly-miR156b | TGACAGAAGAGAGTGAGCAC (544) | 0.8 | 2369 |
| | aly-miR156c | TGACAGAAGAGAGTGAGCAC (545) | 0.8 | 2370 |
| | aly-miR156d | TGACAGAAGAGAGTGAGCAC (546) | 0.8 | 2371 |
| | aly-miR156e | TGACAGAAGAGAGTGAGCAC (547) | 0.8 | 2372 |
| | aly-miR156f | TGACAGAAGAGAGTGAGCAC (548) | 0.8 | 2373 |
| | aly-miR156g | CGACAGAAGAGAGTGAGCAC (549) | 0.8 | 2374 |
| | aly-miR156h | TGACAGAAGAAAGAGAGCAC (550) | 0.85 | 2375 |
| | aqc-miR156a | TGACAGAAGATAGAGAGCAC (551) | 0.9 | 2376 |
| | aqc-miR156b | TGACAGAAGATAGAGAGCAC (552) | 0.9 | 2377 |
| | ath-miR156a | TGACAGAAGAGAGTGAGCAC (553) | 0.8 | 2378 |
| | ath-miR156b | TGACAGAAGAGAGTGAGCAC (554) | 0.8 | 2379 |
| | ath-miR156c | TGACAGAAGAGAGTGAGCAC (555) | 0.8 | 2380 |
| | ath-miR156d | TGACAGAAGAGAGTGAGCAC (556) | 0.8 | 2381 |
| | ath-miR156e | TGACAGAAGAGAGTGAGCAC (557) | 0.8 | 2382 |
| | ath-miR156f | TGACAGAAGAGAGTGAGCAC (558) | 0.8 | 2383 |
| | ath-miR156g | CGACAGAAGAGAGTGAGCAC (559) | 0.8 | 2384 |
| | ath-miR156h | TGACAGAAGAAAGAGAGCAC (560) | 0.85 | 2385 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | bdi-miR156 | TGACAGAAGAGAGAGA GCACA (561) | 0.9 | 2386 |
| | bdi-miR156b | TGACAGAAGAGAGTGA GCAC (562) | 0.8 | 2387 |
| | bdi-miR156c | TGACAGAAGAGAGTGA GCAC (563) | 0.8 | 2388 |
| | bdi-miR156d | TGACAGAAGAGAGTGA GCAC (564) | 0.8 | 2389 |
| | bna-miR156a | TGACAGAAGAGAGTGA GCACA (565) | 0.85 | 2390 |
| | bna-miR156b | TTGACAGAAGATAGAG AGCAC (566) | 0.9 | 2391 |
| | bna-miR156c | TTGACAGAAGATAGAG AGCAC (567) | 0.9 | 2392 |
| | csi-miR156 | TGACAGAAGAGAGTGA GCAC (568) | 0.8 | 2393 |
| | ctr-miR156 | TGACAGAAGAGAGTGA GCAC (569) | 0.8 | 2394 |
| | far-miR156a | TGACAGAAGAGAGAGA GCACA (570) | 0.9 | 2395 |
| | far-miR156b | TTGACAGAAGAGAGAG AGCAC (571) | 0.85 | 2396 |
| | ghr-miR156a | TGACAGAAGAGAGTGA GCAC (572) | 0.8 | 2397 |
| | ghr-miR156b | TGACAGAAGAGAGTGA GCAC (573) | 0.8 | 2398 |
| | ghr-miR156c | TGTCAGAAGAGAGTGA GCAC (574) | 0.75 | 2399 |
| | ghr-miR156d | TGACAGAAGAGAGTGA GCAC (575) | 0.8 | 2400 |
| | gma-miR156a | TGACAGAAGAGAGTGA GCAC (576) | 0.8 | 2401 |
| | gma-miR156b | TGACAGAAGAGAGAGA GCACA (577) | 0.9 | 2402 |
| | gma-miR156c | TTGACAGAAGATAGAG AGCAC (578) | 0.9 | 2403 |
| | gma-miR156d | TTGACAGAAGATAGAG AGCAC (579) | 0.9 | 2404 |
| | gma-miR156e | TTGACAGAAGATAGAG AGCAC (580) | 0.9 | 2405 |
| | gma-miR156f | TTGACAGAAGAGAGAG AGCACA (581) | 0.9 | 2406 |
| | hvu-miR156 | TGACAGAAGAGAGTGA GCACA (582) | 0.85 | 2407 |
| | mtr-miR156 | TGACAGAAGAGAGAGA GCACA (583) | 0.9 | 2408 |
| | mtr-miR156b | TGACAGAAGAGAGTGA GCAC (584) | 0.8 | 2409 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | mtr-miR156c | TGACAGAAGAGAGTGAGCAC (585) | 0.8 | 2410 |
| | mtr-miR156d | TGACAGAAGAGAGTGAGCAC (586) | 0.8 | 2411 |
| | mtr-miR156e | TTGACAGAAGATAGAGAGCAC (587) | 0.9 | 2412 |
| | mtr-miR156f | TTGACAGAAGATAGAGAGCAC (588) | 0.9 | 2413 |
| | mtr-miR156g | TTGACAGAAGATAGAGGGCAC (589) | 0.85 | 2414 |
| | mtr-miR156h | TTGACAGAAGATAGAGAGCAC (590) | 0.9 | 2415 |
| | mtr-miR156i | TGACAGAAGAGAGTGAGCAC (591) | 0.8 | 2416 |
| | osa-miR156a | TGACAGAAGAGAGTGAGCAC (592) | 0.8 | 2417 |
| | osa-miR156b | TGACAGAAGAGAGTGAGCAC (593) | 0.8 | 2418 |
| | osa-miR156c | TGACAGAAGAGAGTGAGCAC (594) | 0.8 | 2419 |
| | osa-miR156d | TGACAGAAGAGAGTGAGCAC (595) | 0.8 | 2420 |
| | osa-miR156e | TGACAGAAGAGAGTGAGCAC (596) | 0.8 | 2421 |
| | osa-miR156f | TGACAGAAGAGAGTGAGCAC (597) | 0.8 | 2422 |
| | osa-miR156g | TGACAGAAGAGAGTGAGCAC (598) | 0.8 | 2423 |
| | osa-miR156h | TGACAGAAGAGAGTGAGCAC (599) | 0.8 | 2424 |
| | osa-miR156i | TGACAGAAGAGAGTGAGCAC (600) | 0.8 | 2425 |
| | osa-miR156j | TGACAGAAGAGAGTGAGCAC (601) | 0.8 | 2426 |
| | osa-miR156k | TGACAGAAGAGAGAGAGCACA (602) | 0.9 | 2427 |
| | osa-miR156l | CGACAGAAGAGAGTGAGCATA (603) | 0.8 | 2428 |
| | ppt-miR156a | TGACAGAAGAGAGTGAGCAC (604) | 0.8 | 2429 |
| | ppt-miR156b | TGACAGAAGAGAGTGAGCAC (605) | 0.8 | 2430 |
| | ppt-miR156c | TGACAGAAGAGAGTGAGCAC (606) | 0.8 | 2431 |
| | pta-miR156a | CAGAAGATAGAGAGCACATC (607) | 0.9 | 2432 |
| | pta-miR156b | CAGAAGATAGAGAGCACAAC (608) | 0.9 | 2433 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ptc-miR156a | TGACAGAAGAGAGTGAGCAC (609) | 0.8 | 2434 |
| | ptc-miR156b | TGACAGAAGAGAGTGAGCAC (610) | 0.8 | 2435 |
| | ptc-miR156c | TGACAGAAGAGAGTGAGCAC (611) | 0.8 | 2436 |
| | ptc-miR156d | TGACAGAAGAGAGTGAGCAC (612) | 0.8 | 2437 |
| | ptc-miR156e | TGACAGAAGAGAGTGAGCAC (613) | 0.8 | 2438 |
| | ptc-miR156f | TGACAGAAGAGAGTGAGCAC (614) | 0.8 | 2439 |
| | ptc-miR156g | TTGACAGAAGATAGAGAGCAC (615) | 0.9 | 2440 |
| | ptc-miR156h | TTGACAGAAGATAGAGAGCAC (616) | 0.9 | 2441 |
| | ptc-miR156i | TTGACAGAAGATAGAGAGCAC (617) | 0.9 | 2442 |
| | ptc-miR156j | TTGACAGAAGATAGAGAGCAC (618) | 0.9 | 2443 |
| | ptc-miR156k | TGACAGAAGAGAGGGAGCAC (619) | 0.8 | 2444 |
| | rco-miR156a | TGACAGAAGAGAGTGAGCACA (620) | 0.85 | 2445 |
| | rco-miR156b | TGACAGAAGAGAGTGAGCACA (621) | 0.85 | 2446 |
| | rco-miR156c | TGACAGAAGAGAGTGAGCACA (622) | 0.85 | 2447 |
| | rco-miR156d | TGACAGAAGAGAGTGAGCACA (623) | 0.85 | 2448 |
| | rco-miR156e | TGACAGAAGAGAGAGAGCACA (624) | 0.9 | 2449 |
| | rco-miR156f | TTGACAGAAGATAGAGAGCAC (625) | 0.9 | 2450 |
| | rco-miR156g | TTGACAGAAGATAGAGAGCAC (626) | 0.9 | 2451 |
| | rco-miR156h | TTGACAGAAGATAGAGAGCAC (627) | 0.9 | 2452 |
| | sbi-miR156a | TGACAGAAGAGAGTGAGCAC (628) | 0.8 | 2453 |
| | sbi-miR156b | TGACAGAAGAGAGTGAGCAC (629) | 0.8 | 2454 |
| | sbi-miR156c | TGACAGAAGAGAGTGAGCAC (630) | 0.8 | 2455 |
| | sbi-miR156d | TGACAGAAGAGAGAGAGCACA (631) | 0.9 | 2456 |
| | sbi-miR156e | TGACAGAAGAGAGAGCGAGCAC (632) | 0.8 | 2457 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | sbi-miR156f | TGACAGAAGAGAGTGAGCAC (633) | 0.8 | 2458 |
| | sbi-miR156g | TGACAGAAGAGAGTGAGCAC (634) | 0.8 | 2459 |
| | sbi-miR156h | TGACAGAAGAGAGTGAGCAC (635) | 0.8 | 2460 |
| | sbi-miR156i | TGACAGAAGAGAGTGAGCAC (636) | 0.8 | 2461 |
| | sly-miR156a | TTGACAGAAGATAGAGAGCAC (637) | 0.9 | 2462 |
| | sly-miR156b | TTGACAGAAGATAGAGAGCAC (638) | 0.9 | 2463 |
| | sly-miR156c | TTGACAGAAGATAGAGAGCAC (639) | 0.9 | 2464 |
| | smo-miR156a | CGACAGAAGAGAGTGAGCAC (640) | 0.8 | 2465 |
| | smo-miR156b | CTGACAGAAGATAGAGAGCAC (641) | 0.9 | 2466 |
| | smo-miR156c | TTGACAGAAGAAAGAGAGCAC (642) | 0.85 | 2467 |
| | smo-miR156d | TTGACAGAAGACAGGGAGCAC (643) | 0.8 | 2468 |
| | sof-miR156 | TGACAGAAGAGAGTGAGCAC (644) | 0.8 | 2469 |
| | ssp-miR156 | TGACAGAAGAGAGTGAGCACA (645) | 0.85 | 2470 |
| | tae-miR156 | TGACAGAAGAGAGTGAGCACA (646) | 0.85 | 2471 |
| | tcc-miR156a | TGACAGAAGAGAGAGAGCACA (647) | 0.9 | 2472 |
| | tcc-miR156b | TGACAGAAGAGAGTGAGCAC (648) | 0.8 | 2473 |
| | tcc-miR156c | TGACAGAAGAGAGTGAGCAC (649) | 0.8 | 2474 |
| | tcc-miR156d | TGACAGAAGAGAGTGAGCAC (650) | 0.8 | 2475 |
| | tcc-miR156e | TTGACAGAAGATAGAGAGCAC (651) | 0.9 | 2476 |
| | tcc-miR156f | TTGACAGAAGATAGAGAGCAC (652) | 0.9 | 2477 |
| | tcc-miR156g | TGACAGAAGAGAGTGAGCAC (653) | 0.8 | 2478 |
| | vvi-miR156a | TGACAGAAGAGAGGGAGCAC (654) | 0.8 | 2479 |
| | vvi-miR156b | TGACAGAAGAGAGTGAGCAC (655) | 0.8 | 2480 |
| | vvi-miR156c | TGACAGAAGAGAGTGAGCAC (656) | 0.8 | 2481 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | vvi-miR156d | TGACAGAAGAGAGTGAGCAC (657) | 0.8 | 2482 |
| | vvi-miR156e | TGACAGAGGAGAGTGAGCAC (658) | 0.75 | 2483 |
| | vvi-miR156f | TTGACAGAAGATAGAGAGCAC (659) | 0.9 | 2484 |
| | vvi-miR156g | TTGACAGAAGATAGAGAGCAC (660) | 0.9 | 2485 |
| | vvi-miR156h | TGACAGAAGAGAGAGAGCAT (661) | 0.8 | 2486 |
| | vvi-miR156i | TTGACAGAAGATAGAGAGCAC (662) | 0.9 | 2487 |
| | zma-miR156a | TGACAGAAGAGAGTGAGCAC (663) | 0.8 | 2488 |
| | zma-miR156b | TGACAGAAGAGAGTGAGCAC (664) | 0.8 | 2489 |
| | zma-miR156c | TGACAGAAGAGAGTGAGCAC (665) | 0.8 | 2490 |
| | zma-miR156d | TGACAGAAGAGAGTGAGCAC (666) | 0.8 | 2491 |
| | zma-miR156e | TGACAGAAGAGAGTGAGCAC (667) | 0.8 | 2492 |
| | zma-miR156f | TGACAGAAGAGAGTGAGCAC (668) | 0.8 | 2493 |
| | zma-miR156g | TGACAGAAGAGAGTGAGCAC (669) | 0.8 | 2494 |
| | zma-miR156h | TGACAGAAGAGAGTGAGCAC (670) | 0.8 | 2495 |
| | zma-miR156i | TGACAGAAGAGAGTGAGCAC (671) | 0.8 | 2496 |
| | zma-miR156j | TGACAGAAGAGAGAGAGCACA (672) | 0.9 | 2497 |
| | zma-miR156k | TGACAGAAGAGAGCGAGCAC (673) | 0.8 | 2498 |
| | zma-miR156l | TGACAGAAGAGAGTGAGCAC (674) | 0.8 | 2499 |
| gma-miR157c | ahy-miR157a-5p | TTGACAGAAGATAGAGAGCAC (675) | 0.95 | 2500 |
| | ahy-miR157k | TTGACAGAAGAGAGAGAGCAC (676) | 0.9 | 2501 |
| | aly-miR157a | TTGACAGAAGATAGAGAGCAC (677) | 0.95 | 2502 |
| | aly-miR157b | TTGACAGAAGATAGAGAGCAC (678) | 0.95 | 2503 |
| | aly-miR157c | TTGACAGAAGATAGAGAGCAC (679) | 0.95 | 2504 |
| | aly-miR157d | TGACAGAAGATAGAGAGCAC (680) | 0.95 | 2505 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ath-miR157a | TTGACAGAAGATAGAGAGCAC (681) | 0.95 | 2506 |
| | ath-miR157b | TTGACAGAAGATAGAGAGCAC (682) | 0.95 | 2507 |
| | ath-miR157c | TTGACAGAAGATAGAGAGCAC (683) | 0.95 | 2508 |
| | ath-miR157d | TGACAGAAGATAGAGAGCAC (684) | 0.95 | 2509 |
| | ath-miR157m | TTGACAGAAGAGAGAGAGCAC (685) | 0.9 | 2510 |
| | bol-miR157a | TTGACAGAAGATAGAGAGCAC (686) | 0.95 | 2511 |
| | bra-miR157a | TTGACAGAAGATAGAGAGCAC (687) | 0.95 | 2512 |
| | can-miR157 | TTGACAGAAGAGAGAGAGCAC (688) | 0.9 | 2513 |
| | ghr-miR157 | ATGACAGAAGAGAGAGAGCAC (689) | 0.9 | 2514 |
| | gma-miR157r | TTGACAGAAGAGAGAGAGCAC (690) | 0.9 | 2515 |
| | gra-miR157a | TTGACAGAAGATAGAGAGCAC (691) | 0.95 | 2516 |
| | gra-miR157b | TTGACAGAAGATAGAGAGCAC (692) | 0.95 | 2517 |
| | gra-miR157c | TTGACAGAAGAGAGAGAGCAC (693) | 0.9 | 2518 |
| | gra-miR157d | TTGACAGAAGAGAGAGAGCAC (694) | 0.9 | 2519 |
| | han-miR157a | TTGACAGAAGATAGAGAGCAC (695) | 0.95 | 2520 |
| | han-miR157b | TTGACAGAAGAGAGAGAGCAC (696) | 0.9 | 2521 |
| | iba-miR157 | TTGACAGAAGATAGAGAGCAT (697) | 0.9 | 2522 |
| | ini-miR157a | TTGACAGAAGATAGAGAGCAT (698) | 0.9 | 2523 |
| | ini-miR157b | TTGACAGAAGATAGAGAGCAT (699) | 0.9 | 2524 |
| | lja-miR157a | TTGACAGAAGATAGAGAGCAC (700) | 0.95 | 2525 |
| | lja-miR157b | TTGACAGAAGAGAGAGAGCAC (701) | 0.9 | 2526 |
| | lja-miR157c | TTGACAGAAGATAGAGAGCAT (702) | 0.9 | 2527 |
| | lsa-miR157 | TTGACAGAAGAGAGAGAGCAC (703) | 0.9 | 2528 |
| | mtr-miR157 | TTGACAGAAGATAGAGGGCAC (704) | 0.9 | 2529 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | nad-miR157a | TTGACAGAAGACAGAGAGCAC (705) | 0.95 | 2530 |
| | nad-miR157b | TTGACAGAAGACAGAGAGCAC (706) | 0.95 | 2531 |
| | nad-miR157c | TTGACAGAAGACAGAGAGCAC (707) | 0.95 | 2532 |
| | nbe-miR157a | TTGACAGAAGAGAGAGAGCAC (708) | 0.9 | 2533 |
| | nbe-miR157b | TTGACAGAAGAGAGAGAGCAC (709) | 0.9 | 2534 |
| | nta-miR157 | TTGACAGAAGATAGAGAGCAC (710) | 0.95 | 2535 |
| | pam-miR157 | TTGACAGAAGAGAGAGAGCAC (711) | 0.9 | 2536 |
| | par-miR157 | TTGACAGAAGAGAGAGAGCAC (712) | 0.9 | 2537 |
| | pco-miR157 | TTGACAGAAGATAGAGAGCAT (713) | 0.9 | 2538 |
| | pts-miR157 | TTGACAGAAGAGAGAGAGCAC (714) | 0.9 | 2539 |
| | sbi-miR157 | TTGACAGAAGAGAGAGTGAGCAC (715) | 0.86 | 2540 |
| | sin-miR157 | TTGACAGAAGAGAGAGAGCAC (716) | 0.9 | 2541 |
| | sly-miR157a | TTGACAGAAGATAGAGAGCAT (717) | 0.9 | 2542 |
| | sly-miR157b | TTGACAGAAGATAGAGAGCAT (718) | 0.9 | 2543 |
| | sly-miR157c | TTGACAGAAGATAGAGAGCAT (719) | 0.9 | 2544 |
| | stu-miR157a | TTGACAGAAGATAGAGAGCAC (720) | 0.95 | 2545 |
| | stu-miR157b | TTGACAGAAGAGAGAGAGCAC (721) | 0.9 | 2546 |
| | stu-miR157c | TTGACAGAAGAGAGAGAGCAC (722) | 0.9 | 2547 |
| | zel-miR157 | TTGACAGAAGAGAGAGAGCAC (723) | 0.9 | 2548 |
| | zma-miR157m | TTGACAGAAGAGAGAGAGCAC (724) | 0.9 | 2549 |
| iba-miR157 | ahy-miR157a-5p | TTGACAGAAGATAGAGAGCAC (725) | 0.95 | 2550 |
| | ahy-miR157k | TTGACAGAAGAGAGAGAGCAC (726) | 0.9 | 2551 |
| | aly-miR157a | TTGACAGAAGATAGAGAGCAC (727) | 0.95 | 2552 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | aly-miR157b | TTGACAGAAGATAGAGAGCAC (728) | 0.95 | 2553 |
| | aly-miR157c | TTGACAGAAGATAGAGAGCAC (729) | 0.95 | 2554 |
| | aly-miR157d | TGACAGAAGATAGAGAGCAC (730) | 0.9 | 2555 |
| | ath-miR157a | TTGACAGAAGATAGAGAGCAC (731) | 0.95 | 2556 |
| | ath-miR157b | TTGACAGAAGATAGAGAGCAC (732) | 0.95 | 2557 |
| | ath-miR157c | TTGACAGAAGATAGAGAGCAC (733) | 0.95 | 2558 |
| | ath-miR157d | TGACAGAAGATAGAGAGCAC (734) | 0.9 | 2559 |
| | ath-miR157m | TTGACAGAAGAGAGAGAGCAC (735) | 0.9 | 2560 |
| | bol-miR157a | TTGACAGAAGATAGAGAGCAC (736) | 0.95 | 2561 |
| | bra-miR157a | TTGACAGAAGATAGAGAGCAC (737) | 0.95 | 2562 |
| | can-miR157 | TTGACAGAAGAGAGAGAGCAC (738) | 0.9 | 2563 |
| | ghr-miR157 | ATGACAGAAGAGAGAGAGCAC (739) | 0.86 | 2564 |
| | gma-miR157c | TGACAGAAGACTAGAGAGCAC (740) | 0.9 | 2565 |
| | gma-miR157r | TTGACAGAAGAGAGAGAGCAC (741) | 0.9 | 2566 |
| | gra-miR157a | TTGACAGAAGATAGAGAGCAC (742) | 0.95 | 2567 |
| | gra-miR157b | TTGACAGAAGATAGAGAGCAC (743) | 0.95 | 2568 |
| | gra-miR157c | TTGACAGAAGAGAGAGAGCAC (744) | 0.9 | 2569 |
| | gra-miR157d | TTGACAGAAGAGAGAGAGCAC (745) | 0.9 | 2570 |
| | han-miR157a | TTGACAGAAGATAGAGAGCAC (746) | 0.95 | 2571 |
| | han-miR157b | TTGACAGAAGAGAGAGAGCAC (747) | 0.9 | 2572 |
| | ini-miR157a | TTGACAGAAGATAGAGAGCAT (748) | 1 | 2573 |
| | ini-miR157b | TTGACAGAAGATAGAGAGCAT (749) | 1 | 2574 |
| | lja-miR157a | TTGACAGAAGATAGAGAGCAC (750) | 0.95 | 2575 |
| | lja-miR157b | TTGACAGAAGAGAGAGAGCAC (751) | 0.9 | 2576 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | lja-miR157c | TTGACAGAAGATAGAGAGCAT (752) | 1 | 2577 |
| | lsa-miR157 | TTGACAGAAGAGAGAGAGCAC (753) | 0.9 | 2578 |
| | mtr-miR157 | TTGACAGAAGATAGAGGGCAC (754) | 0.9 | 2579 |
| | nad-miR157a | TTGACAGAAGACAGAGAGCAC (755) | 0.9 | 2580 |
| | nad-miR157b | TTGACAGAAGACAGAGAGCAC (756) | 0.9 | 2581 |
| | nad-miR157c | TTGACAGAAGACAGAGAGCAC (757) | 0.9 | 2582 |
| | nbe-miR157a | TTGACAGAAGAGAGAGAGCAC (758) | 0.9 | 2583 |
| | nbe-miR157b | TTGACAGAAGAGAGAGAGCAC (759) | 0.9 | 2584 |
| | nta-miR157 | TTGACAGAAGATAGAGAGCAC (760) | 0.95 | 2585 |
| | pam-miR157 | TTGACAGAAGAGAGAGAGCAC (761) | 0.9 | 2586 |
| | par-miR157 | TTGACAGAAGAGAGAGAGCAC (762) | 0.9 | 2587 |
| | pco-miR157 | TTGACAGAAGATAGAGAGCAT (763) | 1 | 2588 |
| | pts-miR157 | TTGACAGAAGAGAGAGAGCAC (764) | 0.9 | 2589 |
| | sbi-miR157 | TTGACAGAAGAGAGTGAGCAC (765) | 0.86 | 2590 |
| | sin-miR157 | TTGACAGAAGAGAGAGAGCAC (766) | 0.9 | 2591 |
| | sly-miR157a | TTGACAGAAGATAGAGAGCAT (767) | 1 | 2592 |
| | sly-miR157b | TTGACAGAAGATAGAGAGCAT (768) | 1 | 2593 |
| | sly-miR157c | TTGACAGAAGATAGAGAGCAT (769) | 1 | 2594 |
| | stu-miR157a | TTGACAGAAGATAGAGAGCAC (770) | 0.95 | 2595 |
| | stu-miR157b | TTGACAGAAGAGAGAGAGCAC (771) | 0.9 | 2596 |
| | stu-miR157c | TTGACAGAAGAGAGAGAGCAC (772) | 0.9 | 2597 |
| | zel-miR157 | TTGACAGAAGAGAGAGAGCAC (773) | 0.9 | 2598 |
| | zma-miR157m | TTGACAGAAGAGAGAGAGCAC (774) | 0.9 | 2599 |
| mdm-miR482a-5p | gma-miR482b-5p | TATGGGGGGATTGGGAAGGAAT (775) | 0.62 | 2600 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | mdo-miR482* | GGAATGGGCTGTTTGGGAACA (776) | 1 | 2601 |
| | pvu-miR482* | GGAATGGGCTGATTGGGAAGCA (777) | 0.95 | 2602 |
| osa-miR159e | acb-miR159 | TTGGACTGAAGGGAGCTCCCT (778) | 0.86 | 2603 |
| | aha-miR159 | TTGGACTGAAGGGAGCTCCCT (779) | 0.86 | 2604 |
| | ahi-miR159 | TTGGACTGAAGGGAGCTCCCT (780) | 0.86 | 2605 |
| | ahy-miR159 | TTTGGATTGAAGGGAGCTCTA (781) | 0.86 | 2606 |
| | aly-miR159a | TTTGGATTGAAGGGAGCTCTA (782) | 0.86 | 2607 |
| | aly-miR159b | TTTGGATTGAAGGGAGCTCTT (783) | 0.9 | 2608 |
| | aly-miR159c | TTTGGATTGAAGGGAGCTCCT (784) | 0.95 | 2609 |
| | ape-miR159 | TTGGACTGAAGGGAGCTCCCT (785) | 0.86 | 2610 |
| | aqc-miR159 | TTTGGACTGAAGGGAGCTCTA (786) | 0.81 | 2611 |
| | ath-miR159a | TTTGGATTGAAGGGAGCTCTA (787) | 0.86 | 2612 |
| | ath-miR159b | TTTGGATTGAAGGGAGCTCTT (788) | 0.9 | 2613 |
| | ath-miR159c | TTTGGATTGAAGGGAGCTCCT (789) | 0.95 | 2614 |
| | bdi-miR159 | CTTGGATTGAAGGGAGCTCT (790) | 0.86 | 2615 |
| | bna-miR159 | TTTGGATTGAAGGGAGCTCTA (791) | 0.86 | 2616 |
| | bra-miR159a | TTTGGATTGAAGGGAGCTCTA (792) | 0.86 | 2617 |
| | bvl-miR159 | TTGGACTGAAGGGAGCTCCCT (793) | 0.86 | 2618 |
| | cmi-miR159 | TTGGACTGAAGGGAGCTCCCT (794) | 0.86 | 2619 |
| | cor-miR159 | TTGGACTGAAGGGAGCTCCCT (795) | 0.86 | 2620 |
| | crb-miR159 | TTGGACTGAAGGGAGCTCCCT (796) | 0.86 | 2621 |
| | csi-miR159 | TTTGGATTGAAGGGAGCTCTA (797) | 0.86 | 2622 |
| | dso-miR159 | TTGGACTGAAGGGAGCTCCCT (798) | 0.86 | 2623 |
| | ech-miR159 | TTGGACTGAAGGGAGCTCCCT (799) | 0.86 | 2624 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | fal-miR159 | TTGGACTGAAGGGAGCTCCCT (800) | 0.86 | 2625 |
| | far-miR159 | TTTGGATTGAAGGGAGCTCTG (801) | 0.86 | 2626 |
| | gma-miR159a-3p | TTTGGATTGAAGGGAGCTCTA (802) | 0.86 | 2627 |
| | gma-miR159b | ATTGGAGTGAAGGGAGCTCCA (803) | 0.9 | 2628 |
| | gma-miR159c | ATTGGAGTGAAGGGAGCTCCG (804) | 0.9 | 2629 |
| | hvu-miR159a | TTTGGATTGAAGGGAGCTCTG (805) | 0.86 | 2630 |
| | hvu-miR159b | TTTGGATTGAAGGGAGCTCTG (806) | 0.86 | 2631 |
| | hvv-miR159a | TTTGGATTGAAGGGAGCTCTG (807) | 0.86 | 2632 |
| | hvv-miR159b | TTTGGATTGAAGGGAGCTCTG (808) | 0.86 | 2633 |
| | ltu-miR159 | TTTGGATTGAAGGGAGCTCTA (809) | 0.86 | 2634 |
| | mma-miR159 | TTGGACTGAAGGGAGCTCCCT (810) | 0.86 | 2635 |
| | mtr-miR159a | TTTGGATTGAAGGGAGCTCTA (811) | 0.86 | 2636 |
| | mtr-miR159b | ATTGAATTGAAGGGAGCAACT (812) | 0.86 | 2637 |
| | mtr-miR159c | TTTGGATTGAAGGGAGCTCTA (813) | 0.86 | 2638 |
| | nof-miR159 | TTGGACTGAAGGGAGCTCCCT (814) | 0.86 | 2639 |
| | oru-miR159 | TTTGGATTGAAGGGAGCTCTG (815) | 0.86 | 2640 |
| | osa-miR159a | TTTGGATTGAAGGGAGCTCTG (816) | 0.86 | 2641 |
| | osa-miR159a.1 | TTTGGATTGAAGGGAGCTCTG (817) | 0.86 | 2642 |
| | osa-miR159b | TTTGGATTGAAGGGAGCTCTG (818) | 0.86 | 2643 |
| | osa-miR159c | ATTGGATTGAAGGGAGCTCCA (819) | 0.95 | 2644 |
| | osa-miR159d | ATTGGATTGAAGGGAGCTCCG (820) | 0.95 | 2645 |
| | osa-miR159f | CTTGGATTGAAGGGAGCTCTA (821) | 0.86 | 2646 |
| | osa-miR159m | TTTGGATTGAAGGGAGCTCTG (822) | 0.86 | 2647 |
| | pgl-miR159 | TTTGGATTGAAGGGAGCTCTG (823) | 0.86 | 2648 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | psi-miR159 | CTTGGATTGAAGGGAGCTCCA (824) | 0.9 | 2649 |
| | pta-miR159a | TTGGATTGAAGGGAGCTCCA (825) | 0.9 | 2650 |
| | pta-miR159b | TTGGATTGAAGAGAGCTCCC (826) | 0.86 | 2651 |
| | pta-miR159c | CTTGGATTGAAGGGAGCTCCC (827) | 0.9 | 2652 |
| | ptc-miR159a | TTTGGATTGAAGGGAGCTCTA (828) | 0.86 | 2653 |
| | ptc-miR159b | TTTGGATTGAAGGGAGCTCTA (829) | 0.86 | 2654 |
| | ptc-miR159c | TTTGGATTGAAGGGAGCTCTA (830) | 0.86 | 2655 |
| | ptc-miR159d | CTTGGATTGAAGGGAGCTCCT (831) | 0.95 | 2656 |
| | ptc-miR159e | CTTGGGGTGAAGGGAGCTCCT (832) | 0.86 | 2657 |
| | ptc-miR159f | ATTGGAGTGAAGGGAGCTCGA (833) | 0.86 | 2658 |
| | pvu-miR159 | TTTGGATTGAAGGGAGCTCTA (834) | 0.86 | 2659 |
| | pvu-miR159.2 | CTTCCATATCTGGGAGCTTC (835) | 0.62 | 2660 |
| | pvu-miR159a.1 | TTTGGATTGAAGGGAGCTCTA (836) | 0.86 | 2661 |
| | pvu-miR159a.2 | CTTCCATATCTGGGAGCTTC (837) | 0.62 | 2662 |
| | rco-miR159 | TTTGGATTGAAGGGAGCTCTA (838) | 0.86 | 2663 |
| | rin-miR159 | TTGGACTGAAGGGAGCTCCCT (839) | 0.86 | 2664 |
| | sar-miR159 | TTTGGATTGAAGGGAGCTCTG (840) | 0.86 | 2665 |
| | sbi-miR159a | TTTGGATTGAAGGGAGCTCTG (841) | 0.86 | 2666 |
| | sbi-miR159b | CTTGGATTGAAGGGAGCTCCT (842) | 0.95 | 2667 |
| | sly-miR159 | TTTGGATTGAAGGGAGCTCTA (843) | 0.86 | 2668 |
| | smo-miR159 | CTTGGATTGAAGGGAGCTCCC (844) | 0.9 | 2669 |
| | sof-miR159a | TTTGGATTGAAGGGAGCTCTG (845) | 0.86 | 2670 |
| | sof-miR159b | TTTGGATTGAAGGGAGCTCTG (846) | 0.86 | 2671 |
| | sof-miR159c | CTTGGATTGAAGGGAGCTCCT (847) | 0.95 | 2672 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | sof-miR159d | TTTGGATTGAAGGGAGCTCTG (848) | 0.86 | 2673 |
| | sof-miR159e | TTTGGATTGAAAGGAGCTCTT (849) | 0.86 | 2674 |
| | spr-miR159 | TTTGGATTGAAGGGAGCTCTG (850) | 0.86 | 2675 |
| | ssp-miR159a | TTTGGATTGAAGGGAGCTCTG (851) | 0.86 | 2676 |
| | svi-miR159 | TTGGACTGAAGGGAGCTCCCT (852) | 0.86 | 2677 |
| | tae-miR159a | TTTGGATTGAAGGGAGCTCTG (853) | 0.86 | 2678 |
| | tae-miR159b | TTTGGATTGAAGGGAGCTCTG (854) | 0.86 | 2679 |
| | tar-miR159 | TTGGACTGAAGGGAGCTCCCT (855) | 0.86 | 2680 |
| | vvi-miR159a | CTTGGAGTGAAGGGAGCTCTC (856) | 0.81 | 2681 |
| | vvi-miR159b | CTTGGAGTGAAGGGAGCTCTC (857) | 0.81 | 2682 |
| | vvi-miR159c | TTTGGATTGAAGGGAGCTCTA (858) | 0.86 | 2683 |
| | zma-miR159a | TTTGGATTGAAGGGAGCTCTG (859) | 0.86 | 2684 |
| | zma-miR159b | TTTGGATTGAAGGGAGCTCTG (860) | 0.86 | 2685 |
| | zma-miR159c | CTTGGATTGAAGGGAGCTCCT (861) | 0.95 | 2686 |
| | zma-miR159d | CTTGGATTGAAGGGAGCTCCT (862) | 0.95 | 2687 |
| | zma-miR159e | ATTGGTTTGAAGGGAGCTCCA (863) | 0.9 | 2688 |
| | zma-miR159f | TTTGGATTGAAGGGAGCTCTG (864) | 0.86 | 2689 |
| | zma-miR159g | TTTGGAGTGAAGGGAGTTCTG (865) | 0.76 | 2690 |
| | zma-miR159h | TTTGGAGTGAAGGGAGCTCTG (866) | 0.81 | 2691 |
| | zma-miR159i | TTTGGAGTGAAGGGAGCTCTG (867) | 0.81 | 2692 |
| | zma-miR159j | TTTGGATTGAAGGGAGCTCTG (868) | 0.86 | 2693 |
| | zma-miR159k | TTTGGATTGAAGGGAGCTCTG (869) | 0.86 | 2694 |
| | zma-miR159m | TTTGGATTGAAGGGAGCTCTG (870) | 0.86 | 2695 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| osa-miR159f | acb-miR159 | TTGGACTGAAGGGAGCTCCCT (871) | 0.81 | 2696 |
| | aha-miR159 | TTGGACTGAAGGGAGCTCCCT (872) | 0.81 | 2697 |
| | ahi-miR159 | TTGGACTGAAGGGAGCTCCCT (873) | 0.81 | 2698 |
| | ahy-miR159 | TTTGGATTGAAGGGAGCTCTA (874) | 0.95 | 2699 |
| | aly-miR159a | TTTGGATTGAAGGGAGCTCTA (875) | 0.95 | 2700 |
| | aly-miR159b | TTTGGATTGAAGGGAGCTCTT (876) | 0.9 | 2701 |
| | aly-miR159c | TTTGGATTGAAGGGAGCTCCT (877) | 0.86 | 2702 |
| | ape-miR159 | TTGGACTGAAGGGAGCTCCCT (878) | 0.81 | 2703 |
| | aqc-miR159 | TTTGGACTGAAGGGAGCTCTA (879) | 0.9 | 2704 |
| | ath-miR159a | TTTGGATTGAAGGGAGCTCTA (880) | 0.95 | 2705 |
| | ath-miR159b | TTTGGATTGAAGGGAGCTCTT (881) | 0.9 | 2706 |
| | ath-miR159c | TTTGGATTGAAGGGAGCTCCT (882) | 0.86 | 2707 |
| | bdi-miR159 | CTTGGATTGAAGGGAGCTCT (883) | 0.95 | 2708 |
| | bna-miR159 | TTTGGATTGAAGGGAGCTCTA (884) | 0.95 | 2709 |
| | bra-miR159a | TTTGGATTGAAGGGAGCTCTA (885) | 0.95 | 2710 |
| | bvl-miR159 | TTGGACTGAAGGGAGCTCCCT (886) | 0.81 | 2711 |
| | cmi-miR159 | TTGGACTGAAGGGAGCTCCCT (887) | 0.81 | 2712 |
| | cor-miR159 | TTGGACTGAAGGGAGCTCCCT (888) | 0.81 | 2713 |
| | crb-miR159 | TTGGACTGAAGGGAGCTCCCT (889) | 0.81 | 2714 |
| | csi-miR159 | TTTGGATTGAAGGGAGCTCTA (890) | 0.95 | 2715 |
| | dso-miR159 | TTGGACTGAAGGGAGCTCCCT (891) | 0.81 | 2716 |
| | ech-miR159 | TTGGACTGAAGGGAGCTCCCT (892) | 0.81 | 2717 |
| | fal-miR159 | TTGGACTGAAGGGAGCTCCCT (893) | 0.81 | 2718 |
| | far-miR159 | TTTGGATTGAAGGGAGCTCTG (894) | 0.9 | 2719 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | gma-miR159a-3p | TTTGGATTGAAGGGAGCTCTA (895) | 0.95 | 2720 |
| | gma-miR159b | ATTGGAGTGAAGGGAGCTCCA (896) | 0.86 | 2721 |
| | gma-miR159c | ATTGGAGTGAAGGGAGCTCCG (897) | 0.81 | 2722 |
| | hvu-miR159a | TTTGGATTGAAGGGAGCTCTG (898) | 0.9 | 2723 |
| | hvu-miR159b | TTTGGATTGAAGGGAGCTCTG (899) | 0.9 | 2724 |
| | hvv-miR159a | TTTGGATTGAAGGGAGCTCTG (900) | 0.9 | 2725 |
| | hvv-miR159b | TTTGGATTGAAGGGAGCTCTG (901) | 0.9 | 2726 |
| | ltu-miR159 | TTTGGATTGAAGGGAGCTCTA (902) | 0.95 | 2727 |
| | mma-miR159 | TTGGACTGAAGGGAGCTCCCT (903) | 0.81 | 2728 |
| | mtr-miR159a | TTTGGATTGAAGGGAGCTCTA (904) | 0.95 | 2729 |
| | mtr-miR159b | ATTGAATTGAAGGGAGCAACT (905) | 0.71 | 2730 |
| | mtr-miR159c | TTTGGATTGAAGGGAGCTCTA (906) | 0.95 | 2731 |
| | nof-miR159 | TTGGACTGAAGGGAGCTCCCT (907) | 0.81 | 2732 |
| | oru-miR159 | TTTGGATTGAAGGGAGCTCTG (908) | 0.9 | 2733 |
| | osa-miR159a | TTTGGATTGAAGGGAGCTCTG (909) | 0.9 | 2734 |
| | osa-miR159a.1 | TTTGGATTGAAGGGAGCTCTG (910) | 0.9 | 2735 |
| | osa-miR159b | TTTGGATTGAAGGGAGCTCTG (911) | 0.9 | 2736 |
| | osa-miR159c | ATTGGATTGAAGGGAGCTCCA (912) | 0.9 | 2737 |
| | osa-miR159d | ATTGGATTGAAGGGAGCTCCG (913) | 0.86 | 2738 |
| | osa-miR159e | ATTGGATTGAAGGGAGCTCCT (914) | 0.86 | 2739 |
| | osa-miR159m | TTTGGATTGAAGGGAGCTCTG (915) | 0.9 | 2740 |
| | pgl-miR159 | TTTGGATTGAAGGGAGCTCTG (916) | 0.9 | 2741 |
| | psi-miR159 | CTTGGATTGAAGGGAGCTCCA (917) | 0.95 | 2742 |
| | pta-miR159a | TTGGATTGAAGGGAGCTCCA (918) | 0.9 | 2743 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | pta-miR159b | TTGGATTGAAGAGAGCTCCC (919) | 0.81 | 2744 |
| | pta-miR159c | CTTGGATTGAAGGGAGCTCCC (920) | 0.9 | 2745 |
| | ptc-miR159a | TTTGGATTGAAGGGAGCTCTA (921) | 0.95 | 2746 |
| | ptc-miR159b | TTTGGATTGAAGGGAGCTCTA (922) | 0.95 | 2747 |
| | ptc-miR159c | TTTGGATTGAAGGGAGCTCTA (923) | 0.95 | 2748 |
| | ptc-miR159d | CTTGGATTGAAGGGAGCTCCT (924) | 0.9 | 2749 |
| | ptc-miR159e | CTTGGGGTGAAGGGAGCTCCT (925) | 0.81 | 2750 |
| | ptc-miR159f | ATTGGAGTGAAGGGAGCTCGA (926) | 0.86 | 2751 |
| | pvu-miR159 | TTTGGATTGAAGGGAGCTCTA (927) | 0.95 | 2752 |
| | pvu-miR159.2 | CTTCCATATCTGGGAGCTTC (928) | 0.62 | 2753 |
| | pvu-miR159a.1 | TTTGGATTGAAGGGAGCTCTA (929) | 0.95 | 2754 |
| | pvu-miR159a.2 | CTTCCATATCTGGGAGCTTC (930) | 0.62 | 2755 |
| | rco-miR159 | TTTGGATTGAAGGGAGCTCTA (931) | 0.95 | 2756 |
| | rin-miR159 | TTGGACTGAAGGGAGCTCCCT (932) | 0.81 | 2757 |
| | sar-miR159 | TTTGGATTGAAGGGAGCTCTG (933) | 0.9 | 2758 |
| | sbi-miR159a | TTTGGATTGAAGGGAGCTCTG (934) | 0.9 | 2759 |
| | sbi-miR159b | CTTGGATTGAAGGGAGCTCCT (935) | 0.9 | 2760 |
| | sly-miR159 | TTTGGATTGAAGGGAGCTCTA (936) | 0.95 | 2761 |
| | smo-miR159 | CTTGGATTGAAGGGAGCTCCC (937) | 0.9 | 2762 |
| | sof-miR159a | TTTGGATTGAAGGGAGCTCTG (938) | 0.9 | 2763 |
| | sof-miR159b | TTTGGATTGAAGGGAGCTCTG (939) | 0.9 | 2764 |
| | sof-miR159c | CTTGGATTGAAGGGAGCTCCT (940) | 0.9 | 2765 |
| | sof-miR159d | TTTGGATTGAAGGGAGCTCTG (941) | 0.9 | 2766 |
| | sof-miR159e | TTTGGATTGAAAGGAGCTCTT (942) | 0.86 | 2767 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | spr-miR159 | TTTGGATTGAAGGGAGCTCTG (943) | 0.9 | 2768 |
| | ssp-miR159a | TTTGGATTGAAGGGAGCTCTG (944) | 0.9 | 2769 |
| | svi-miR159 | TTGGACTGAAGGGAGCTCCCT (945) | 0.81 | 2770 |
| | tae-miR159a | TTTGGATTGAAGGGAGCTCTG (946) | 0.9 | 2771 |
| | tae-miR159b | TTTGGATTGAAGGGAGCTCTG (947) | 0.9 | 2772 |
| | tar-miR159 | TTGGACTGAAGGGAGCTCCCT (948) | 0.81 | 2773 |
| | vvi-miR159a | CTTGGAGTGAAGGGAGCTCTC (949) | 0.9 | 2774 |
| | vvi-miR159b | CTTGGAGTGAAGGGAGCTCTC (950) | 0.9 | 2775 |
| | vvi-miR159c | TTTGGATTGAAGGGAGCTCTA (951) | 0.95 | 2776 |
| | zma-miR159a | TTTGGATTGAAGGGAGCTCTG (952) | 0.9 | 2777 |
| | zma-miR159b | TTTGGATTGAAGGGAGCTCTG (953) | 0.9 | 2778 |
| | zma-miR159c | CTTGGATTGAAGGGAGCTCCT (954) | 0.9 | 2779 |
| | zma-miR159d | CTTGGATTGAAGGGAGCTCCT (955) | 0.9 | 2780 |
| | zma-miR159e | ATTGGTTTGAAGGGAGCTCCA (956) | 0.86 | 2781 |
| | zma-miR159f | TTTGGATTGAAGGGAGCTCTG (957) | 0.9 | 2782 |
| | zma-miR159g | TTTGGAGTGAAGGGAGTTCTG (958) | 0.81 | 2783 |
| | zma-miR159h | TTTGGAGTGAAGGGAGCTCTG (959) | 0.86 | 2784 |
| | zma-miR159i | TTTGGAGTGAAGGGAGCTCTG (960) | 0.86 | 2785 |
| | zma-miR159j | TTTGGATTGAAGGGAGCTCTG (961) | 0.9 | 2786 |
| | zma-miR159k | TTTGGATTGAAGGGAGCTCTG (962) | 0.9 | 2787 |
| | zma-miR159m | TTTGGATTGAAGGGAGCTCTG (963) | 0.9 | 2788 |
| osa-miR1858a | osa-miR1858b | GAGAGGAGGACGGAGTGGGGC (964) | 1 | 2789 |
| psi-miR159 | acb-miR159 | TTGGACTGAAGGGAGCTCCCT (965) | 0.86 | 2790 |
| | aha-miR159 | TTGGACTGAAGGGAGCTCCCT (966) | 0.86 | 2791 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ahi-miR159 | TTGGACTGAAGGGAGCTCCCT (967) | 0.86 | 2792 |
| | ahy-miR159 | TTTGGATTGAAGGGAGCTCTA (968) | 0.9 | 2793 |
| | aly-miR159a | TTTGGATTGAAGGGAGCTCTA (969) | 0.9 | 2794 |
| | aly-miR159b | TTTGGATTGAAGGGAGCTCTT (970) | 0.86 | 2795 |
| | aly-miR159c | TTTGGATTGAAGGGAGCTCCT (971) | 0.9 | 2796 |
| | ape-miR159 | TTGGACTGAAGGGAGCTCCCT (972) | 0.86 | 2797 |
| | aqc-miR159 | TTTGGACTGAAGGGAGCTCTA (973) | 0.86 | 2798 |
| | ath-miR159a | TTTGGATTGAAGGGAGCTCTA (974) | 0.9 | 2799 |
| | ath-miR159b | TTTGGATTGAAGGGAGCTCTT (975) | 0.86 | 2800 |
| | ath-miR159c | TTTGGATTGAAGGGAGCTCCT (976) | 0.9 | 2801 |
| | bdi-miR159 | CTTGGATTGAAGGGAGCTCT (977) | 0.9 | 2802 |
| | bna-miR159 | TTTGGATTGAAGGGAGCTCTA (978) | 0.9 | 2803 |
| | bra-miR159a | TTTGGATTGAAGGGAGCTCTA (979) | 0.9 | 2804 |
| | bvl-miR159 | TTGGACTGAAGGGAGCTCCCT (980) | 0.86 | 2805 |
| | cmi-miR159 | TTGGACTGAAGGGAGCTCCCT (981) | 0.86 | 2806 |
| | cor-miR159 | TTGGACTGAAGGGAGCTCCCT (982) | 0.86 | 2807 |
| | crb-miR159 | TTGGACTGAAGGGAGCTCCCT (983) | 0.86 | 2808 |
| | csi-miR159 | TTTGGATTGAAGGGAGCTCTA (984) | 0.9 | 2809 |
| | dso-miR159 | TTGGACTGAAGGGAGCTCCCT (985) | 0.86 | 2810 |
| | ech-miR159 | TTGGACTGAAGGGAGCTCCCT (986) | 0.86 | 2811 |
| | fal-miR159 | TTGGACTGAAGGGAGCTCCCT (987) | 0.86 | 2812 |
| | far-miR159 | TTTGGATTGAAGGGAGCTCTG (988) | 0.86 | 2813 |
| | gma-miR159a-3p | TTTGGATTGAAGGGAGCTCTA (989) | 0.9 | 2814 |
| | gma-miR159b | ATTGGAGTGAAGGGAGCTCCA (990) | 0.9 | 2815 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | gma-miR159c | ATTGGAGTGAAGGGAGCTCCG (991) | 0.86 | 2816 |
| | hvu-miR159a | TTTGGATTGAAGGGAGCTCTG (992) | 0.86 | 2817 |
| | hvu-miR159b | TTTGGATTGAAGGGAGCTCTG (993) | 0.86 | 2818 |
| | hvv-miR159a | TTTGGATTGAAGGGAGCTCTG (994) | 0.86 | 2819 |
| | hvv-miR159b | TTTGGATTGAAGGGAGCTCTG (995) | 0.86 | 2820 |
| | ltu-miR159 | TTTGGATTGAAGGGAGCTCTA (996) | 0.9 | 2821 |
| | mma-miR159 | TTGGACTGAAGGGAGCTCCCT (997) | 0.86 | 2822 |
| | mtr-miR159a | TTTGGATTGAAGGGAGCTCTA (998) | 0.9 | 2823 |
| | mtr-miR159b | ATTGAATTGAAGGGAGCAACT (999) | 0.76 | 2824 |
| | mtr-miR159c | TTTGGATTGAAGGGAGCTCTA (1000) | 0.9 | 2825 |
| | nof-miR159 | TTGGACTGAAGGGAGCTCCCT (1001) | 0.86 | 2826 |
| | oru-miR159 | TTTGGATTGAAGGGAGCTCTG (1002) | 0.86 | 2827 |
| | osa-miR159a | TTTGGATTGAAGGGAGCTCTG (1003) | 0.86 | 2828 |
| | osa-miR159a.1 | TTTGGATTGAAGGGAGCTCTG (1004) | 0.86 | 2829 |
| | osa-miR159a.2 | TTGCATGCCCCAGGAGCTGCA (1005) | 0.62 | 2830 |
| | osa-miR159b | TTTGGATTGAAGGGAGCTCTG (1006) | 0.86 | 2831 |
| | osa-miR159c | ATTGGATTGAAGGGAGCTCCA (1007) | 0.95 | 2832 |
| | osa-miR159d | ATTGGATTGAAGGGAGCTCCG (1008) | 0.9 | 2833 |
| | osa-miR159e | ATTGGATTGAAGGGAGCTCCT (1009) | 0.9 | 2834 |
| | osa-miR159f | CTTGGATTGAAGGGAGCTCTA (1010) | 0.95 | 2835 |
| | osa-miR159m | TTTGGATTGAAGGGAGCTCTG (1011) | 0.86 | 2836 |
| | pgl-miR159 | TTTGGATTGAAGGGAGCTCTG (1012) | 0.86 | 2837 |
| | pta-miR159a | TTGGATTGAAGGGAGCTCCA (1013) | 0.95 | 2838 |
| | pta-miR159b | TTGGATTGAAGAGAGCTCCC (1014) | 0.86 | 2839 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | pta-miR159c | CTTGGATTGAAGGGAGC TCCC (1015) | 0.95 | 2840 |
| | ptc-miR159a | TTTGGATTGAAGGGAGC TCTA (1016) | 0.9 | 2841 |
| | ptc-miR159b | TTTGGATTGAAGGGAGC TCTA (1017) | 0.9 | 2842 |
| | ptc-miR159c | TTTGGATTGAAGGGAGC TCTA (1018) | 0.9 | 2843 |
| | ptc-miR159d | CTTGGATTGAAGGGAGC TCCT (1019) | 0.95 | 2844 |
| | ptc-miR159e | CTTGGGGTGAAGGGAG CTCCT (1020) | 0.86 | 2845 |
| | ptc-miR159f | ATTGGAGTGAAGGGAG CTCGA (1021) | 0.86 | 2846 |
| | pvu-miR159 | TTTGGATTGAAGGGAGC TCTA (1022) | 0.9 | 2847 |
| | pvu-miR159.2 | CTTCCATATCTGGGGAG CTTC (1023) | 0.67 | 2848 |
| | pvu-miR159a.1 | TTTGGATTGAAGGGAGC TCTA (1024) | 0.9 | 2849 |
| | pvu-miR159a.2 | CTTCCATATCTGGGGAG CTTC (1025) | 0.67 | 2850 |
| | rco-miR159 | TTTGGATTGAAGGGAGC TCTA (1026) | 0.9 | 2851 |
| | rin-miR159 | TTGGACTGAAGGGAGCT CCCT (1027) | 0.86 | 2852 |
| | sar-miR159 | TTTGGATTGAAGGGAGC TCTG (1028) | 0.86 | 2853 |
| | sbi-miR159a | TTTGGATTGAAGGGAGC TCTG (1029) | 0.86 | 2854 |
| | sbi-miR159b | CTTGGATTGAAGGGAGC TCCT (1030) | 0.95 | 2855 |
| | sly-miR159 | TTTGGATTGAAGGGAGC TCTA (1031) | 0.9 | 2856 |
| | smo-miR159 | CTTGGATTGAAGGGAGC TCCC (1032) | 0.95 | 2857 |
| | sof-miR159a | TTTGGATTGAAGGGAGC TCTG (1033) | 0.86 | 2858 |
| | sof-miR159b | TTTGGATTGAAGGGAGC TCTG (1034) | 0.86 | 2859 |
| | sof-miR159c | CTTGGATTGAAGGGAGC TCCT (1035) | 0.95 | 2860 |
| | sof-miR159d | TTTGGATTGAAGGGAGC TCTG (1036) | 0.86 | 2861 |
| | sof-miR159e | TTTGGATTGAAAGGAGC TCTT (1037) | 0.81 | 2862 |
| | spr-miR159 | TTTGGATTGAAGGGAGC TCTG (1038) | 0.86 | 2863 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
| --- | --- | --- | --- | --- |
| | ssp-miR159a | TTTGGATTGAAGGGAGCTCTG (1039) | 0.86 | 2864 |
| | svi-miR159 | TTGGACTGAAGGGAGCTCCCT (1040) | 0.86 | 2865 |
| | tae-miR159a | TTTGGATTGAAGGGAGCTCTG (1041) | 0.86 | 2866 |
| | tae-miR159b | TTTGGATTGAAGGGAGCTCTG (1042) | 0.86 | 2867 |
| | tar-miR159 | TTGGACTGAAGGGAGCTCCCT (1043) | 0.86 | 2868 |
| | vvi-miR159a | CTTGGAGTGAAGGGAGCTCTC (1044) | 0.86 | 2869 |
| | vvi-miR159b | CTTGGAGTGAAGGGAGCTCTC (1045) | 0.86 | 2870 |
| | vvi-miR159c | TTTGGATTGAAGGGAGCTCTA (1046) | 0.9 | 2871 |
| | zma-miR159a | TTTGGATTGAAGGGAGCTCTG (1047) | 0.86 | 2872 |
| | zma-miR159b | TTTGGATTGAAGGGAGCTCTG (1048) | 0.86 | 2873 |
| | zma-miR159c | CTTGGATTGAAGGGAGCTCCT (1049) | 0.95 | 2874 |
| | zma-miR159d | CTTGGATTGAAGGGAGCTCCT (1050) | 0.95 | 2875 |
| | zma-miR159e | ATTGGTTTGAAGGGAGCTCCA (1051) | 0.9 | 2876 |
| | zma-miR159f | TTTGGATTGAAGGGAGCTCTG (1052) | 0.86 | 2877 |
| | zma-miR159g | TTTGGAGTGAAGGGAGTTCTG (1053) | 0.76 | 2878 |
| | zma-miR159h | TTTGGAGTGAAGGGAGCTCTG (1054) | 0.81 | 2879 |
| | zma-miR159i | TTTGGAGTGAAGGGAGCTCTG (1055) | 0.81 | 2880 |
| | zma-miR159j | TTTGGATTGAAGGGAGCTCTG (1056) | 0.86 | 2881 |
| | zma-miR159k | TTTGGATTGAAGGGAGCTCTG (1057) | 0.86 | 2882 |
| | zma-miR159m | TTTGGATTGAAGGGAGCTCTG (1058) | 0.86 | 2883 |
| pta-miR156a | ahy-miR156a | TGACAGAAGAGAGAGCAC (1059) | 0.8 | 2884 |
| | ahy-miR156b-5p | TTGACAGAAGATAGAGAGCAC (1060) | 0.85 | 2885 |
| | ahy-miR156c | TTGACAGAAGAGAGAGCAC (1061) | 0.8 | 2886 |
| | aly-miR156a | TGACAGAAGAGAGTGAGCAC (1062) | 0.75 | 2887 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | aly-miR156b | TGACAGAAGAGAGTGAGCAC (1063) | 0.75 | 2888 |
| | aly-miR156c | TGACAGAAGAGAGTGAGCAC (1064) | 0.75 | 2889 |
| | aly-miR156d | TGACAGAAGAGAGTGAGCAC (1065) | 0.75 | 2890 |
| | aly-miR156e | TGACAGAAGAGAGTGAGCAC (1066) | 0.75 | 2891 |
| | aly-miR156f | TGACAGAAGAGAGTGAGCAC (1067) | 0.75 | 2892 |
| | aly-miR156g | CGACAGAAGAGAGTGAGCAC (1068) | 0.75 | 2893 |
| | aly-miR156h | TGACAGAAGAAAGAGAGCAC (1069) | 0.8 | 2894 |
| | aqc-miR156a | TGACAGAAGATAGAGAGCAC (1070) | 0.85 | 2895 |
| | aqc-miR156b | TGACAGAAGATAGAGAGCAC (1071) | 0.85 | 2896 |
| | ath-miR156a | TGACAGAAGAGAGTGAGCAC (1072) | 0.75 | 2897 |
| | ath-miR156b | TGACAGAAGAGAGTGAGCAC (1073) | 0.75 | 2898 |
| | ath-miR156c | TGACAGAAGAGAGTGAGCAC (1074) | 0.75 | 2899 |
| | ath-miR156d | TGACAGAAGAGAGTGAGCAC (1075) | 0.75 | 2900 |
| | ath-miR156e | TGACAGAAGAGAGTGAGCAC (1076) | 0.75 | 2901 |
| | ath-miR156f | TGACAGAAGAGAGTGAGCAC (1077) | 0.75 | 2902 |
| | ath-miR156g | CGACAGAAGAGAGTGAGCAC (1078) | 0.75 | 2903 |
| | ath-miR156h | TGACAGAAGAAAGAGAGCAC (1079) | 0.8 | 2904 |
| | ath-miR156m | TGACAGAAGAGAGAGAGCAC (1080) | 0.8 | 2905 |
| | ath-miR156o | TGACAGAAGAGAGAGAGCAC (1081) | 0.8 | 2906 |
| | ath-miR156p | TGACAGAAGAGAGAGAGCAC (1082) | 0.8 | 2907 |
| | ath-miR156q | TGACAGAAGAGAGAGAGCAC (1083) | 0.8 | 2908 |
| | ath-miR156r | TGACAGAAGAGAGAGAGCAC (1084) | 0.8 | 2909 |
| | ath-miR156s | TGACAGAAGAGAGAGAGCAC (1085) | 0.8 | 2910 |
| | bdi-miR156 | TGACAGAAGAGAGAGAGCACA (1086) | 0.85 | 2911 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | bdi-miR156b | TGACAGAAGAGAGTGAGCAC (1087) | 0.75 | 2912 |
| | bdi-miR156c | TGACAGAAGAGAGTGAGCAC (1088) | 0.75 | 2913 |
| | bdi-miR156d | TGACAGAAGAGAGTGAGCAC (1089) | 0.75 | 2914 |
| | bna-miR156a | TGACAGAAGAGAGTGAGCACA (1090) | 0.8 | 2915 |
| | bna-miR156b | TTGACAGAAGATAGAGAGCAC (1091) | 0.85 | 2916 |
| | bna-miR156c | TTGACAGAAGATAGAGAGCAC (1092) | 0.85 | 2917 |
| | can-miR156a | TGACAGAAGAGAGAGAGCAC (1093) | 0.8 | 2918 |
| | can-miR156b | TGACAGAAGAGAGGGAGCAC (1094) | 0.75 | 2919 |
| | cpt-miR156a | TGACAGAAGAGAGTGAGCAC (1095) | 0.75 | 2920 |
| | cpt-miR156b | TGACAGAAGAGAGAGAGCAC (1096) | 0.8 | 2921 |
| | cru-miR156 | TGACAGAAGAGAGAGAGCAC (1097) | 0.8 | 2922 |
| | csi-miR156 | TGACAGAAGAGAGTGAGCAC (1098) | 0.75 | 2923 |
| | csi-miR156a | TGACAGAAGAGAGAGAGCAC (1099) | 0.8 | 2924 |
| | csi-miR156b | TGACAGAAGAGAGAGAGCAC (1100) | 0.8 | 2925 |
| | ctr-miR156 | TGACAGAAGAGAGTGAGCAC (1101) | 0.75 | 2926 |
| | eca-miR156 | TGACAGAAGAGAGAGAGCAC (1102) | 0.8 | 2927 |
| | far-miR156a | TGACAGAAGAGAGAGAGCACA (1103) | 0.85 | 2928 |
| | far-miR156b | TTGACAGAAGAGAGAGAGCAC (1104) | 0.8 | 2929 |
| | ghr-miR156a | TGACAGAAGAGAGTGAGCAC (1105) | 0.75 | 2930 |
| | ghr-miR156b | TGACAGAAGAGAGTGAGCAC (1106) | 0.75 | 2931 |
| | ghr-miR156c | TGTCAGAAGAGAGTGAGCAC (1107) | 0.75 | 2932 |
| | ghr-miR156d | TGACAGAAGAGAGTGAGCAC (1108) | 0.75 | 2933 |
| | gma-miR156a | TGACAGAAGAGAGTGAGCAC (1109) | 0.75 | 2934 |
| | gma-miR156b | TGACAGAAGAGAGAGAGCACA (1110) | 0.85 | 2935 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | gma-miR156c | TTGACAGAAGATAGAGAGCAC (1111) | 0.85 | 2936 |
| | gma-miR156d | TTGACAGAAGATAGAGAGCAC (1112) | 0.85 | 2937 |
| | gma-miR156e | TTGACAGAAGATAGAGAGCAC (1113) | 0.85 | 2938 |
| | gma-miR156f | TTGACAGAAGAGAGAGAGCACA (1114) | 0.85 | 2939 |
| | gma-miR156g | ACAGAAGATAGAGAGCACAG (1115) | 0.9 | 2940 |
| | gma-miR156h | TGACAGAAGAGAGAGAGCAC (1116) | 0.8 | 2941 |
| | gma-miR156i | TGACAGAAGAGAGAGAGCAC (1117) | 0.8 | 2942 |
| | han-miR156 | TGACAGAAGAGAGAGAGCAC (1118) | 0.8 | 2943 |
| | hvs-miR156 | TGACAGAAGAGAGAGAGCAC (1119) | 0.8 | 2944 |
| | hvu-miR156 | TGACAGAAGAGAGTGAGCACA (1120) | 0.8 | 2945 |
| | hvv-miR156a | TGACAGAAGAGAGTGAGCAC (1121) | 0.75 | 2946 |
| | hvv-miR156b | TGACAGAAGAGAGAGAGCAC (1122) | 0.8 | 2947 |
| | hvv-miR156c | TGACAGAAGAGAGAGAGCAC (1123) | 0.8 | 2948 |
| | hvv-miR156d | TGACAGAAGAGAGAGAGCAC (1124) | 0.8 | 2949 |
| | lja-miR156 | TGACAGAAGAGAGAGAGCAC (1125) | 0.8 | 2950 |
| | lsa-miR156 | TGACAGAAGAGAGAGAGCAC (1126) | 0.8 | 2951 |
| | mdo-miR156a | TGACAGAAGAGAGAGAGCAC (1127) | 0.8 | 2952 |
| | mdo-miR156b | TGACAGAAGAGAGAGAGCAC (1128) | 0.8 | 2953 |
| | mtr-miR156 | TGACAGAAGAGAGAGAGCACA (1129) | 0.85 | 2954 |
| | mtr-miR156b | TGACAGAAGAGAGTGAGCAC (1130) | 0.75 | 2955 |
| | mtr-miR156c | TGACAGAAGAGAGTGAGCAC (1131) | 0.75 | 2956 |
| | mtr-miR156d | TGACAGAAGAGAGTGAGCAC (1132) | 0.75 | 2957 |
| | mtr-miR156e | TTGACAGAAGATAGAGAGCAC (1133) | 0.85 | 2958 |
| | mtr-miR156f | TTGACAGAAGATAGAGAGCAC (1134) | 0.85 | 2959 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | mtr-miR156g | TTGACAGAAGATAGAGGGCAC (1135) | 0.8 | 2960 |
| | mtr-miR156h | TTGACAGAAGATAGAGAGCAC (1136) | 0.85 | 2961 |
| | mtr-miR156i | TGACAGAAGAGAGTGAGCAC (1137) | 0.75 | 2962 |
| | nbe-miR156a | TGACAGAAGAGAGAGAGCAC (1138) | 0.8 | 2963 |
| | nbe-miR156b | TGACAGAAGAGAGAGAGCAC (1139) | 0.8 | 2964 |
| | oru-miR156 | TGACAGAAGAGAGTGAGCAC (1140) | 0.75 | 2965 |
| | osa-miR156a | TGACAGAAGAGAGTGAGCAC (1141) | 0.75 | 2966 |
| | osa-miR156b | TGACAGAAGAGAGTGAGCAC (1142) | 0.75 | 2967 |
| | osa-miR156c | TGACAGAAGAGAGTGAGCAC (1143) | 0.75 | 2968 |
| | osa-miR156d | TGACAGAAGAGAGTGAGCAC (1144) | 0.75 | 2969 |
| | osa-miR156e | TGACAGAAGAGAGTGAGCAC (1145) | 0.75 | 2970 |
| | osa-miR156f | TGACAGAAGAGAGTGAGCAC (1146) | 0.75 | 2971 |
| | osa-miR156g | TGACAGAAGAGAGTGAGCAC (1147) | 0.75 | 2972 |
| | osa-miR156h | TGACAGAAGAGAGTGAGCAC (1148) | 0.75 | 2973 |
| | osa-miR156i | TGACAGAAGAGAGTGAGCAC (1149) | 0.75 | 2974 |
| | osa-miR156j | TGACAGAAGAGAGTGAGCAC (1150) | 0.75 | 2975 |
| | osa-miR156k | TGACAGAAGAGAGAGAGCACA (1151) | 0.85 | 2976 |
| | osa-miR156l | CGACAGAAGAGAGTGAGCATA (1152) | 0.75 | 2977 |
| | osa-miR156m | TGACAGAAGAGAGTGAGCAC (1153) | 0.75 | 2978 |
| | osa-miR156n | TGACAGAAGAGAGTGAGCAC (1154) | 0.75 | 2979 |
| | osa-miR156o | TGACAGAAGAGAGTGAGCAT (1155) | 0.7 | 2980 |
| | osa-miR156p | TGACAGAAGAGAGTGAGCTC (1156) | 0.7 | 2981 |
| | osa-miR156q | TGACAGAACAGAGTGAGCAC (1157) | 0.7 | 2982 |
| | osa-miR156r | TGACAGAAGAGAGAGAGCAC (1158) | 0.8 | 2983 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | par-miR156 | TGACAGAAGAGAGAGAGCAC (1159) | 0.8 | 2984 |
| | ppd-miR156 | TGACAGAAGAGAGAGAGCAC (1160) | 0.8 | 2985 |
| | ppr-miR156 | TGACAGAAGAGAGTGAGCAC (1161) | 0.75 | 2986 |
| | ppt-miR156a | TGACAGAAGAGAGTGAGCAC (1162) | 0.75 | 2987 |
| | ppt-miR156b | TGACAGAAGAGAGTGAGCAC (1163) | 0.75 | 2988 |
| | ppt-miR156c | TGACAGAAGAGAGTGAGCAC (1164) | 0.75 | 2989 |
| | pta-miR156b | CAGAAGATAGAGAGCACAAC (1165) | 0.95 | 2990 |
| | ptc-miR156a | TGACAGAAGAGAGTGAGCAC (1166) | 0.75 | 2991 |
| | ptc-miR156b | TGACAGAAGAGAGTGAGCAC (1167) | 0.75 | 2992 |
| | ptc-miR156c | TGACAGAAGAGAGTGAGCAC (1168) | 0.75 | 2993 |
| | ptc-miR156d | TGACAGAAGAGAGTGAGCAC (1169) | 0.75 | 2994 |
| | ptc-miR156e | TGACAGAAGAGAGTGAGCAC (1170) | 0.75 | 2995 |
| | ptc-miR156f | TGACAGAAGAGAGTGAGCAC (1171) | 0.75 | 2996 |
| | ptc-miR156g | TTGACAGAAGATAGAGAGCAC (1172) | 0.85 | 2997 |
| | ptc-miR156h | TTGACAGAAGATAGAGAGCAC (1173) | 0.85 | 2998 |
| | ptc-miR156i | TTGACAGAAGATAGAGAGCAC (1174) | 0.85 | 2999 |
| | ptc-miR156j | TTGACAGAAGATAGAGAGCAC (1175) | 0.85 | 3000 |
| | ptc-miR156k | TGACAGAAGAGAGGGAGCAC (1176) | 0.75 | 3001 |
| | ptr-miR156 | TGACAGAAGAGAGAGAGCAC (1177) | 0.8 | 3002 |
| | pts-miR156a | TGACAGAAGAGAGTGAGCGC (1178) | 0.7 | 3003 |
| | pts-miR156b | TGACAGAAGAGAGAGAGCAC (1179) | 0.8 | 3004 |
| | pts-miR156c | TGACAGAAGAGAGAGAGCAC (1180) | 0.8 | 3005 |
| | rco-miR156a | TGACAGAAGAGAGTGAGCACA (1181) | 0.8 | 3006 |
| | rco-miR156b | TGACAGAAGAGAGTGAGCACA (1182) | 0.8 | 3007 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | rco-miR156c | TGACAGAAGAGAGTGAGCACA (1183) | 0.8 | 3008 |
| | rco-miR156d | TGACAGAAGAGAGTGAGCACA (1184) | 0.8 | 3009 |
| | rco-miR156e | TGACAGAAGAGAGAGAGCACA (1185) | 0.85 | 3010 |
| | rco-miR156f | TTGACAGAAGATAGAGAGCAC (1186) | 0.85 | 3011 |
| | rco-miR156g | TTGACAGAAGATAGAGAGCAC (1187) | 0.85 | 3012 |
| | rco-miR156h | TTGACAGAAGATAGAGAGCAC (1188) | 0.85 | 3013 |
| | sbi-miR156a | TGACAGAAGAGAGTGAGCAC (1189) | 0.75 | 3014 |
| | sbi-miR156b | TGACAGAAGAGAGTGAGCAC (1190) | 0.75 | 3015 |
| | sbi-miR156c | TGACAGAAGAGAGTGAGCAC (1191) | 0.75 | 3016 |
| | sbi-miR156d | TGACAGAAGAGAGAGAGCACA (1192) | 0.85 | 3017 |
| | sbi-miR156e | TGACAGAAGAGAGCGAGCAC (1193) | 0.75 | 3018 |
| | sbi-miR156f | TGACAGAAGAGAGTGAGCAC (1194) | 0.75 | 3019 |
| | sbi-miR156g | TGACAGAAGAGAGTGAGCAC (1195) | 0.75 | 3020 |
| | sbi-miR156h | TGACAGAAGAGAGTGAGCAC (1196) | 0.75 | 3021 |
| | sbi-miR156i | TGACAGAAGAGAGTGAGCAC (1197) | 0.75 | 3022 |
| | sin-miR156 | TGACAGAAGAGAGAGAGCAC (1198) | 0.8 | 3023 |
| | sly-miR156a | TTGACAGAAGATAGAGAGCAC (1199) | 0.85 | 3024 |
| | sly-miR156b | TTGACAGAAGATAGAGAGCAC (1200) | 0.85 | 3025 |
| | sly-miR156c | TTGACAGAAGATAGAGAGCAC (1201) | 0.85 | 3026 |
| | smo-miR156a | CGACAGAAGAGAGTGAGCAC (1202) | 0.75 | 3027 |
| | smo-miR156b | CTGACAGAAGATAGAGAGCAC (1203) | 0.85 | 3028 |
| | smo-miR156c | TTGACAGAAGAAAGAGAGCAC (1204) | 0.8 | 3029 |
| | smo-miR156d | TTGACAGAAGACAGGGAGCAC (1205) | 0.75 | 3030 |
| | sof-miR156 | TGACAGAAGAGAGTGAGCAC (1206) | 0.75 | 3031 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | sof-miR156c | TGACAGAAGAGAGAGCAC (1207) | 0.8 | 3032 |
| | sof-miR156d | TGACAGAAGAGAGAGCAC (1208) | 0.8 | 3033 |
| | sof-miR156e | TGACAGAAGAGAGAGCAC (1209) | 0.8 | 3034 |
| | sof-miR156f | TGACAGAAGAGAGAGCAC (1210) | 0.8 | 3035 |
| | sof-miR156g | TGACAGAAGAGAGAGCAC (1211) | 0.8 | 3036 |
| | sof-miR156h | TGACAGAAGAGAGAGCAC (1212) | 0.8 | 3037 |
| | sof-miR156u | TGACAGAAGAGAGAGCAC (1213) | 0.8 | 3038 |
| | spr-miR156 | TGACAGAAGAGAGAGCAC (1214) | 0.8 | 3039 |
| | ssp-miR156 | TGACAGAAGAGAGTGAGCACA (1215) | 0.8 | 3040 |
| | stu-miR156a | TGACAGAAGAGAGTGAGCAC (1216) | 0.75 | 3041 |
| | stu-miR156b | TGACAGAAGAGAGAGCAC (1217) | 0.8 | 3042 |
| | stu-miR156c | TGACAGAAGAGAGAGCAC (1218) | 0.8 | 3043 |
| | stu-miR156d | TGACAGAAGAGAGAGCAC (1219) | 0.8 | 3044 |
| | stu-miR156e | TGACAGAAGAGAGAGCAC (1220) | 0.8 | 3045 |
| | tae-miR156 | TGACAGAAGAGAGTGAGCACA (1221) | 0.8 | 3046 |
| | tae-miR156a | TGACAGAAGAGAGAGCAC (1222) | 0.8 | 3047 |
| | tae-miR156b | TGACAGAAGAGAGAGCAC (1223) | 0.8 | 3048 |
| | tcc-miR156a | TGACAGAAGAGAGAGAGCACA (1224) | 0.85 | 3049 |
| | tcc-miR156b | TGACAGAAGAGAGTGAGCAC (1225) | 0.75 | 3050 |
| | tcc-miR156c | TGACAGAAGAGAGTGAGCAC (1226) | 0.75 | 3051 |
| | tcc-miR156d | TGACAGAAGAGAGTGAGCAC (1227) | 0.75 | 3052 |
| | tcc-miR156e | TTGACAGAAGATAGAGAGCAC (1228) | 0.85 | 3053 |
| | tcc-miR156f | TTGACAGAAGATAGAGAGCAC (1229) | 0.85 | 3054 |
| | tcc-miR156g | TGACAGAAGAGAGTGAGCAC (1230) | 0.75 | 3055 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | tre-miR156 | TGACAGAAGAGAGTGAGCAC (1231) | 0.75 | 3056 |
| | vvi-miR156a | TGACAGAAGAGAGGGAGCAC (1232) | 0.75 | 3057 |
| | vvi-miR156b | TGACAGAAGAGAGTGAGCAC (1233) | 0.75 | 3058 |
| | vvi-miR156c | TGACAGAAGAGAGTGAGCAC (1234) | 0.75 | 3059 |
| | vvi-miR156d | TGACAGAAGAGAGTGAGCAC (1235) | 0.75 | 3060 |
| | vvi-miR156e | TGACAGAGGAGAGTGAGCAC (1236) | 0.7 | 3061 |
| | vvi-miR156f | TTGACAGAAGATAGAGAGCAC (1237) | 0.85 | 3062 |
| | vvi-miR156g | TTGACAGAAGATAGAGAGCAC (1238) | 0.85 | 3063 |
| | vvi-miR156h | TGACAGAAGAGAGAGAGCAT (1239) | 0.75 | 3064 |
| | vvi-miR156i | TTGACAGAAGATAGAGAGCAC (1240) | 0.85 | 3065 |
| | zel-miR156 | TGACAGAAGAGAGAGAGCAC (1241) | 0.8 | 3066 |
| | zma-miR156a | TGACAGAAGAGAGTGAGCAC (1242) | 0.75 | 3067 |
| | zma-miR156b | TGACAGAAGAGAGTGAGCAC (1243) | 0.75 | 3068 |
| | zma-miR156c | TGACAGAAGAGAGTGAGCAC (1244) | 0.75 | 3069 |
| | zma-miR156d | TGACAGAAGAGAGTGAGCAC (1245) | 0.75 | 3070 |
| | zma-miR156e | TGACAGAAGAGAGTGAGCAC (1246) | 0.75 | 3071 |
| | zma-miR156f | TGACAGAAGAGAGTGAGCAC (1247) | 0.75 | 3072 |
| | zma-miR156g | TGACAGAAGAGAGTGAGCAC (1248) | 0.75 | 3073 |
| | zma-miR156h | TGACAGAAGAGAGTGAGCAC (1249) | 0.75 | 3074 |
| | zma-miR156i | TGACAGAAGAGAGTGAGCAC (1250) | 0.75 | 3075 |
| | zma-miR156j | TGACAGAAGAGAGAGAGCACA (1251) | 0.85 | 3076 |
| | zma-miR156k | TGACAGAAGAGAGCGAGCAC (1252) | 0.75 | 3077 |
| | zma-miR156l | TGACAGAAGAGAGTGAGCAC (1253) | 0.75 | 3078 |
| | zma-miR156m | TGACAGAAGAGAGTGAGCAC (1254) | 0.75 | 3079 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | zma-miR156n | TGACAGAAGAGAGTGAGCAC (1255) | 0.75 | 3080 |
| | zma-miR156o | TGACAGAAGAGAGTGAGCAC (1256) | 0.75 | 3081 |
| | zma-miR156p | TGACAGAAGAGAGAGAGCAC (1257) | 0.8 | 3082 |
| | zma-miR156q | TGACAGAAGAGAGAGAGCAC (1258) | 0.8 | 3083 |
| | zma-miR156r | TGACAGAAGAGAGTGGGCAC (1259) | 0.7 | 3084 |
| pta-miR156b | ahy-miR156a | TGACAGAAGAGAGAGAGCAC (1260) | 0.8 | 3085 |
| | ahy-miR156b-5p | TTGACAGAAGATAGAGAGCAC (1261) | 0.85 | 3086 |
| | ahy-miR156c | TTGACAGAAGAGAGAGAGCAC (1262) | 0.8 | 3087 |
| | aly-miR156a | TGACAGAAGAGAGTGAGCAC (1263) | 0.75 | 3088 |
| | aly-miR156b | TGACAGAAGAGAGTGAGCAC (1264) | 0.75 | 3089 |
| | aly-miR156c | TGACAGAAGAGAGTGAGCAC (1265) | 0.75 | 3090 |
| | aly-miR156d | TGACAGAAGAGAGTGAGCAC (1266) | 0.75 | 3091 |
| | aly-miR156e | TGACAGAAGAGAGTGAGCAC (1267) | 0.75 | 3092 |
| | aly-miR156f | TGACAGAAGAGAGTGAGCAC (1268) | 0.75 | 3093 |
| | aly-miR156g | CGACAGAAGAGAGTGAGCAC (1269) | 0.75 | 3094 |
| | aly-miR156h | TGACAGAAGAAAGAGAGCAC (1270) | 0.8 | 3095 |
| | aqc-miR156a | TGACAGAAGATAGAGAGCAC (1271) | 0.85 | 3096 |
| | aqc-miR156b | TGACAGAAGATAGAGAGCAC (1272) | 0.85 | 3097 |
| | ath-miR156a | TGACAGAAGAGAGTGAGCAC (1273) | 0.75 | 3098 |
| | ath-miR156b | TGACAGAAGAGAGTGAGCAC (1274) | 0.75 | 3099 |
| | ath-miR156c | TGACAGAAGAGAGTGAGCAC (1275) | 0.75 | 3100 |
| | ath-miR156d | TGACAGAAGAGAGTGAGCAC (1276) | 0.75 | 3101 |
| | ath-miR156e | TGACAGAAGAGAGTGAGCAC (1277) | 0.75 | 3102 |
| | ath-miR156f | TGACAGAAGAGAGTGAGCAC (1278) | 0.75 | 3103 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ath-miR156g | CGACAGAAGAGAGTGAGCAC (1279) | 0.75 | 3104 |
| | ath-miR156h | TGACAGAAGAAAGAGAGCAC (1280) | 0.8 | 3105 |
| | ath-miR156m | TGACAGAAGAGAGAGAGCAC (1281) | 0.8 | 3106 |
| | ath-miR156o | TGACAGAAGAGAGAGAGCAC (1282) | 0.8 | 3107 |
| | ath-miR156p | TGACAGAAGAGAGAGAGCAC (1283) | 0.8 | 3108 |
| | ath-miR156q | TGACAGAAGAGAGAGAGCAC (1284) | 0.8 | 3109 |
| | ath-miR156r | TGACAGAAGAGAGAGAGCAC (1285) | 0.8 | 3110 |
| | ath-miR156s | TGACAGAAGAGAGAGAGCAC (1286) | 0.8 | 3111 |
| | bdi-miR156 | TGACAGAAGAGAGAGAGCACA (1287) | 0.85 | 3112 |
| | bdi-miR156b | TGACAGAAGAGAGTGAGCAC (1288) | 0.75 | 3113 |
| | bdi-miR156c | TGACAGAAGAGAGTGAGCAC (1289) | 0.75 | 3114 |
| | bdi-miR156d | TGACAGAAGAGAGTGAGCAC (1290) | 0.75 | 3115 |
| | bna-miR156a | TGACAGAAGAGAGTGAGCACA (1291) | 0.8 | 3116 |
| | bna-miR156b | TTGACAGAAGATAGAGAGCAC (1292) | 0.85 | 3117 |
| | bna-miR156c | TTGACAGAAGATAGAGAGCAC (1293) | 0.85 | 3118 |
| | can-miR156a | TGACAGAAGAGAGAGAGCAC (1294) | 0.8 | 3119 |
| | can-miR156b | TGACAGAAGAGAGGGAGCAC (1295) | 0.75 | 3120 |
| | cpt-miR156a | TGACAGAAGAGAGTGAGCAC (1296) | 0.75 | 3121 |
| | cpt-miR156b | TGACAGAAGAGAGAGAGCAC (1297) | 0.8 | 3122 |
| | cru-miR156 | TGACAGAAGAGAGAGAGCAC (1298) | 0.8 | 3123 |
| | csi-miR156 | TGACAGAAGAGAGTGAGCAC (1299) | 0.75 | 3124 |
| | csi-miR156a | TGACAGAAGAGAGAGAGCAC (1300) | 0.8 | 3125 |
| | csi-miR156b | TGACAGAAGAGAGAGAGCAC (1301) | 0.8 | 3126 |
| | ctr-miR156 | TGACAGAAGAGAGTGAGCAC (1302) | 0.75 | 3127 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | eca-miR156 | TGACAGAAGAGAGAGA GCAC (1303) | 0.8 | 3128 |
| | far-miR156a | TGACAGAAGAGAGAGA GCACA (1304) | 0.85 | 3129 |
| | far-miR156b | TTGACAGAAGAGAGAG AGCAC (1305) | 0.8 | 3130 |
| | ghr-miR156a | TGACAGAAGAGAGTGA GCAC (1306) | 0.75 | 3131 |
| | ghr-miR156b | TGACAGAAGAGAGTGA GCAC (1307) | 0.75 | 3132 |
| | ghr-miR156c | TGTCAGAAGAGAGTGA GCAC (1308) | 0.75 | 3133 |
| | ghr-miR156d | TGACAGAAGAGAGTGA GCAC (1309) | 0.75 | 3134 |
| | gma-miR156a | TGACAGAAGAGAGTGA GCAC (1310) | 0.75 | 3135 |
| | gma-miR156b | TGACAGAAGAGAGAGA GCACA (1311) | 0.85 | 3136 |
| | gma-miR156c | TTGACAGAAGATAGAG AGCAC (1312) | 0.85 | 3137 |
| | gma-miR156d | TTGACAGAAGATAGAG AGCAC (1313) | 0.85 | 3138 |
| | gma-miR156e | TTGACAGAAGATAGAG AGCAC (1314) | 0.85 | 3139 |
| | gma-miR156f | TTGACAGAAGAGAGAG AGCACA (1315) | 0.85 | 3140 |
| | gma-miR156g | ACAGAAGATAGAGAGC ACAG (1316) | 0.9 | 3141 |
| | gma-miR156h | TGACAGAAGAGAGAGA GCAC (1317) | 0.8 | 3142 |
| | gma-miR156i | TGACAGAAGAGAGAGA GCAC (1318) | 0.8 | 3143 |
| | han-miR156 | TGACAGAAGAGAGAGA GCAC (1319) | 0.8 | 3144 |
| | hvs-miR156 | TGACAGAAGAGAGAGA GCAC (1320) | 0.8 | 3145 |
| | hvu-miR156 | TGACAGAAGAGAGTGA GCACA (1321) | 0.8 | 3146 |
| | hvv-miR156a | TGACAGAAGAGAGTGA GCAC (1322) | 0.75 | 3147 |
| | hvv-miR156b | TGACAGAAGAGAGAGA GCAC (1323) | 0.8 | 3148 |
| | hvv-miR156c | TGACAGAAGAGAGAGA GCAC (1324) | 0.8 | 3149 |
| | hvv-miR156d | TGACAGAAGAGAGAGA GCAC (1325) | 0.8 | 3150 |
| | lja-miR156 | TGACAGAAGAGAGAGA GCAC (1326) | 0.8 | 3151 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
| --- | --- | --- | --- | --- |
| | lsa-miR156 | TGACAGAAGAGAGAGCAC (1327) | 0.8 | 3152 |
| | mdo-miR156a | TGACAGAAGAGAGAGCAC (1328) | 0.8 | 3153 |
| | mdo-miR156b | TGACAGAAGAGAGAGCAC (1329) | 0.8 | 3154 |
| | mtr-miR156 | TGACAGAAGAGAGAGCACA (1330) | 0.85 | 3155 |
| | mtr-miR156b | TGACAGAAGAGAGTGAGCAC (1331) | 0.75 | 3156 |
| | mtr-miR156c | TGACAGAAGAGAGTGAGCAC (1332) | 0.75 | 3157 |
| | mtr-miR156d | TGACAGAAGAGAGTGAGCAC (1333) | 0.75 | 3158 |
| | mtr-miR156e | TTGACAGAAGATAGAGAGCAC (1334) | 0.85 | 3159 |
| | mtr-miR156f | TTGACAGAAGATAGAGAGCAC (1335) | 0.85 | 3160 |
| | mtr-miR156g | TTGACAGAAGATAGAGGGCAC (1336) | 0.8 | 3161 |
| | mtr-miR156h | TTGACAGAAGATAGAGAGCAC (1337) | 0.85 | 3162 |
| | mtr-miR156i | TGACAGAAGAGAGTGAGCAC (1338) | 0.75 | 3163 |
| | nbe-miR156a | TGACAGAAGAGAGAGCAC (1339) | 0.8 | 3164 |
| | nbe-miR156b | TGACAGAAGAGAGAGCAC (1340) | 0.8 | 3165 |
| | oru-miR156 | TGACAGAAGAGAGTGAGCAC (1341) | 0.75 | 3166 |
| | osa-miR156a | TGACAGAAGAGAGTGAGCAC (1342) | 0.75 | 3167 |
| | osa-miR156b | TGACAGAAGAGAGTGAGCAC (1343) | 0.75 | 3168 |
| | osa-miR156c | TGACAGAAGAGAGTGAGCAC (1344) | 0.75 | 3169 |
| | osa-miR156d | TGACAGAAGAGAGTGAGCAC (1345) | 0.75 | 3170 |
| | osa-miR156e | TGACAGAAGAGAGTGAGCAC (1346) | 0.75 | 3171 |
| | osa-miR156f | TGACAGAAGAGAGTGAGCAC (1347) | 0.75 | 3172 |
| | osa-miR156g | TGACAGAAGAGAGTGAGCAC (1348) | 0.75 | 3173 |
| | osa-miR156h | TGACAGAAGAGAGTGAGCAC (1349) | 0.75 | 3174 |
| | osa-miR156i | TGACAGAAGAGAGTGAGCAC (1350) | 0.75 | 3175 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | osa-miR156j | TGACAGAAGAGAGTGA GCAC (1351) | 0.75 | 3176 |
| | osa-miR156k | TGACAGAAGAGAGAGA GCACA (1352) | 0.85 | 3177 |
| | osa-miR156l | CGACAGAAGAGAGTGA GCATA (1353) | 0.75 | 3178 |
| | osa-miR156m | TGACAGAAGAGAGTGA GCAC (1354) | 0.75 | 3179 |
| | osa-miR156n | TGACAGAAGAGAGTGA GCAC (1355) | 0.75 | 3180 |
| | osa-miR156o | TGACAGAAGAGAGTGA GCAT (1356) | 0.7 | 3181 |
| | osa-miR156p | TGACAGAAGAGAGTGA GCTC (1357) | 0.7 | 3182 |
| | osa-miR156q | TGACAGAACAGAGTGA GCAC (1358) | 0.7 | 3183 |
| | osa-miR156r | TGACAGAAGAGAGAGA GCAC (1359) | 0.8 | 3184 |
| | par-miR156 | TGACAGAAGAGAGAGA GCAC (1360) | 0.8 | 3185 |
| | ppd-miR156 | TGACAGAAGAGAGAGA GCAC (1361) | 0.8 | 3186 |
| | ppr-miR156 | TGACAGAAGAGAGTGA GCAC (1362) | 0.75 | 3187 |
| | ppt-miR156a | TGACAGAAGAGAGTGA GCAC (1363) | 0.75 | 3188 |
| | ppt-miR156b | TGACAGAAGAGAGTGA GCAC (1364) | 0.75 | 3189 |
| | ppt-miR156c | TGACAGAAGAGAGTGA GCAC (1365) | 0.75 | 3190 |
| | pta-miR156a | CAGAAGATAGAGAGCA CATC (1366) | 0.95 | 3191 |
| | ptc-miR156a | TGACAGAAGAGAGTGA GCAC (1367) | 0.75 | 3192 |
| | ptc-miR156b | TGACAGAAGAGAGTGA GCAC (1368) | 0.75 | 3193 |
| | ptc-miR156c | TGACAGAAGAGAGTGA GCAC (1369) | 0.75 | 3194 |
| | ptc-miR156d | TGACAGAAGAGAGTGA GCAC (1370) | 0.75 | 3195 |
| | ptc-miR156e | TGACAGAAGAGAGTGA GCAC (1371) | 0.75 | 3196 |
| | ptc-miR156f | TGACAGAAGAGAGTGA GCAC (1372) | 0.75 | 3197 |
| | ptc-miR156g | TTGACAGAAGATAGAG AGCAC (1373) | 0.85 | 3198 |
| | ptc-miR156h | TTGACAGAAGATAGAG AGCAC (1374) | 0.85 | 3199 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ptc-miR156i | TTGACAGAAGATAGAGAGCAC (1375) | 0.85 | 3200 |
| | ptc-miR156j | TTGACAGAAGATAGAGAGCAC (1376) | 0.85 | 3201 |
| | ptc-miR156k | TGACAGAAGAGAGGGAGCAC (1377) | 0.75 | 3202 |
| | ptr-miR156 | TGACAGAAGAGAGAGAGCAC (1378) | 0.8 | 3203 |
| | pts-miR156a | TGACAGAAGAGAGAGTGAGCGC (1379) | 0.7 | 3204 |
| | pts-miR156b | TGACAGAAGAGAGAGAGCAC (1380) | 0.8 | 3205 |
| | pts-miR156c | TGACAGAAGAGAGAGAGCAC (1381) | 0.8 | 3206 |
| | rco-miR156a | TGACAGAAGAGAGTGAGCACA (1382) | 0.8 | 3207 |
| | rco-miR156b | TGACAGAAGAGAGTGAGCACA (1383) | 0.8 | 3208 |
| | rco-miR156c | TGACAGAAGAGAGTGAGCACA (1384) | 0.8 | 3209 |
| | rco-miR156d | TGACAGAAGAGAGTGAGCACA (1385) | 0.8 | 3210 |
| | rco-miR156e | TGACAGAAGAGAGAGAGCACA (1386) | 0.85 | 3211 |
| | rco-miR156f | TTGACAGAAGATAGAGAGCAC (1387) | 0.85 | 3212 |
| | rco-miR156g | TTGACAGAAGATAGAGAGCAC (1388) | 0.85 | 3213 |
| | rco-miR156h | TTGACAGAAGATAGAGAGCAC (1389) | 0.85 | 3214 |
| | sbi-miR156a | TGACAGAAGAGAGTGAGCAC (1390) | 0.75 | 3215 |
| | sbi-miR156b | TGACAGAAGAGAGTGAGCAC (1391) | 0.75 | 3216 |
| | sbi-miR156c | TGACAGAAGAGAGTGAGCAC (1392) | 0.75 | 3217 |
| | sbi-miR156d | TGACAGAAGAGAGAGAGCACA (1393) | 0.85 | 3218 |
| | sbi-miR156e | TGACAGAAGAGAGCGAGCAC (1394) | 0.75 | 3219 |
| | sbi-miR156f | TGACAGAAGAGAGTGAGCAC (1395) | 0.75 | 3220 |
| | sbi-miR156g | TGACAGAAGAGAGTGAGCAC (1396) | 0.75 | 3221 |
| | sbi-miR156h | TGACAGAAGAGAGTGAGCAC (1397) | 0.75 | 3222 |
| | sbi-miR156i | TGACAGAAGAGAGTGAGCAC (1398) | 0.75 | 3223 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | sin-miR156 | TGACAGAAGAGAGAGCAC (1399) | 0.8 | 3224 |
| | sly-miR156a | TTGACAGAAGATAGAGAGCAC (1400) | 0.85 | 3225 |
| | sly-miR156b | TTGACAGAAGATAGAGAGCAC (1401) | 0.85 | 3226 |
| | sly-miR156c | TTGACAGAAGATAGAGAGCAC (1402) | 0.85 | 3227 |
| | smo-miR156a | CGACAGAAGAGAGTGAGCAC (1403) | 0.75 | 3228 |
| | smo-miR156b | CTGACAGAAGATAGAGAGCAC (1404) | 0.85 | 3229 |
| | smo-miR156c | TTGACAGAAGAAAGAGAGCAC (1405) | 0.8 | 3230 |
| | smo-miR156d | TTGACAGAAGACAGGGAGCAC (1406) | 0.75 | 3231 |
| | sof-miR156 | TGACAGAAGAGAGTGAGCAC (1407) | 0.75 | 3232 |
| | sof-miR156c | TGACAGAAGAGAGAGAGCAC (1408) | 0.8 | 3233 |
| | sof-miR156d | TGACAGAAGAGAGAGAGCAC (1409) | 0.8 | 3234 |
| | sof-miR156e | TGACAGAAGAGAGAGAGCAC (1410) | 0.8 | 3235 |
| | sof-miR156f | TGACAGAAGAGAGAGAGCAC (1411) | 0.8 | 3236 |
| | sof-miR156g | TGACAGAAGAGAGAGAGCAC (1412) | 0.8 | 3237 |
| | sof-miR156h | TGACAGAAGAGAGAGAGCAC (1413) | 0.8 | 3238 |
| | sof-miR156u | TGACAGAAGAGAGAGAGCAC (1414) | 0.8 | 3239 |
| | spr-miR156 | TGACAGAAGAGAGAGAGCAC (1415) | 0.8 | 3240 |
| | ssp-miR156 | TGACAGAAGAGAGTGAGCACA (1416) | 0.8 | 3241 |
| | stu-miR156a | TGACAGAAGAGAGTGAGCAC (1417) | 0.75 | 3242 |
| | stu-miR156b | TGACAGAAGAGAGAGAGCAC (1418) | 0.8 | 3243 |
| | stu-miR156c | TGACAGAAGAGAGAGAGCAC (1419) | 0.8 | 3244 |
| | stu-miR156d | TGACAGAAGAGAGAGAGCAC (1420) | 0.8 | 3245 |
| | stu-miR156e | TGACAGAAGAGAGAGAGCAC (1421) | 0.8 | 3246 |
| | tae-miR156 | TGACAGAAGAGAGTGAGCACA (1422) | 0.8 | 3247 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | tae-miR156a | TGACAGAAGAGAGAGA GCAC (1423) | 0.8 | 3248 |
| | tae-miR156b | TGACAGAAGAGAGAGA GCAC (1424) | 0.8 | 3249 |
| | tcc-miR156a | TGACAGAAGAGAGAGA GCACA (1425) | 0.85 | 3250 |
| | tcc-miR156b | TGACAGAAGAGAGTGA GCAC (1426) | 0.75 | 3251 |
| | tcc-miR156c | TGACAGAAGAGAGTGA GCAC (1427) | 0.75 | 3252 |
| | tcc-miR156d | TGACAGAAGAGAGTGA GCAC (1428) | 0.75 | 3253 |
| | tcc-miR156e | TTGACAGAAGATAGAG AGCAC (1429) | 0.85 | 3254 |
| | tcc-miR156f | TTGACAGAAGATAGAG AGCAC (1430) | 0.85 | 3255 |
| | tcc-miR156g | TGACAGAAGAGAGTGA GCAC (1431) | 0.75 | 3256 |
| | tre-miR156 | TGACAGAAGAGAGTGA GCAC (1432) | 0.75 | 3257 |
| | vvi-miR156a | TGACAGAAGAGAGGGA GCAC (1433) | 0.75 | 3258 |
| | vvi-miR156b | TGACAGAAGAGAGTGA GCAC (1434) | 0.75 | 3259 |
| | vvi-miR156c | TGACAGAAGAGAGTGA GCAC (1435) | 0.75 | 3260 |
| | vvi-miR156d | TGACAGAAGAGAGTGA GCAC (1436) | 0.75 | 3261 |
| | vvi-miR156e | TGACAGAGGAGAGTGA GCAC (1437) | 0.7 | 3262 |
| | vvi-miR156f | TTGACAGAAGATAGAG AGCAC (1438) | 0.85 | 3263 |
| | vvi-miR156g | TTGACAGAAGATAGAG AGCAC (1439) | 0.85 | 3264 |
| | vvi-miR156h | TGACAGAAGAGAGAGA GCAT (1440) | 0.75 | 3265 |
| | vvi-miR156i | TTGACAGAAGATAGAG AGCAC (1441) | 0.85 | 3266 |
| | zel-miR156 | TGACAGAAGAGAGAGA GCAC (1442) | 0.8 | 3267 |
| | zma-miR156a | TGACAGAAGAGAGTGA GCAC (1443) | 0.75 | 3268 |
| | zma-miR156b | TGACAGAAGAGAGTGA GCAC (1444) | 0.75 | 3269 |
| | zma-miR156c | TGACAGAAGAGAGTGA GCAC (1445) | 0.75 | 3270 |
| | zma-miR156d | TGACAGAAGAGAGTGA GCAC (1446) | 0.75 | 3271 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | zma-miR156e | TGACAGAAGAGAGTGA GCAC (1447) | 0.75 | 3272 |
| | zma-miR156f | TGACAGAAGAGAGTGA GCAC (1448) | 0.75 | 3273 |
| | zma-miR156g | TGACAGAAGAGAGTGA GCAC (1449) | 0.75 | 3274 |
| | zma-miR156h | TGACAGAAGAGAGTGA GCAC (1450) | 0.75 | 3275 |
| | zma-miR156i | TGACAGAAGAGAGTGA GCAC (1451) | 0.75 | 3276 |
| | zma-miR156j | TGACAGAAGAGAGAGA GCACA (1452) | 0.85 | 3277 |
| | zma-miR156k | TGACAGAAGAGAGCGA GCAC (1453) | 0.75 | 3278 |
| | zma-miR156l | TGACAGAAGAGAGTGA GCAC (1454) | 0.75 | 3279 |
| | zma-miR156m | TGACAGAAGAGAGTGA GCAC (1455) | 0.75 | 3280 |
| | zma-miR156n | TGACAGAAGAGAGTGA GCAC (1456) | 0.75 | 3281 |
| | zma-miR156o | TGACAGAAGAGAGTGA GCAC (1457) | 0.75 | 3282 |
| | zma-miR156p | TGACAGAAGAGAGAGA GCAC (1458) | 0.8 | 3283 |
| | zma-miR156q | TGACAGAAGAGAGAGA GCAC (1459) | 0.8 | 3284 |
| | zma-miR156r | TGACAGAAGAGAGTGG GCAC (1460) | 0.7 | 3285 |
| ptc-miRf10271-akr | ahy-miR159 | TTTGGATTGAAGGGAGC TCTA (1461) | 0.95 | 3286 |
| | aly-miR159a | TTTGGATTGAAGGGAGC TCTA (1462) | 0.95 | 3287 |
| | aly-miR159b | TTTGGATTGAAGGGAGC TCTT (1463) | 0.9 | 3288 |
| | aqc-miR159 | TTTGGACTGAAGGGAGC TCTA (1464) | 0.9 | 3289 |
| | ath-miR159a | TTTGGATTGAAGGGAGC TCTA (1465) | 0.95 | 3290 |
| | ath-miR159b | TTTGGATTGAAGGGAGC TCTT (1466) | 0.9 | 3291 |
| | bdi-miR159 | CTTGGATTGAAGGGAGC TCT (1467) | 0.9 | 3292 |
| | bna-miR159 | TTTGGATTGAAGGGAGC TCTA (1468) | 0.95 | 3293 |
| | bra-miR159a | TTTGGATTGAAGGGAGC TCTA (1469) | 0.95 | 3294 |
| | csi-miR159 | TTTGGATTGAAGGGAGC TCTA (1470) | 0.95 | 3295 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | far-miR159 | TTTGGATTGAAGGGAGCTCTG (1471) | 0.9 | 3296 |
| | gma-miR159a-3p | TTTGGATTGAAGGGAGCTCTA (1472) | 0.95 | 3297 |
| | hvu-miR159a | TTTGGATTGAAGGGAGCTCTG (1473) | 0.9 | 3298 |
| | hvu-miR159b | TTTGGATTGAAGGGAGCTCTG (1474) | 0.9 | 3299 |
| | mtr-miR159a | TTTGGATTGAAGGGAGCTCTA (1475) | 0.95 | 3300 |
| | osa-miR159a.1 | TTTGGATTGAAGGGAGCTCTG (1476) | 0.9 | 3301 |
| | osa-miR159b | TTTGGATTGAAGGGAGCTCTG (1477) | 0.9 | 3302 |
| | osa-miR159c | ATTGGATTGAAGGGAGCTCCA (1478) | 0.9 | 3303 |
| | osa-miR159f | CTTGGATTGAAGGGAGCTCTA (1479) | 0.95 | 3304 |
| | pta-miR159a | TTGGATTGAAGGGAGCTCCA (1480) | 0.9 | 3305 |
| | ptc-miR159a | TTTGGATTGAAGGGAGCTCTA (1481) | 0.95 | 3306 |
| | ptc-miR159b | TTTGGATTGAAGGGAGCTCTA (1482) | 0.95 | 3307 |
| | ptc-miR159c | TTTGGATTGAAGGGAGCTCTA (1483) | 0.95 | 3308 |
| | pvu-miR159a.1 | TTTGGATTGAAGGGAGCTCTA (1484) | 0.95 | 3309 |
| | rco-miR159 | TTTGGATTGAAGGGAGCTCTA (1485) | 0.95 | 3310 |
| | sbi-miR159a | TTTGGATTGAAGGGAGCTCTG (1486) | 0.9 | 3311 |
| | sly-miR159 | TTTGGATTGAAGGGAGCTCTA (1487) | 0.95 | 3312 |
| | sof-miR159a | TTTGGATTGAAGGGAGCTCTG (1488) | 0.9 | 3313 |
| | sof-miR159b | TTTGGATTGAAGGGAGCTCTG (1489) | 0.9 | 3314 |
| | sof-miR159d | TTTGGATTGAAGGGAGCTCTG (1490) | 0.9 | 3315 |
| | ssp-miR159a | TTTGGATTGAAGGGAGCTCTG (1491) | 0.9 | 3316 |
| | tae-miR159a | TTTGGATTGAAGGGAGCTCTG (1492) | 0.9 | 3317 |
| | tae-miR159b | TTTGGATTGAAGGGAGCTCTG (1493) | 0.9 | 3318 |
| | vvi-miR159c | TTTGGATTGAAGGGAGCTCTA (1494) | 0.95 | 3319 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | zma-miR159a | TTTGGATTGAAGGGAGCTCTG (1495) | 0.9 | 3320 |
| | zma-miR159b | TTTGGATTGAAGGGAGCTCTG (1496) | 0.9 | 3321 |
| | zma-miR159f | TTTGGATTGAAGGGAGCTCTG (1497) | 0.9 | 3322 |
| | zma-miR159j | TTTGGATTGAAGGGAGCTCTG (1498) | 0.9 | 3323 |
| | zma-miR159k | TTTGGATTGAAGGGAGCTCTG (1499) | 0.9 | 3324 |
| ptc-miRf10985-akr | gma-miR156g | ACAGAAGATAGAGAGCACAG (1500) | 0.9 | 3325 |
| ath-miR157a | ahy-miR156a | TGACAGAAGAGAGAGAGCAC (1501) | 0.9 | 3326 |
| | ahy-miR156b-5p | TTGACAGAAGATAGAGAGCAC (1502) | 1 | 3327 |
| | ahy-miR156c | TTGACAGAAGAGAGAGAGCAC (1503) | 0.95 | 3328 |
| | aly-miR156a | TGACAGAAGAGAGTGAGCAC (1504) | 0.86 | 3329 |
| | aly-miR156b | TGACAGAAGAGAGTGAGCAC (1505) | 0.86 | 3330 |
| | aly-miR156c | TGACAGAAGAGAGTGAGCAC (1506) | 0.86 | 3331 |
| | aly-miR156d | TGACAGAAGAGAGTGAGCAC (1507) | 0.86 | 3332 |
| | aly-miR156e | TGACAGAAGAGAGTGAGCAC (1508) | 0.86 | 3333 |
| | aly-miR156f | TGACAGAAGAGAGTGAGCAC (1509) | 0.86 | 3334 |
| | aly-miR156g | CGACAGAAGAGAGTGAGCAC (1510) | 0.81 | 3335 |
| | aly-miR156h | TGACAGAAGAAAGAGAGCAC (1511) | 0.9 | 3336 |
| | aqc-miR156a | TGACAGAAGATAGAGAGCAC (1512) | 0.95 | 3337 |
| | aqc-miR156b | TGACAGAAGATAGAGAGCAC (1513) | 0.95 | 3338 |
| | ath-miR156a | TGACAGAAGAGAGTGAGCAC (1514) | 0.86 | 3339 |
| | ath-miR156b | TGACAGAAGAGAGTGAGCAC (1515) | 0.86 | 3340 |
| | ath-miR156c | TGACAGAAGAGAGTGAGCAC (1516) | 0.86 | 3341 |
| | ath-miR156d | TGACAGAAGAGAGTGAGCAC (1517) | 0.86 | 3342 |
| | ath-miR156e | TGACAGAAGAGAGTGAGCAC (1518) | 0.86 | 3343 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ath-miR156f | TGACAGAAGAGAGTGAGCAC (1519) | 0.86 | 3344 |
| | ath-miR156g | CGACAGAAGAGAGTGAGCAC (1520) | 0.81 | 3345 |
| | ath-miR156h | TGACAGAAGAAAGAGAGCAC (1521) | 0.9 | 3346 |
| | ath-miR156m | TGACAGAAGAGAGAGAGCAC (1522) | 0.9 | 3347 |
| | ath-miR156o | TGACAGAAGAGAGAGAGCAC (1523) | 0.9 | 3348 |
| | ath-miR156p | TGACAGAAGAGAGAGAGCAC (1524) | 0.9 | 3349 |
| | ath-miR156q | TGACAGAAGAGAGAGAGCAC (1525) | 0.9 | 3350 |
| | ath-miR156r | TGACAGAAGAGAGAGAGCAC (1526) | 0.9 | 3351 |
| | ath-miR156s | TGACAGAAGAGAGAGAGCAC (1527) | 0.9 | 3352 |
| | bdi-miR156 | TGACAGAAGAGAGAGAGCACA (1528) | 0.9 | 3353 |
| | bdi-miR156b | TGACAGAAGAGAGTGAGCAC (1529) | 0.86 | 3354 |
| | bdi-miR156c | TGACAGAAGAGAGTGAGCAC (1530) | 0.86 | 3355 |
| | bdi-miR156d | TGACAGAAGAGAGTGAGCAC (1531) | 0.86 | 3356 |
| | bna-miR156a | TGACAGAAGAGAGTGAGCACA (1532) | 0.86 | 3357 |
| | bna-miR156b | TTGACAGAAGATAGAGAGCAC (1533) | 1 | 3358 |
| | bna-miR156c | TTGACAGAAGATAGAGAGCAC (1534) | 1 | 3359 |
| | can-miR156a | TGACAGAAGAGAGAGAGCAC (1535) | 0.9 | 3360 |
| | can-miR156b | TGACAGAAGAGAGGGAGCAC (1536) | 0.86 | 3361 |
| | cpt-miR156a | TGACAGAAGAGAGTGAGCAC (1537) | 0.86 | 3362 |
| | cpt-miR156b | TGACAGAAGAGAGAGAGCAC (1538) | 0.9 | 3363 |
| | cru-miR156 | TGACAGAAGAGAGAGAGCAC (1539) | 0.9 | 3364 |
| | csi-miR156 | TGACAGAAGAGAGTGAGCAC (1540) | 0.86 | 3365 |
| | csi-miR156a | TGACAGAAGAGAGAGAGCAC (1541) | 0.9 | 3366 |
| | csi-miR156b | TGACAGAAGAGAGAGAGCAC (1542) | 0.9 | 3367 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ctr-miR156 | TGACAGAAGAGAGTGAGCAC (1543) | 0.86 | 3368 |
| | eca-miR156 | TGACAGAAGAGAGAGAGCAC (1544) | 0.9 | 3369 |
| | far-miR156a | TGACAGAAGAGAGAGAGCACA (1545) | 0.9 | 3370 |
| | far-miR156b | TTGACAGAAGAGAGAGAGCAC (1546) | 0.95 | 3371 |
| | ghr-miR156a | TGACAGAAGAGAGTGAGCAC (1547) | 0.86 | 3372 |
| | ghr-miR156b | TGACAGAAGAGAGTGAGCAC (1548) | 0.86 | 3373 |
| | ghr-miR156c | TGTCAGAAGAGAGTGAGCAC (1549) | 0.81 | 3374 |
| | ghr-miR156d | TGACAGAAGAGAGTGAGCAC (1550) | 0.86 | 3375 |
| | gma-miR156a | TGACAGAAGAGAGTGAGCAC (1551) | 0.86 | 3376 |
| | gma-miR156b | TGACAGAAGAGAGAGAGCACA (1552) | 0.9 | 3377 |
| | gma-miR156c | TTGACAGAAGATAGAGAGCAC (1553) | 1 | 3378 |
| | gma-miR156d | TTGACAGAAGATAGAGAGCAC (1554) | 1 | 3379 |
| | gma-miR156e | TTGACAGAAGATAGAGAGCAC (1555) | 1 | 3380 |
| | gma-miR156f | TTGACAGAAGAGAGAGAGCACA (1556) | 0.95 | 3381 |
| | gma-miR156g | ACAGAAGATAGAGAGCACAG (1557) | 0.86 | 3382 |
| | gma-miR156h | TGACAGAAGAGAGAGAGCAC (1558) | 0.9 | 3383 |
| | gma-miR156i | TGACAGAAGAGAGAGAGCAC (1559) | 0.9 | 3384 |
| | han-miR156 | TGACAGAAGAGAGAGAGCAC (1560) | 0.9 | 3385 |
| | hvs-miR156 | TGACAGAAGAGAGAGAGCAC (1561) | 0.9 | 3386 |
| | hvu-miR156 | TGACAGAAGAGAGTGAGCACA (1562) | 0.86 | 3387 |
| | hvv-miR156a | TGACAGAAGAGAGTGAGCAC (1563) | 0.86 | 3388 |
| | hvv-miR156b | TGACAGAAGAGAGAGAGCAC (1564) | 0.9 | 3389 |
| | hvv-miR156c | TGACAGAAGAGAGAGAGCAC (1565) | 0.9 | 3390 |
| | hvv-miR156d | TGACAGAAGAGAGAGAGCAC (1566) | 0.9 | 3391 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | lja-miR156 | TGACAGAAGAGAGAGA GCAC (1567) | 0.9 | 3392 |
| | lsa-miR156 | TGACAGAAGAGAGAGA GCAC (1568) | 0.9 | 3393 |
| | mdo-miR156a | TGACAGAAGAGAGAGA GCAC (1569) | 0.9 | 3394 |
| | mdo-miR156b | TGACAGAAGAGAGAGA GCAC (1570) | 0.9 | 3395 |
| | mtr-miR156 | TGACAGAAGAGAGAGA GCACA (1571) | 0.9 | 3396 |
| | mtr-miR156b | TGACAGAAGAGAGTGA GCAC (1572) | 0.86 | 3397 |
| | mtr-miR156c | TGACAGAAGAGAGTGA GCAC (1573) | 0.86 | 3398 |
| | mtr-miR156d | TGACAGAAGAGAGTGA GCAC (1574) | 0.86 | 3399 |
| | mtr-miR156e | TTGACAGAAGATAGAG AGCAC (1575) | 1 | 3400 |
| | mtr-miR156f | TTGACAGAAGATAGAG AGCAC (1576) | 1 | 3401 |
| | mtr-miR156g | TTGACAGAAGATAGAG GGCAC (1577) | 0.95 | 3402 |
| | mtr-miR156h | TTGACAGAAGATAGAG AGCAC (1578) | 1 | 3403 |
| | mtr-miR156i | TGACAGAAGAGAGTGA GCAC (1579) | 0.86 | 3404 |
| | nbe-miR156a | TGACAGAAGAGAGAGA GCAC (1580) | 0.9 | 3405 |
| | nbe-miR156b | TGACAGAAGAGAGAGA GCAC (1581) | 0.9 | 3406 |
| | oru-miR156 | TGACAGAAGAGAGTGA GCAC (1582) | 0.86 | 3407 |
| | osa-miR156a | TGACAGAAGAGAGTGA GCAC (1583) | 0.86 | 3408 |
| | osa-miR156b | TGACAGAAGAGAGTGA GCAC (1584) | 0.86 | 3409 |
| | osa-miR156c | TGACAGAAGAGAGTGA GCAC (1585) | 0.86 | 3410 |
| | osa-miR156d | TGACAGAAGAGAGTGA GCAC (1586) | 0.86 | 3411 |
| | osa-miR156e | TGACAGAAGAGAGTGA GCAC (1587) | 0.86 | 3412 |
| | osa-miR156f | TGACAGAAGAGAGTGA GCAC (1588) | 0.86 | 3413 |
| | osa-miR156g | TGACAGAAGAGAGTGA GCAC (1589) | 0.86 | 3414 |
| | osa-miR156h | TGACAGAAGAGAGTGA GCAC (1590) | 0.86 | 3415 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | osa-miR156i | TGACAGAAGAGAGTGAGCAC (1591) | 0.86 | 3416 |
| | osa-miR156j | TGACAGAAGAGAGTGAGCAC (1592) | 0.86 | 3417 |
| | osa-miR156k | TGACAGAAGAGAGAGAGCACA (1593) | 0.9 | 3418 |
| | osa-miR156l | CGACAGAAGAGAGTGAGCATA (1594) | 0.76 | 3419 |
| | osa-miR156m | TGACAGAAGAGAGTGAGCAC (1595) | 0.86 | 3420 |
| | osa-miR156n | TGACAGAAGAGAGTGAGCAC (1596) | 0.86 | 3421 |
| | osa-miR156o | TGACAGAAGAGAGTGAGCAT (1597) | 0.81 | 3422 |
| | osa-miR156p | TGACAGAAGAGAGTGAGCTC (1598) | 0.81 | 3423 |
| | osa-miR156q | TGACAGAACAGAGTGAGCAC (1599) | 0.81 | 3424 |
| | osa-miR156r | TGACAGAAGAGAGAGAGCAC (1600) | 0.9 | 3425 |
| | par-miR156 | TGACAGAAGAGAGAGAGCAC (1601) | 0.9 | 3426 |
| | pga-miR156a | GATCCTAGAGCCCTTGAGCC (1602) | 0.38 | 3427 |
| | ppd-miR156 | TGACAGAAGAGAGAGAGCAC (1603) | 0.9 | 3428 |
| | ppr-miR156 | TGACAGAAGAGAGTGAGCAC (1604) | 0.86 | 3429 |
| | ppt-miR156a | TGACAGAAGAGAGTGAGCAC (1605) | 0.86 | 3430 |
| | ppt-miR156b | TGACAGAAGAGAGTGAGCAC (1606) | 0.86 | 3431 |
| | ppt-miR156c | TGACAGAAGAGAGTGAGCAC (1607) | 0.86 | 3432 |
| | pta-miR156a | CAGAAGATAGAGAGCACATC (1608) | 0.81 | 3433 |
| | pta-miR156b | CAGAAGATAGAGAGCACAAC (1609) | 0.81 | 3434 |
| | ptc-miR156a | TGACAGAAGAGAGTGAGCAC (1610) | 0.86 | 3435 |
| | ptc-miR156b | TGACAGAAGAGAGTGAGCAC (1611) | 0.86 | 3436 |
| | ptc-miR156c | TGACAGAAGAGAGTGAGCAC (1612) | 0.86 | 3437 |
| | ptc-miR156d | TGACAGAAGAGAGTGAGCAC (1613) | 0.86 | 3438 |
| | ptc-miR156e | TGACAGAAGAGAGTGAGCAC (1614) | 0.86 | 3439 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ptc-miR156f | TGACAGAAGAGAGTGA GCAC (1615) | 0.86 | 3440 |
| | ptc-miR156g | TTGACAGAAGATAGAG AGCAC (1616) | 1 | 3441 |
| | ptc-miR156h | TTGACAGAAGATAGAG AGCAC (1617) | 1 | 3442 |
| | ptc-miR156i | TTGACAGAAGATAGAG AGCAC (1618) | 1 | 3443 |
| | ptc-miR156j | TTGACAGAAGATAGAG AGCAC (1619) | 1 | 3444 |
| | ptc-miR156k | TGACAGAAGAGAGGGA GCAC (1620) | 0.86 | 3445 |
| | ptr-miR156 | TGACAGAAGAGAGAGA GCAC (1621) | 0.9 | 3446 |
| | pts-miR156a | TGACAGAAGAGAGTGA GCGC (1622) | 0.81 | 3447 |
| | pts-miR156b | TGACAGAAGAGAGAGA GCAC (1623) | 0.9 | 3448 |
| | pts-miR156c | TGACAGAAGAGAGAGA GCAC (1624) | 0.9 | 3449 |
| | rco-miR156a | TGACAGAAGAGAGTGA GCACA (1625) | 0.86 | 3450 |
| | rco-miR156b | TGACAGAAGAGAGTGA GCACA (1626) | 0.86 | 3451 |
| | rco-miR156c | TGACAGAAGAGAGTGA GCACA (1627) | 0.86 | 3452 |
| | rco-miR156d | TGACAGAAGAGAGTGA GCACA (1628) | 0.86 | 3453 |
| | rco-miR156e | TGACAGAAGAGAGAGA GCACA (1629) | 0.9 | 3454 |
| | rco-miR156f | TTGACAGAAGATAGAG AGCAC (1630) | 1 | 3455 |
| | rco-miR156g | TTGACAGAAGATAGAG AGCAC (1631) | 1 | 3456 |
| | rco-miR156h | TTGACAGAAGATAGAG AGCAC (1632) | 1 | 3457 |
| | sbi-miR156a | TGACAGAAGAGAGTGA GCAC (1633) | 0.86 | 3458 |
| | sbi-miR156b | TGACAGAAGAGAGTGA GCAC (1634) | 0.86 | 3459 |
| | sbi-miR156c | TGACAGAAGAGAGTGA GCAC (1635) | 0.86 | 3460 |
| | sbi-miR156d | TGACAGAAGAGAGAGA GCACA (1636) | 0.9 | 3461 |
| | sbi-miR156e | TGACAGAAGAGAGCGA GCAC (1637) | 0.86 | 3462 |
| | sbi-miR156f | TGACAGAAGAGAGTGA GCAC (1638) | 0.86 | 3463 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | sbi-miR156g | TGACAGAAGAGAGTGAGCAC (1639) | 0.86 | 3464 |
| | sbi-miR156h | TGACAGAAGAGAGTGAGCAC (1640) | 0.86 | 3465 |
| | sbi-miR156i | TGACAGAAGAGAGTGAGCAC (1641) | 0.86 | 3466 |
| | sin-miR156 | TGACAGAAGAGAGAGAGCAC (1642) | 0.9 | 3467 |
| | sly-miR156a | TTGACAGAAGATAGAGAGCAC (1643) | 1 | 3468 |
| | sly-miR156b | TTGACAGAAGATAGAGAGCAC (1644) | 1 | 3469 |
| | sly-miR156c | TTGACAGAAGATAGAGAGCAC (1645) | 1 | 3470 |
| | smo-miR156a | CGACAGAAGAGAGTGAGCAC (1646) | 0.81 | 3471 |
| | smo-miR156b | CTGACAGAAGATAGAGAGCAC (1647) | 0.95 | 3472 |
| | smo-miR156c | TTGACAGAAGAAAGAGAGCAC (1648) | 0.95 | 3473 |
| | smo-miR156d | TTGACAGAAGACAGGGAGCAC (1649) | 0.9 | 3474 |
| | sof-miR156 | TGACAGAAGAGAGTGAGCAC (1650) | 0.86 | 3475 |
| | sof-miR156c | TGACAGAAGAGAGAGAGCAC (1651) | 0.9 | 3476 |
| | sof-miR156d | TGACAGAAGAGAGAGAGCAC (1652) | 0.9 | 3477 |
| | sof-miR156e | TGACAGAAGAGAGAGAGCAC (1653) | 0.9 | 3478 |
| | sof-miR156f | TGACAGAAGAGAGAGAGCAC (1654) | 0.9 | 3479 |
| | sof-miR156g | TGACAGAAGAGAGAGAGCAC (1655) | 0.9 | 3480 |
| | sof-miR156h | TGACAGAAGAGAGAGAGCAC (1656) | 0.9 | 3481 |
| | sof-miR156u | TGACAGAAGAGAGAGAGCAC (1657) | 0.9 | 3482 |
| | spr-miR156 | TGACAGAAGAGAGAGAGCAC (1658) | 0.9 | 3483 |
| | ssp-miR156 | TGACAGAAGAGAGTGAGCACA (1659) | 0.86 | 3484 |
| | stu-miR156a | TGACAGAAGAGAGTGAGCAC (1660) | 0.86 | 3485 |
| | stu-miR156b | TGACAGAAGAGAGAGAGCAC (1661) | 0.9 | 3486 |
| | stu-miR156c | TGACAGAAGAGAGAGAGCAC (1662) | 0.9 | 3487 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | stu-miR156d | TGACAGAAGAGAGAGA GCAC (1663) | 0.9 | 3488 |
| | stu-miR156e | TGACAGAAGAGAGAGA GCAC (1664) | 0.9 | 3489 |
| | tae-miR156 | TGACAGAAGAGAGTGA GCACA (1665) | 0.86 | 3490 |
| | tae-miR156a | TGACAGAAGAGAGAGA GCAC (1666) | 0.9 | 3491 |
| | tae-miR156b | TGACAGAAGAGAGAGA GCAC (1667) | 0.9 | 3492 |
| | tcc-miR156a | TGACAGAAGAGAGAGA GCACA (1668) | 0.9 | 3493 |
| | tcc-miR156b | TGACAGAAGAGAGTGA GCAC (1669) | 0.86 | 3494 |
| | tcc-miR156c | TGACAGAAGAGAGTGA GCAC (1670) | 0.86 | 3495 |
| | tcc-miR156d | TGACAGAAGAGAGTGA GCAC (1671) | 0.86 | 3496 |
| | tcc-miR156e | TTGACAGAAGATAGAG AGCAC (1672) | 1 | 3497 |
| | tcc-miR156f | TTGACAGAAGATAGAG AGCAC (1673) | 1 | 3498 |
| | tcc-miR156g | TGACAGAAGAGAGTGA GCAC (1674) | 0.86 | 3499 |
| | tre-miR156 | TGACAGAAGAGAGTGA GCAC (1675) | 0.86 | 3500 |
| | vvi-miR156a | TGACAGAAGAGAGGGA GCAC (1676) | 0.86 | 3501 |
| | vvi-miR156b | TGACAGAAGAGAGTGA GCAC (1677) | 0.86 | 3502 |
| | vvi-miR156c | TGACAGAAGAGAGTGA GCAC (1678) | 0.86 | 3503 |
| | vvi-miR156d | TGACAGAAGAGAGTGA GCAC (1679) | 0.86 | 3504 |
| | vvi-miR156e | TGACAGAGGAGAGTGA GCAC (1680) | 0.81 | 3505 |
| | vvi-miR156f | TTGACAGAAGATAGAG AGCAC (1681) | 1 | 3506 |
| | vvi-miR156g | TTGACAGAAGATAGAG AGCAC (1682) | 1 | 3507 |
| | vvi-miR156h | TGACAGAAGAGAGAGA GCAT (1683) | 0.86 | 3508 |
| | vvi-miR156i | TTGACAGAAGATAGAG AGCAC (1684) | 1 | 3509 |
| | zel-miR156 | TGACAGAAGAGAGAGA GCAC (1685) | 0.9 | 3510 |
| | zma-miR156a | TGACAGAAGAGAGTGA GCAC (1686) | 0.86 | 3511 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | zma-miR156b | TGACAGAAGAGAGTGAGCAC (1687) | 0.86 | 3512 |
| | zma-miR156c | TGACAGAAGAGAGTGAGCAC (1688) | 0.86 | 3513 |
| | zma-miR156d | TGACAGAAGAGAGTGAGCAC (1689) | 0.86 | 3514 |
| | zma-miR156e | TGACAGAAGAGAGTGAGCAC (1690) | 0.86 | 3515 |
| | zma-miR156f | TGACAGAAGAGAGTGAGCAC (1691) | 0.86 | 3516 |
| | zma-miR156g | TGACAGAAGAGAGTGAGCAC (1692) | 0.86 | 3517 |
| | zma-miR156h | TGACAGAAGAGAGTGAGCAC (1693) | 0.86 | 3518 |
| | zma-miR156i | TGACAGAAGAGAGTGAGCAC (1694) | 0.86 | 3519 |
| | zma-miR156j | TGACAGAAGAGAGAGAGCACA (1695) | 0.9 | 3520 |
| | zma-miR156k | TGACAGAAGAGAGCGAGCAC (1696) | 0.86 | 3521 |
| | zma-miR156l | TGACAGAAGAGAGTGAGCAC (1697) | 0.86 | 3522 |
| | zma-miR156m | TGACAGAAGAGAGTGAGCAC (1698) | 0.86 | 3523 |
| | zma-miR156n | TGACAGAAGAGAGTGAGCAC (1699) | 0.86 | 3524 |
| | zma-miR156o | TGACAGAAGAGAGTGAGCAC (1700) | 0.86 | 3525 |
| | zma-miR156p | TGACAGAAGAGAGAGAGCAC (1701) | 0.9 | 3526 |
| | zma-miR156q | TGACAGAAGAGAGAGAGCAC (1702) | 0.9 | 3527 |
| | zma-miR156r | TGACAGAAGAGAGTGGGCAC (1703) | 0.81 | 3528 |
| smo-miR156b | ahy-miR156a | TGACAGAAGAGAGAGAGCAC (1704) | 0.9 | 3529 |
| | ahy-miR156b-5p | TTGACAGAAGATAGAGAGCAC (1705) | 0.95 | 3530 |
| | ahy-miR156c | TTGACAGAAGAGAGAGAGCAC (1706) | 0.9 | 3531 |
| | aly-miR156a | TGACAGAAGAGAGTGAGCAC (1707) | 0.86 | 3532 |
| | aly-miR156b | TGACAGAAGAGAGTGAGCAC (1708) | 0.86 | 3533 |
| | aly-miR156c | TGACAGAAGAGAGTGAGCAC (1709) | 0.86 | 3534 |
| | aly-miR156d | TGACAGAAGAGAGTGAGCAC (1710) | 0.86 | 3535 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | aly-miR156e | TGACAGAAGAGAGTGAGCAC (1711) | 0.86 | 3536 |
| | aly-miR156f | TGACAGAAGAGAGTGAGCAC (1712) | 0.86 | 3537 |
| | aly-miR156g | CGACAGAAGAGAGTGAGCAC (1713) | 0.81 | 3538 |
| | aly-miR156h | TGACAGAAGAAAGAGAGCAC (1714) | 0.9 | 3539 |
| | aqc-miR156a | TGACAGAAGATAGAGAGCAC (1715) | 0.95 | 3540 |
| | aqc-miR156b | TGACAGAAGATAGAGAGCAC (1716) | 0.95 | 3541 |
| | ath-miR156a | TGACAGAAGAGAGTGAGCAC (1717) | 0.86 | 3542 |
| | ath-miR156b | TGACAGAAGAGAGTGAGCAC (1718) | 0.86 | 3543 |
| | ath-miR156c | TGACAGAAGAGAGTGAGCAC (1719) | 0.86 | 3544 |
| | ath-miR156d | TGACAGAAGAGAGTGAGCAC (1720) | 0.86 | 3545 |
| | ath-miR156e | TGACAGAAGAGAGTGAGCAC (1721) | 0.86 | 3546 |
| | ath-miR156f | TGACAGAAGAGAGTGAGCAC (1722) | 0.86 | 3547 |
| | ath-miR156g | CGACAGAAGAGAGTGAGCAC (1723) | 0.81 | 3548 |
| | ath-miR156h | TGACAGAAGAAAGAGAGCAC (1724) | 0.9 | 3549 |
| | ath-miR156m | TGACAGAAGAGAGAGAGCAC (1725) | 0.9 | 3550 |
| | ath-miR156o | TGACAGAAGAGAGAGAGCAC (1726) | 0.9 | 3551 |
| | ath-miR156p | TGACAGAAGAGAGAGAGCAC (1727) | 0.9 | 3552 |
| | ath-miR156q | TGACAGAAGAGAGAGAGCAC (1728) | 0.9 | 3553 |
| | ath-miR156r | TGACAGAAGAGAGAGAGCAC (1729) | 0.9 | 3554 |
| | ath-miR156s | TGACAGAAGAGAGAGAGCAC (1730) | 0.9 | 3555 |
| | bdi-miR156 | TGACAGAAGAGAGAGAGCACA (1731) | 0.9 | 3556 |
| | bdi-miR156b | TGACAGAAGAGAGTGAGCAC (1732) | 0.86 | 3557 |
| | bdi-miR156c | TGACAGAAGAGAGTGAGCAC (1733) | 0.86 | 3558 |
| | bdi-miR156d | TGACAGAAGAGAGTGAGCAC (1734) | 0.86 | 3559 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | bna-miR156a | TGACAGAAGAGAGTGAGCACA (1735) | 0.86 | 3560 |
| | bna-miR156b | TTGACAGAAGATAGAGAGCAC (1736) | 0.95 | 3561 |
| | bna-miR156c | TTGACAGAAGATAGAGAGCAC (1737) | 0.95 | 3562 |
| | can-miR156a | TGACAGAAGAGAGAGAGCAC (1738) | 0.9 | 3563 |
| | can-miR156b | TGACAGAAGAGAGGGAGCAC (1739) | 0.86 | 3564 |
| | cpt-miR156a | TGACAGAAGAGAGTGAGCAC (1740) | 0.86 | 3565 |
| | cpt-miR156b | TGACAGAAGAGAGAGAGCAC (1741) | 0.9 | 3566 |
| | cru-miR156 | TGACAGAAGAGAGAGAGCAC (1742) | 0.9 | 3567 |
| | csi-miR156 | TGACAGAAGAGAGTGAGCAC (1743) | 0.86 | 3568 |
| | csi-miR156a | TGACAGAAGAGAGAGAGCAC (1744) | 0.9 | 3569 |
| | csi-miR156b | TGACAGAAGAGAGAGAGCAC (1745) | 0.9 | 3570 |
| | ctr-miR156 | TGACAGAAGAGAGTGAGCAC (1746) | 0.86 | 3571 |
| | eca-miR156 | TGACAGAAGAGAGAGAGCAC (1747) | 0.9 | 3572 |
| | far-miR156a | TGACAGAAGAGAGAGAGCACA (1748) | 0.9 | 3573 |
| | far-miR156b | TTGACAGAAGAGAGAGAGCAC (1749) | 0.9 | 3574 |
| | ghr-miR156a | TGACAGAAGAGAGTGAGCAC (1750) | 0.86 | 3575 |
| | ghr-miR156b | TGACAGAAGAGAGTGAGCAC (1751) | 0.86 | 3576 |
| | ghr-miR156c | TGTCAGAAGAGAGTGAGCAC (1752) | 0.81 | 3577 |
| | ghr-miR156d | TGACAGAAGAGAGTGAGCAC (1753) | 0.86 | 3578 |
| | gma-miR156a | TGACAGAAGAGAGTGAGCAC (1754) | 0.86 | 3579 |
| | gma-miR156b | TGACAGAAGAGAGAGAGCACA (1755) | 0.9 | 3580 |
| | gma-miR156c | TTGACAGAAGATAGAGAGCAC (1756) | 0.95 | 3581 |
| | gma-miR156d | TTGACAGAAGATAGAGAGCAC (1757) | 0.95 | 3582 |
| | gma-miR156e | TTGACAGAAGATAGAGAGCAC (1758) | 0.95 | 3583 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | gma-miR156f | TTGACAGAAGAGAGAG AGCACA (1759) | 0.9 | 3584 |
| | gma-miR156g | ACAGAAGATAGAGAGC ACAG (1760) | 0.86 | 3585 |
| | gma-miR156h | TGACAGAAGAGAGAGA GCAC (1761) | 0.9 | 3586 |
| | gma-miR156i | TGACAGAAGAGAGAGA GCAC (1762) | 0.9 | 3587 |
| | han-miR156 | TGACAGAAGAGAGAGA GCAC (1763) | 0.9 | 3588 |
| | hvs-miR156 | TGACAGAAGAGAGAGA GCAC (1764) | 0.9 | 3589 |
| | hvu-miR156 | TGACAGAAGAGAGTGA GCACA (1765) | 0.86 | 3590 |
| | hvv-miR156a | TGACAGAAGAGAGTGA GCACA (1766) | 0.86 | 3591 |
| | hvv-miR156b | TGACAGAAGAGAGAGA GCAC (1767) | 0.9 | 3592 |
| | hvv-miR156c | TGACAGAAGAGAGAGA GCAC (1768) | 0.9 | 3593 |
| | hvv-miR156d | TGACAGAAGAGAGAGA GCAC (1769) | 0.9 | 3594 |
| | lja-miR156 | TGACAGAAGAGAGAGA GCAC (1770) | 0.9 | 3595 |
| | lsa-miR156 | TGACAGAAGAGAGAGA GCAC (1771) | 0.9 | 3596 |
| | mdo-miR156a | TGACAGAAGAGAGAGA GCAC (1772) | 0.9 | 3597 |
| | mdo-miR156b | TGACAGAAGAGAGAGA GCAC (1773) | 0.9 | 3598 |
| | mtr-miR156 | TGACAGAAGAGAGAGA GCACA (1774) | 0.9 | 3599 |
| | mtr-miR156b | TGACAGAAGAGAGTGA GCAC (1775) | 0.86 | 3600 |
| | mtr-miR156c | TGACAGAAGAGAGTGA GCAC (1776) | 0.86 | 3601 |
| | mtr-miR156d | TGACAGAAGAGAGTGA GCAC (1777) | 0.86 | 3602 |
| | mtr-miR156e | TTGACAGAAGATAGAG AGCAC (1778) | 0.95 | 3603 |
| | mtr-miR156f | TTGACAGAAGATAGAG AGCAC (1779) | 0.95 | 3604 |
| | mtr-miR156g | TTGACAGAAGATAGAG GGCAC (1780) | 0.9 | 3605 |
| | mtr-miR156h | TTGACAGAAGATAGAG AGCAC (1781) | 0.95 | 3606 |
| | mtr-miR156i | TGACAGAAGAGAGTGA GCAC (1782) | 0.86 | 3607 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | nbe-miR156a | TGACAGAAGAGAGAGCAC (1783) | 0.9 | 3608 |
| | nbe-miR156b | TGACAGAAGAGAGAGCAC (1784) | 0.9 | 3609 |
| | oru-miR156 | TGACAGAAGAGAGTGAGCAC (1785) | 0.86 | 3610 |
| | osa-miR156a | TGACAGAAGAGAGTGAGCAC (1786) | 0.86 | 3611 |
| | osa-miR156b | TGACAGAAGAGAGTGAGCAC (1787) | 0.86 | 3612 |
| | osa-miR156c | TGACAGAAGAGAGTGAGCAC (1788) | 0.86 | 3613 |
| | osa-miR156d | TGACAGAAGAGAGTGAGCAC (1789) | 0.86 | 3614 |
| | osa-miR156e | TGACAGAAGAGAGTGAGCAC (1790) | 0.86 | 3615 |
| | osa-miR156f | TGACAGAAGAGAGTGAGCAC (1791) | 0.86 | 3616 |
| | osa-miR156g | TGACAGAAGAGAGTGAGCAC (1792) | 0.86 | 3617 |
| | osa-miR156h | TGACAGAAGAGAGTGAGCAC (1793) | 0.86 | 3618 |
| | osa-miR156i | TGACAGAAGAGAGTGAGCAC (1794) | 0.86 | 3619 |
| | osa-miR156j | TGACAGAAGAGAGTGAGCAC (1795) | 0.86 | 3620 |
| | osa-miR156k | TGACAGAAGAGAGAGAGCACA (1796) | 0.9 | 3621 |
| | osa-miR156l | CGACAGAAGAGAGTGAGCATA (1797) | 0.76 | 3622 |
| | osa-miR156m | TGACAGAAGAGAGTGAGCAC (1798) | 0.86 | 3623 |
| | osa-miR156n | TGACAGAAGAGAGTGAGCAC (1799) | 0.86 | 3624 |
| | osa-miR156o | TGACAGAAGAGAGTGAGCAT (1800) | 0.81 | 3625 |
| | osa-miR156p | TGACAGAAGAGAGTGAGCTC (1801) | 0.81 | 3626 |
| | osa-miR156q | TGACAGAACAGAGTGAGCAC (1802) | 0.81 | 3627 |
| | osa-miR156r | TGACAGAAGAGAGAGAGCAC (1803) | 0.9 | 3628 |
| | par-miR156 | TGACAGAAGAGAGAGAGCAC (1804) | 0.9 | 3629 |
| | ppd-miR156 | TGACAGAAGAGAGAGAGCAC (1805) | 0.9 | 3630 |
| | ppr-miR156 | TGACAGAAGAGAGTGAGCAC (1806) | 0.86 | 3631 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
| --- | --- | --- | --- | --- |
| | ppt-miR156a | TGACAGAAGAGAGTGAGCAC (1807) | 0.86 | 3632 |
| | ppt-miR156b | TGACAGAAGAGAGTGAGCAC (1808) | 0.86 | 3633 |
| | ppt-miR156c | TGACAGAAGAGAGTGAGCAC (1809) | 0.86 | 3634 |
| | pta-miR156a | CAGAAGATAGAGAGCACATC (1810) | 0.81 | 3635 |
| | pta-miR156b | CAGAAGATAGAGAGCACAAC (1811) | 0.81 | 3636 |
| | ptc-miR156a | TGACAGAAGAGAGTGAGCAC (1812) | 0.86 | 3637 |
| | ptc-miR156b | TGACAGAAGAGAGTGAGCAC (1813) | 0.86 | 3638 |
| | ptc-miR156c | TGACAGAAGAGAGTGAGCAC (1814) | 0.86 | 3639 |
| | ptc-miR156d | TGACAGAAGAGAGTGAGCAC (1815) | 0.86 | 3640 |
| | ptc-miR156e | TGACAGAAGAGAGTGAGCAC (1816) | 0.86 | 3641 |
| | ptc-miR156f | TGACAGAAGAGAGTGAGCAC (1817) | 0.86 | 3642 |
| | ptc-miR156g | TTGACAGAAGATAGAGAGCAC (1818) | 0.95 | 3643 |
| | ptc-miR156h | TTGACAGAAGATAGAGAGCAC (1819) | 0.95 | 3644 |
| | ptc-miR156i | TTGACAGAAGATAGAGAGCAC (1820) | 0.95 | 3645 |
| | ptc-miR156j | TTGACAGAAGATAGAGAGCAC (1821) | 0.95 | 3646 |
| | ptc-miR156k | TGACAGAAGAGAGGGAGCAC (1822) | 0.86 | 3647 |
| | ptr-miR156 | TGACAGAAGAGAGAGAGCAC (1823) | 0.9 | 3648 |
| | pts-miR156a | TGACAGAAGAGAGTGAGCGC (1824) | 0.81 | 3649 |
| | pts-miR156b | TGACAGAAGAGAGAGAGCAC (1825) | 0.9 | 3650 |
| | pts-miR156c | TGACAGAAGAGAGAGAGCAC (1826) | 0.9 | 3651 |
| | rco-miR156a | TGACAGAAGAGAGTGAGCACA (1827) | 0.86 | 3652 |
| | rco-miR156b | TGACAGAAGAGAGTGAGCACA (1828) | 0.86 | 3653 |
| | rco-miR156c | TGACAGAAGAGAGTGAGCACA (1829) | 0.86 | 3654 |
| | rco-miR156d | TGACAGAAGAGAGTGAGCACA (1830) | 0.86 | 3655 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | rco-miR156e | TGACAGAAGAGAGAGA GCACA (1831) | 0.9 | 3656 |
| | rco-miR156f | TTGACAGAAGATAGAG AGCAC (1832) | 0.95 | 3657 |
| | rco-miR156g | TTGACAGAAGATAGAG AGCAC (1833) | 0.95 | 3658 |
| | rco-miR156h | TTGACAGAAGATAGAG AGCAC (1834) | 0.95 | 3659 |
| | sbi-miR156a | TGACAGAAGAGAGTGA GCAC (1835) | 0.86 | 3660 |
| | sbi-miR156b | TGACAGAAGAGAGTGA GCAC (1836) | 0.86 | 3661 |
| | sbi-miR156c | TGACAGAAGAGAGTGA GCAC (1837) | 0.86 | 3662 |
| | sbi-miR156d | TGACAGAAGAGAGAGA GCACA (1838) | 0.9 | 3663 |
| | sbi-miR156e | TGACAGAAGAGAGCGA GCAC (1839) | 0.86 | 3664 |
| | sbi-miR156f | TGACAGAAGAGAGTGA GCAC (1840) | 0.86 | 3665 |
| | sbi-miR156g | TGACAGAAGAGAGTGA GCAC (1841) | 0.86 | 3666 |
| | sbi-miR156h | TGACAGAAGAGAGTGA GCAC (1842) | 0.86 | 3667 |
| | sbi-miR156i | TGACAGAAGAGAGTGA GCAC (1843) | 0.86 | 3668 |
| | sin-miR156 | TGACAGAAGAGAGAGA GCAC (1844) | 0.9 | 3669 |
| | sly-miR156a | TTGACAGAAGATAGAG AGCAC (1845) | 0.95 | 3670 |
| | sly-miR156b | TTGACAGAAGATAGAG AGCAC (1846) | 0.95 | 3671 |
| | sly-miR156c | TTGACAGAAGATAGAG AGCAC (1847) | 0.95 | 3672 |
| | smo-miR156a | CGACAGAAGAGAGTGA GCAC (1848) | 0.81 | 3673 |
| | smo-miR156c | TTGACAGAAGAAAGAG AGCAC (1849) | 0.9 | 3674 |
| | smo-miR156d | TTGACAGAAGACAGGG AGCAC (1850) | 0.86 | 3675 |
| | sof-miR156 | TGACAGAAGAGAGTGA GCAC (1851) | 0.86 | 3676 |
| | sof-miR156c | TGACAGAAGAGAGAGA GCAC (1852) | 0.9 | 3677 |
| | sof-miR156d | TGACAGAAGAGAGAGA GCAC (1853) | 0.9 | 3678 |
| | sof-miR156e | TGACAGAAGAGAGAGA GCAC (1854) | 0.9 | 3679 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | sof-miR156f | TGACAGAAGAGAGAGA GCAC (1855) | 0.9 | 3680 |
| | sof-miR156g | TGACAGAAGAGAGAGA GCAC (1856) | 0.9 | 3681 |
| | sof-miR156h | TGACAGAAGAGAGAGA GCAC (1857) | 0.9 | 3682 |
| | sof-miR156u | TGACAGAAGAGAGAGA GCAC (1858) | 0.9 | 3683 |
| | spr-miR156 | TGACAGAAGAGAGAGA GCAC (1859) | 0.9 | 3684 |
| | ssp-miR156 | TGACAGAAGAGAGTGA GCACA (1860) | 0.86 | 3685 |
| | stu-miR156a | TGACAGAAGAGAGTGA GCAC (1861) | 0.86 | 3686 |
| | stu-miR156b | TGACAGAAGAGAGAGA GCAC (1862) | 0.9 | 3687 |
| | stu-miR156c | TGACAGAAGAGAGAGA GCAC (1863) | 0.9 | 3688 |
| | stu-miR156d | TGACAGAAGAGAGAGA GCAC (1864) | 0.9 | 3689 |
| | stu-miR156e | TGACAGAAGAGAGAGA GCAC (1865) | 0.9 | 3690 |
| | tae-miR156 | TGACAGAAGAGAGTGA GCACA (1866) | 0.86 | 3691 |
| | tae-miR156a | TGACAGAAGAGAGAGA GCAC (1867) | 0.9 | 3692 |
| | tae-miR156b | TGACAGAAGAGAGAGA GCAC (1868) | 0.9 | 3693 |
| | tcc-miR156a | TGACAGAAGAGAGAGA GCACA (1869) | 0.9 | 3694 |
| | tcc-miR156b | TGACAGAAGAGAGTGA GCAC (1870) | 0.86 | 3695 |
| | tcc-miR156c | TGACAGAAGAGAGTGA GCAC (1871) | 0.86 | 3696 |
| | tcc-miR156d | TGACAGAAGAGAGTGA GCAC (1872) | 0.86 | 3697 |
| | tcc-miR156e | TTGACAGAAGATAGAG AGCAC (1873) | 0.95 | 3698 |
| | tcc-miR156f | TTGACAGAAGATAGAG AGCAC (1874) | 0.95 | 3699 |
| | tcc-miR156g | TGACAGAAGAGAGTGA GCAC (1875) | 0.86 | 3700 |
| | tre-miR156 | TGACAGAAGAGAGTGA GCAC (1876) | 0.86 | 3701 |
| | vvi-miR156a | TGACAGAAGAGAGGGA GCAC (1877) | 0.86 | 3702 |
| | vvi-miR156b | TGACAGAAGAGAGTGA GCAC (1878) | 0.86 | 3703 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
| --- | --- | --- | --- | --- |
| | vvi-miR156c | TGACAGAAGAGAGTGAGCAC (1879) | 0.86 | 3704 |
| | vvi-miR156d | TGACAGAAGAGAGTGAGCAC (1880) | 0.86 | 3705 |
| | vvi-miR156e | TGACAGAGGAGAGTGAGCAC (1881) | 0.81 | 3706 |
| | vvi-miR156f | TTGACAGAAGATAGAGAGCAC (1882) | 0.95 | 3707 |
| | vvi-miR156g | TTGACAGAAGATAGAGAGCAC (1883) | 0.95 | 3708 |
| | vvi-miR156h | TGACAGAAGAGAGAGAGCAT (1884) | 0.86 | 3709 |
| | vvi-miR156i | TTGACAGAAGATAGAGAGCAC (1885) | 0.95 | 3710 |
| | zel-miR156 | TGACAGAAGAGAGAGAGCAC (1886) | 0.9 | 3711 |
| | zma-miR156a | TGACAGAAGAGAGTGAGCAC (1887) | 0.86 | 3712 |
| | zma-miR156b | TGACAGAAGAGAGTGAGCAC (1888) | 0.86 | 3713 |
| | zma-miR156c | TGACAGAAGAGAGTGAGCAC (1889) | 0.86 | 3714 |
| | zma-miR156d | TGACAGAAGAGAGTGAGCAC (1890) | 0.86 | 3715 |
| | zma-miR156e | TGACAGAAGAGAGTGAGCAC (1891) | 0.86 | 3716 |
| | zma-miR156f | TGACAGAAGAGAGTGAGCAC (1892) | 0.86 | 3717 |
| | zma-miR156g | TGACAGAAGAGAGTGAGCAC (1893) | 0.86 | 3718 |
| | zma-miR156h | TGACAGAAGAGAGTGAGCAC (1894) | 0.86 | 3719 |
| | zma-miR156i | TGACAGAAGAGAGTGAGCAC (1895) | 0.86 | 3720 |
| | zma-miR156j | TGACAGAAGAGAGAGAGCACA (1896) | 0.9 | 3721 |
| | zma-miR156k | TGACAGAAGAGAGCGAGCAC (1897) | 0.86 | 3722 |
| | zma-miR156l | TGACAGAAGAGAGTGAGCAC (1898) | 0.86 | 3723 |
| | zma-miR156m | TGACAGAAGAGAGTGAGCAC (1899) | 0.86 | 3724 |
| | zma-miR156n | TGACAGAAGAGAGTGAGCAC (1900) | 0.86 | 3725 |
| | zma-miR156o | TGACAGAAGAGAGTGAGCAC (1901) | 0.86 | 3726 |
| | zma-miR156p | TGACAGAAGAGAGAGAGCAC (1902) | 0.9 | 3727 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | zma-miR156q | TGACAGAAGAGAGAGA GCAC (1903) | 0.9 | 3728 |
| | zma-miR156r | TGACAGAAGAGAGTGG GCAC (1904) | 0.81 | 3729 |
| gma-miR159a-3p | acb-miR159 | TTGGACTGAAGGGAGCT CCCT (1905) | 0.81 | 3730 |
| | aha-miR159 | TTGGACTGAAGGGAGCT CCCT (1906) | 0.81 | 3731 |
| | ahi-miR159 | TTGGACTGAAGGGAGCT CCCT (1907) | 0.81 | 3732 |
| | ahy-miR159 | TTTGGATTGAAGGGAGC TCTA (1908) | 1 | 3733 |
| | aly-miR159a | TTTGGATTGAAGGGAGC TCTA (1909) | 1 | 3734 |
| | aly-miR159b | TTTGGATTGAAGGGAGC TCTT (1910) | 0.95 | 3735 |
| | aly-miR159c | TTTGGATTGAAGGGAGC TCCT (1911) | 0.9 | 3736 |
| | ape-miR159 | TTGGACTGAAGGGAGCT CCCT (1912) | 0.81 | 3737 |
| | aqc-miR159 | TTTGGACTGAAGGGAGC TCTA (1913) | 0.95 | 3738 |
| | ath-miR159a | TTTGGATTGAAGGGAGC TCTA (1914) | 1 | 3739 |
| | ath-miR159b | TTTGGATTGAAGGGAGC TCTT (1915) | 0.95 | 3740 |
| | ath-miR159c | TTTGGATTGAAGGGAGC TCCT (1916) | 0.9 | 3741 |
| | bdi-miR159 | CTTGGATTGAAGGGAGC TCT (1917) | 0.9 | 3742 |
| | bna-miR159 | TTTGGATTGAAGGGAGC TCTA (1918) | 1 | 3743 |
| | bra-miR159a | TTTGGATTGAAGGGAGC TCTA (1919) | 1 | 3744 |
| | bvl-miR159 | TTGGACTGAAGGGAGCT CCCT (1920) | 0.81 | 3745 |
| | cmi-miR159 | TTGGACTGAAGGGAGCT CCCT (1921) | 0.81 | 3746 |
| | cor-miR159 | TTGGACTGAAGGGAGCT CCCT (1922) | 0.81 | 3747 |
| | crb-miR159 | TTGGACTGAAGGGAGCT CCCT (1923) | 0.81 | 3748 |
| | csi-miR159 | TTTGGATTGAAGGGAGC TCTA (1924) | 1 | 3749 |
| | dso-miR159 | TTGGACTGAAGGGAGCT CCCT (1925) | 0.81 | 3750 |
| | ech-miR159 | TTGGACTGAAGGGAGCT CCCT (1926) | 0.81 | 3751 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | fal-miR159 | TTGGACTGAAGGGAGCTCCCT (1927) | 0.81 | 3752 |
| | far-miR159 | TTTGGATTGAAGGGAGCTCTG (1928) | 0.95 | 3753 |
| | gma-miR159b | ATTGGAGTGAAGGGAGCTCCA (1929) | 0.86 | 3754 |
| | gma-miR159c | ATTGGAGTGAAGGGAGCTCCG (1930) | 0.81 | 3755 |
| | hvu-miR159a | TTTGGATTGAAGGGAGCTCTG (1931) | 0.95 | 3756 |
| | hvu-miR159b | TTTGGATTGAAGGGAGCTCTG (1932) | 0.95 | 3757 |
| | hvv-miR159a | TTTGGATTGAAGGGAGCTCTG (1933) | 0.95 | 3758 |
| | hvv-miR159b | TTTGGATTGAAGGGAGCTCTG (1934) | 0.95 | 3759 |
| | ltu-miR159 | TTTGGATTGAAGGGAGCTCTA (1935) | 1 | 3760 |
| | mma-miR159 | TTGGACTGAAGGGAGCTCCCT (1936) | 0.81 | 3761 |
| | mtr-miR159a | TTTGGATTGAAGGGAGCTCTA (1937) | 1 | 3762 |
| | mtr-miR159b | ATTGAATTGAAGGGAGCAACT (1938) | 0.71 | 3763 |
| | mtr-miR159c | TTTGGATTGAAGGGAGCTCTA (1939) | 1 | 3764 |
| | nof-miR159 | TTGGACTGAAGGGAGCTCCCT (1940) | 0.81 | 3765 |
| | oru-miR159 | TTTGGATTGAAGGGAGCTCTG (1941) | 0.95 | 3766 |
| | osa-miR159a | TTTGGATTGAAGGGAGCTCTG (1942) | 0.95 | 3767 |
| | osa-miR159a.1 | TTTGGATTGAAGGGAGCTCTG (1943) | 0.95 | 3768 |
| | osa-miR159b | TTTGGATTGAAGGGAGCTCTG (1944) | 0.95 | 3769 |
| | osa-miR159c | ATTGGATTGAAGGGAGCTCCA (1945) | 0.9 | 3770 |
| | osa-miR159d | ATTGGATTGAAGGGAGCTCCG (1946) | 0.86 | 3771 |
| | osa-miR159e | ATTGGATTGAAGGGAGCTCCT (1947) | 0.86 | 3772 |
| | osa-miR159f | CTTGGATTGAAGGGAGCTCTA (1948) | 0.95 | 3773 |
| | osa-miR159m | TTTGGATTGAAGGGAGCTCTG (1949) | 0.95 | 3774 |
| | pgl-miR159 | TTTGGATTGAAGGGAGCTCTG (1950) | 0.95 | 3775 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | psi-miR159 | CTTGGATTGAAGGGAGCTCCA (1951) | 0.9 | 3776 |
| | pta-miR159a | TTGGATTGAAGGGAGCTCCA (1952) | 0.9 | 3777 |
| | pta-miR159b | TTGGATTGAAGAGAGCTCCC (1953) | 0.81 | 3778 |
| | pta-miR159c | CTTGGATTGAAGGGAGCTCCC (1954) | 0.86 | 3779 |
| | ptc-miR159a | TTTGGATTGAAGGGAGCTCTA (1955) | 1 | 3780 |
| | ptc-miR159b | TTTGGATTGAAGGGAGCTCTA (1956) | 1 | 3781 |
| | ptc-miR159c | TTTGGATTGAAGGGAGCTCTA (1957) | 1 | 3782 |
| | ptc-miR159d | CTTGGATTGAAGGGAGCTCCT (1958) | 0.86 | 3783 |
| | ptc-miR159e | CTTGGGGTGAAGGGAGCTCCT (1959) | 0.76 | 3784 |
| | ptc-miR159f | ATTGGAGTGAAGGGAGCTCGA (1960) | 0.86 | 3785 |
| | pvu-miR159 | TTTGGATTGAAGGGAGCTCTA (1961) | 1 | 3786 |
| | pvu-miR159a.1 | TTTGGATTGAAGGGAGCTCTA (1962) | 1 | 3787 |
| | rco-miR159 | TTTGGATTGAAGGGAGCTCTA (1963) | 1 | 3788 |
| | rin-miR159 | TTGGACTGAAGGGAGCTCCCT (1964) | 0.81 | 3789 |
| | sar-miR159 | TTTGGATTGAAGGGAGCTCTG (1965) | 0.95 | 3790 |
| | sbi-miR159a | TTTGGATTGAAGGGAGCTCTG (1966) | 0.95 | 3791 |
| | sbi-miR159b | CTTGGATTGAAGGGAGCTCCT (1967) | 0.86 | 3792 |
| | sly-miR159 | TTTGGATTGAAGGGAGCTCTA (1968) | 1 | 3793 |
| | smo-miR159 | CTTGGATTGAAGGGAGCTCCC (1969) | 0.86 | 3794 |
| | sof-miR159a | TTTGGATTGAAGGGAGCTCTG (1970) | 0.95 | 3795 |
| | sof-miR159b | TTTGGATTGAAGGGAGCTCTG (1971) | 0.95 | 3796 |
| | sof-miR159c | CTTGGATTGAAGGGAGCTCCT (1972) | 0.86 | 3797 |
| | sof-miR159d | TTTGGATTGAAGGGAGCTCTG (1973) | 0.95 | 3798 |
| | sof-miR159e | TTTGGATTGAAAGGAGCTCTT (1974) | 0.9 | 3799 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | spr-miR159 | TTTGGATTGAAGGGAGCTCTG (1975) | 0.95 | 3800 |
| | ssp-miR159a | TTTGGATTGAAG)GGAGCTCTG (1976 | 0.95 | 3801 |
| | svi-miR159 | TTGGACTGAAG)GGAGCTCCCT (1977 | 0.81 | 3802 |
| | tae-miR159a | TTTGGATTGAAGGGAGCTCTG (1978) | 0.95 | 3803 |
| | tae-miR159b | TTTGGATTGAAGGGAGCTCTG (1979) | 0.95 | 3804 |
| | tar-miR159 | TTGGACTGAAGGGAGCTCCCT (1980) | 0.81 | 3805 |
| | vvi-miR159a | CTTGGAGTGAAGGGAGCTCTC (1981) | 0.86 | 3806 |
| | vvi-miR159b | CTTGGAGTGAAGGGAGCTCTC (1982) | 0.86 | 3807 |
| | vvi-miR159c | TTTGGATTGAAGGGAGCTCTA (1983) | 1 | 3808 |
| | zma-miR159a | TTTGGATTGAAGGGAGCTCTG (1984) | 0.95 | 3809 |
| | zma-miR159b | TTTGGATTGAAGGGAGCTCTG (1985) | 0.95 | 3810 |
| | zma-miR159c | CTTGGATTGAAGGGAGCTCCT (1986) | 0.86 | 3811 |
| | zma-miR159d | CTTGGATTGAAGGGAGCTCCT (1987) | 0.86 | 3812 |
| | zma-miR159e | ATTGGTTTGAAGGGAGCTCCA (1988) | 0.86 | 3813 |
| | zma-miR159f | TTTGGATTGAAGGGAGCTCTG (1989) | 0.95 | 3814 |
| | zma-miR159g | TTTGGAGTGAAGGGAGTTCTG (1990) | 0.86 | 3815 |
| | zma-miR159h | TTTGGAGTGAAGGGAGCTCTG (1991) | 0.9 | 3816 |
| | zma-miR159i | TTTGGAGTGAAGGGAGCTCTG (1992) | 0.9 | 3817 |
| | zma-miR159j | TTTGGATTGAAGGGAGCTCTG (1993) | 0.95 | 3818 |
| | zma-miR159k | TTTGGATTGAAGGGAGCTCTG (1994) | 0.95 | 3819 |
| | zma-miR159m | TTTGGATTGAAGGGAGCTCTG (1995) | 0.95 | 3820 |
| sbi-miR159a | acb-miR159 | TTGGACTGAAGGGAGCTCCCT (1996) | 0.81 | 3821 |
| | aha-miR159 | TTGGACTGAAGGGAGCTCCCT (1997) | 0.81 | 3822 |
| | ahi-miR159 | TTGGACTGAAGGGAGCTCCCT (1998) | 0.81 | 3823 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ahy-miR159 | TTTGGATTGAAGGGAGCTCTA (1999) | 0.95 | 3824 |
| | aly-miR159a | TTTGGATTGAAGGGAGCTCTA (2000) | 0.95 | 3825 |
| | aly-miR159b | TTTGGATTGAAGGGAGCTCTT (2001) | 0.95 | 3826 |
| | aly-miR159c | TTTGGATTGAAGGGAGCTCCT (2002) | 0.9 | 3827 |
| | ape-miR159 | TTGGACTGAAGGGAGCTCCCT (2003) | 0.81 | 3828 |
| | aqc-miR159 | TTTGGACTGAAGGGAGCTCTA (2004) | 0.9 | 3829 |
| | ath-miR159a | TTTGGATTGAAGGGAGCTCTA (2005) | 0.95 | 3830 |
| | ath-miR159b | TTTGGATTGAAGGGAGCTCTT (2006) | 0.95 | 3831 |
| | ath-miR159c | TTTGGATTGAAGGGAGCTCCT (2007) | 0.9 | 3832 |
| | bdi-miR159 | CTTGGATTGAAGGGAGCTCT (2008) | 0.9 | 3833 |
| | bna-miR159 | TTTGGATTGAAGGGAGCTCTA (2009) | 0.95 | 3834 |
| | bra-miR159a | TTTGGATTGAAGGGAGCTCTA (2010) | 0.95 | 3835 |
| | bvl-miR159 | TTGGACTGAAGGGAGCTCCCT (2011) | 0.81 | 3836 |
| | cmi-miR159 | TTGGACTGAAGGGAGCTCCCT (2012) | 0.81 | 3837 |
| | cor-miR159 | TTGGACTGAAGGGAGCTCCCT (2013) | 0.81 | 3838 |
| | crb-miR159 | TTGGACTGAAGGGAGCTCCCT (2014) | 0.81 | 3839 |
| | csi-miR159 | TTTGGATTGAAGGGAGCTCTA (2015) | 0.95 | 3840 |
| | dso-miR159 | TTGGACTGAAGGGAGCTCCCT (2016) | 0.81 | 3841 |
| | ech-miR159 | TTGGACTGAAGGGAGCTCCCT (2017) | 0.81 | 3842 |
| | fal-miR159 | TTGGACTGAAGGGAGCTCCCT (2018) | 0.81 | 3843 |
| | far-miR159 | TTTGGATTGAAGGGAGCTCTG (2019) | 1 | 3844 |
| | gma-miR159a-3p | TTTGGATTGAAGGGAGCTCTA (2020) | 0.95 | 3845 |
| | gma-miR159b | ATTGGAGTGAAGGGAGCTCCA (2021) | 0.81 | 3846 |
| | gma-miR159c | ATTGGAGTGAAGGGAGCTCCG (2022) | 0.86 | 3847 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | hvu-miR159a | TTTGGATTGAAGGGAGCTCTG (2023) | 1 | 3848 |
| | hvu-miR159b | TTTGGATTGAAGGGAGCTCTG (2024) | 1 | 3849 |
| | hvv-miR159a | TTTGGATTGAAGGGAGCTCTG (2025) | 1 | 3850 |
| | hvv-miR159b | TTTGGATTGAAGGGAGCTCTG (2026) | 1 | 3851 |
| | ltu-miR159 | TTTGGATTGAAGGGAGCTCTA (2027) | 0.95 | 3852 |
| | mma-miR159 | TTGGACTGAAGGGAGCTCCCT (2028) | 0.81 | 3853 |
| | mtr-miR159a | TTTGGATTGAAGGGAGCTCTA (2029) | 0.95 | 3854 |
| | mtr-miR159b | ATTGAATTGAAGGGAGCAACT (2030) | 0.71 | 3855 |
| | mtr-miR159c | TTTGGATTGAAGGGAGCTCTA (2031) | 0.95 | 3856 |
| | nof-miR159 | TTGGACTGAAGGGAGCTCCCT (2032) | 0.81 | 3857 |
| | oru-miR159 | TTTGGATTGAAGGGAGCTCTG (2033) | 1 | 3858 |
| | osa-miR159a | TTTGGATTGAAGGGAGCTCTG (2034) | 1 | 3859 |
| | osa-miR159a.1 | TTTGGATTGAAGGGAGCTCTG (2035) | 1 | 3860 |
| | osa-miR159b | TTTGGATTGAAGGGAGCTCTG (2036) | 1 | 3861 |
| | osa-miR159c | ATTGGATTGAAGGGAGCTCCA (2037) | 0.86 | 3862 |
| | osa-miR159d | ATTGGATTGAAGGGAGCTCCG (2038) | 0.9 | 3863 |
| | osa-miR159e | ATTGGATTGAAGGGAGCTCCT (2039) | 0.86 | 3864 |
| | osa-miR159f | CTTGGATTGAAGGGAGCTCTA (2040) | 0.9 | 3865 |
| | osa-miR159m | TTTGGATTGAAGGGAGCTCTG (2041) | 1 | 3866 |
| | pgl-miR159 | TTTGGATTGAAGGGAGCTCTG (2042) | 1 | 3867 |
| | psi-miR159 | CTTGGATTGAAGGGAGCTCCA (2043) | 0.86 | 3868 |
| | pta-miR159a | TTGGATTGAAGGGAGCTCCA (2044) | 0.86 | 3869 |
| | pta-miR159b | TTGGATTGAAGAGAGCTCCC (2045) | 0.81 | 3870 |
| | pta-miR159c | CTTGGATTGAAGGGAGCTCCC (2046) | 0.86 | 3871 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | ptc-miR159a | TTTGGATTGAAGGGAGCTCTA (2047) | 0.95 | 3872 |
| | ptc-miR159b | TTTGGATTGAAGGGAGCTCTA (2048) | 0.95 | 3873 |
| | ptc-miR159c | TTTGGATTGAAGGGAGCTCTA (2049) | 0.95 | 3874 |
| | ptc-miR159d | CTTGGATTGAAGGGAGCTCCT (2050) | 0.86 | 3875 |
| | ptc-miR159e | CTTGGGGTGAAGGGAGCTCCT (2051) | 0.76 | 3876 |
| | ptc-miR159f | ATTGGAGTGAAGGGAGCTCGA (2052) | 0.81 | 3877 |
| | pvu-miR159 | TTTGGATTGAAGGGAGCTCTA (2053) | 0.95 | 3878 |
| | pvu-miR159a.1 | TTTGGATTGAAGGGAGCTCTA (2054) | 0.95 | 3879 |
| | rco-miR159 | TTTGGATTGAAGGGAGCTCTA (2055) | 0.95 | 3880 |
| | rin-miR159 | TTGGACTGAAGGGAGCTCCCT (2056) | 0.81 | 3881 |
| | sar-miR159 | TTTGGATTGAAGGGAGCTCTG (2057) | 1 | 3882 |
| | sbi-miR159b | CTTGGATTGAAGGGAGCTCCT (2058) | 0.86 | 3883 |
| | sly-miR159 | TTTGGATTGAAGGGAGCTCTA (2059) | 0.95 | 3884 |
| | smo-miR159 | CTTGGATTGAAGGGAGCTCCC (2060) | 0.86 | 3885 |
| | sof-miR159a | TTTGGATTGAAGGGAGCTCTG (2061) | 1 | 3886 |
| | sof-miR159b | TTTGGATTGAAGGGAGCTCTG (2062) | 1 | 3887 |
| | sof-miR159c | CTTGGATTGAAGGGAGCTCCT (2063) | 0.86 | 3888 |
| | sof-miR159d | TTTGGATTGAAGGGAGCTCTG (2064) | 1 | 3889 |
| | sof-miR159e | TTTGGATTGAAAGGAGCTCTT (2065) | 0.9 | 3890 |
| | spr-miR159 | TTTGGATTGAAGGGAGCTCTG (2066) | 1 | 3891 |
| | ssp-miR159a | TTTGGATTGAAGGGAGCTCTG (2067) | 1 | 3892 |
| | svi-miR159 | TTGGACTGAAGGGAGCTCCCT (2068) | 0.81 | 3893 |
| | tae-miR159a | TTTGGATTGAAGGGAGCTCTG (2069) | 1 | 3894 |
| | tae-miR159b | TTTGGATTGAAGGGAGCTCTG (2070) | 1 | 3895 |

TABLE 7-continued

Summary of Homologs (Orthologs to Small RNAs which are up-regulated in Abiotic Stress in Soybean Plants.

| Mir Name | Homolog Name | Homolog Sequence (SEQ ID NO:) | % Identity | Homolog stem-loop sequence (SEQ ID NO:) |
|---|---|---|---|---|
| | tar-miR159 | TTGGACTGAAGGGAGCTCCCT (2071) | 0.81 | 3896 |
| | vvi-miR159a | CTTGGAGTGAAGGGAGCTCTC (2072) | 0.86 | 3897 |
| | vvi-miR159b | CTTGGAGTGAAGGGAGCTCTC (2073) | 0.86 | 3898 |
| | vvi-miR159c | TTTGGATTGAAGGGAGCTCTA (2074) | 0.95 | 3899 |
| | zma-miR159a | TTTGGATTGAAGGGAGCTCTG (2075) | 1 | 3900 |
| | zma-miR159b | TTTGGATTGAAGGGAGCTCTG (2076) | 1 | 3901 |
| | zma-miR159c | CTTGGATTGAAGGGAGCTCCT (2077) | 0.86 | 3902 |
| | zma-miR159d | CTTGGATTGAAGGGAGCTCCT (2078) | 0.86 | 3903 |
| | zma-miR159e | ATTGGTTTGAAGGGAGCTCCA (2079) | 0.81 | 3904 |
| | zma-miR159f | TTTGGATTGAAGGGAGCTCTG (2080) | 1 | 3905 |
| | zma-miR159g | TTTGGAGTGAAGGGAGTTCTG (2081) | 0.9 | 3906 |
| | zma-miR159h | TTTGGAGTGAAGGGAGCTCTG (2082) | 0.95 | 3907 |
| | zma-miR159i | TTTGGAGTGAAGGGAGCTCTG (2083) | 0.95 | 3908 |
| | zma-miR159j | TTTGGATTGAAGGGAGCTCTG (2084) | 1 | 3909 |
| | zma-miR159k | TTTGGATTGAAGGGAGCTCTG (2085) | 1 | 3910 |
| | zma-miR159m | TTTGGATTGAAGGGAGCTCTG (2086) | 1 | 3911 |

TABLE 8

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| aly-miR396a-3p | aly-miR396b-3p | GCTCAAGAAAGCTGTGGGAAA (3953) | 0.86 | 5117 |
| | csi-miR396c | TTCAAGAAATCTGTGGGAAG (3954) | 0.86 | 5118 |
| | gma-miR396d | AAGAAAGCTGTGGGAGAATATGGC (3955) | 0.67 | 5119 |
| | osa-miR396e* | GTTCAAGAAAGCCCATGGAAA (3956) | 0.71 | 5120 |
| | osa-miR396e-3p | ATGGTTCAAGAAAGCCCATGGAAA (3957) | 0.71 | 5121 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | osa-miR396f* | GTTCAAGAAAGTCCTTGGAAA (3958) | 0.71 | 5122 |
| | osa-miR396f-3p | ATAGTTCAAGAAAGTCCTTGGAAA (3959) | 0.71 | 5123 |
| | zma-miR396a* | GTTCAATAAAGCTGTGGGAAA (3960) | 0.95 | 5124 |
| | zma-miR396b-3p | GTTCAATAAAGCTGTGGGAAA (3961) | 0.95 | 5125 |
| | zma-miR396e* | GGTCAAGAAAGCCGTGGGAAG (3962) | 0.86 | 5126 |
| | zma-miR396f* | GGTCAAGAAAGCTGTGGGAAG (3963) | 0.9 | 5127 |
| | zma-miR396g* | GTTCAAGAAAGCTGTGGAAGA (3964) | 0.81 | 5128 |
| aly-miR396b-3p | aly-miR396a-3p | GTTCAATAAAGCTGTGGGAAG (3965) | 0.86 | 5129 |
| | csi-miR396c | TTCAAGAAATCTGTGGGAAG (3966) | 0.81 | 5130 |
| | gma-miR396d | AAGAAAGCTGTGGGAGAATATGGC (3967) | 0.76 | 5131 |
| | osa-miR396e* | GTTCAAGAAAGCCCATGGAAA (3968) | 0.76 | 5132 |
| | osa-miR396e-3p | ATGGTTCAAGAAAGCCCATGGAAA (3969) | 0.76 | 5133 |
| | osa-miR396f* | GTTCAAGAAAGTCCTTGGAAA (3970) | 0.76 | 5134 |
| | osa-miR396f-3p | ATAGTTCAAGAAAGTCCTTGGAAA (3971) | 0.76 | 5135 |
| | zma-miR396a* | GTTCAATAAAGCTGTGGGAAA (3972) | 0.9 | 5136 |
| | zma-miR396b-3p | GTTCAATAAAGCTGTGGGAAA (3973) | 0.9 | 5137 |
| | zma-miR396e* | GGTCAAGAAAGCCGTGGGAAG (3974) | 0.86 | 5138 |
| | zma-miR396f* | GGTCAAGAAAGCTGTGGGAAG (3975) | 0.9 | 5139 |
| | zma-miR396g* | GTTCAAGAAAGCTGTGGAAGA (3976) | 0.86 | 5140 |
| ath-miRf10239-akr | aly-miR168a* | CCCGCCTTGCATCAACTGAAT (3977) | 0.95 | 5141 |
| bna-miR2111b-5p | aly-miR2111a | TAATCTGCATCCTGAGGTTTA (3978) | 1 | 5142 |
| | aly-miR2111b | TAATCTGCATCCTGAGGTTTA (3979) | 1 | 5143 |
| | ath-miR2111a | TAATCTGCATCCTGAGGTTTA (3980) | 1 | 5144 |
| | ath-miR2111b | TAATCTGCATCCTGAGGTTTA (3981) | 1 | 5145 |
| | bna-miR2111a | TAATCTGCATCCTGAGGTTTA (3982) | 1 | 5146 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | bra-miR2111a | TAATCTGCATCCTGAGGTTTA (3983) | 1 | 5147 |
| | bra-miR2111b | TAATCTGCATCCTGAGGTTTA (3984) | 1 | 5148 |
| | lja-miR2111 | TAATCTGCATCCTGAGGTTTA (3985) | 1 | 5149 |
| | mtr-miR2111a | TAATCTGCATCCTGAGGTTTA (3986) | 1 | 5150 |
| | mtr-miR2111b | TAATCTGCATCCTGAGGTTTA (3987) | 1 | 5151 |
| | mtr-miR2111c | TAATCTGCATCCTGAGGTTTA (3988) | 1 | 5152 |
| | mtr-miR2111d | TAATCTGCATCCTGAGGTTTA (3989) | 1 | 5153 |
| | mtr-miR2111e | TAATCTGCATCCTGAGGTTTA (3990) | 1 | 5154 |
| | mtr-miR2111f | TAATCTGCATCCTGAGGTTTA (3991) | 1 | 5155 |
| | mtr-miR2111h | TAATCTGCATCCTGAGGTTTA (3992) | 1 | 5156 |
| | mtr-miR2111i | TAATCTGCATCCTGAGGTTTA (3993) | 1 | 5157 |
| | mtr-miR2111j | TAATCTGCATCCTGAGGTTTA (3994) | 1 | 5158 |
| | mtr-miR2111k | TAATCTGCATCCTGAGGTTTA (3995) | 1 | 5159 |
| | mtr-miR2111l | TAATCTGCATCCTGAGGTTTA (3996) | 1 | 5160 |
| | mtr-miR2111m | TAATCTGCATCCTGAGGTTTA (3997) | 1 | 5161 |
| | mtr-miR2111n | TAATCTGCATCCTGAGGTTTA (3998) | 1 | 5162 |
| | mtr-miR2111o | TAATCTGCATCCTGAGGTTTA (3999) | 1 | 5163 |
| | mtr-miR2111p | TAATCTGCATCCTGAGGTTTA (4000) | 1 | 5164 |
| | mtr-miR2111q | TAATCTGCATCCTGAGGTTTA (4001) | 1 | 5165 |
| | mtr-miR2111r | TAATCTGCATCCTGAGGTTTA (4002) | 1 | 5166 |
| | mtr-miR2111s | TAATCTGCATCCTGAGGTTTA (4003) | 1 | 5167 |
| | tcc-miR2111 | TAATCTGCATCCTGAGGTTTA (4004) | 1 | 5168 |
| | vvi-miR2111-5p | TAATCTGCATCCTGAGGTCTA (4005) | 0.95 | 5169 |
| csi-miR162-5p | aly-miR162a* | GGAGGCAGCGGTTCATCGATC (4006) | 0.95 | 5170 |
| | aly-miR162b* | GGAGGCAGCGGTTCATCGATC (4007) | 0.95 | 5171 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | zma-miR162* | GGGCGCAGTGGTTTATCGATC (4008) | 0.77 | 5172 |
| gma-miR396d | aly-miR396b-3p | GCTCAAGAAAGCTGTGGGAAA (4009) | 0.67 | 5173 |
| | zma-miR396a* | GTTCAATAAAGCTGTGGGAAA (4010) | 0.63 | 5174 |
| | zma-miR396b-3p | GTTCAATAAAGCTGTGGGAAA (4011) | 0.63 | 5175 |
| | zma-miR396f* | GGTCAAGAAAGCTGTGGGAAG (4012) | 0.63 | 5176 |
| | zma-miR396g* | GTTCAAGAAAGCTGTGGAAGA (4013) | 0.67 | 5177 |
| gma-miR482a-3p | aqc-miR482a | TCTTGCCGACTCCTCCCATACC (4014) | 0.71 | 5178 |
| | aqc-miR482b | TCTTGCCGACTCCTCCCATACC (4015) | 0.71 | 5179 |
| | aqc-miR482c | TCTTGCCGACTCCTCCCATACC (4016) | 0.71 | 5180 |
| | csi-miR482a | TCTTCCCTATGCCTCCCATTCC (4017) | 0.79 | 5181 |
| | csi-miR482b | TCTTGCCCACCCCTCCCATTCC (4018) | 0.71 | 5182 |
| | csi-miR482c | TTCCCTAGTCCCCCTATTCCTA (4019) | 0.75 | 5183 |
| | ghr-miR482a | TCTTTCCTACTCCTCCCATACC (4020) | 0.71 | 5184 |
| | ghr-miR482b | TCTTGCCTACTCCACCCATGCC (4021) | 0.71 | 5185 |
| | gma-miR482 | TCTTCCCAATTCCGCCCATTCCTA (4022) | 1 | 5186 |
| | gra-miR482 | TCTTTCCAATTCCTCCCATTCC (4023) | 0.83 | 5187 |
| | gso-miR482a | TCTTCCCTACACCTCCCATAC (4024) | 0.67 | 5188 |
| | gso-miR482b | TCTTCCCTACACCTCCCATAC (4025) | 0.67 | 5189 |
| | mdm-miR482 | TCTTCCCAAGCCCGCCCATTCC (4026) | 0.83 | 5190 |
| | mdo-miR482 | TCTTCCCAAGCCCGCCCATTCC (4027) | 0.83 | 5191 |
| | pab-miR482a | TCTTCCCTACTCCTCCCATTCC (4028) | 0.79 | 5192 |
| | pab-miR482b | TCTTCCCTATTCCTCCCATTCC (4029) | 0.83 | 5193 |
| | pab-miR482c | TCTTTCCTACTCCTCCCATTCC (4030) | 0.75 | 5194 |
| | pta-miR482a | TCTTCCCTACTCCTCCCATTCC (4031) | 0.79 | 5195 |
| | pta-miR482b | TCTTCCCTACTCCTCCCATTCC (4032) | 0.79 | 5196 |
| | pta-miR482c | TCTTCCCTATTCCTCCCATT (4033) | 0.75 | 5197 |
| | pta-miR482d | TCCTCCCTACTCCTCCCATT (4034) | 0.67 | 5198 |
| | ptc-miR482.2 | TCTTGCCTACTCCTCCCATT (4035) | 0.67 | 5199 |
| | pvu-miR482 | TCTTCCCAATTCCGCCCATTCC (4036) | 0.92 | 5200 |
| | sly-miR482 | TTTCCAATTCCACCCATTCCTA (4037) | 0.83 | 5201 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | vvi-miR482 | TCTTTCCTACTCCTCCCATTCC (4038) | 0.75 | 5202 |
| | zma-miR482 | TCTTCCTTGTTCCTCCCATT (4039) | 0.67 | 5203 |
| gma-miR482b-5p | pvu-miR482* | GGAATGGGCTGATTGGGAAGCA (4040) | 0.73 | 5204 |
| gso-miR169g* | aly-miR169a* | GGCAAGTTGTCCTTGGCTACA (4041) | 0.85 | 5205 |
| | aly-miR169b* | GGCAAGTTGTCCTTCGGCTACA (4042) | 0.85 | 5206 |
| | aly-miR169c* | GGCAAGTCATCTCTGGCTATG (4043) | 0.65 | 5207 |
| | aly-miR169d* | GCAAGTTGACCTTGGCTCTGT (4044) | 0.8 | 5208 |
| | aly-miR169e* | GCAAGTTGACCTTGGCTCTGT (4045) | 0.8 | 5209 |
| | aly-miR169f* | GCAAGTTGACCTTGGCTCTGC (4046) | 0.8 | 5210 |
| | aly-miR169g* | GCAAGTTGACCTTGGCTCTGT (4047) | 0.8 | 5211 |
| | aly-miR169h | TAGCCAAGGATGACTTGCCTG (4048) | 0.65 | 5212 |
| | aly-miR169h* | GGCAGTCTCCTTGGCTATT (4049) | 0.65 | 5213 |
| | aly-miR169i | TAGCCAAGGATGACTTGCCTG (4050) | 0.65 | 5214 |
| | aly-miR169i* | GGCAGTCTCCTTGGATATC (4051) | 0.6 | 5215 |
| | aly-miR169j | TAGCCAAGGATGACTTGCCTG (4052) | 0.65 | 5216 |
| | aly-miR169j* | GGCAGTCTCCTTGGCTATC (4053) | 0.65 | 5217 |
| | aly-miR169k | TAGCCAAGGATGACTTGCCTG (4054) | 0.65 | 5218 |
| | aly-miR169k* | GGCAGTCTCCTTGGCTATC (4055) | 0.65 | 5219 |
| | aly-miR169l | TAGCCAAGGATGACTTGCCTG (4056) | 0.65 | 5220 |
| | aly-miR169l* | GGCAGTCTCCTTGGCTATC (4057) | 0.65 | 5221 |
| | aly-miR169m | TAGCCAAGGATGACTTGCCTG (4058) | 0.65 | 5222 |
| | aly-miR169m* | GGCAGTCTTCTTGGCTATC (4059) | 0.6 | 5223 |
| | aly-miR169n | TAGCCAAAGATGACTTGCCTG (4060) | 0.6 | 5224 |
| | aly-miR169n* | GGCAGTCTCTTTGGCTATC (4061) | 0.6 | 5225 |
| | aqc-miR169a | TAGCCAAGGATGACTTGCCTA (4062) | 0.65 | 5226 |
| | aqc-miR169b | TAGCCAAGGATGACTTGCCTG (4063) | 0.65 | 5227 |
| | ath-miR169g* | TCCGGCAAGTTGACCTTGGCT (4064) | 0.9 | 5228 |
| | ath-miR169h | TAGCCAAGGATGACTTGCCTG (4065) | 0.65 | 5229 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | ath-miR169i | TAGCCAAGGATGACTTGCCTG (4066) | 0.65 | 5230 |
| | ath-miR169j | TAGCCAAGGATGACTTGCCTG (4067) | 0.65 | 5231 |
| | ath-miR169k | TAGCCAAGGATGACTTGCCTG (4068) | 0.65 | 5232 |
| | ath-miR169l | TAGCCAAGGATGACTTGCCTG (4069) | 0.65 | 5233 |
| | ath-miR169m | TAGCCAAGGATGACTTGCCTG (4070) | 0.65 | 5234 |
| | ath-miR169n | TAGCCAAGGATGACTTGCCTG (4071) | 0.65 | 5235 |
| | bdi-miR169b | TAGCCAAGGATGACTTGCCGG (4072) | 0.6 | 5236 |
| | bdi-miR169d | TAGCCAAGAATGACTTGCCTA (4073) | 0.65 | 5237 |
| | bdi-miR169e | TAGCCAAGGATGACTTGCCTG (4074) | 0.65 | 5238 |
| | bdi-miR169g | TAGCCAAGGATGACTTGCCTG (4075) | 0.65 | 5239 |
| | bdi-miR169h | TAGCCAAGGATGACTTGCCTA (4076) | 0.65 | 5240 |
| | bdi-miR169i | CCAGCCAAGAATGGCTTGCCTA (4077) | 0.6 | 5241 |
| | bdi-miR169j | TAGCCAGGAATGGCTTGCCTA (4078) | 0.6 | 5242 |
| | bdi-miR169k | TAGCCAAGGATGATTTGCCTGT (4079) | 0.6 | 5243 |
| | bna-miR169c | TAGCCAAGGATGACTTGCCTA (4080) | 0.65 | 5244 |
| | bna-miR169d | TAGCCAAGGATGACTTGCCTA (4081) | 0.65 | 5245 |
| | bna-miR169e | TAGCCAAGGATGACTTGCCTA (4082) | 0.65 | 5246 |
| | bna-miR169f | TAGCCAAGGATGACTTGCCTA (4083) | 0.65 | 5247 |
| | bna-miR169g | TAGCCAAGGATGACTTGCCTGC (4084) | 0.65 | 5248 |
| | bna-miR169h | TAGCCAAGGATGACTTGCCTGC (4085) | 0.65 | 5249 |
| | bna-miR169i | TAGCCAAGGATGACTTGCCTGC (4086) | 0.65 | 5250 |
| | bna-miR169j | TAGCCAAGGATGACTTGCCTGC (4087) | 0.65 | 5251 |
| | bna-miR169k | TAGCCAAGGATGACTTGCCTGC (4088) | 0.65 | 5252 |
| | bna-miR169l | TAGCCAAGGATGACTTGCCTGC (4089) | 0.65 | 5253 |
| | far-miR169 | TAGCCAAGGATGACTTGCCTA (4090) | 0.65 | 5254 |
| | ghb-miR169a | TAGCCAAGGATGACTTGCCTG (4091) | 0.65 | 5255 |
| | ghr-miR169 | ACGCCAAGGATGTCTTGCGTC (4092) | 0.6 | 5256 |
| | mtr-miR169f | AAGCCAAGGATGACTTGCCTA (4093) | 0.6 | 5257 |
| | osa-miR169e | TAGCCAAGGATGACTTGCCGG (4094) | 0.6 | 5258 |
| | osa-miR169f | TAGCCAAGGATGACTTGCCTA (4095) | 0.65 | 5259 |
| | osa-miR169g | TAGCCAAGGATGACTTGCCTA (4096) | 0.65 | 5260 |
| | osa-miR169h | TAGCCAAGGATGACTTGCCTG (4097) | 0.65 | 5261 |
| | osa-miR169i | TAGCCAAGGATGACTTGCCTG (4098) | 0.65 | 5262 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | osa-miR169j | TAGCCAAGGATGACTTGCCTG (4099) | 0.65 | 5263 |
| | osa-miR169k | TAGCCAAGGATGACTTGCCTG (4100) | 0.65 | 5264 |
| | osa-miR169l | TAGCCAAGGATGACTTGCCTG (4101) | 0.65 | 5265 |
| | osa-miR169m | TAGCCAAGGATGACTTGCCTG (4102) | 0.65 | 5266 |
| | osa-miR169n | TAGCCAAGAATGACTTGCCTA (4103) | 0.65 | 5267 |
| | osa-miR169o | TAGCCAAGAATGACTTGCCTA (4104) | 0.65 | 5268 |
| | ptc-miR169ab | TAGCCAAGGACGACTTGCCCA (4105) | 0.6 | 5269 |
| | ptc-miR169ac | TAGCCAAGGACGACTTGCCCA (4106) | 0.6 | 5270 |
| | ptc-miR169ad | TAGCCAAGGACGACTTGCCCA (4107) | 0.6 | 5271 |
| | ptc-miR169ae | TAGCCAAGGACGACTTGCCCA (4108) | 0.6 | 5272 |
| | ptc-miR169af | TAGCCAAGGACGACTTGCCCA (4109) | 0.6 | 5273 |
| | ptc-miR169i | TAGCCAAGGATGACTTGCCTG (4110) | 0.65 | 5274 |
| | ptc-miR169j | TAGCCAAGGATGACTTGCCTG (4111) | 0.65 | 5275 |
| | ptc-miR169k | TAGCCAAGGATGACTTGCCTG (4112) | 0.65 | 5276 |
| | ptc-miR169l | TAGCCAAGGATGACTTGCCTG (4113) | 0.65 | 5277 |
| | ptc-miR169m | TAGCCAAGGATGACTTGCCTG (4114) | 0.65 | 5278 |
| | ptc-miR169o | AAGCCAAGGATGACTTGCCTG (4115) | 0.6 | 5279 |
| | ptc-miR169p | AAGCCAAGGATGACTTGCCTG (4116) | 0.6 | 5280 |
| | ptc-miR169q | TAGCCAAGGACGACTTGCCTG (4117) | 0.65 | 5281 |
| | ptc-miR169r | TAGCCAAGGATGACTTGCCTA (4118) | 0.65 | 5282 |
| | ptc-miR169s | TCAGCCAAGGATGACTTGCCG (4119) | 0.65 | 5283 |
| | ptc-miR169u | TAGCCAAGGACGACTTGCCTA (4120) | 0.65 | 5284 |
| | ptc-miR169v | TAGCCAAGGATGACTTGCCCA (4121) | 0.6 | 5285 |
| | ptc-miR169w | TAGCCAAGGATGACTTGCCCA (4122) | 0.6 | 5286 |
| | sbi-miR169c | TAGCCAAGGATGACTTGCCTA (4123) | 0.65 | 5287 |
| | sbi-miR169d | TAGCCAAGGATGACTTGCCTA (4124) | 0.65 | 5288 |
| | sbi-miR169e | TAGCCAAGGATGACTTGCCGG (4125) | 0.6 | 5289 |
| | sbi-miR169f | TAGCCAAGGATGACTTGCCTG (4126) | 0.65 | 5290 |
| | sbi-miR169g | TAGCCAAGGATGACTTGCCTG (4127) | 0.65 | 5291 |
| | sbi-miR169h | TAGCCAAGGATGACTTGCCTA (4128) | 0.65 | 5292 |
| | sbi-miR169i | TAGCCAAGAATGACTTGCCTA (4129) | 0.65 | 5293 |
| | sbi-miR169j | TAGCCAAGGATGACTTGCCGG (4130) | 0.6 | 5294 |
| | sbi-miR169l | TAGCCAAGGATGACTTGCCTG (4131) | 0.65 | 5295 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | sbi-miR169m | TAGCCAAGGATGACTTGCCTA (4132) | 0.65 | 5296 |
| | sbi-miR169n | TAGCCAAGGATGACTTGCCTA (4133) | 0.65 | 5297 |
| | sbi-miR169o | TAGCCAAGGATGATTTGCCTG (4134) | 0.6 | 5298 |
| | sbi-miR169p | TAGCCAAGAATGGCTTGCCTA (4135) | 0.65 | 5299 |
| | sbi-miR169q | TAGCCAAGAATGGCTTGCCTA (4136) | 0.65 | 5300 |
| | sly-miR169b | TAGCCAAGGATGACTTGCCTG (4137) | 0.65 | 5301 |
| | sly-miR169d | TAGCCAAGGATGACTTGCCTA (4138) | 0.65 | 5302 |
| | sof-miR169 | TAGCCAAGGATGACTTGCCGG (4139) | 0.6 | 5303 |
| | ssp-miR169 | TAGCCAAGGATGACTTGCCGG (4140) | 0.6 | 5304 |
| | tcc-miR169d | TAGCCAAGGATGACTTGCCTA (4141) | 0.65 | 5305 |
| | tcc-miR169f | AAGCCAAGAATGACTTGCCTG (4142) | 0.6 | 5306 |
| | tcc-miR169g | TAGCCAGGGATGACTTGCCTA (4143) | 0.6 | 5307 |
| | tcc-miR169h | TAGCCAAGGATGACTTGCCTG (4144) | 0.65 | 5308 |
| | tcc-miR169i | TAGCCAAGGATGAGTTGCCTG (4145) | 0.6 | 5309 |
| | tcc-miR169j | TAGCCAAGGATGACTTGCCTG (4146) | 0.65 | 5310 |
| | vvi-miR169e | TAGCCAAGGATGACTTGCCTGC (4147) | 0.65 | 5311 |
| | vvi-miR169x | TAGCCAAGGATGACTTGCCTA (4148) | 0.65 | 5312 |
| | vvi-miR169y | TAGCGAAGGATGACTTGCCTA (4149) | 0.6 | 5313 |
| | zma-miR169a* | GGCAAGTTGTTCTTGGCTACA (4150) | 0.8 | 5314 |
| | zma-miR169b* | GGCAAGTTGTTCTTGGCTACA (4151) | 0.8 | 5315 |
| | zma-miR169c* | GGCAAGTCTGTCCTTGGCTACA (4152) | 0.85 | 5316 |
| | zma-miR169f | TAGCCAAGGATGACTTGCCTA (4153) | 0.65 | 5317 |
| | zma-miR169f* | GGCATGTCTTCCTTGGCTACT (4154) | 0.7 | 5318 |
| | zma-miR169g | TAGCCAAGGATGACTTGCCTA (4155) | 0.65 | 5319 |
| | zma-miR169h | TAGCCAAGGATGACTTGCCTA (4156) | 0.65 | 5320 |
| | zma-miR169i | TAGCCAAGGATGACTTGCCTG (4157) | 0.65 | 5321 |
| | zma-miR169i* | GGCAGTCTCCTTGGCTAG (4158) | 0.65 | 5322 |
| | zma-miR169j | TAGCCAAGGATGACTTGCCTG (4159) | 0.65 | 5323 |
| | zma-miR169j* | GGCAGTCTCCTTGGCTAG (4160) | 0.65 | 5324 |
| | zma-miR169k | TAGCCAAGGATGACTTGCCTG (4161) | 0.65 | 5325 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | zma-miR169k* | GGCAGTCTCCTTGGCTAG (4162) | 0.65 | 5326 |
| | zma-miR169m | TAGCCAAGAATGGCTTGCCTA (4163) | 0.65 | 5327 |
| | zma-miR169n | TAGCCAAGAATGGCTTGCCTA (4164) | 0.65 | 5328 |
| | zma-miR169n* | GGCAGGCCTTCTTGGCTAAG (4165) | 0.6 | 5329 |
| | zma-miR169o | TAGCCAAGAATGACTTGCCTA (4166) | 0.65 | 5330 |
| | zma-miR169o* | GGCAGGTCTTCTTGGCTAGC (4167) | 0.65 | 5331 |
| | zma-miR169p | TAGCCAAGGATGACTTGCCGG (4168) | 0.6 | 5332 |
| | zma-miR169p* | GGCAAGTCATCTGGGGCTACG (4169) | 0.6 | 5333 |
| | zma-miR169q | TAGCCAAGAATGGCTTGCCTA (4170) | 0.65 | 5334 |
| | zma-miR169r* | GGCAAGTTGTCCTTGGCTACA (4171) | 0.85 | 5335 |
| ppt-miR533b-5p | ppt-miR533a* | GAGCTGGCCAGGCTGTGAGGG (4172) | 0.95 | 5336 |
| ptc-miRf11953-akr | aly-miR2111a | TAATCTGCATCCTGAGGTTTA (4173) | 0.95 | 5337 |
| | aly-miR2111b | TAATCTGCATCCTGAGGTTTA (4174) | 0.95 | 5338 |
| | ath-miR2111a | TAATCTGCATCCTGAGGTTTA (4175) | 0.95 | 5339 |
| | ath-miR2111b | TAATCTGCATCCTGAGGTTTA (4176) | 0.95 | 5340 |
| | bna-miR2111a | TAATCTGCATCCTGAGGTTTA (4177) | 0.95 | 5341 |
| | bna-miR2111b-5p | TAATCTGCATCCTGAGGTTTA (4178) | 0.95 | 5342 |
| | bra-miR2111a | TAATCTGCATCCTGAGGTTTA (4179) | 0.95 | 5343 |
| | bra-miR2111b | TAATCTGCATCCTGAGGTTTA (4180) | 0.95 | 5344 |
| | lja-miR2111 | TAATCTGCATCCTGAGGTTTA (4181) | 0.95 | 5345 |
| | mtr-miR2111a | TAATCTGCATCCTGAGGTTTA (4182) | 0.95 | 5346 |
| | mtr-miR2111b | TAATCTGCATCCTGAGGTTTA (4183) | 0.95 | 5347 |
| | mtr-miR2111c | TAATCTGCATCCTGAGGTTTA (4184) | 0.95 | 5348 |
| | mtr-miR2111d | TAATCTGCATCCTGAGGTTTA (4185) | 0.95 | 5349 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
| --- | --- | --- | --- | --- |
| | mtr-miR2111e | TAATCTGCATCCTGAGGTTTA (4186) | 0.95 | 5350 |
| | mtr-miR2111f | TAATCTGCATCCTGAGGTTTA (4187) | 0.95 | 5351 |
| | mtr-miR2111h | TAATCTGCATCCTGAGGTTTA (4188) | 0.95 | 5352 |
| | mtr-miR2111i | TAATCTGCATCCTGAGGTTTA (4189) | 0.95 | 5353 |
| | mtr-miR2111j | TAATCTGCATCCTGAGGTTTA (4190) | 0.95 | 5354 |
| | mtr-miR2111k | TAATCTGCATCCTGAGGTTTA (4191) | 0.95 | 5355 |
| | mtr-miR2111l | TAATCTGCATCCTGAGGTTTA (4192) | 0.95 | 5356 |
| | mtr-miR2111m | TAATCTGCATCCTGAGGTTTA (4193) | 0.95 | 5357 |
| | mtr-miR2111n | TAATCTGCATCCTGAGGTTTA (4194) | 0.95 | 5358 |
| | mtr-miR2111o | TAATCTGCATCCTGAGGTTTA (4195) | 0.95 | 5359 |
| | mtr-miR2111p | TAATCTGCATCCTGAGGTTTA (4196) | 0.95 | 5360 |
| | mtr-miR2111q | TAATCTGCATCCTGAGGTTTA (4197) | 0.95 | 5361 |
| | mtr-miR2111r | TAATCTGCATCCTGAGGTTTA (4198) | 0.95 | 5362 |
| | mtr-miR2111s | TAATCTGCATCCTGAGGTTTA (4199) | 0.95 | 5363 |
| | tcc-miR2111 | TAATCTGCATCCTGAGGTTTA (4200) | 0.95 | 5364 |
| | vvi-miR2111-5p | TAATCTGCATCCTGAGGTCTA (4201) | 0.9 | 5365 |
| vvi-miR2111-5p | aly-miR2111a | TAATCTGCATCCTGAGGTTTA (4202) | 0.95 | 5366 |
| | aly-miR2111b | TAATCTGCATCCTGAGGTTTA (4203) | 0.95 | 5367 |
| | ath-miR2111a | TAATCTGCATCCTGAGGTTTA (4204) | 0.95 | 5368 |
| | ath-miR2111b | TAATCTGCATCCTGAGGTTTA (4205) | 0.95 | 5369 |
| | bna-miR2111a | TAATCTGCATCCTGAGGTTTA (4206) | 0.95 | 5370 |
| | bna-miR2111b-5p | TAATCTGCATCCTGAGGTTTA (4207) | 0.95 | 5371 |
| | bra-miR2111a | TAATCTGCATCCTGAGGTTTA (4208) | 0.95 | 5372 |
| | bra-miR2111b | TAATCTGCATCCTGAGGTTTA (4209) | 0.95 | 5373 |
| | lja-miR2111 | TAATCTGCATCCTGAGGTTTA (4210) | 0.95 | 5374 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | mtr-miR2111a | TAATCTGCATCCTGAGGTTTA (4211) | 0.95 | 5375 |
| | mtr-miR2111b | TAATCTGCATCCTGAGGTTTA (4212) | 0.95 | 5376 |
| | mtr-miR2111c | TAATCTGCATCCTGAGGTTTA (4213) | 0.95 | 5377 |
| | mtr-miR2111d | TAATCTGCATCCTGAGGTTTA (4214) | 0.95 | 5378 |
| | mtr-miR2111e | TAATCTGCATCCTGAGGTTTA (4215) | 0.95 | 5379 |
| | mtr-miR2111f | TAATCTGCATCCTGAGGTTTA (4216) | 0.95 | 5380 |
| | mtr-miR2111h | TAATCTGCATCCTGAGGTTTA (4217) | 0.95 | 5381 |
| | mtr-miR2111i | TAATCTGCATCCTGAGGTTTA (4218) | 0.95 | 5382 |
| | mtr-miR2111j | TAATCTGCATCCTGAGGTTTA (4219) | 0.95 | 5383 |
| | mtr-miR2111k | TAATCTGCATCCTGAGGTTTA (4220) | 0.95 | 5384 |
| | mtr-miR2111l | TAATCTGCATCCTGAGGTTTA (4221) | 0.95 | 5385 |
| | mtr-miR2111m | TAATCTGCATCCTGAGGTTTA (4222) | 0.95 | 5386 |
| | mtr-miR2111n | TAATCTGCATCCTGAGGTTTA (4223) | 0.95 | 5387 |
| | mtr-miR2111o | TAATCTGCATCCTGAGGTTTA (4224) | 0.95 | 5388 |
| | mtr-miR2111p | TAATCTGCATCCTGAGGTTTA (4225) | 0.95 | 5389 |
| | mtr-miR2111q | TAATCTGCATCCTGAGGTTTA (4226) | 0.95 | 5390 |
| | mtr-miR2111r | TAATCTGCATCCTGAGGTTTA (4227) | 0.95 | 5391 |
| | mtr-miR2111s | TAATCTGCATCCTGAGGTTTA (4228) | 0.95 | 5392 |
| | tcc-miR2111 | TAATCTGCATCCTGAGGTTTA (4229) | 0.95 | 5393 |
| zma-miR396b-3p | aly-miR396a-3p | GTTCAATAAAGCTGTGGGAAG (4230) | 0.95 | 5394 |
| | aly-miR396b-3p | GCTCAAGAAAGCTGTGGGAAA (4231) | 0.9 | 5395 |
| | csi-miR396c | TTCAAGAAATCTGTGGGAAG (4232) | 0.81 | 5396 |
| | gma-miR396d | AAGAAAGCTGTGGGAGAATATGGC (4233) | 0.71 | 5397 |
| | osa-miR396e* | GTTCAAGAAAGCCCATGGAAA (4234) | 0.76 | 5398 |
| | osa-miR396e-3p | ATGGTTCAAGAAAGCCCATGGAAA (4235) | 0.76 | 5399 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | osa-miR396f* | GTTCAAGAAAGTCCTTGGAAA (4236) | 0.76 | 5400 |
| | osa-miR396f-3p | ATAGTTCAAGAAAGTCCTTGGAAA (4237) | 0.76 | 5401 |
| | zma-miR396a* | GTTCAATAAAGCTGTGGGAAA (4238) | 1 | 5402 |
| | zma-miR396e* | GGTCAAGAAAGCCGTGGGAAG (4239) | 0.81 | 5403 |
| | zma-miR396f* | GGTCAAGAAAGCTGTGGGAAG (4240) | 0.86 | 5404 |
| | zma-miR396g* | GTTCAAGAAAGCTGTGGAAGA (4241) | 0.86 | 5405 |
| ctr-miR171 | aly-miR171a | TGATTGAGCCGCGCCAATATC (4242) | 0.81 | 5406 |
| | aly-miR171b | TTGAGCCGTGCCAATATCACG (4243) | 0.81 | 5407 |
| | aly-miR171c | TTGAGCCGTGCCAATATCACG (4244) | 0.81 | 5408 |
| | aqc-miR171a | TGATTGAGCCGTGCCAATATC (4245) | 0.76 | 5409 |
| | aqc-miR171b | TGATTGAGCCGTGCCAATATC (4246) | 0.76 | 5410 |
| | aqc-miR171c | TAATTGAACCGCACTAATATC (4247) | 0.67 | 5411 |
| | aqc-miR171d | TGATTGAGCCGTGCCAATATC (4248) | 0.76 | 5412 |
| | aqc-miR171e | TGAATGAACCGAGCCAACATC (4249) | 0.62 | 5413 |
| | aqc-miR171f | TAATTGAGCCGTGCCAATATC (4250) | 0.76 | 5414 |
| | ath-miR171a | TGATTGAGCCGCGCCAATATC (4251) | 0.81 | 5415 |
| | ath-miR171b | TTGAGCCGTGCCAATATCACG (4252) | 0.81 | 5416 |
| | ath-miR171c | TTGAGCCGTGCCAATATCACG (4253) | 0.81 | 5417 |
| | bdi-miR171a | TGATTGAGCCGCGCCAATATC (4254) | 0.81 | 5418 |
| | bdi-miR171b | TGATTGAGCCGTGCCAATATC (4255) | 0.76 | 5419 |
| | bdi-miR171c | TGATTGAGCCGTGCCAATATC (4256) | 0.76 | 5420 |
| | bdi-miR171d | TGATTGAGCCGTGCCAATATC (4257) | 0.76 | 5421 |
| | bna-miR171a | TTGAGCCGTGCCAATATCACG (4258) | 0.81 | 5422 |
| | bna-miR171b | TTGAGCCGTGCCAATATCACG (4259) | 0.81 | 5423 |
| | bna-miR171c | TTGAGCCGTGCCAATATCACG (4260) | 0.81 | 5424 |
| | bna-miR171d | TTGAGCCGTGCCAATATCACG (4261) | 0.81 | 5425 |
| | bna-miR171e | TTGAGCCGTGCCAATATCACG (4262) | 0.81 | 5426 |
| | bna-miR171f | TGATTGAGCCGCGCCAATATC (4263) | 0.81 | 5427 |
| | bna-miR171g | TGATTGAGCCGCGCCAATATCT (4264) | 0.86 | 5428 |
| | bol-miR171a | TTGAGCCGTGCCAATATCACG (4265) | 0.81 | 5429 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | bra-miR171a | TTGAGCCGTGCCAATATCACG (4266) | 0.81 | 5430 |
| | bra-miR171b | TTGAGCCGTGCCAATATCACG (4267) | 0.81 | 5431 |
| | bra-miR171c | TTGAGCCGTGCCAATATCACG (4268) | 0.81 | 5432 |
| | bra-miR171d | TTGAGCCGTGCCAATATCACG (4269) | 0.81 | 5433 |
| | bra-miR171e | TGATTGAGCCGCGCCAATATC (4270) | 0.81 | 5434 |
| | ccl-miR171 | TGATTGAGCCGCGCCAATATC (4271) | 0.81 | 5435 |
| | crt-miR171 | TGATTGAGCCGTGCCAATATC (4272) | 0.76 | 5436 |
| | csi-miR171a | TTGAGCCGCGCCAATATCAC (4273) | 0.86 | 5437 |
| | csi-miR171b | CGAGCCGAATCAATATCACTC (4274) | 0.71 | 5438 |
| | ctr-miR171 | TTGAGCCGCGTCAATATCTCC (4275) | 1 | 5439 |
| | far-miR171 | TGATTGAGCCGTGCCAATATC (4276) | 0.76 | 5440 |
| | gma-miR171a | TGAGCCGTGCCAATATCACGA (4277) | 0.76 | 5441 |
| | gma-miR171b-3p | CGAGCCGAATCAATATCACTC (4278) | 0.71 | 5442 |
| | hvu-miR171 | TGATTGAGCCGTGCCAATATC (4279) | 0.76 | 5443 |
| | mtr-miR171 | TGATTGAGTCGTGCCAATATC (4280) | 0.71 | 5444 |
| | mtr-miR171b | TGATTGAGCCGCGTCAATATC (4281) | 0.86 | 5445 |
| | mtr-miR171c | TGATTGAGCCGTGCCAATATT (4282) | 0.71 | 5446 |
| | mtr-miR171d | TGATTGAGCCGTGCCAATATC (4283) | 0.76 | 5447 |
| | mtr-miR171e | AGATTGAGCCGCGCCAATATC (4284) | 0.81 | 5448 |
| | mtr-miR171f | TTGAGCCGTGCCAATATCACG (4285) | 0.81 | 5449 |
| | mtr-miR171g | TGATTGAGCCGTGCCAATATC (4286) | 0.76 | 5450 |
| | osa-miR171a | TGATTGAGCCGCGCCAATATC (4287) | 0.81 | 5451 |
| | osa-miR171b | TGATTGAGCCGTGCCAATATC (4288) | 0.76 | 5452 |
| | osa-miR171c | TGATTGAGCCGTGCCAATATC (4289) | 0.76 | 5453 |
| | osa-miR171d | TGATTGAGCCGTGCCAATATC (4290) | 0.76 | 5454 |
| | osa-miR171e | TGATTGAGCCGTGCCAATATC (4291) | 0.76 | 5455 |
| | osa-miR171f | TGATTGAGCCGTGCCAATATC (4292) | 0.76 | 5456 |
| | osa-miR171g | GAGGTGAGCCGAGCCAATATC (4293) | 0.71 | 5457 |
| | osa-miR171h | GTGAGCCGAACCAATATCACT (4294) | 0.71 | 5458 |
| | osa-miR171i | GGATTGAGCCGCGTCAATATC (4295) | 0.86 | 5459 |
| | ppt-miR171a | TGAGCCGCGCCAATATCACAT (4296) | 0.81 | 5460 |
| | ppt-miR171b | TTGAGCCGCGCCAATATCACA (4297) | 0.86 | 5461 |
| | pta-miR171 | TGATTGAGACGAGTCCATATC (4298) | 0.71 | 5462 |
| | ptc-miR171a | TTGAGCCGTGCCAATATCACG (4299) | 0.81 | 5463 |
| | ptc-miR171b | TTGAGCCGTGCCAATATCACG (4300) | 0.81 | 5464 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | ptc-miR171c | AGATTGAGCCGCGCCAATATC (4301) | 0.81 | 5465 |
| | ptc-miR171d | AGATTGAGCCGCGCCAATATC (4302) | 0.81 | 5466 |
| | ptc-miR171e | TGATTGAGCCGTGCCAATATC (4303) | 0.76 | 5467 |
| | ptc-miR171f | TGATTGAGCCGTGCCAATATC (4304) | 0.76 | 5468 |
| | ptc-miR171g | TGATTGAGCCGTGCCAATATC (4305) | 0.76 | 5469 |
| | ptc-miR171h | TGATTGAGCCGTGCCAATATC (4306) | 0.76 | 5470 |
| | ptc-miR171i | TGATTGAGCCGTGCCAATATC (4307) | 0.76 | 5471 |
| | ptc-miR171j | GGATTGAGCCGCGCCAATACT (4308) | 0.71 | 5472 |
| | ptc-miR171k | GGATTGAGCCGCGCCAATATC (4309) | 0.81 | 5473 |
| | ptc-miR171l | CGAGCCGAATCAATATCACT (4310) | 0.71 | 5474 |
| | ptc-miR171m | CGAGCCGAATCAATATCACT (4311) | 0.71 | 5475 |
| | ptc-miR171n | CGAGCCGAATCAATATCACT (4312) | 0.71 | 5476 |
| | rco-miR171a | TTGAGCCGTGCCAATATCACG (4313) | 0.81 | 5477 |
| | rco-miR171b | TTGAGCCGTGCCAATATCACG (4314) | 0.81 | 5478 |
| | rco-miR171c | TGATTGAGCCGTGCCAATATC (4315) | 0.76 | 5479 |
| | rco-miR171d | TGATTGAGCCGTGCCAATATC (4316) | 0.76 | 5480 |
| | rco-miR171e | TGATTGAGCCGTGCCAATATC (4317) | 0.76 | 5481 |
| | rco-miR171f | TGATTGAGCCGTGCCAATATC (4318) | 0.76 | 5482 |
| | rco-miR171g | AGATTGAGCCGCGCCAATATC (4319) | 0.81 | 5483 |
| | sbi-miR171a | TGATTGAGCCGTGCCAATATC (4320) | 0.76 | 5484 |
| | sbi-miR171b | TGATTGAGCCGTGCCAATATC (4321) | 0.76 | 5485 |
| | sbi-miR171c | GAGGTGAGCCGAGCCAATATC (4322) | 0.71 | 5486 |
| | sbi-miR171d | TGATTGAGCCGTGCCAATATC (4323) | 0.76 | 5487 |
| | sbi-miR171e | GTGAGCCGAACCAATATCACT (4324) | 0.71 | 5488 |
| | sbi-miR171f | ATGAGCCGAACCAATATCACT (4325) | 0.71 | 5489 |
| | sbi-miR171g | TGATTGAGCCGCGCCAATATC (4326) | 0.81 | 5490 |
| | sbi-miR171h | GGATTGAGCCGCGTCAATATC (4327) | 0.86 | 5491 |
| | sbi-miR171i | TGATTGAGCCGTGCCAATATC (4328) | 0.76 | 5492 |
| | sbi-miR171j | TGATTGAGCCGCGCCAATATC (4329) | 0.81 | 5493 |
| | sbi-miR171k | TGATTGAGCCGTGCCAATATC (4330) | 0.76 | 5494 |
| | sly-miR171a | TGATTGAGCCGTGCCAATATC (4331) | 0.76 | 5495 |
| | sly-miR171b | TTGAGCCGTGCCAATATCACG (4332) | 0.81 | 5496 |
| | sly-miR171d | TTGAGCCGCGCCAATATCAC (4333) | 0.86 | 5497 |
| | smo-miR171a | TTGAGCCGTGCCAATATCACT (4334) | 0.81 | 5498 |
| | smo-miR171b | TGAGCCGTGCCAATATCACAT (4335) | 0.76 | 5499 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | smo-miR171c | TTGAGTCGCGCCAATATCATG (4336) | 0.76 | 5500 |
| | smo-miR171d | TGAGCCGCGCCAATATCACAT (4337) | 0.81 | 5501 |
| | tae-miR171a | TGATTGAGCCGTGCCAATATC (4338) | 0.76 | 5502 |
| | tae-miR171b | TTGAGCCGTGCCAATATCACG (4339) | 0.81 | 5503 |
| | tcc-miR171a | TGATTGAGCCGCGCCAATATC (4340) | 0.81 | 5504 |
| | tcc-miR171b | AGATTGAGCCGCGCCAATATC (4341) | 0.81 | 5505 |
| | tcc-miR171c | AGATTGAGCCGCGCCAATATC (4342) | 0.81 | 5506 |
| | tcc-miR171d | TGATTGAGCCGTGCCAATATC (4343) | 0.76 | 5507 |
| | tcc-miR171e | TGATTGAGCCGTGCCAATATC (4344) | 0.76 | 5508 |
| | tcc-miR171f | TGATTGAGCCGTGCCAATATC (4345) | 0.76 | 5509 |
| | tcc-miR171g | TGATTGAGCCGTGCCAATATC (4346) | 0.76 | 5510 |
| | tcc-miR171h | TGATTGAGCCGTGCCAATATC (4347) | 0.76 | 5511 |
| | vvi-miR171a | TGATTGAGCCGTGCCAATATC (4348) | 0.76 | 5512 |
| | vvi-miR171b | TGATTGAGCCGCGTCAATATC (4349) | 0.86 | 5513 |
| | vvi-miR171c | TGATTGAGCCGTGCCAATATC (4350) | 0.76 | 5514 |
| | vvi-miR171d | TGATTGAGCCGTGCCAATATC (4351) | 0.76 | 5515 |
| | vvi-miR171e | TGATTGAGCCGCGCCAATATC (4352) | 0.81 | 5516 |
| | vvi-miR171f | TTGAGCCGCGCCAATATCACT (4353) | 0.86 | 5517 |
| | vvi-miR171g | TTGAGCCGAACCAATATCACC (4354) | 0.81 | 5518 |
| | vvi-miR171h | TGGTTGAGCCGCGCCAATATC (4355) | 0.81 | 5519 |
| | vvi-miR171i | TGATTGAGCCGTGCCAATATC (4356) | 0.76 | 5520 |
| | zma-miR171a | TGATTGAGCCGCGCCAATAT (4357) | 0.76 | 5521 |
| | zma-miR171b | TTGAGCCGTGCCAATATCAC (4358) | 0.81 | 5522 |
| | zma-miR171c | TGACTGAGCCGTGCCAATATC (4359) | 0.71 | 5523 |
| | zma-miR171d | TGATTGAGCCGTGCCAATATC (4360) | 0.76 | 5524 |
| | zma-miR171e | TGATTGAGCCGTGCCAATATC (4361) | 0.76 | 5525 |
| | zma-miR171f | TTGAGCCGTGCCAATATCACA (4362) | 0.81 | 5526 |
| | zma-miR171g | GAGGTGAGCCGAGCCAATATC (4363) | 0.71 | 5527 |
| | zma-miR171h | GTGAGCCGAACCAATATCACT (4364) | 0.71 | 5528 |
| | zma-miR171i | TGATTGAGCCGTGCCAATATC (4365) | 0.76 | 5529 |
| | zma-miR171j | TGATTGAGCCGTGCCAATATC (4366) | 0.76 | 5530 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | zma-miR171k | GTGAGCCGAACCAATATCACT (4367) | 0.71 | 5531 |
| | zma-miR171l | GGATTGAGCCGCGTCAATATC (4368) | 0.86 | 5532 |
| | zma-miR171m | GGATTGAGCCGCGTCAATATC (4369) | 0.86 | 5533 |
| | zma-miR171n | TGATTGAGCCGCGCCAATATC (4370) | 0.81 | 5534 |
| aly-miR160c-3p | ahy-miR160-3p | GCATGAAGGGAGTCACGCAGG (4371) | 0.67 | 5535 |
| | aly-miR160a* | GCGTATGAGGAGCCATGCATA (4372) | 0.81 | 5536 |
| | aly-miR160b* | GCGTACAGAGTAGTCAAGCATG (4373) | 0.86 | 5537 |
| | bra-miR160a-3p | GCGTATGAGGAGCCATGCATA (4374) | 0.81 | 5538 |
| | zma-miR160a* | GCGTGCAAGGGGCCAAGCATG (4375) | 0.9 | 5539 |
| | zma-miR160b* | GCGTGCAAGGAGCCAAGCATG (4376) | 0.95 | 5540 |
| | zma-miR160c* | GCGTGCATGGTGCCAAGCATA (4377) | 0.81 | 5541 |
| | zma-miR160d* | GCGTGCGTGGAGCCAAGCATG (4378) | 0.86 | 5542 |
| | zma-miR160f* | GCGTGCGAGGTGCCAGGCATG (4379) | 0.81 | 5543 |
| | zma-miR160g* | GCGTGCAAGGAGCCAAGCATG (4380) | 0.95 | 5544 |
| bra-miR160a-3p | aly-miR160a* | GCGTATGAGGAGCCATGCATA (4381) | 1 | 5545 |
| | aly-miR160b* | GCGTACAGAGTAGTCAAGCATG (4382) | 0.76 | 5546 |
| | aly-miR160c-3p | GCGTACAAGGAGCCAAGCATG (4383) | 0.81 | 5547 |
| | zma-miR160a* | GCGTGCAAGGGGCCAAGCATG (4384) | 0.71 | 5548 |
| | zma-miR160b* | GCGTGCAAGGAGCCAAGCATG (4385) | 0.76 | 5549 |
| | zma-miR160c* | GCGTGCATGGTGCCAAGCATA (4386) | 0.71 | 5550 |
| | zma-miR160d* | GCGTGCGTGGAGCCAAGCATG (4387) | 0.76 | 5551 |
| | zma-miR160f* | GCGTGCGAGGTGCCAGGCATG (4388) | 0.76 | 5552 |
| | zma-miR160g* | GCGTGCAAGGAGCCAAGCATG (4389) | 0.76 | 5553 |
| gma-miR1507a | ahy-miR1507 | CCTCGTTCCATACATCATCTA (4390) | 0.77 | 5554 |
| | gma-miR1507b | TCTCATTCCATACATCGTCTG (4391) | 0.95 | 5555 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | gso-miR1507a | TCTCATTCCATACATCGTCTGA (4392) | 1 | 5556 |
| | gso-miR1507b | TCTCATTCCATACATCGTCTGA (4393) | 1 | 5557 |
| | mtr-miR1507 | CCTCGTTCCATACATCATCTAG (4394) | 0.77 | 5558 |
| | vun-miR1507a | TCTCATTCCATACATCGTCTG (4395) | 0.95 | 5559 |
| | vun-miR1507b | TCTCATTCCATACATCGTCTG (4396) | 0.95 | 5560 |
| gma-miR4371b | gma-miR4371a | AAGTGATGACATGACAAGCGAAGT (4397) | 0.75 | 5561 |
| gso-miR482a | aqc-miR482a | TCTTGCCGACTCCTCCCATACC (4398) | 0.86 | 5562 |
| | aqc-miR482b | TCTTGCCGACTCCTCCCATACC (4399) | 0.86 | 5563 |
| | aqc-miR482c | TCTTGCCGACTCCTCCCATACC (4400) | 0.86 | 5564 |
| | csi-miR482a | TCTTCCCTATGCCTCCCATTCC (4401) | 0.86 | 5565 |
| | csi-miR482b | TCTTGCCCACCCCTCCCATTCC (4402) | 0.81 | 5566 |
| | csi-miR482c | TTCCCTAGTCCCCCTATTCCTA (4403) | 0.67 | 5567 |
| | ghr-miR482a | TCTTTCCTACTCCTCCCATACC (4404) | 0.9 | 5568 |
| | ghr-miR482b | TCTTGCCTACTCCACCCATGCC (4405) | 0.81 | 5569 |
| | gma-miR482 | TCTTCCCAATTCCGCCCATTCCTA (4406) | 0.76 | 5570 |
| | gma-miR482a-3p | TCTTCCCAATTCCGCCCATTCCTA (4407) | 0.76 | 5571 |
| | gra-miR482 | TCTTTCCAATTCCTCCCATTCC (4408) | 0.76 | 5572 |
| | gso-miR482b | TCTTCCCTACACCTCCCATAC (4409) | 1 | 5573 |
| | mdm-miR482 | TCTTCCCAAGCCCGCCCATTCC (4410) | 0.76 | 5574 |
| | mdo-miR482 | TCTTCCCAAGCCCGCCCATTCC (4411) | 0.76 | 5575 |
| | pab-miR482a | TCTTCCCTACTCCTCCCATTCC (4412) | 0.9 | 5576 |
| | pab-miR482b | TCTTCCCTATTCCTCCCATTCC (4413) | 0.86 | 5577 |
| | pab-miR482c | TCTTTCCTACTCCTCCCATTCC (4414) | 0.86 | 5578 |
| | pta-miR482a | TCTTCCCTACTCCTCCCATTCC (4415) | 0.9 | 5579 |
| | pta-miR482b | TCTTCCCTACTCCTCCCATTCC (4416) | 0.9 | 5580 |
| | pta-miR482c | TCTTCCCTATTCCTCCCATT (4417) | 0.81 | 5581 |
| | pta-miR482d | TCCTCCCTACTCCTCCCATT (4418) | 0.81 | 5582 |
| | ptc-miR482.1 | CCTACTCCTCCCATTCC (4419) | 0.67 | 5583 |
| | ptc-miR482.2 | TCTTGCCTACTCCTCCCATT (4420) | 0.81 | 5584 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | pvu-miR482 | TCTTCCCAATTCCGCCCATTCC (4421) | 0.76 | 5585 |
| | sly-miR482 | TTTCCAATTCCACCCATTCCTA (4422) | 0.62 | 5586 |
| | vvi-miR482 | TCTTTCCTACTCCTCCCATTCC (4423) | 0.86 | 5587 |
| | zma-miR482 | TCTTCCTTGTTCCTCCCATT (4424) | 0.71 | 5588 |
| osa-miR1846e | osa-miR1846a-5p | AGTGAGGAGGCCGGGGCCGCT (4425) | 0.75 | 5589 |
| | osa-miR1846b-5p | AGTGAGGAGGCCGGGGCCGCT (4426) | 0.75 | 5590 |
| | osa-miR1846c-5p | AGTGAGGAGGCCGGGGCCGCT (4427) | 0.75 | 5591 |
| ppt-miR166m | aly-miR166a | TCGGACCAGGCTTCATTCCCC (4428) | 0.86 | 5592 |
| | aly-miR166b | TCGGACCAGGCTTCATTCCCC (4429) | 0.86 | 5593 |
| | aly-miR166c | TCGGACCAGGCTTCATTCCCC (4430) | 0.86 | 5594 |
| | aly-miR166d | TCGGACCAGGCTTCATTCCCC (4431) | 0.86 | 5595 |
| | aly-miR166e | TCGGACCAGGCTTCATTCCCC (4432) | 0.86 | 5596 |
| | aly-miR166f | TCGGACCAGGCTTCATTCCCC (4433) | 0.86 | 5597 |
| | aly-miR166g | TCGGACCAGGCTTCATTCCCC (4434) | 0.86 | 5598 |
| | aqc-miR166a | TCGGACCAGGCTTCATTCCTC (4435) | 0.9 | 5599 |
| | aqc-miR166b | TCGGACCAGGCTTCATTCCCC (4436) | 0.86 | 5600 |
| | aqc-miR166c | TCGGACCAGGCTTCATTCCT (4437) | 0.9 | 5601 |
| | aqc-miR166d | TCGGACCAGGCTTCATTCCTC (4438) | 0.9 | 5602 |
| | aqc-miR166e | TCGGACCAGGCTTCATTCCCC (4439) | 0.86 | 5603 |
| | ath-miR166a | TCGGACCAGGCTTCATTCCCC (4440) | 0.86 | 5604 |
| | ath-miR166b | TCGGACCAGGCTTCATTCCCC (4441) | 0.86 | 5605 |
| | ath-miR166c | TCGGACCAGGCTTCATTCCCC (4442) | 0.86 | 5606 |
| | ath-miR166d | TCGGACCAGGCTTCATTCCCC (4443) | 0.86 | 5607 |
| | ath-miR166e | TCGGACCAGGCTTCATTCCCC (4444) | 0.86 | 5608 |
| | ath-miR166f | TCGGACCAGGCTTCATTCCCC (4445) | 0.86 | 5609 |
| | ath-miR166g | TCGGACCAGGCTTCATTCCCC (4446) | 0.86 | 5610 |
| | bdi-miR166 | TCGGACCAGGCTTCATTCCCC (4447) | 0.86 | 5611 |
| | bdi-miR166a | TCGGACCAGGCTTCATTCCCC (4448) | 0.86 | 5612 |
| | bdi-miR166b | TCGGACCAGGCTTCATTCCCC (4449) | 0.86 | 5613 |
| | bdi-miR166c | TCGGACCAGGCTTCATTCCCC (4450) | 0.86 | 5614 |
| | bdi-miR166d | TCGGACCAGGCTTCATTCCCC (4451) | 0.86 | 5615 |
| | bdi-miR166e | CTCGGACCAGGCTTCATTCCC (4452) | 0.86 | 5616 |
| | bdi-miR166f | TCTCGGACCAGGCTTCATTCC (4453) | 0.86 | 5617 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | bna-miR166a | TCGGACCAGGCTTCATTCCCC (4454) | 0.86 | 5618 |
| | bna-miR166b | TCGGACCAGGCTTCATTCCCC (4455) | 0.86 | 5619 |
| | bna-miR166c | TCGGACCAGGCTTCATTCCCC (4456) | 0.86 | 5620 |
| | bna-miR166d | TCGGACCAGGCTTCATTCCCC (4457) | 0.86 | 5621 |
| | cpt-miR166 | TCGGACCAGGCTTCATTCCC (4458) | 0.86 | 5622 |
| | crt-miR166a | TCGGACCAGGCTTCATTCCCGT (4459) | 0.86 | 5623 |
| | crt-miR166b | TCGGACCAGGCTTCATTCCCTT (4460) | 0.9 | 5624 |
| | csi-miR166 | TCGGACCAGGCTTCATTCCCC (4461) | 0.86 | 5625 |
| | csi-miR166a | TCGGACCAGGCTTCATTCCCCC (4462) | 0.86 | 5626 |
| | csi-miR166b | TCGGACCAGGCTTCATTCCCGT (4463) | 0.86 | 5627 |
| | csi-miR166c | TCGGACCAGGCTTCATTCCC (4464) | 0.86 | 5628 |
| | csi-miR166d | TCGGACCAGGCTTCATTCCCT (4465) | 0.9 | 5629 |
| | csi-miR166e | TCGGACCAGGCTTCATTCCCC (4466) | 0.86 | 5630 |
| | ctr-miR166 | TCGGACCAGGCTTCATTCCCCC (4467) | 0.86 | 5631 |
| | far-miR166 | CCGGACCAGGCTTCATCCCAG (4468) | 0.76 | 5632 |
| | flm-miR166 | TCGGACCAGGCTTCATCCCCC (4469) | 0.81 | 5633 |
| | ghr-miR166a | TCGGACCAGGCTTCATTCCCC (4470) | 0.86 | 5634 |
| | ghr-miR166b | TCGGACCAGGCTTCATTCCCC (4471) | 0.86 | 5635 |
| | gma-miR166a | TCGGACCAGGCTTCATTCCCC (4472) | 0.86 | 5636 |
| | gma-miR166b | TCGGACCAGGCTTCATTCCCC (4473) | 0.86 | 5637 |
| | gma-miR166n | TCGGACCAGGCTTCATTCCCC (4474) | 0.86 | 5638 |
| | gma-miR166o | TCGGACCAGGCTTCATTCCCC (4475) | 0.86 | 5639 |
| | gma-miR166q | TCGGACCAGGCTTCATTCCCG (4476) | 0.86 | 5640 |
| | gma-miR166r | TCGGACCAGGCTTCATTCCCT (4477) | 0.9 | 5641 |
| | hvu-miR166 | TCGGACCAGGCTTCATTCCCC (4478) | 0.86 | 5642 |
| | hvu-miR166b | TCGGACCAGGCTTCATTCCCC (4479) | 0.86 | 5643 |
| | hvu-miR166c | TCGGACCAGGCTTCATTCCCC (4480) | 0.86 | 5644 |
| | hvv-miR166 | TCGGACCAGGCTTCATTCCCC (4481) | 0.86 | 5645 |
| | ini-miR166 | TCGGACCAGGCTTCATTCCTC (4482) | 0.9 | 5646 |
| | mtr-miR166 | TCGGACCAGGCTTCATTCCCC (4483) | 0.86 | 5647 |
| | mtr-miR166b | TCGGACCAGGCTTCATTCCTA (4484) (TCGGACCAGGCTTCATTCCCC (5115) | 0.9 | 5648 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | mtr-miR166c | TCGGACCAGGCTTCATTCCTC (4485) | 0.9 | 5649 |
| | mtr-miR166d | TCGGGCCAGGCTTCATCCCCC (4486) | 0.76 | 5650 |
| | mtr-miR166e | TCGGACCAGGCTTCATTCCCC (4487) | 0.86 | 5651 |
| | mtr-miR166f | TCGGACCAGGCTTCATTCCTC (4488) | 0.9 | 5652 |
| | mtr-miR166g | TCGGACCAGGCTTCATTCCCC (4489) | 0.86 | 5653 |
| | mtr-miR166h | TCGGACCAGGCTTCATTCCCC (4490) | 0.86 | 5654 |
| | nsy-miR166 | TCGGACCAGGCTTCATTCCCC (4491) | 0.86 | 5655 |
| | osa-miR166a | TCGGACCAGGCTTCATTCCCC (4492) | 0.86 | 5656 |
| | osa-miR166b | TCGGACCAGGCTTCATTCCCC (4493) | 0.86 | 5657 |
| | osa-miR166c | TCGGACCAGGCTTCATTCCCC (4494) | 0.86 | 5658 |
| | osa-miR166d | TCGGACCAGGCTTCATTCCCC (4495) | 0.86 | 5659 |
| | osa-miR166e | TCGAACCAGGCTTCATTCCCC (4496) | 0.81 | 5660 |
| | osa-miR166f | TCGGACCAGGCTTCATTCCCC (4497) | 0.86 | 5661 |
| | osa-miR166g | TCGGACCAGGCTTCATTCCTC (4498) | 0.9 | 5662 |
| | osa-miR166h | TCGGACCAGGCTTCATTCCTC (4499) | 0.9 | 5663 |
| | osa-miR166i | TCGGATCAGGCTTCATTCCTC (4500) | 0.86 | 5664 |
| | osa-miR166j | TCGGATCAGGCTTCATTCCTC (4501) | 0.86 | 5665 |
| | osa-miR166k | TCGGACCAGGCTTCAATCCCT (4502) | 0.86 | 5666 |
| | osa-miR166l | TCGGACCAGGCTTCAATCCCT (4503) | 0.86 | 5667 |
| | osa-miR166m | TCGGACCAGGCTTCATTCCCT (4504) | 0.9 | 5668 |
| | osa-miR166n | TCGGACCAGGCTTCATTCCCC (4505) | 0.86 | 5669 |
| | pab-miR166a | TCGGACCAGGCTTCATTCCTC (4506) | 0.9 | 5670 |
| | pab-miR166b | TCGGACCAGGCTTCATTCCTT (4507) | 0.95 | 5671 |
| | pga-miR166 | TCGGACCAGGCTTCATTCCTT (4508) | 0.95 | 5672 |
| | ppt-miR166a | TCGGACCAGGCTTCATTCCCC (4509) | 0.86 | 5673 |
| | ppt-miR166b | TCGGACCAGGCTTCATTCCCC (4510) | 0.86 | 5674 |
| | ppt-miR166c | TCGGACCAGGCTTCATTCCCC (4511) | 0.86 | 5675 |
| | ppt-miR166d | TCGGACCAGGCTTCATTCCCC (4512) | 0.86 | 5676 |
| | ppt-miR166e | TCGGACCAGGCTTCATTCCCC (4513) | 0.86 | 5677 |
| | ppt-miR166f | TCGGACCAGGCTTCATTCCCC (4514) | 0.86 | 5678 |
| | ppt-miR166g | TCGGACCAGGCTTCATTCCCC (4515) | 0.86 | 5679 |
| | ppt-miR166h | TCGGACCAGGCTTCATTCCCC (4516) | 0.86 | 5680 |
| | ppt-miR166i | TCGGACCAGGCTTCATTCCCC (4517) | 0.86 | 5681 |
| | ppt-miR166j | TCCGGACCAGGCTTCATTCCC (4518) | 0.81 | 5682 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | ppt-miR166k | TCCGGACCAGGCTTCATTCCCC (4519) | 0.81 | 5683 |
| | ppt-miR166l | TCCGGACCAGGCTTCATTCCCC (4520) | 0.81 | 5684 |
| | pta-miR166a | TCGGACCAGGCTTCATTCCCC (4521) | 0.86 | 5685 |
| | pta-miR166b | TCGGACCAGGCTTCATTCCCC (4522) | 0.86 | 5686 |
| | pta-miR166c | CCGGACCAGGCTTCATCCCAG (4523) | 0.76 | 5687 |
| | ptc-miR166a | TCGGACCAGGCTTCATTCCCC (4524) | 0.86 | 5688 |
| | ptc-miR166b | TCGGACCAGGCTTCATTCCCC (4525) | 0.86 | 5689 |
| | ptc-miR166c | TCGGACCAGGCTTCATTCCCC (4526) | 0.86 | 5690 |
| | ptc-miR166d | TCGGACCAGGCTTCATTCCCC (4527) | 0.86 | 5691 |
| | ptc-miR166e | TCGGACCAGGCTTCATTCCCC (4528) | 0.86 | 5692 |
| | ptc-miR166f | TCGGACCAGGCTTCATTCCCC (4529) | 0.86 | 5693 |
| | ptc-miR166g | TCGGACCAGGCTTCATTCCCC (4530) | 0.86 | 5694 |
| | ptc-miR166h | TCGGACCAGGCTTCATTCCCC (4531) | 0.86 | 5695 |
| | ptc-miR166i | TCGGACCAGGCTTCATTCCCC (4532) | 0.86 | 5696 |
| | ptc-miR166j | TCGGACCAGGCTTCATTCCCC (4533) | 0.86 | 5697 |
| | ptc-miR166k | TCGGACCAGGCTTCATTCCCC (4534) | 0.86 | 5698 |
| | ptc-miR166l | TCGGACCAGGCTTCATTCCCC (4535) | 0.86 | 5699 |
| | ptc-miR166m | TCGGACCAGGCTTCATTCCCC (4536) | 0.86 | 5700 |
| | ptc-miR166n | TCGGACCAGGCTTCATTCCTT (4537) | 0.95 | 5701 |
| | ptc-miR166o | TCGGACCAGGCTTCATTCCTT (4538) | 0.95 | 5702 |
| | ptc-miR166p | TCGGACCAGGCTCCATTCCTT (4539) | 0.9 | 5703 |
| | ptc-miR166q | TCGGACCAGGCTTCATTCCTT (4540) | 0.95 | 5704 |
| | pvu-miR166 | TCGGACCAGGCTTCATTCCCC (4541) | 0.86 | 5705 |
| | pvu-miR166a | TCGGACCAGGCTTCATTCCCC (4542) | 0.86 | 5706 |
| | rco-miR166a | TCGGACCAGGCTTCATTCCCC (4543) | 0.86 | 5707 |
| | rco-miR166b | TCGGACCAGGCTTCATTCCCC (4544) | 0.86 | 5708 |
| | rco-miR166c | TCGGACCAGGCTTCATTCCCC (4545) | 0.86 | 5709 |
| | rco-miR166d | TCGGACCAGGCTTCATTCCCC (4546) | 0.86 | 5710 |
| | rco-miR166e | TCGGACCAGGCTTCATTCCCC (4547) | 0.86 | 5711 |
| | sbi-miR166a | TCGGACCAGGCTTCATTCCC (4548) | 0.86 | 5712 |
| | sbi-miR166b | TCGGACCAGGCTTCATTCCC (4549) | 0.86 | 5713 |
| | sbi-miR166c | TCGGACCAGGCTTCATTCCC (4550) | 0.86 | 5714 |
| | sbi-miR166d | TCGGACCAGGCTTCATTCCC (4551) | 0.86 | 5715 |
| | sbi-miR166e | TCGGACCAGGCTTCAATCCCT (4552) | 0.86 | 5716 |
| | sbi-miR166f | TCGGACCAGGCTTCATTCCTC (4553) | 0.9 | 5717 |
| | sbi-miR166g | TCGGACCAGGCTTCAATCCCT (4554) | 0.86 | 5718 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | sbi-miR166h | TCGGACCAGGCTTCATTCCC (4555) | 0.86 | 5719 |
| | sbi-miR166i | TCGGACCAGGCTTCATTCCC (4556) | 0.86 | 5720 |
| | sbi-miR166j | TCGGACCAGGCTTCATTCCC (4557) | 0.86 | 5721 |
| | sbi-miR166k | TCGGACCAGGCTTCATTCCT (4558) | 0.9 | 5722 |
| | sly-miR166a | TCGGACCAGGCTTCATTCCCC (4559) | 0.86 | 5723 |
| | sly-miR166b | TCGGACCAGGCTTCATTCCCC (4560) | 0.86 | 5724 |
| | smo-miR166a | TCGGACCAGGCTTCATTCCCC (4561) | 0.86 | 5725 |
| | smo-miR166b | TCGGACCAGGCTTCATTCCCC (4562) | 0.86 | 5726 |
| | smo-miR166c | TCGGACCAGGCTTCATTCCCC (4563) | 0.86 | 5727 |
| | sof-miR166 | TCGGACCAGGCTTCATTCCCC (4564) | 0.86 | 5728 |
| | tae-miR166 | CCGGACCAGGCTTCATTCCCA (4565) | 0.81 | 5729 |
| | tcc-miR166a | TCGGACCAGGCTTCATTCCCC (4566) | 0.86 | 5730 |
| | tcc-miR166b | TCGGACCAGGCTTCATTCCC (4567) | 0.86 | 5731 |
| | tcc-miR166c | TCGGACCAGGCTTCATTCCTC (4568) | 0.9 | 5732 |
| | tcc-miR166d | TCGGACCAGGCTTCATTCCCC (4569) | 0.86 | 5733 |
| | vvi-miR166a | TCGGACCAGGCTTCATTCC (4570) | 0.86 | 5734 |
| | vvi-miR166b | TCGGACCAGGCTTCATTCC (4571) | 0.86 | 5735 |
| | vvi-miR166c | TCGGACCAGGCTTCATTCCCC (4572) | 0.86 | 5736 |
| | vvi-miR166d | TCGGACCAGGCTTCATTCCCC (4573) | 0.86 | 5737 |
| | vvi-miR166e | TCGGACCAGGCTTCATTCCCC (4574) | 0.86 | 5738 |
| | vvi-miR166f | TCGGACCAGGCTTCATTCCCC (4575) | 0.86 | 5739 |
| | vvi-miR166g | TCGGACCAGGCTTCATTCCCC (4576) | 0.86 | 5740 |
| | vvi-miR166h | TCGGACCAGGCTTCATTCCCC (4577) | 0.86 | 5741 |
| | zma-miR166a | TCGGACCAGGCTTCATTCCCC (4578) | 0.86 | 5742 |
| | zma-miR166b | TCGGACCAGGCTTCATTCCC (4579) | 0.86 | 5743 |
| | zma-miR166c | TCGGACCAGGCTTCATTCCC (4580) | 0.86 | 5744 |
| | zma-miR166d | TCGGACCAGGCTTCATTCCC (4581) | 0.86 | 5745 |
| | zma-miR166e | TCGGACCAGGCTTCATTCCC (4582) | 0.86 | 5746 |
| | zma-miR166f | TCGGACCAGGCTTCATTCCC (4583) | 0.86 | 5747 |
| | zma-miR166g | TCGGACCAGGCTTCATTCCC (4584) | 0.86 | 5748 |
| | zma-miR166h | TCGGACCAGGCTTCATTCCC (4585) | 0.86 | 5749 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | zma-miR166i | TCGGACCAGGCTTCATTCCCC (4586) | 0.86 | 5750 |
| | zma-miR166j | TCGGACCAGGCTTCAATCCCT (4587) | 0.86 | 5751 |
| | zma-miR166k | TCGGACCAGGCTTCAATCCCT (4588) | 0.86 | 5752 |
| | zma-miR166l | TCGGACCAGGCTTCATTCCTC (4589) | 0.9 | 5753 |
| | zma-miR166m | TCGGACCAGGCTTCATTCCTC (4590) | 0.9 | 5754 |
| | zma-miR166n | TCGGACCAGGCTTCAATCCCT (4591) | 0.86 | 5755 |
| | zma-miR166o | TCGGACCAGGCTTCATTCCCC (4592) | 0.86 | 5756 |
| | zma-miR166p | TCGGACCAGGCTTCATTCCCC (4593) | 0.86 | 5757 |
| | zma-miR166q | TCGGACCAGGCTTCATTCCCC (4594) | 0.86 | 5758 |
| | zma-miR166r | TCGGACCAGGCTTCATTCCCC (4595) | 0.86 | 5759 |
| | zma-miR166s | TCGGACCAGGCTTCATTCCCC (4596) | 0.86 | 5760 |
| | zma-miR166t | TCGGACCAGGCTTCATTCCCC (4597) | 0.86 | 5761 |
| | zma-miR166u | TCGGACCACGCTTCATTCCCC (4598) | 0.81 | 5762 |
| pta-miR166c | aly-miR166a | TCGGACCAGGCTTCATTCCCC (4599) | 0.81 | 5763 |
| | aly-miR166b | TCGGACCAGGCTTCATTCCCC (4600) | 0.81 | 5764 |
| | aly-miR166c | TCGGACCAGGCTTCATTCCCC (4601) | 0.81 | 5765 |
| | aly-miR166d | TCGGACCAGGCTTCATTCCCC (4602) | 0.81 | 5766 |
| | aly-miR166e | TCGGACCAGGCTTCATTCCCC (4603) | 0.81 | 5767 |
| | aly-miR166f | TCGGACCAGGCTTCATTCCCC (4604) | 0.81 | 5768 |
| | aly-miR166g | TCGGACCAGGCTTCATTCCCC (4605) | 0.81 | 5769 |
| | aqc-miR166a | TCGGACCAGGCTTCATTCCTC (4606) | 0.81 | 5770 |
| | aqc-miR166b | TCGGACCAGGCTTCATTCCCC (4607) | 0.81 | 5771 |
| | aqc-miR166c | TCGGACCAGGCTTCATTCCT (4608) | 0.81 | 5772 |
| | aqc-miR166d | TCGGACCAGGCTTCATTCCTC (4609) | 0.81 | 5773 |
| | aqc-miR166e | TCGGACCAGGCTTCATTCCCC (4610) | 0.81 | 5774 |
| | ath-miR166a | TCGGACCAGGCTTCATTCCCC (4611) | 0.81 | 5775 |
| | ath-miR166b | TCGGACCAGGCTTCATTCCCC (4612) | 0.81 | 5776 |
| | ath-miR166c | TCGGACCAGGCTTCATTCCCC (4613) | 0.81 | 5777 |
| | ath-miR166d | TCGGACCAGGCTTCATTCCCC (4614) | 0.81 | 5778 |
| | ath-miR166e | TCGGACCAGGCTTCATTCCCC (4615) | 0.81 | 5779 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | ath-miR166f | TCGGACCAGGCTTCATTCCCC (4616) | 0.81 | 5780 |
| | ath-miR166g | TCGGACCAGGCTTCATTCCCC (4617) | 0.81 | 5781 |
| | bdi-miR166 | TCGGACCAGGCTTCATTCCCC (4618) | 0.81 | 5782 |
| | bdi-miR166a | TCGGACCAGGCTTCATTCCCC (4619) | 0.81 | 5783 |
| | bdi-miR166b | TCGGACCAGGCTTCATTCCCC (4620) | 0.81 | 5784 |
| | bdi-miR166c | TCGGACCAGGCTTCATTCCCC (4621) | 0.81 | 5785 |
| | bdi-miR166d | TCGGACCAGGCTTCATTCCCC (4622) | 0.81 | 5786 |
| | bdi-miR166e | CTCGGACCAGGCTTCATTCCC (4623) | 0.81 | 5787 |
| | bdi-miR166f | TCTCGGACCAGGCTTCATTCC (4624) | 0.81 | 5788 |
| | bna-miR166a | TCGGACCAGGCTTCATTCCCC (4625) | 0.81 | 5789 |
| | bna-miR166b | TCGGACCAGGCTTCATTCCCC (4626) | 0.81 | 5790 |
| | bna-miR166c | TCGGACCAGGCTTCATTCCCC (4627) | 0.81 | 5791 |
| | bna-miR166d | TCGGACCAGGCTTCATTCCCC (4628) | 0.81 | 5792 |
| | cpt-miR166 | TCGGACCAGGCTTCATTCCC (4629) | 0.81 | 5793 |
| | crt-miR166a | TCGGACCAGGCTTCATTCCCGT (4630) | 0.86 | 5794 |
| | crt-miR166b | TCGGACCAGGCTTCATTCCCTT (4631) | 0.81 | 5795 |
| | csi-miR166 | TCGGACCAGGCTTCATTCCCC (4632) | 0.81 | 5796 |
| | csi-miR166a | TCGGACCAGGCTTCATTCCCCC (4633) | 0.81 | 5797 |
| | csi-miR166b | TCGGACCAGGCTTCATTCCCGT (4634) | 0.86 | 5798 |
| | csi-miR166c | TCGGACCAGGCTTCATTCCC (4635) | 0.81 | 5799 |
| | csi-miR166d | TCGGACCAGGCTTCATTCCCT (4636) | 0.81 | 5800 |
| | csi-miR166e | TCGGACCAGGCTTCATTCCCC (4637) | 0.81 | 5801 |
| | ctr-miR166 | TCGGACCAGGCTTCATTCCCCC (4638) | 0.81 | 5802 |
| | far-miR166 | CCGGACCAGGCTTCATCCCAG (4639) | 1 | 5803 |
| | flm-miR166 | TCGGACCAGGCTTCATCCCCC (4640) | 0.86 | 5804 |
| | ghr-miR166a | TCGGACCAGGCTTCATTCCCC (4641) | 0.81 | 5805 |
| | ghr-miR166b | TCGGACCAGGCTTCATTCCCC (4642) | 0.81 | 5806 |
| | gma-miR166a | TCGGACCAGGCTTCATTCCCC (4643) | 0.81 | 5807 |
| | gma-miR166b | TCGGACCAGGCTTCATTCCCC (4644) | 0.81 | 5808 |
| | gma-miR166n | TCGGACCAGGCTTCATTCCCC (4645) | 0.81 | 5809 |
| | gma-miR166o | TCGGACCAGGCTTCATTCCCC (4646) | 0.81 | 5810 |
| | gma-miR166q | TCGGACCAGGCTTCATTCCCG (4647) | 0.86 | 5811 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | gma-miR166r | TCGGACCAGGCTTCATTCCCT (4648) | 0.81 | 5812 |
| | hvu-miR166 | TCGGACCAGGCTTCATTCCCC (4649) | 0.81 | 5813 |
| | hvu-miR166b | TCGGACCAGGCTTCATTCCCC (4650) | 0.81 | 5814 |
| | hvu-miR166c | TCGGACCAGGCTTCATTCCCC (4651) | 0.81 | 5815 |
| | hvv-miR166 | TCGGACCAGGCTTCATTCCCC (4652) | 0.81 | 5816 |
| | ini-miR166 | TCGGACCAGGCTTCATTCCTC (4653) | 0.81 | 5817 |
| | mtr-miR166 | TCGGACCAGGCTTCATTCCCC (4654) | 0.81 | 5818 |
| | mtr-miR166b | TCGGACCAGGCTTCATTCCTA (4655) | 0.81 | 5819 |
| | mtr-miR166c | TCGGACCAGGCTTCATTCCTC (4656) | 0.81 | 5820 |
| | mtr-miR166d | TCGGGCCAGGCTTCATCCCCC (4657) | 0.81 | 5821 |
| | mtr-miR166e | TCGGACCAGGCTTCATTCCCC (4658) | 0.81 | 5822 |
| | mtr-miR166f | TCGGACCAGGCTTCATTCCTC (4659) | 0.81 | 5823 |
| | mtr-miR166g | TCGGACCAGGCTTCATTCCCC (4660) | 0.81 | 5824 |
| | mtr-miR166h | TCGGACCAGGCTTCATTCCCC (4661) | 0.81 | 5825 |
| | nsy-miR166 | TCGGACCAGGCTTCATTCCCC (4662) | 0.81 | 5826 |
| | osa-miR166a | TCGGACCAGGCTTCATTCCCC (4663) | 0.81 | 5827 |
| | osa-miR166b | TCGGACCAGGCTTCATTCCCC (4664) | 0.81 | 5828 |
| | osa-miR166c | TCGGACCAGGCTTCATTCCCC (4665) | 0.81 | 5829 |
| | osa-miR166d | TCGGACCAGGCTTCATTCCCC (4666) | 0.81 | 5830 |
| | osa-miR166e | TCGAACCAGGCTTCATTCCCC (4667) | 0.76 | 5831 |
| | osa-miR166f | TCGGACCAGGCTTCATTCCCC (4668) | 0.81 | 5832 |
| | osa-miR166g | TCGGACCAGGCTTCATTCCTC (4669) | 0.81 | 5833 |
| | osa-miR166h | TCGGACCAGGCTTCATTCCTC (4670) | 0.81 | 5834 |
| | osa-miR166i | TCGGATCAGGCTTCATTCCTC (4671) | 0.76 | 5835 |
| | osa-miR166j | TCGGATCAGGCTTCATTCCTC (4672) | 0.76 | 5836 |
| | osa-miR166k | TCGGACCAGGCTTCAATCCCT (4673) | 0.76 | 5837 |
| | osa-miR166l | TCGGACCAGGCTTCAATCCCT (4674) | 0.76 | 5838 |
| | osa-miR166m | TCGGACCAGGCTTCATTCCCT (4675) | 0.81 | 5839 |
| | osa-miR166n | TCGGACCAGGCTTCATTCCCC (4676) | 0.81 | 5840 |
| | pab-miR166a | TCGGACCAGGCTTCATTCCTC (4677) | 0.81 | 5841 |
| | pab-miR166b | TCGGACCAGGCTTCATTCCTT (4678) | 0.81 | 5842 |
| | pga-miR166 | TCGGACCAGGCTTCATTCCTT (4679) | 0.81 | 5843 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | ppt-miR166a | TCGGACCAGGCTTCATTCCCC (4680) | 0.81 | 5844 |
| | ppt-miR166b | TCGGACCAGGCTTCATTCCCC (4681) | 0.81 | 5845 |
| | ppt-miR166c | TCGGACCAGGCTTCATTCCCC (4682) | 0.81 | 5846 |
| | ppt-miR166d | TCGGACCAGGCTTCATTCCCC (4683) | 0.81 | 5847 |
| | ppt-miR166e | TCGGACCAGGCTTCATTCCCC (4684) | 0.81 | 5848 |
| | ppt-miR166f | TCGGACCAGGCTTCATTCCCC (4685) | 0.81 | 5849 |
| | ppt-miR166g | TCGGACCAGGCTTCATTCCCC (4686) | 0.81 | 5850 |
| | ppt-miR166h | TCGGACCAGGCTTCATTCCCC (4687) | 0.81 | 5851 |
| | ppt-miR166i | TCGGACCAGGCTTCATTCCCC (4688) | 0.81 | 5852 |
| | ppt-miR166j | TCCGGACCAGGCTTCATTCCC (4689) | 0.86 | 5853 |
| | ppt-miR166k | TCCGGACCAGGCTTCATTCCC (4690) | 0.86 | 5854 |
| | ppt-miR166l | TCCGGACCAGGCTTCATTCCC (4691) | 0.86 | 5855 |
| | ppt-miR166m | TCGGACCAGGCATCATTCCTT (4692) | 0.76 | 5856 |
| | pta-miR166a | TCGGACCAGGCTTCATTCCCC (4693) | 0.81 | 5857 |
| | pta-miR166b | TCGGACCAGGCTTCATTCCCC (4694) | 0.81 | 5858 |
| | ptc-miR166a | TCGGACCAGGCTTCATTCCCC (4695) | 0.81 | 5859 |
| | ptc-miR166b | TCGGACCAGGCTTCATTCCCC (4696) | 0.81 | 5860 |
| | ptc-miR166c | TCGGACCAGGCTTCATTCCCC (4697) | 0.81 | 5861 |
| | ptc-miR166d | TCGGACCAGGCTTCATTCCCC (4698) | 0.81 | 5862 |
| | ptc-miR166e | TCGGACCAGGCTTCATTCCCC (4699) | 0.81 | 5863 |
| | ptc-miR166f | TCGGACCAGGCTTCATTCCCC (4700) | 0.81 | 5864 |
| | ptc-miR166g | TCGGACCAGGCTTCATTCCCC (4701) | 0.81 | 5865 |
| | ptc-miR166h | TCGGACCAGGCTTCATTCCCC (4702) | 0.81 | 5866 |
| | ptc-miR166i | TCGGACCAGGCTTCATTCCCC (4703) | 0.81 | 5867 |
| | ptc-miR166j | TCGGACCAGGCTTCATTCCCC (4704) | 0.81 | 5868 |
| | ptc-miR166k | TCGGACCAGGCTTCATTCCCC (4705) | 0.81 | 5869 |
| | ptc-miR166l | TCGGACCAGGCTTCATTCCCC (4706) | 0.81 | 5870 |
| | ptc-miR166m | TCGGACCAGGCTTCATTCCCC (4707) | 0.81 | 5871 |
| | ptc-miR166n | TCGGACCAGGCTTCATTCCTT (4708) | 0.81 | 5872 |
| | ptc-miR166o | TCGGACCAGGCTTCATTCCTT (4709) | 0.81 | 5873 |
| | ptc-miR166p | TCGGACCAGGCTCCATTCCTT (4710) | 0.76 | 5874 |
| | ptc-miR166q | TCGGACCAGGCTTCATTCCTT (4711) | 0.81 | 5875 |
| | pvu-miR166 | TCGGACCAGGCTTCATTCCCC (4712) | 0.81 | 5876 |
| | pvu-miR166a | TCGGACCAGGCTTCATTCCCC (4713) | 0.81 | 5877 |
| | rco-miR166a | TCGGACCAGGCTTCATTCCCC (4714) | 0.81 | 5878 |
| | rco-miR166b | TCGGACCAGGCTTCATTCCCC (4715) | 0.81 | 5879 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | rco-miR166c | TCGGACCAGGCTTCATTCCCC (4716) | 0.81 | 5880 |
| | rco-miR166d | TCGGACCAGGCTTCATTCCCC (4717) | 0.81 | 5881 |
| | rco-miR166e | TCGGACCAGGCTTCATTCCCC (4718) | 0.81 | 5882 |
| | sbi-miR166a | TCGGACCAGGCTTCATTCCC (4719) | 0.81 | 5883 |
| | sbi-miR166b | TCGGACCAGGCTTCATTCCC (4720) | 0.81 | 5884 |
| | sbi-miR166c | TCGGACCAGGCTTCATTCCC (4721) | 0.81 | 5885 |
| | sbi-miR166d | TCGGACCAGGCTTCATTCCC (4722) | 0.81 | 5886 |
| | sbi-miR166e | TCGGACCAGGCTTCAATCCCT (4723) | 0.76 | 5887 |
| | sbi-miR166f | TCGGACCAGGCTTCATTCCTC (4724) | 0.81 | 5888 |
| | sbi-miR166g | TCGGACCAGGCTTCAATCCCT (4725) | 0.76 | 5889 |
| | sbi-miR166h | TCGGACCAGGCTTCATTCCC (4726) | 0.81 | 5890 |
| | sbi-miR166i | TCGGACCAGGCTTCATTCCC (4727) | 0.81 | 5891 |
| | sbi-miR166j | TCGGACCAGGCTTCATTCCC (4728) | 0.81 | 5892 |
| | sbi-miR166k | TCGGACCAGGCTTCATTCCT (4729) | 0.81 | 5893 |
| | sly-miR166a | TCGGACCAGGCTTCATTCCCC (4730) | 0.81 | 5894 |
| | sly-miR166b | TCGGACCAGGCTTCATTCCCC (4731) | 0.81 | 5895 |
| | smo-miR166a | TCGGACCAGGCTTCATTCCCC (4732) | 0.81 | 5896 |
| | smo-miR166b | TCGGACCAGGCTTCATTCCCC (4733) | 0.81 | 5897 |
| | smo-miR166c | TCGGACCAGGCTTCATTCCCC (4734) | 0.81 | 5898 |
| | sof-miR166 | TCGGACCAGGCTTCATTCCCC (4735) | 0.81 | 5899 |
| | tae-miR166 | CCGGACCAGGCTTCATTCCCA (4736) | 0.86 | 5900 |
| | tcc-miR166a | TCGGACCAGGCTTCATTCCCC (4737) | 0.81 | 5901 |
| | tcc-miR166b | TCGGACCAGGCTTCATTCCC (4738) | 0.81 | 5902 |
| | tcc-miR166c | TCGGACCAGGCTTCATTCCTC (4739) | 0.81 | 5903 |
| | tcc-miR166d | TCGGACCAGGCTTCATTCCCC (4740) | 0.81 | 5904 |
| | vvi-miR166a | TCGGACCAGGCTTCATTCC (4741) | 0.81 | 5905 |
| | vvi-miR166b | TCGGACCAGGCTTCATTCC (4742) | 0.81 | 5906 |
| | vvi-miR166c | TCGGACCAGGCTTCATTCCCC (4743) | 0.81 | 5907 |
| | vvi-miR166d | TCGGACCAGGCTTCATTCCCC (4744) | 0.81 | 5908 |
| | vvi-miR166e | TCGGACCAGGCTTCATTCCCC (4745) | 0.81 | 5909 |
| | vvi-miR166f | TCGGACCAGGCTTCATTCCCC (4746) | 0.81 | 5910 |
| | vvi-miR166g | TCGGACCAGGCTTCATTCCCC (4747) | 0.81 | 5911 |
| | vvi-miR166h | TCGGACCAGGCTTCATTCCCC (4748) | 0.81 | 5912 |
| | zma-miR166a | TCGGACCAGGCTTCATTCCCC (4749) | 0.81 | 5913 |
| | zma-miR166b | TCGGACCAGGCTTCATTCCC (4750) | 0.81 | 5914 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | zma-miR166c | TCGGACCAGGCTTCATTCCC (4751) | 0.81 | 5915 |
| | zma-miR166d | TCGGACCAGGCTTCATTCCC (4752) | 0.81 | 5916 |
| | zma-miR166e | TCGGACCAGGCTTCATTCCC (4753) | 0.81 | 5917 |
| | zma-miR166f | TCGGACCAGGCTTCATTCCC (4754) | 0.81 | 5918 |
| | zma-miR166g | TCGGACCAGGCTTCATTCCC (4755) | 0.81 | 5919 |
| | zma-miR166h | TCGGACCAGGCTTCATTCCC (4756) | 0.81 | 5920 |
| | zma-miR166i | TCGGACCAGGCTTCATTCCC (4757) | 0.81 | 5921 |
| | zma-miR166j | TCGGACCAGGCTTCAATCCCT (4758) | 0.76 | 5922 |
| | zma-miR166k | TCGGACCAGGCTTCAATCCCT (4759) | 0.76 | 5923 |
| | zma-miR166l | TCGGACCAGGCTTCATTCCTC (4760) | 0.81 | 5924 |
| | zma-miR166m | TCGGACCAGGCTTCATTCCTC (4761) | 0.81 | 5925 |
| | zma-miR166n | TCGGACCAGGCTTCAATCCCT (4762) | 0.76 | 5926 |
| | zma-miR166o | TCGGACCAGGCTTCATTCCCC (4763) | 0.81 | 5927 |
| | zma-miR166p | TCGGACCAGGCTTCATTCCCC (4764) | 0.81 | 5928 |
| | zma-miR166q | TCGGACCAGGCTTCATTCCCC (4765) | 0.81 | 5929 |
| | zma-miR166r | TCGGACCAGGCTTCATTCCCC (4766) | 0.81 | 5930 |
| | zma-miR166s | TCGGACCAGGCTTCATTCCCC (4767) | 0.81 | 5931 |
| | zma-miR166t | TCGGACCAGGCTTCATTCCCC (4768) | 0.81 | 5932 |
| | zma-miR166u | TCGGACCACGCTTCATTCCCC (4769) | 0.76 | 5933 |
| ptc-miR166p | aly-miR166a | TCGGACCAGGCTTCATTCCCC (4770) | 0.86 | 5934 |
| | aly-miR166b | TCGGACCAGGCTTCATTCCCC (4771) | 0.86 | 5935 |
| | aly-miR166c | TCGGACCAGGCTTCATTCCCC (4772) | 0.86 | 5936 |
| | aly-miR166d | TCGGACCAGGCTTCATTCCCC (4773) | 0.86 | 5937 |
| | aly-miR166e | TCGGACCAGGCTTCATTCCCC (4774) | 0.86 | 5938 |
| | aly-miR166f | TCGGACCAGGCTTCATTCCCC (4775) | 0.86 | 5939 |
| | aly-miR166g | TCGGACCAGGCTTCATTCCCC (4776) | 0.86 | 5940 |
| | aqc-miR166a | TCGGACCAGGCTTCATTCCTC (4777) | 0.9 | 5941 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | aqc-miR166b | TCGGACCAGGCTTCATTCCCC (4778) | 0.86 | 5942 |
| | aqc-miR166c | TCGGACCAGGCTTCATTCCT (4779) | 0.9 | 5943 |
| | aqc-miR166d | TCGGACCAGGCTTCATTCCTC (4780) | 0.9 | 5944 |
| | aqc-miR166e | TCGGACCAGGCTTCATTCCCC (4781) | 0.86 | 5945 |
| | ath-miR166a | TCGGACCAGGCTTCATTCCCC (4782) | 0.86 | 5946 |
| | ath-miR166b | TCGGACCAGGCTTCATTCCCC (4783) | 0.86 | 5947 |
| | ath-miR166c | TCGGACCAGGCTTCATTCCCC (4784) | 0.86 | 5948 |
| | ath-miR166d | TCGGACCAGGCTTCATTCCCC (4785) | 0.86 | 5949 |
| | ath-miR166e | TCGGACCAGGCTTCATTCCCC (4786) | 0.86 | 5950 |
| | ath-miR166f | TCGGACCAGGCTTCATTCCCC (4787) | 0.86 | 5951 |
| | ath-miR166g | TCGGACCAGGCTTCATTCCCC (4788) | 0.86 | 5952 |
| | bdi-miR166 | TCGGACCAGGCTTCATTCCCC (4789) | 0.86 | 5953 |
| | bdi-miR166a | TCGGACCAGGCTTCATTCCCC (4790) | 0.86 | 5954 |
| | bdi-miR166b | TCGGACCAGGCTTCATTCCCC (4791) | 0.86 | 5955 |
| | bdi-miR166c | TCGGACCAGGCTTCATTCCCC (4792) | 0.86 | 5956 |
| | bdi-miR166d | TCGGACCAGGCTTCATTCCCC (4793) | 0.86 | 5957 |
| | bdi-miR166e | CTCGGACCAGGCTTCATTCCC (4794) | 0.86 | 5958 |
| | bdi-miR166f | TCTCGGACCAGGCTTCATTCC (4795) | 0.86 | 5959 |
| | bna-miR166a | TCGGACCAGGCTTCATTCCCC (4796) | 0.86 | 5960 |
| | bna-miR166b | TCGGACCAGGCTTCATTCCCC (4797) | 0.86 | 5961 |
| | bna-miR166c | TCGGACCAGGCTTCATTCCCC (4798) | 0.86 | 5962 |
| | bna-miR166d | TCGGACCAGGCTTCATTCCCC (4799) | 0.86 | 5963 |
| | cpt-miR166 | TCGGACCAGGCTTCATTCCC (4800) | 0.86 | 5964 |
| | crt-miR166a | TCGGACCAGGCTTCATTCCCGT (4801) | 0.86 | 5965 |
| | crt-miR166b | TCGGACCAGGCTTCATTCCCTT (4802) | 0.9 | 5966 |
| | csi-miR166 | TCGGACCAGGCTTCATTCCCC (4803) | 0.86 | 5967 |
| | csi-miR166a | TCGGACCAGGCTTCATTCCCCC (4804) | 0.86 | 5968 |
| | csi-miR166b | TCGGACCAGGCTTCATTCCCGT (4805) | 0.86 | 5969 |
| | csi-miR166c | TCGGACCAGGCTTCATTCCC (4806) | 0.86 | 5970 |
| | csi-miR166d | TCGGACCAGGCTTCATTCCCT (4807) | 0.9 | 5971 |
| | csi-miR166e | TCGGACCAGGCTTCATTCCCC (4808) | 0.86 | 5972 |
| | ctr-miR166 | TCGGACCAGGCTTCATTCCCCC (4809) | 0.86 | 5973 |
| | far-miR166 | CCGGACCAGGCTTCATCCCAG (4810) | 0.76 | 5974 |
| | flm-miR166 | TCGGACCAGGCTTCATCCCCC (4811) | 0.81 | 5975 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | ghr-miR166a | TCGGACCAGGCTTCATTCCCC (4812) | 0.86 | 5976 |
| | ghr-miR166b | TCGGACCAGGCTTCATTCCCC (4813) | 0.86 | 5977 |
| | gma-miR166a | TCGGACCAGGCTTCATTCCCC (4814) | 0.86 | 5978 |
| | gma-miR166b | TCGGACCAGGCTTCATTCCCC (4815) | 0.86 | 5979 |
| | gma-miR166n | TCGGACCAGGCTTCATTCCCC (4816) | 0.86 | 5980 |
| | gma-miR166o | TCGGACCAGGCTTCATTCCCC (4817) | 0.86 | 5981 |
| | gma-miR166q | TCGGACCAGGCTTCATTCCCG (4818) | 0.86 | 5982 |
| | gma-miR166r | TCGGACCAGGCTTCATTCCCT (4819) | 0.9 | 5983 |
| | hvu-miR166 | TCGGACCAGGCTTCATTCCCC (4820) | 0.86 | 5984 |
| | hvu-miR166b | TCGGACCAGGCTTCATTCCCC (4821) | 0.86 | 5985 |
| | hvu-miR166c | TCGGACCAGGCTTCATTCCCC (4822) | 0.86 | 5986 |
| | hvv-miR166 | TCGGACCAGGCTTCATTCCCC (4823) | 0.86 | 5987 |
| | ini-miR166 | TCGGACCAGGCTTCATTCCTC (4824) | 0.9 | 5988 |
| | mtr-miR166 | TCGGACCAGGCTTCATTCCCC (4825) | 0.86 | 5989 |
| | mtr-miR166b | TCGGACCAGGCTTCATTCCTA (4826) (TCGGACCAGGCTTCATTCCCC (5116) | 0.9 | 5990 |
| | mtr-miR166c | TCGGACCAGGCTTCATTCCTC (4827) | 0.9 | 5991 |
| | mtr-miR166d | TCGGGCCAGGCTTCATCCCCC (4828) | 0.76 | 5992 |
| | mtr-miR166e | TCGGACCAGGCTTCATTCCCC (4829) | 0.86 | 5993 |
| | mtr-miR166f | TCGGACCAGGCTTCATTCCTC (4830) | 0.9 | 5994 |
| | mtr-miR166g | TCGGACCAGGCTTCATTCCCC (4831) | 0.86 | 5995 |
| | mtr-miR166h | TCGGACCAGGCTTCATTCCCC (4832) | 0.86 | 5996 |
| | nsy-miR166 | TCGGACCAGGCTTCATTCCCC (4833) | 0.86 | 5997 |
| | osa-miR166a | TCGGACCAGGCTTCATTCCCC (4834) | 0.86 | 5998 |
| | osa-miR166b | TCGGACCAGGCTTCATTCCCC (4835) | 0.86 | 5999 |
| | osa-miR166c | TCGGACCAGGCTTCATTCCCC (4836) | 0.86 | 6000 |
| | osa-miR166d | TCGGACCAGGCTTCATTCCCC (4837) | 0.86 | 6001 |
| | osa-miR166e | TCGAACCAGGCTTCATTCCCC (4838) | 0.81 | 6002 |
| | osa-miR166f | TCGGACCAGGCTTCATTCCCC (4839) | 0.86 | 6003 |
| | osa-miR166g | TCGGACCAGGCTTCATTCCTC (4840) | 0.9 | 6004 |
| | osa-miR166h | TCGGACCAGGCTTCATTCCTC (4841) | 0.9 | 6005 |
| | osa-miR166i | TCGGATCAGGCTTCATTCCTC (4842) | 0.86 | 6006 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
| --- | --- | --- | --- | --- |
| | osa-miR166j | TCGGATCAGGCTTCATTCCTC (4843) | 0.86 | 6007 |
| | osa-miR166k | TCGGACCAGGCTTCAATCCCT (4844) | 0.86 | 6008 |
| | osa-miR166l | TCGGACCAGGCTTCAATCCCT (4845) | 0.86 | 6009 |
| | osa-miR166m | TCGGACCAGGCTTCATTCCCT (4846) | 0.9 | 6010 |
| | osa-miR166n | TCGGACCAGGCTTCATTCCCC (4847) | 0.86 | 6011 |
| | pab-miR166a | TCGGACCAGGCTTCATTCCTC (4848) | 0.9 | 6012 |
| | pab-miR166b | TCGGACCAGGCTTCATTCCTT (4849) | 0.95 | 6013 |
| | pga-miR166 | TCGGACCAGGCTTCATTCCTT (4850) | 0.95 | 6014 |
| | ppt-miR166a | TCGGACCAGGCTTCATTCCCC (4851) | 0.86 | 6015 |
| | ppt-miR166b | TCGGACCAGGCTTCATTCCCC (4852) | 0.86 | 6016 |
| | ppt-miR166c | TCGGACCAGGCTTCATTCCCC (4853) | 0.86 | 6017 |
| | ppt-miR166d | TCGGACCAGGCTTCATTCCCC (4854) | 0.86 | 6018 |
| | ppt-miR166e | TCGGACCAGGCTTCATTCCCC (4855) | 0.86 | 6019 |
| | ppt-miR166f | TCGGACCAGGCTTCATTCCCC (4856) | 0.86 | 6020 |
| | ppt-miR166g | TCGGACCAGGCTTCATTCCCC (4857) | 0.86 | 6021 |
| | ppt-miR166h | TCGGACCAGGCTTCATTCCCC (4858) | 0.86 | 6022 |
| | ppt-miR166i | TCGGACCAGGCTTCATTCCCC (4859) | 0.86 | 6023 |
| | ppt-miR166j | TCCGGACCAGGCTTCATTCCC (4860) | 0.81 | 6024 |
| | ppt-miR166k | TCCGGACCAGGCTTCATTCCC (4861) | 0.81 | 6025 |
| | ppt-miR166l | TCCGGACCAGGCTTCATTCCC (4862) | 0.81 | 6026 |
| | ppt-miR166m | TCGGACCAGGCATCATTCCTT (4863) | 0.9 | 6027 |
| | pta-miR166a | TCGGACCAGGCTTCATTCCCC (4864) | 0.86 | 6028 |
| | pta-miR166b | TCGGACCAGGCTTCATTCCCC (4865) | 0.86 | 6029 |
| | pta-miR166c | CCGGACCAGGCTTCATCCCAG (4866) | 0.76 | 6030 |
| | ptc-miR166a | TCGGACCAGGCTTCATTCCCC (4867) | 0.86 | 6031 |
| | ptc-miR166b | TCGGACCAGGCTTCATTCCCC (4868) | 0.86 | 6032 |
| | ptc-miR166c | TCGGACCAGGCTTCATTCCCC (4869) | 0.86 | 6033 |
| | ptc-miR166d | TCGGACCAGGCTTCATTCCCC (4870) | 0.86 | 6034 |
| | ptc-miR166e | TCGGACCAGGCTTCATTCCCC (4871) | 0.86 | 6035 |
| | ptc-miR166f | TCGGACCAGGCTTCATTCCCC (4872) | 0.86 | 6036 |
| | ptc-miR166g | TCGGACCAGGCTTCATTCCCC (4873) | 0.86 | 6037 |
| | ptc-miR166h | TCGGACCAGGCTTCATTCCCC (4874) | 0.86 | 6038 |
| | ptc-miR166i | TCGGACCAGGCTTCATTCCCC (4875) | 0.86 | 6039 |
| | ptc-miR166j | TCGGACCAGGCTTCATTCCCC (4876) | 0.86 | 6040 |
| | ptc-miR166k | TCGGACCAGGCTTCATTCCCC (4877) | 0.86 | 6041 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | ptc-miR166l | TCGGACCAGGCTTCATTCCCC (4878) | 0.86 | 6042 |
| | ptc-miR166m | TCGGACCAGGCTTCATTCCCC (4879) | 0.86 | 6043 |
| | ptc-miR166n | TCGGACCAGGCTTCATTCCTT (4880) | 0.95 | 6044 |
| | ptc-miR166o | TCGGACCAGGCTTCATTCCTT (4881) | 0.95 | 6045 |
| | ptc-miR166q | TCGGACCAGGCTTCATTCCTT (4882) | 0.95 | 6046 |
| | pvu-miR166 | TCGGACCAGGCTTCATTCCCC (4883) | 0.86 | 6047 |
| | pvu-miR166a | TCGGACCAGGCTTCATTCCCC (4884) | 0.86 | 6048 |
| | rco-miR166a | TCGGACCAGGCTTCATTCCCC (4885) | 0.86 | 6049 |
| | rco-miR166b | TCGGACCAGGCTTCATTCCCC (4886) | 0.86 | 6050 |
| | rco-miR166c | TCGGACCAGGCTTCATTCCCC (4887) | 0.86 | 6051 |
| | rco-miR166d | TCGGACCAGGCTTCATTCCCC (4888) | 0.86 | 6052 |
| | rco-miR166e | TCGGACCAGGCTTCATTCCCC (4889) | 0.86 | 6053 |
| | sbi-miR166a | TCGGACCAGGCTTCATTCCC (4890) | 0.86 | 6054 |
| | sbi-miR166b | TCGGACCAGGCTTCATTCCC (4891) | 0.86 | 6055 |
| | sbi-miR166c | TCGGACCAGGCTTCATTCCC (4892) | 0.86 | 6056 |
| | sbi-miR166d | TCGGACCAGGCTTCATTCCC (4893) | 0.86 | 6057 |
| | sbi-miR166e | TCGGACCAGGCTTCAATCCCT (4894) | 0.86 | 6058 |
| | sbi-miR166f | TCGGACCAGGCTTCATTCCTC (4895) | 0.9 | 6059 |
| | sbi-miR166g | TCGGACCAGGCTTCAATCCCT (4896) | 0.86 | 6060 |
| | sbi-miR166h | TCGGACCAGGCTTCATTCCC (4897) | 0.86 | 6061 |
| | sbi-miR166i | TCGGACCAGGCTTCATTCCC (4898) | 0.86 | 6062 |
| | sbi-miR166j | TCGGACCAGGCTTCATTCCC (4899) | 0.86 | 6063 |
| | sbi-miR166k | TCGGACCAGGCTTCATTCCT (4900) | 0.9 | 6064 |
| | sly-miR166a | TCGGACCAGGCTTCATTCCCC (4901) | 0.86 | 6065 |
| | sly-miR166b | TCGGACCAGGCTTCATTCCCC (4902) | 0.86 | 6066 |
| | smo-miR166a | TCGGACCAGGCTTCATTCCCC (4903) | 0.86 | 6067 |
| | smo-miR166b | TCGGACCAGGCTTCATTCCCC (4904) | 0.86 | 6068 |
| | smo-miR166c | TCGGACCAGGCTTCATTCCCC (4905) | 0.86 | 6069 |
| | sof-miR166 | TCGGACCAGGCTTCATTCCCC (4906) | 0.86 | 6070 |
| | tae-miR166 | CCGGACCAGGCTTCATTCCCA (4907) | 0.81 | 6071 |
| | tcc-miR166a | TCGGACCAGGCTTCATTCCCC (4908) | 0.86 | 6072 |
| | tcc-miR166b | TCGGACCAGGCTTCATTCCC (4909) | 0.86 | 6073 |
| | tcc-miR166c | TCGGACCAGGCTTCATTCCTC (4910) | 0.9 | 6074 |
| | tcc-miR166d | TCGGACCAGGCTTCATTCCCC (4911) | 0.86 | 6075 |
| | vvi-miR166a | TCGGACCAGGCTTCATTCC (4912) | 0.86 | 6076 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | vvi-miR166b | TCGGACCAGGCTTCATTCC (4913) | 0.86 | 6077 |
| | vvi-miR166c | TCGGACCAGGCTTCATTCCCC (4914) | 0.86 | 6078 |
| | vvi-miR166d | TCGGACCAGGCTTCATTCCCC (4915) | 0.86 | 6079 |
| | vvi-miR166e | TCGGACCAGGCTTCATTCCCC (4916) | 0.86 | 6080 |
| | vvi-miR166f | TCGGACCAGGCTTCATTCCCC (4917) | 0.86 | 6081 |
| | vvi-miR166g | TCGGACCAGGCTTCATTCCCC (4918) | 0.86 | 6082 |
| | vvi-miR166h | TCGGACCAGGCTTCATTCCCC (4919) | 0.86 | 6083 |
| | zma-miR166a | TCGGACCAGGCTTCATTCCCC (4920) | 0.86 | 6084 |
| | zma-miR166b | TCGGACCAGGCTTCATTCCC (4921) | 0.86 | 6085 |
| | zma-miR166c | TCGGACCAGGCTTCATTCCC (4922) | 0.86 | 6086 |
| | zma-miR166d | TCGGACCAGGCTTCATTCCC (4923) | 0.86 | 6087 |
| | zma-miR166e | TCGGACCAGGCTTCATTCCC (4924) | 0.86 | 6088 |
| | zma-miR166f | TCGGACCAGGCTTCATTCCC (4925) | 0.86 | 6089 |
| | zma-miR166g | TCGGACCAGGCTTCATTCCC (4926) | 0.86 | 6090 |
| | zma-miR166h | TCGGACCAGGCTTCATTCCC (4927) | 0.86 | 6091 |
| | zma-miR166i | TCGGACCAGGCTTCATTCCC (4928) | 0.86 | 6092 |
| | zma-miR166j | TCGGACCAGGCTTCAATCCCT (4929) | 0.86 | 6093 |
| | zma-miR166k | TCGGACCAGGCTTCAATCCCT (4930) | 0.86 | 6094 |
| | zma-miR166l | TCGGACCAGGCTTCATTCCTC (4931) | 0.9 | 6095 |
| | zma-miR166m | TCGGACCAGGCTTCATTCCTC (4932) | 0.9 | 6096 |
| | zma-miR166n | TCGGACCAGGCTTCAATCCCT (4933) | 0.86 | 6097 |
| | zma-miR166o | TCGGACCAGGCTTCATTCCCC (4934) | 0.86 | 6098 |
| | zma-miR166p | TCGGACCAGGCTTCATTCCCC (4935) | 0.86 | 6099 |
| | zma-miR166q | TCGGACCAGGCTTCATTCCCC (4936) | 0.86 | 6100 |
| | zma-miR166r | TCGGACCAGGCTTCATTCCCC (4937) | 0.86 | 6101 |
| | zma-miR166s | TCGGACCAGGCTTCATTCCCC (4938) | 0.86 | 6102 |
| | zma-miR166t | TCGGACCAGGCTTCATTCCCC (4939) | 0.86 | 6103 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | zma-miR166u | TCGGACCACGCTTCATTCCCC (4940) | 0.81 | 6104 |
| vvi-miR394b | ahy-miR394 | TTGGCATTCTGTCCACCTCC (4941) | 1 | 6105 |
| | aly-miR394a | TTGGCATTCTGTCCACCTCC (4942) | 1 | 6106 |
| | aly-miR394b | TTGGCATTCTGTCCACCTCC (4943) | 1 | 6107 |
| | ath-miR394a | TTGGCATTCTGTCCACCTCC (4944) | 1 | 6108 |
| | ath-miR394b | TTGGCATTCTGTCCACCTCC (4945) | 1 | 6109 |
| | bdi-miR394 | TTGGCATTCTGTCCACCTCC (4946) | 1 | 6110 |
| | csi-miR394 | TTGGCATTCTGTCCACCTCC (4947) | 1 | 6111 |
| | ghr-miR394 | TTGGCATTCTGTCCACCTCC (4948) | 1 | 6112 |
| | ghr-miR394a | TTGGCATTCTGTCCACCTCC (4949) | 1 | 6113 |
| | ghr-miR394b | TTGGCATTCTGTCCACCTCC (4950) | 1 | 6114 |
| | gma-miR394b | AGGTGGGCATACTGTCAACT (4951) | 0.65 | 6115 |
| | osa-miR394 | TTGGCATTCTGTCCACCTCC (4952) | 1 | 6116 |
| | ptc-miR394a-5p | TTGGCATTCTGTCCACCTCC (4953) | 1 | 6117 |
| | ptc-miR394b-5p | TTGGCATTCTGTCCACCTCC (4954) | 1 | 6118 |
| | sbi-miR394a | TTGGCATTCTGTCCACCTCC (4955) | 1 | 6119 |
| | sbi-miR394b | TTGGCATTCTGTCCACCTCC (4956) | 1 | 6120 |
| | tcc-miR394a | TTGGCATTCTGTCCACCTCC (4957) | 1 | 6121 |
| | tcc-miR394b | TTGGCATTCTGTCCACCTCC (4958) | 1 | 6122 |
| | vvi-miR394a | TTGGCATTCTGTCCACCTCCAT (4959) | 1 | 6123 |
| | vvi-miR394c | TTGGCATTCTGTCCACCTCCAT (4960) | 1 | 6124 |
| | zma-miR394a | TTGGCATTCTGTCCACCTCC (4961) | 1 | 6125 |
| | zma-miR394b | TTGGCATTCTGTCCACCTCC (4962) | 1 | 6126 |
| zma-miR167u | ahy-miR167-5p | TGAAGCTGCCAGCATGATCTT (4963) | 0.95 | 6127 |
| | aly-miR167a | TGAAGCTGCCAGCATGATCTA (4964) | 0.95 | 6128 |
| | aly-miR167b | TGAAGCTGCCAGCATGATCTA (4965) | 0.95 | 6129 |
| | aly-miR167b* | GGTCATGCTCTGACAGCCTCACT (4966) | 0.5 | 6130 |
| | aly-miR167c | TAAGCTGCCAGCATGATCTTG (4967) | 0.85 | 6131 |
| | aly-miR167d | TGAAGCTGCCAGCATGATCTGG (4968) | 1 | 6132 |
| | aqc-miR167 | TCAAGCTGCCAGCATGATCTA (4969) | 0.9 | 6133 |
| | ath-miR167a | TGAAGCTGCCAGCATGATCTA (4970) | 0.95 | 6134 |
| | ath-miR167b | TGAAGCTGCCAGCATGATCTA (4971) | 0.95 | 6135 |
| | ath-miR167c | TAAGCTGCCAGCATGATCTTG (4972) | 0.85 | 6136 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | ath-miR167d | TGAAGCTGCCAGCATGATCTGG (4973) | 1 | 6137 |
| | ath-miR167m | TGAAGCTGCCAGCATGATCTG (4974) | 1 | 6138 |
| | bdi-miR167 | TGAAGCTGCCAGCATGATCTA (4975) | 0.95 | 6139 |
| | bdi-miR167a | TGAAGCTGCCAGCATGATCTA (4976) | 0.95 | 6140 |
| | bdi-miR167b | TGAAGCTGCCAGCATGATCTA (4977) | 0.95 | 6141 |
| | bdi-miR167c | TGAAGCTGCCAGCATGATCTGA (4978) | 1 | 6142 |
| | bdi-miR167d | TGAAGCTGCCAGCATGATCTGA (4979) | 1 | 6143 |
| | bna-miR167a | TGAAGCTGCCAGCATGATCTAA (4980) | 0.95 | 6144 |
| | bna-miR167b | TGAAGCTGCCAGCATGATCTAA (4981) | 0.95 | 6145 |
| | bna-miR167c | TGAAGCTGCCAGCATGATCTA (4982) | 0.95 | 6146 |
| | bra-miR167a | TGAAGCTGCCAGCATGATCTA (4983) | 0.95 | 6147 |
| | bra-miR167b | TGAAGCTGCCAGCATGATCTA (4984) | 0.95 | 6148 |
| | bra-miR167c | TGAAGCTGCCAGCATGATCTA (4985) | 0.95 | 6149 |
| | bra-miR167d | TGAAGCTGCCAGCATGATCTA (4986) | 0.95 | 6150 |
| | ccl-miR167a | TGAAGCTGCCAGCATGATCTGA (4987) | 1 | 6151 |
| | ccl-miR167b | TGAAGCTGCCAGCATGATCTGA (4988) | 1 | 6152 |
| | cle-miR167 | TGAAGCTGCCAGCATGATCTG (4989) | 1 | 6153 |
| | csi-miR167a | TGAAGCTGCCAGCATGATCTG (4990) | 1 | 6154 |
| | csi-miR167b | TGAAGCTGCCAGCATGATCTT (4991) | 0.95 | 6155 |
| | csi-miR167c | TGAAGCTGCCAGCATGATCTG (4992) | 1 | 6156 |
| | ctr-miR167 | TGAAGCTGCCAGCATGATCTGA (4993) | 1 | 6157 |
| | ghr-miR167 | TGAAGCTGCCAGCATGATCTA (4994) | 0.95 | 6158 |
| | gma-miR167a | TGAAGCTGCCAGCATGATCTA (4995) | 0.95 | 6159 |
| | gma-miR167b | TGAAGCTGCCAGCATGATCTA (4996) | 0.95 | 6160 |
| | gma-miR167c | TGAAGCTGCCAGCATGATCTG (4997) | 1 | 6161 |
| | gma-miR167d | TGAAGCTGCCAGCATGATCTA (4998) | 0.95 | 6162 |
| | gma-miR167e | TGAAGCTGCCAGCATGATCTT (4999) | 0.95 | 6163 |
| | gma-miR167f | TGAAGCTGCCAGCATGATCTT (5000) | 0.95 | 6164 |
| | gma-miR167g | TGAAGCTGCCAGCATGATCTGA (5001) | 1 | 6165 |
| | gma-miR167n | TGAAGCTGCCAGCATGATCT (5002) | 0.95 | 6166 |
| | gma-miR167o | TGAAGCTGCCAGCATGATCTG (5003) | 1 | 6167 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | gso-miR167a | TGAAGCTGCCAGCATGATCTG (5004) | 1 | 6168 |
| | ini-miR167 | TGAAGCTGCCAGCATGATCTG (5005) | 1 | 6169 |
| | lja-miR167 | TGAAGCTGCCAGCATGATCTG (5006) | 1 | 6170 |
| | mtr-miR167 | TGAAGCTGCCAGCATGATCTA (5007) | 0.95 | 6171 |
| | osa-miR167a | TGAAGCTGCCAGCATGATCTA (5008) | 0.95 | 6172 |
| | osa-miR167a* | ATCATGCATGACAGCCTCATTT (5009) | 0.65 | 6173 |
| | osa-miR167b | TGAAGCTGCCAGCATGATCTA (5010) | 0.95 | 6174 |
| | osa-miR167c | TGAAGCTGCCAGCATGATCTA (5011) | 0.95 | 6175 |
| | osa-miR167d | TGAAGCTGCCAGCATGATCTG (5012) | 1 | 6176 |
| | osa-miR167e | TGAAGCTGCCAGCATGATCTG (5013) | 1 | 6177 |
| | osa-miR167f | TGAAGCTGCCAGCATGATCTG (5014) | 1 | 6178 |
| | osa-miR167g | TGAAGCTGCCAGCATGATCTG (5015) | 1 | 6179 |
| | osa-miR167h | TGAAGCTGCCAGCATGATCTG (5016) | 1 | 6180 |
| | osa-miR167i | TGAAGCTGCCAGCATGATCTG (5017) | 1 | 6181 |
| | osa-miR167j | TGAAGCTGCCAGCATGATCTG (5018) | 1 | 6182 |
| | osa-miR167m | TGAAGCTGCCAGCATGATCTG (5019) | 1 | 6183 |
| | osa-miR167n | TGAAGCTGCCAGCATGATCTG (5020) | 1 | 6184 |
| | pco-miR167 | TGAAGCTGCCAGCATGATCTT (5021) | 0.95 | 6185 |
| | ppl-miR167a | TGAAGCTGCCAGCATGATCTA (5022) | 0.95 | 6186 |
| | ppl-miR167b | TGAAGCTGCCAGCATGATCTG (5023) | 1 | 6187 |
| | ppt-miR167 | GGAAGCTGCCAGCATGATCCT (5024) | 0.85 | 6188 |
| | ptc-miR167a | TGAAGCTGCCAGCATGATCTA (5025) | 0.95 | 6189 |
| | ptc-miR167b | TGAAGCTGCCAGCATGATCTA (5026) | 0.95 | 6190 |
| | ptc-miR167c | TGAAGCTGCCAGCATGATCTA (5027) | 0.95 | 6191 |
| | ptc-miR167d | TGAAGCTGCCAGCATGATCTA (5028) | 0.95 | 6192 |
| | ptc-miR167e | TGAAGCTGCCAGCATGATCTG (5029) | 1 | 6193 |
| | ptc-miR167f | TGAAGCTGCCAGCATGATCTT (5030) | 0.95 | 6194 |
| | ptc-miR167g | TGAAGCTGCCAGCATGATCTT (5031) | 0.95 | 6195 |
| | ptc-miR167h | TGAAGCTGCCAACATGATCTG (5032) | 1 | 6196 |
| | pts-miR167 | TGAAGCTGCCAGCATGATCTG (5033) | 1 | 6197 |
| | rco-miR167a | TGAAGCTGCCAGCATGATCTA (5034) | 0.95 | 6198 |
| | rco-miR167b | TGAAGCTGCCAGCATGATCTA (5035) | 0.95 | 6199 |
| | rco-miR167c | TGAAGCTGCCAGCATGATCTGG (5036) | 1 | 6200 |
| | sbi-miR167a | TGAAGCTGCCAGCATGATCTA (5037) | 0.95 | 6201 |
| | sbi-miR167b | TGAAGCTGCCAGCATGATCTA (5038) | 0.95 | 6202 |
| | sbi-miR167c | TGAAGCTGCCAGCATGATCTG (5039) | 1 | 6203 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | sbi-miR167d | TGAAGCTGCCAGCATGATCTG (5040) | 1 | 6204 |
| | sbi-miR167e | TGAAGCTGCCAGCATGATCTG (5041) | 1 | 6205 |
| | sbi-miR167f | TGAAGCTGCCAGCATGATCTG (5042) | 1 | 6206 |
| | sbi-miR167g | TGAAGCTGCCAGCATGATCTG (5043) | 1 | 6207 |
| | sbi-miR167h | TGAAGCTGCCAGCATGATCTG (5044) | 1 | 6208 |
| | sbi-miR167i | TGAAGCTGCCAGCATGATCTA (5045) | 0.95 | 6209 |
| | sly-miR167 | TGAAGCTGCCAGCATGATCTA (5046) | 0.95 | 6210 |
| | sof-miR167a | TGAAGCTGCCAGCATGATCTG (5047) | 1 | 6211 |
| | sof-miR167b | TGAAGCTGCCAGCATGATCTG (5048) | 1 | 6212 |
| | ssp-miR167 | TGAAGCTGCCAGCATGATCTG (5049) | 1 | 6213 |
| | ssp-miR167b | TGAAGCTGCCAGCATGATCTG (5050) | 1 | 6214 |
| | tae-miR167 | TGAAGCTGCCAGCATGATCTA (5051) | 0.95 | 6215 |
| | tae-miR167b | TGAAGCTGACAGCATGATCTA (5052) | 0.9 | 6216 |
| | tcc-miR167a | TGAAGCTGCCAGCATGATCTA (5053) | 0.95 | 6217 |
| | tcc-miR167b | TGAAGCTGCCAGCATGATCTA (5054) | 0.95 | 6218 |
| | tcc-miR167c | TGAAGCTGCCAGCATGATCTT (5055) | 0.95 | 6219 |
| | vvi-miR167a | TGAAGCTGCCAGCATGATCTG (5056) | 1 | 6220 |
| | vvi-miR167b | TGAAGCTGCCAGCATGATCTA (5057) | 0.95 | 6221 |
| | vvi-miR167c | TGAAGCTGCCAGCATGATCTC (5058) | 0.95 | 6222 |
| | vvi-miR167d | TGAAGCTGCCAGCATGATCTA (5059) | 0.95 | 6223 |
| | vvi-miR167e | TGAAGCTGCCAGCATGATCTA (5060) | 0.95 | 6224 |
| | zma-miR167a | TGAAGCTGCCAGCATGATCTA (5061) | 0.95 | 6225 |
| | zma-miR167b | TGAAGCTGCCAGCATGATCTA (5062) | 0.95 | 6226 |
| | zma-miR167b* | GATCATGCTGTGACAGTTTCACT (5063) | 0.55 | 6227 |
| | zma-miR167c | TGAAGCTGCCAGCATGATCTA (5064) | 0.95 | 6228 |
| | zma-miR167d | TGAAGCTGCCAGCATGATCTA (5065) | 0.95 | 6229 |
| | zma-miR167e | TGAAGCTGCCAGCATGATCTG (5066) | 1 | 6230 |
| | zma-miR167f | TGAAGCTGCCAGCATGATCTG (5067) | 1 | 6231 |
| | zma-miR167g | TGAAGCTGCCAGCATGATCTG (5068) | 1 | 6232 |
| | zma-miR167h | TGAAGCTGCCAGCATGATCTG (5069) | 1 | 6233 |
| | zma-miR167i | TGAAGCTGCCAGCATGATCTG (5070) | 1 | 6234 |
| | zma-miR167j | TGAAGCTGCCAGCATGATCTG (5071) | 1 | 6235 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | zma-miR167k | TGAAGCTGCCAGCATGATCTG (5072) | 1 | 6236 |
| | zma-miR167l | TGAAGCTGCCAGCATGATCTG (5073) | 1 | 6237 |
| | zma-miR167m | TGAAGCTGCCAGCATGATCTG (5074) | 1 | 6238 |
| | zma-miR167n | TGAAGCTGCCAGCATGATCTA (5075) | 0.95 | 6239 |
| | zma-miR167o | TGAAGCTGCCAGCATGATCTA (5076) | 0.95 | 6240 |
| | zma-miR167p | TGAAGCTGCCAGCATGATCTA (5077) | 0.95 | 6241 |
| | zma-miR167q | TGAAGCTGCCAGCATGATCTA (5078) | 0.95 | 6242 |
| | zma-miR167r | TGAAGCTGCCAGCATGATCTA (5079) | 0.95 | 6243 |
| | zma-miR167s | TGAAGCTGCCAGCATGATCTA (5080) | 0.95 | 6244 |
| | zma-miR167t | TGAAGCTGCCAGCATGATCTA (5081) | 0.95 | 6245 |
| gma-miR2119 | mtr-miR2119 | TCAAAGGGAGGTGTGGAGTAG (5082) | 0.76 | 6246 |
| | pvu-miR2119 | TCAAAGGGAGTTGTAGGGGAA (5083) | 1 | 6247 |
| osa-miR162a | aly-miR162a | TCGATAAACCTCTGCATCCAG (5084) | 1 | 6248 |
| | aly-miR162b | TCGATAAACCTCTGCATCCAG (5085) | 1 | 6249 |
| | ath-miR162a | TCGATAAACCTCTGCATCCAG (5086) | 1 | 6250 |
| | ath-miR162b | TCGATAAACCTCTGCATCCAG (5087) | 1 | 6251 |
| | bdi-miR162 | TCGATAAACCTCTGCATCCGG (5088) | 0.95 | 6252 |
| | cpa-miR162a | TCGATAAACCTCTGCATCCAG (5089) | 1 | 6253 |
| | csi-miR162 | TCGATAAACCTCTGCATCCAG (5090) | 1 | 6254 |
| | csi-miR162.5 | TCGATAAACCTCTGCATCCAG (5091) | 1 | 6255 |
| | ghr-miR162a | TCGATAAACCTCTGCATCCAG (5092) | 1 | 6256 |
| | gma-miR162 | TCGATAAACCTCTGCATCCA (5093) | 0.95 | 6257 |
| | gma-miR162a | TCGATAAACCTCTGCATCCAG (5094) | 1 | 6258 |
| | gma-miR162m | TCGATAAACCTCTGCATCCAG (5095) | 1 | 6259 |
| | llu-miR162 | TCGATAAACCTCTGCATCCAG (5096) | 1 | 6260 |
| | lsa-miR162 | TCGATAAACCTCTGCATCCAG (5097) | 1 | 6261 |
| | mdo-miR162 | TCGATAAACCTTTGCATCCAG (5098) | 0.95 | 6262 |
| | mtr-miR162 | TCGATAAACCTCTGCATCCAG (5099) | 1 | 6263 |
| | mtr-miR162b | TCGATAAACCTCTGCATCCA (5100) | 0.95 | 6264 |

TABLE 8-continued

Summary of Homologs (Orthologs to Small RNAs which are down-regulated in Abiotic Stress in Soybean Plants.

| Mir Name | Homolog Name | Homolog Sequence (SEQ ID NO:) | % Identity | Homolog Stem-loop Sequence |
|---|---|---|---|---|
| | mtr-miR162c | TCGATGAACCGCTGCATCCAG (5101) | 0.9 | 6265 |
| | mtr-miR162d | TCGATAAACCTCTGCATCCAG (5102) | 1 | 6266 |
| | osa-miR162b | TCGATAAGCCTCTGCATCCAG (5103) | 0.95 | 6267 |
| | osa-miR162m | TCGATAAGCCTCTGCATCCAG (5104) | 0.95 | 6268 |
| | ptc-miR162a | TCGATAAACCTCTGCATCCAG (5105) | 1 | 6269 |
| | ptc-miR162b | TCGATAAACCTCTGCATCCAG (5106) | 1 | 6270 |
| | ptc-miR162c | TCGATAAACCTCTGCATCCAG (5107) | 1 | 6271 |
| | rco-miR162 | TCGATAAACCTCTGCATCCAG (5108) | 1 | 6272 |
| | sbi-miR162 | TCGATAAACCTCTGCATCCAG (5109) | 1 | 6273 |
| | sly-miR162 | TCGATAAACCTCTGCATCCAG (5110) | 1 | 6274 |
| | tcc-miR162 | TCGATAAACCTCTGCATCCAG (5111) | 1 | 6275 |
| | vvi-miR162 | TCGATAAACCTCTGCATCCAG (5112) | 1 | 6276 |
| | zma-miR162 | TCGATAAACCTCTGCATCCA (5113) | 0.95 | 6277 |
| | zma-miR162b | TCGATAAACCTCTGCATCCAG (5114) | 1 | 6278 |

Example 3

Identification of miRNAs Associated with Abiotic Stress and Target Prediction Using Bioinformatics Tools Small RNAs that are potentially associated with improved abiotic or biotic stress tolerance can be identified by proprietary computational algorithms that analyze RNA expression profiles alongside publicly available gene and protein databases. A high throughput screening is performed on microarrays loaded with miRNAs that were found to be differential under multiple stress and optimal environmental conditions and in different plant tissues. The initial trait-associated miRNAs are later validated by quantitative Real Time PCR (qRT-PCR).

Target prediction—homologous or orthologous genes to the genes of interest in soybean and/or *arabidopsis* are found through a proprietary tool that analyzes publicly available genomic as well as expression and gene annotation databases from multiple plant species. Homologous and orthologous protein and nucleotide sequences of target genes of the small RNA sequences of the invention, were found using BLAST having at least 70% identity on at least 60% of the entire master gene length, and are summarized in Tables 9-10 below.

TABLE 9

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| aqc-miR159 | 305-325 | XP_003551790 | 356567161 | 1 | *Glycine max* | 6315 | 8130 |
| | 334-354 | XP_003554567 | 356572827 | 1 | *Glycine max* | 6316 | 8131 |
| | | XP_003521605 | 356505654 | 0.9723 | *Glycine max* | 6317 | 8132 |
| | | XP_003521606 | 356505656 | 0.9723 | *Glycine max* | 6318 | 8133 |
| | | XP_003626013 | 357511448 | 0.8949 | *Medicago truncatula* | 6319 | 8134 |
| | | XP_002272575 | 225437676 | 0.8423 | *Vitis vinifera* | 6320 | 8135 |
| | | CBI37003 | 270254427 | 0.8409 | *Vitis vinifera* | 6321 | 8136 |
| | | XP_002515224 | 255761086 | 0.8382 | *Ricinus communis* | 6322 | |
| | | CAN71135 | 147786943 | 0.8354 | *Vitis vinifera* | 6323 | 8137 |
| | | XP_002301535 | 255761085 | 0.8313 | *Populus trichocarpa* | 6324 | |
| | | ADF30190 | 294713705 | 0.8119 | *Brassica napus* | 6325 | 8138 |
| | 124-144 | XP_003543825 | 356550908 | 1 | *Glycine max* | 6326 | 8139 |
| | 752-772 | XP_003543825 | 356550908 | 1 | *Glycine max* | 6327 | 8140 |
| | | XP_003556814 | 356577399 | 0.813 | *Glycine max* | 6328 | 8141 |
| | 360-380 | XP_003549039 | 356561539 | 1 | *Glycine max* | 6329 | 8142 |
| | | XP_003533180 | 356529191 | 0.8282 | *Glycine max* | 6330 | 8143 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 614-634 | XP_003541563 | 356546291 | 1 | Glycine max | 6331 | 8144 |
| | | XP_003545791 | 356554924 | 0.805 | Glycine max | 6332 | 8145 |
| | 905-925 | XP_003556814 | 356577399 | 1 | Glycine max | 6333 | 8146 |
| | | XP_003543825 | 356550908 | 0.8659 | Glycine max | 6334 | 8147 |
| | 141-161 | XP_003518351 | 356499037 | 1 | Glycine max | 6335 | 8148 |
| | 2016-2036 | XP_003538988 | 356541033 | 1 | Glycine max | 6336 | 8149 |
| | | XP_003607189 | 357473808 | 0.7407 | Medicago truncatula | 6337 | 8150 |
| | | XP_003604038 | 357467506 | 0.7035 | Medicago truncatula | 6338 | 8151 |
| | 839-859 | XP_003526354 | 356515330 | 1 | Glycine max | 6339 | 8152 |
| | | XP_003523913 | 356510372 | 0.9333 | Glycine max | 6340 | 8153 |
| | 842-862 | XP_003523913 | 356510372 | 1 | Glycine max | 6341 | 8154 |
| | | XP_003526354 | 356515330 | 0.9333 | Glycine max | 6342 | 8155 |
| | 926-946 | XP_003545791 | 356554924 | 1 | Glycine max | 6343 | 8156 |
| | | XP_003541563 | 356546291 | 0.8662 | Glycine max | 6344 | 8157 |
| ath-miR159b | 334-354 | XP_003554567 | 356572827 | 1 | Glycine max | 6345 | 8158 |
| | | XP_003521605 | 356505654 | 0.9723 | Glycine max | 6346 | 8159 |
| | | XP_003521606 | 356505656 | 0.9723 | Glycine max | 6347 | 8160 |
| | | XP_003626013 | 357511448 | 0.8949 | Medicago truncatula | 6348 | 8161 |
| | | XP_002272575 | 225437676 | 0.8423 | Vitis vinifera | 6349 | 8162 |
| | | CBI37003 | 270254427 | 0.8409 | Vitis vinifera | 6350 | 8163 |
| | | XP_002515224 | 255761086 | 0.8382 | Ricinus communis | 6351 | |
| | | CAN71135 | 147786943 | 0.8354 | Vitis vinifera | 6352 | 8164 |
| | | XP_002301535 | 255761085 | 0.8313 | Populus trichocarpa | 6353 | |
| | | ADF30190 | 294713705 | 0.8119 | Brassica napus | 6354 | 8165 |
| | 405-425 | XP_003542140 | 356547479 | 1 | Glycine max | 6355 | 8166 |
| | | XP_003546908 | 356557204 | 0.8696 | Glycine max | 6356 | 8167 |
| | 305-325 | XP_003541823 | 356546825 | 1 | Glycine max | 6357 | 8168 |
| | 124-144 | XP_003543825 | 356550908 | 1 | Glycine max | 6358 | 8169 |
| | | XP_003556814 | 356577399 | 0.813 | Glycine max | 6359 | 8170 |
| | 839-859 | XP_003526354 | 356515330 | 1 | Glycine max | 6360 | 8171 |
| | | XP_003523913 | 356510372 | 0.9333 | Glycine max | 6361 | 8172 |
| | 2079-2099 | XP_003538988 | 356541033 | 1 | Glycine max | 6362 | 8173 |
| | | XP_003607189 | 357473808 | 0.7407 | Medicago truncatula | 6363 | 8174 |
| | | XP_003604038 | 357467506 | 0.7035 | Medicago truncatula | 6364 | 8175 |
| | 614-634 | XP_003541563 | 356546291 | 1 | Glycine max | 6365 | 8176 |
| | | XP_003545791 | 356554924 | 0.805 | Glycine max | 6366 | 8177 |
| | 905-925 | XP_003556814 | 356577399 | 1 | Glycine max | 6367 | 8178 |
| | | XP_003543825 | 356550908 | 0.8659 | Glycine max | 6368 | 8179 |
| | 926-946 | XP_003545791 | 356554924 | 1 | Glycine max | 6369 | 8180 |
| | | XP_003541563 | 356546291 | 0.8662 | Glycine max | 6370 | 8181 |
| | 842-862 | XP_003523913 | 356510372 | 1 | Glycine max | 6371 | 8182 |
| | | XP_003526354 | 356515330 | 0.9333 | Glycine max | 6372 | 8183 |
| ath-miR159c | 251-271 | NP_001236122 | 351727005 | 1 | Glycine max | 6373 | 8184 |
| | | ACU21384 | 255642238 | 0.7676 | Glycine max | 6374 | 8185 |
| | 46-66 | XP_003519140 | 356500640 | 1 | Glycine max | 6375 | 8186 |
| | | XP_003549552 | 356562588 | 0.8757 | Glycine max | 6376 | 8187 |
| | | XP_003610353 | 357480134 | 0.9006 | Medicago truncatula | 6377 | 8188 |
| | 817-837 | XP_003525997 | 356514606 | 1 | Glycine max | 6378 | 8189 |
| | | XP_003540066 | 356543230 | 0.8441 | Glycine max | 6379 | 8190 |
| | 289-309 | XP_003518627 | 356499601 | 1 | Glycine max | 6380 | 8191 |
| | | XP_003542153 | 356547506 | 0.9478 | Glycine max | 6381 | 8192 |
| | | ADN33938 | 307136081 | 0.7937 | Cucumis melo subsp. melo | 6382 | 8193 |
| | | XP_002518919 | 255761086 | 0.7755 | Ricinus communis | 6383 | |
| | | XP_002279642 | 225426567 | 0.7755 | Vitis vinifera | 6384 | 8194 |
| | | XP_002870592 | 297853636 | 0.7664 | Arabidopsis lyrata subsp. lyrata | 6385 | |
| | | NP_199024 | 30693991 | 0.7642 | Arabidopsis thaliana | 6386 | 8195 |
| | | AAM63843 | 21405504 | 0.7596 | Arabidopsis thaliana | 6387 | 8196 |
| | | XP_002299422 | 255761085 | 0.7528 | Populus trichocarpa | 6388 | |
| | | XP_002303695 | 255761085 | 0.7574 | Populus trichocarpa | 6389 | |
| | 124-144 | XP_003543825 | 356550908 | 1 | Glycine max | 6390 | 8197 |
| | | XP_003556814 | 356577399 | 0.813 | Glycine max | 6391 | 8198 |
| | 461-481 | XP_003542153 | 356547506 | 1 | Glycine max | 6392 | 8199 |
| | | XP_003518627 | 356499601 | 0.9436 | Glycine max | 6393 | 8200 |
| | 1162-1182 | XP_003531162 | 356525093 | 1 | Glycine max | 6394 | 8201 |
| | | XP_003524148 | 356510852 | 0.7692 | Glycine max | 6395 | 8202 |
| | 839-859 | XP_003526354 | 356515330 | 1 | Glycine max | 6396 | 8203 |
| | | XP_003523913 | 356510372 | 0.9333 | Glycine max | 6397 | 8204 |
| | 495-515 | XP_003524148 | 356510852 | 1 | Glycine max | 6398 | 8205 |
| | | XP_003531162 | 356525093 | 0.7762 | Glycine max | 6399 | 8206 |
| | 949-969 | XP_003547199 | 356557800 | 1 | Glycine max | 6400 | 8207 |
| | | XP_003541668 | 356546507 | 0.8748 | Glycine max | 6401 | 8208 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 614-634 | XP_003541563 | 356546291 | 1 | Glycine max | 6402 | 8209 |
| | | XP_003545791 | 356554924 | 0.805 | Glycine max | 6403 | 8210 |
| | 905-925 | XP_003556814 | 356577399 | 1 | Glycine max | 6404 | 8211 |
| | | XP_003543825 | 356550908 | 0.8659 | Glycine max | 6405 | 8212 |
| | 2016-2036 | XP_003538988 | 356541033 | 1 | Glycine max | 6406 | 8213 |
| | | XP_003607189 | 357473808 | 0.7407 | Medicago truncatula | 6407 | 8214 |
| | | XP_003604038 | 357467506 | 0.7035 | Medicago truncatula | 6408 | 8215 |
| | 1330-1350 | XP_003541668 | 356546507 | 1 | Glycine max | 6409 | 8216 |
| | | XP_003547199 | 356557800 | 0.8383 | Glycine max | 6410 | 8217 |
| | 842-862 | XP_003523913 | 356510372 | 1 | Glycine max | 6411 | 8218 |
| | | XP_003526354 | 356515330 | 0.9333 | Glycine max | 6412 | 8219 |
| | 926-946 | XP_003545791 | 356554924 | 1 | Glycine max | 6413 | 8220 |
| | | XP_003541563 | 356546291 | 0.8662 | Glycine max | 6414 | 8221 |
| ath-miRf10240-akr | 288-307 | AES96257 | 357486022 | 1 | Medicago truncatula | 6415 | 8222 |
| | | XP_003613299 | 357486022 | 1 | Medicago truncatula | 6416 | 8223 |
| | | XP_003517816 | 356497943 | 0.9446 | Glycine max | 6417 | 8224 |
| | | XP_003519545 | 356501464 | 0.9418 | Glycine max | 6418 | 8225 |
| | | XP_003517817 | 356497945 | 0.9446 | Glycine max | 6419 | 8226 |
| | | XP_003530656 | 356524070 | 0.8809 | Glycine max | 6420 | 8227 |
| | | XP_003551180 | 356565911 | 0.8753 | Glycine max | 6421 | 8228 |
| | | XP_002531401 | 255761086 | 0.8421 | Ricinus communis | 6422 | |
| | | XP_003628672 | 357516766 | 0.8504 | Medicago truncatula | 6423 | 8229 |
| | | XP_002266222 | 225424743 | 0.8393 | Vitis vinifera | 6424 | 8230 |
| | | CAN76955 | 147776916 | 0.8338 | Vitis vinifera | 6425 | 8231 |
| | 1503-1522 | XP_003547951 | 356559326 | 1 | Glycine max | 6426 | 8232 |
| | | ACU23369 | 255645751 | 0.998 | Glycine max | 6427 | 8233 |
| | | XP_003547950 | 356559324 | 0.8408 | Glycine max | 6428 | 8234 |
| | | ACU18289 | 255635883 | 0.8388 | Glycine max | 6429 | 8235 |
| | | XP_003629354 | 357518130 | 0.7531 | Medicago truncatula | 6430 | 8236 |
| | | XP_002531509 | 255761086 | 0.7204 | Ricinus communis | 6431 | |
| | | ABK95760 | 118487875 | 0.7245 | Populus trichocarpa | 6432 | 8237 |
| | | XP_003612122 | 357483670 | 0.7327 | Medicago truncatula | 6433 | 8238 |
| | | XP_002333330 | 255761085 | 0.7122 | Populus trichocarpa | 6434 | |
| | | XP_002310843 | 255761085 | 0.702 | Populus trichocarpa | 6435 | |
| | 115-134 | AES78100 | 357503186 | 1 | Medicago truncatula | 6436 | 8239 |
| | | XP_003621882 | 357503186 | 1 | Medicago truncatula | 6437 | 8240 |
| | 95-114 | AET03830 | 357518130 | 1 | Medicago truncatula | 6438 | 8241 |
| | | XP_003547951 | 356559326 | 0.811 | Glycine max | 6439 | 8242 |
| | 487-506 | NP_001238238 | 351721588 | 1 | Glycine max | 6440 | 8243 |
| | | NP_001237618 | 351725834 | 0.9947 | Glycine max | 6441 | 8244 |
| | | ACU16478 | 255632239 | 0.9679 | Glycine max | 6442 | 8245 |
| | | XP_003519150 | 356500660 | 0.7968 | Glycine max | 6443 | 8246 |
| | 149-168 | XP_003531007 | 356524781 | 1 | Glycine max | 6444 | 8247 |
| | | XP_003528405 | 356519488 | 0.9391 | Glycine max | 6445 | 8248 |
| | | XP_003608343 | 357476114 | 0.8746 | Medicago truncatula | 6446 | 8249 |
| | | XP_002264303 | 225429239 | 0.7885 | Vitis vinifera | 6447 | 8250 |
| | | CBI35448 | 270252044 | 0.7885 | Vitis vinifera | 6448 | |
| | | XP_002518318 | 255761086 | 0.767 | Ricinus communis | 6449 | |
| | | NP_201251 | 145359643 | 0.7742 | Arabidopsis thaliana | 6450 | 8251 |
| | | XP_002866616 | 297853636 | 0.7778 | Arabidopsis lyrata subsp. lyrata | 6451 | |
| | | ABK95206 | 118486740 | 0.7527 | Populus trichocarpa | 6452 | 8252 |
| | | XP_002313210 | 255761085 | 0.7491 | Populus trichocarpa | 6453 | |
| | 214-233 | XP_003525932 | 356514476 | 1 | Glycine max | 6454 | 8253 |
| | 700-719 | XP_003523287 | 356509093 | 1 | Glycine max | 6455 | 8254 |
| | | XP_003526789 | 356516210 | 0.9406 | Glycine max | 6456 | 8255 |
| | | XP_003518282 | 356498893 | 0.7406 | Glycine max | 6457 | 8256 |
| | | XP_003544853 | 356553012 | 0.7406 | Glycine max | 6458 | 8257 |
| ath-miRf10368-akr | 587-606 | XP_003543893 | 356551052 | 1 | Glycine max | 6459 | 8258 |
| | | XP_003554723 | 356573142 | 0.9659 | Glycine max | 6460 | 8259 |
| | | ACJ85427 | 357496652 | 0.8447 | Medicago truncatula | 6461 | 8260 |
| | | XP_003531841 | 356526470 | 0.8333 | Glycine max | 6462 | 8261 |
| | | XP_003552550 | 356568703 | 0.8106 | Glycine max | 6463 | 8262 |
| | | XP_002284521 | 225457306 | 0.7765 | Vitis vinifera | 6464 | 8263 |
| | | XP_002323884 | 255761085 | 0.7765 | Populus trichocarpa | 6465 | |
| | | XP_002284184 | 225452935 | 0.7803 | Vitis vinifera | 6466 | 8264 |
| | | XP_002306045 | 255761085 | 0.7424 | Populus trichocarpa | 6467 | |
| | | XP_002526069 | 255761086 | 0.7424 | Ricinus communis | 6468 | |
| | 456-475 | XP_003539013 | 356541084 | 1 | Glycine max | 6469 | 8265 |
| | | XP_003540676 | 356544475 | 0.8768 | Glycine max | 6470 | 8266 |
| | | XP_003539012 | 356541082 | 0.7183 | Glycine max | 6471 | 8267 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 685-704 | NP_001235161 | 351721419 | 1 | Glycine max | 6472 | 8268 |
| | | XP_003548144 | 356559717 | 0.9705 | Glycine max | 6473 | 8269 |
| | | XP_003548143 | 356559715 | 0.7785 | Glycine max | 6474 | 8270 |
| | | BAB86923 | 19911192 | 0.711 | Vigna angularis | 6475 | 8271 |
| | 685-704 | NP_001235161 | 351721419 | 1 | Glycine max | 6476 | 8272 |
| | 3330-3349 | XP_003551446 | 356566453 | 1 | Glycine max | 6477 | |
| | 347-366 | XP_003540896 | 356544921 | 1 | Glycine max | 6478 | 8273 |
| | | XP_003533477 | 356529802 | 0.7278 | Glycine max | 6479 | 8274 |
| | | XP_003607171 | 357473772 | 0.8086 | Medicago truncatula | 6480 | 8275 |
| | | XP_002533189 | 255761086 | 0.7412 | Ricinus communis | 6481 | |
| | | XP_002279051 | 225428040 | 0.7305 | Vitis vinifera | 6482 | 8276 |
| | | XP_003522637 | 356507769 | 0.7466 | Glycine max | 6483 | 8277 |
| | | XP_003526942 | 356516520 | 0.7035 | Glycine max | 6484 | 8278 |
| | 88-107 | XP_002533189 | 255761086 | 1 | Ricinus communis | 6485 | |
| | | XP_003540896 | 356544921 | 0.7035 | Glycine max | 6486 | 8279 |
| | | XP_002270345 | 225457886 | 0.7008 | Vitis vinifera | 6487 | 8280 |
| | 589-608 | XP_003518505 | 356499351 | 1 | Glycine max | 6488 | 8281 |
| | 75-94 | XP_002312957 | 255761085 | 1 | Populus trichocarpa | 6489 | |
| | | XP_002306186 | 255761085 | 0.9181 | Populus trichocarpa | 6490 | |
| | | CAN67732 | 147790359 | 0.8836 | Vitis vinifera | 6491 | 8282 |
| | 682-701 | XP_003556840 | 356577453 | 1 | Glycine max | 6492 | 8283 |
| | | XP_003519003 | 356500365 | 0.7261 | Glycine max | 6493 | 8284 |
| | | XP_003542320 | 356547854 | 0.7261 | Glycine max | 6494 | 8285 |
| | 220-239 | XP_003527967 | 356518600 | 1 | Glycine max | 6495 | 8286 |
| | | XP_003523399 | 356509321 | 0.7599 | Glycine max | 6496 | 8287 |
| | 1834-1853 | XP_003539709 | 356542508 | 1 | Glycine max | 6497 | 8288 |
| | | XP_003538207 | 356539441 | 0.9136 | Glycine max | 6498 | 8289 |
| | | XP_003606389 | 357472208 | 0.8066 | Medicago truncatula | 6499 | 8290 |
| | | NP_001238028 | 351722912 | 0.7617 | Glycine max | 6500 | 8291 |
| | | XP_003543464 | 356550174 | 0.7375 | Glycine max | 6501 | 8292 |
| | | XP_003539710 | 356542510 | 0.8394 | Glycine max | 6502 | 8293 |
| | | XP_002530284 | 255761086 | 0.7081 | Ricinus communis | 6503 | |
| | 0-19 | AES82704 | 357512394 | 1 | Medicago truncatula | 6504 | |
| | | XP_003521781 | 356506009 | 0.8339 | Glycine max | 6505 | |
| | | CBI28651 | 270241399 | 0.747 | Vitis vinifera | 6506 | |
| | | XP_002267871 | 225430630 | 0.7263 | Vitis vinifera | 6507 | |
| | | XP_003553769 | 356571203 | 0.8332 | Glycine max | 6508 | |
| | 1104-1123 | XP_003518991 | 356500340 | 1 | Glycine max | 6509 | 8294 |
| | | XP_003535145 | 356533178 | 0.8841 | Glycine max | 6510 | 8295 |
| | | XP_003535146 | 356533180 | 0.8509 | Glycine max | 6511 | 8296 |
| | 439-458 | XP_003526441 | 356515505 | 1 | Glycine max | 6512 | 8297 |
| | | XP_003522648 | 356507791 | 0.9351 | Glycine max | 6513 | 8298 |
| | | XP_003522647 | 356507789 | 0.8643 | Glycine max | 6514 | 8299 |
| | | XP_002284618 | 225430104 | 0.7935 | Vitis vinifera | 6515 | 8300 |
| | | XP_003526440 | 356515503 | 0.8525 | Glycine max | 6516 | 8301 |
| | | XP_002284775 | 225445329 | 0.7788 | Vitis vinifera | 6517 | 8302 |
| | | XP_002515572 | 255761086 | 0.7699 | Ricinus communis | 6518 | |
| | | AES73734 | 357466396 | 0.7876 | Medicago truncatula | 6519 | 8303 |
| | 1245-1264 | NP_001238286 | 351722970 | 1 | Glycine max | 6520 | 8304 |
| | | BAG72094 | 207367147 | 0.9584 | Glycine max | 6521 | 8305 |
| | | ACE79196 | 190586158 | 0.9558 | Glycine max | 6522 | 8306 |
| | | ACE79197 | 190586160 | 0.9019 | Glycine max | 6523 | 8307 |
| | | XP_003555766 | 356575272 | 0.8983 | Glycine max | 6524 | 8308 |
| | | P93673 | | 0.8453 | Lathyrus sativus | 6525 | |
| | | P15001 | | 0.8453 | Pisum sativum | 6526 | |
| | | AES61525 | 357441992 | 0.8426 | Medicago truncatula | 6527 | 8309 |
| | | XP_002278610 | 225450404 | 0.7772 | Vitis vinifera | 6528 | 8310 |
| | | ACC60969 | 183239021 | 0.7763 | Vitis riparia | 6529 | |
| | 177-196 | XP_002306186 | 255761085 | 1 | Populus trichocarpa | 6530 | |
| | | XP_002312957 | 255761085 | 0.7553 | Populus trichocarpa | 6531 | |
| | 439-458 | XP_003522648 | 356507791 | 1 | Glycine max | 6532 | 8311 |
| | | XP_003526441 | 356515505 | 0.9351 | Glycine max | 6533 | 8312 |
| | | NP_189078 | 42565156 | 0.7168 | Arabidopsis thaliana | 6534 | 8313 |
| | 200-219 | XP_003597608 | 357454654 | 1 | Medicago truncatula | 6535 | 8314 |
| | | ABN08398 | 357454654 | 1 | Medicago truncatula | 6536 | 8315 |
| | | XP_003546676 | 356556729 | 0.8954 | Glycine max | 6537 | 8316 |
| | | XP_003543598 | 356550445 | 0.8942 | Glycine max | 6538 | 8317 |
| | | XP_003531618 | 356526020 | 0.8609 | Glycine max | 6539 | 8318 |
| | | XP_003529875 | 356522481 | 0.8537 | Glycine max | 6540 | 8319 |
| | | CAA07236 | 316995680 | 0.849 | Cicer arietinum | 6541 | 8320 |
| | | ABK96254 | 118488889 | 0.8121 | Populus trichocarpa × Populus deltoides | 6542 | 8321 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | CAC44500 | 14970838 | 0.8157 | *Fragaria × ananassa* | 6543 | 8322 |
| | | XP_002327432 | 255761085 | 0.8109 | *Populus trichocarpa* | 6544 | |
| | | ABV32545 | 157313303 | 0.824 | *Prunus persica* | 6545 | 8323 |
| | 20-39 | XP_003538511 | 356540064 | 1 | *Glycine max* | 6546 | |
| | | XP_003540789 | 356544707 | 0.9546 | *Glycine max* | 6547 | |
| | | AES88424 | 357471884 | 0.8454 | *Medicago truncatula* | 6548 | |
| | | XP_002328167 | 255761085 | 0.78 | *Populus trichocarpa* | 6549 | |
| | | XP_002529065 | 255761086 | 0.7791 | *Ricinus communis* | 6550 | |
| | | XP_002269920 | 225436294 | 0.7732 | *Vitis vinifera* | 6551 | |
| | 1726-1745 | XP_003538207 | 356539441 | 1 | *Glycine max* | 6552 | 8324 |
| | | XP_003539709 | 356542508 | 0.901 | *Glycine max* | 6553 | 8325 |
| | | AES88586 | 357472208 | 0.8038 | *Medicago truncatula* | 6554 | 8326 |
| | | XP_003538208 | 356539443 | 0.8362 | *Glycine max* | 6555 | 8327 |
| ath-miRf10763-akr | 137-156 | XP_003540953 | 356545038 | 1 | *Glycine max* | 6556 | 8328 |
| | | XP_003537828 | 356538677 | 0.9174 | *Glycine max* | 6557 | 8329 |
| | 246-265 | ACU17625 | 255634523 | 1 | *Glycine max* | 6558 | 8330 |
| | | XP_003520499 | 356503402 | 0.9227 | *Glycine max* | 6559 | 8331 |
| | | XP_003554133 | 356571948 | 0.8886 | *Glycine max* | 6560 | 8332 |
| | 448-467 | XP_003555015 | 356573740 | 1 | *Glycine max* | 6561 | 8333 |
| | 145-164 | XP_002267145 | 225438252 | 1 | *Vitis vinifera* | 6562 | 8334 |
| | | XP_003517356 | 356497006 | 0.8121 | *Glycine max* | 6563 | 8335 |
| | | XP_003539260 | 356541595 | 0.8166 | *Glycine max* | 6564 | 8336 |
| | | XP_003611551 | 357482528 | 0.7919 | *Medicago truncatula* | 6565 | 8337 |
| | | NP_566927 | 42565786 | 0.7696 | *Arabidopsis thaliana* | 6566 | 8338 |
| | | XP_002877705 | 297853636 | 0.774 | *Arabidopsis lyrata* subsp. *lyrata* | 6567 | |
| | | XP_002285420 | 225458889 | 0.8076 | *Vitis vinifera* | 6568 | 8339 |
| | | AAM61258 | 21403407 | 0.7673 | *Arabidopsis thaliana* | 6569 | 8340 |
| | | NP_201393 | 30698164 | 0.7405 | *Arabidopsis thaliana* | 6570 | 8341 |
| | | AAL32554 | 17064799 | 0.7383 | *Arabidopsis thaliana* | 6571 | 8342 |
| | 523-542 | XP_003524815 | 356512212 | 1 | *Glycine max* | 6572 | 8343 |
| | | | 356528136 | 0.981 | *Glycine max* | 6573 | |
| | 136-155 | XP_003520083 | 356502552 | 1 | *Glycine max* | 6574 | 8344 |
| | | XP_003517797 | 356497905 | 0.8522 | *Glycine max* | 6575 | 8345 |
| | 993-1012 | AET34792 | 356650815 | 1 | *Pisum sativum* | 6576 | 8346 |
| | | AET34790 | 356650811 | 0.9979 | *Pisum sativum* | 6577 | 8347 |
| | | AET34786 | 356650803 | 0.9358 | *Medicago truncatula* | 6578 | 8348 |
| | | XP_003625012 | 357509446 | 0.9337 | *Medicago truncatula* | 6579 | 8349 |
| | | AET34796 | 356650823 | 0.8654 | *Glycine max* | 6580 | 8350 |
| | | XP_003521136 | 356504705 | 0.8551 | *Glycine max* | 6581 | 8351 |
| | | AEM62768 | 343794555 | 0.8778 | *Lotus japonicus* | 6582 | 8352 |
| | | XP_002275980 | 225441316 | 0.8282 | *Vitis vinifera* | 6583 | 8353 |
| | | CAN80112 | 147852377 | 0.8282 | *Vitis vinifera* | 6584 | 8354 |
| | | XP_002308905 | 255761085 | 0.824 | *Populus trichocarpa* | 6585 | |
| | 223-242 | XP_003520499 | 356503402 | 1 | *Glycine max* | 6586 | 8355 |
| | | ACU17625 | 255634523 | 0.9878 | *Glycine max* | 6587 | 8356 |
| | 217-236 | XP_003526336 | 356515293 | 1 | *Glycine max* | 6588 | 8357 |
| | | XP_003540834 | 356544797 | 0.7611 | *Glycine max* | 6589 | 8358 |
| | 241-260 | XP_003519685 | 356501746 | 1 | *Glycine max* | 6590 | 8359 |
| | | ACU23918 | 255646896 | 0.9948 | *Glycine max* | 6591 | 8360 |
| | | XP_003545065 | 356553441 | 0.8093 | *Glycine max* | 6592 | 8361 |
| | 26-45 | CBI33098 | 270247736 | 1 | *Vitis vinifera* | 6593 | 8362 |
| | 237-256 | AAF73257 | 8132346 | 1 | *Pisum sativum* | 6594 | 8363 |
| | | XP_003523778 | 356510099 | 0.9489 | *Glycine max* | 6595 | 8364 |
| | | XP_003527981 | 356518628 | 0.9382 | *Glycine max* | 6596 | 8365 |
| | | CAN70091 | 123701299 | 0.8817 | *Vitis vinifera* | 6597 | 8366 |
| | | Q40517 | | 0.8817 | *Nicotiana tabacum* | 6598 | |
| | | NP_001233761 | 350539780 | 0.8737 | *Solanum lycopersicum* | 6599 | 8367 |
| | | Q40884 | | 0.8737 | *Petunia × hybrida* | 6600 | |
| | | XP_002302017 | 255761085 | 0.871 | *Populus trichocarpa* | 6601 | |
| | | XP_002510434 | 255761086 | 0.8737 | *Ricinus communis* | 6602 | |
| | 360-379 | XP_003539534 | 356542151 | 1 | *Glycine max* | 6603 | 8368 |
| | | XP_003543335 | 356549913 | 0.8571 | *Glycine max* | 6604 | 8369 |
| | 26-45 | XP_003601902 | 357463240 | 1 | *Medicago truncatula* | 6605 | 8370 |
| | | XP_003538598 | 356540240 | 0.8571 | *Glycine max* | 6606 | 8371 |
| | | XP_003551994 | 356567575 | 0.8521 | *Glycine max* | 6607 | 8372 |
| | | XP_003531333 | 356525440 | 0.8045 | *Glycine max* | 6608 | 8373 |
| | | XP_003525038 | 356512665 | 0.797 | *Glycine max* | 6609 | 8374 |
| | | XP_002530039 | 255761086 | 0.7845 | *Ricinus communis* | 6610 | |
| | | XP_002314593 | 255761085 | 0.7694 | *Populus trichocarpa* | 6611 | |
| | | XP_002282407 | 225424658 | 0.7669 | *Vitis vinifera* | 6612 | 8375 |
| | | XP_002311761 | 255761085 | 0.7669 | *Populus trichocarpa* | 6613 | |
| | | CBI16790 | 270228074 | 0.7569 | *Vitis vinifera* | 6614 | |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 502-521 | NP_001234991 | 351723886 | 1 | Glycine max | 6615 | 8376 |
| | | XP_003552315 | 356568227 | 0.9954 | Glycine max | 6616 | 8377 |
| | | XP_003543429 | 356550102 | 0.9815 | Glycine max | 6617 | 8378 |
| | | NP_001236946 | 351721215 | 0.9769 | Glycine max | 6618 | 8379 |
| | | XP_003596822 | 357453090 | 0.9444 | Medicago truncatula | 6619 | 8380 |
| | | XP_003611340 | 357482108 | 0.9444 | Medicago truncatula | 6620 | 8381 |
| | | XP_003600923 | 357461282 | 0.9444 | Medicago truncatula | 6621 | 8382 |
| | | NP_001237030 | 351723638 | 0.9306 | Glycine max | 6622 | 8383 |
| | | ACG24758 | 195605855 | 0.875 | Zea mays | 6623 | 8384 |
| | | ACG33436 | 195623211 | 0.875 | Zea mays | 6624 | 8385 |
| | 129-148 | ACU17625 | 255634523 | 1 | Glycine max | 6625 | 8386 |
| | 290-309 | XP_003548849 | 356561151 | 1 | Glycine max | 6626 | 8387 |
| | | XP_003519868 | 356502117 | 0.8445 | Glycine max | 6627 | 8388 |
| | | XP_003629318 | 357518058 | 0.7456 | Medicago truncatula | 6628 | 8389 |
| | 237-256 | XP_003527981 | 356518628 | 1 | Glycine max | 6629 | 8390 |
| | | AAF73257 | 8132346 | 0.9407 | Pisum sativum | 6630 | 8391 |
| | | ABA00652 | 74231015 | 0.8814 | Gossypium hirsutum | 6631 | 8392 |
| | 37-56 | XP_003547100 | 356557592 | 1 | Glycine max | 6632 | 8393 |
| | | XP_003541782 | 356546742 | 0.862 | Glycine max | 6633 | 8394 |
| | | XP_003593272 | 357445988 | 0.7085 | Medicago truncatula | 6634 | 8395 |
| | 248-267 | ACU23918 | 255646896 | 1 | Glycine max | 6635 | 8396 |
| | | XP_003519685 | 356501746 | 0.9948 | Glycine max | 6636 | 8397 |
| ath-miRf11042-akr | 757-777 | XP_003629993 | 357519408 | 1 | Medicago truncatula | 6637 | 8398 |
| | | ACJ84083 | 217071445 | 0.9917 | Medicago truncatula | 6638 | 8399 |
| | | NP_001235375 | 351727608 | 0.8595 | Glycine max | 6639 | 8400 |
| | | NP_001237170 | 351727706 | 0.8264 | Glycine max | 6640 | 8401 |
| | | CAA10134 | 3860332 | 0.8347 | Cicer arietinum | 6641 | 8402 |
| | | XP_002298184 | 255761085 | 0.719 | Populus trichocarpa | 6642 | |
| | | NP_001237531 | 351723330 | 0.7107 | Glycine max | 6643 | 8403 |
| | | XP_003523409 | 356509341 | 0.7107 | Glycine max | 6644 | 8404 |
| | | | 357519363 | 1 | Medicago truncatula | 6645 | |
| | 361-381 | XP_003592180 | 357443804 | 1 | Medicago truncatula | 6646 | 8405 |
| | | XP_003556131 | 356576015 | 0.7984 | Glycine max | 6647 | 8406 |
| | | XP_003535589 | 356534086 | 0.8 | Glycine max | 6648 | 8407 |
| | | XP_002329680 | 255761085 | 0.777 | Populus trichocarpa | 6649 | |
| | | XP_002276766 | 225464654 | 0.7475 | Vitis vinifera | 6650 | 8408 |
| | | CBI22616 | 270233919 | 0.7213 | Vitis vinifera | 6651 | 8409 |
| | 1042-1062 | XP_003616507 | 357492436 | 1 | Medicago truncatula | 6652 | 8410 |
| | | XP_003518398 | 356499134 | 0.8512 | Glycine max | 6653 | 8411 |
| | | XP_003545247 | 356553814 | 0.8492 | Glycine max | 6654 | 8412 |
| | | XP_003537472 | 356537955 | 0.7738 | Glycine max | 6655 | 8413 |
| | | XP_003552860 | 356569339 | 0.7718 | Glycine max | 6656 | 8414 |
| | | XP_002524242 | 255761086 | 0.7321 | Ricinus communis | 6657 | |
| | | XP_002277622 | 225449359 | 0.7063 | Vitis vinifera | 6658 | 8415 |
| | 520-540 | XP_003534554 | 356531980 | 1 | Glycine max | 6659 | |
| | | XP_003552402 | 356568406 | 0.9572 | Glycine max | 6660 | |
| | | XP_003548671 | 356560791 | 0.7736 | Glycine max | 6661 | |
| | | XP_003528847 | 356520393 | 0.7732 | Glycine max | 6662 | |
| | | XP_003623999 | 357507420 | 0.7898 | Medicago truncatula | 6663 | |
| | | XP_003627563 | 357514548 | 0.7385 | Medicago truncatula | 6664 | |
| | | XP_002276245 | 225454279 | 0.7367 | Vitis vinifera | 6665 | |
| | | XP_002511882 | 255761086 | 0.7349 | Ricinus communis | 6666 | |
| | | CAN74059 | 147789689 | 0.7228 | Vitis vinifera | 6667 | |
| | 1412-1432 | XP_003556131 | 356576015 | 1 | Glycine max | 6668 | 8416 |
| | | XP_003592180 | 357443804 | 0.8203 | Medicago truncatula | 6669 | 8417 |
| csi-miR3948 | 43-66 | XP_003547789 | 356558998 | 1 | Glycine max | 6670 | 8418 |
| | | XP_003531955 | 356526700 | 0.9164 | Glycine max | 6671 | 8419 |
| | | ACU23577 | 255646183 | 0.9078 | Glycine max | 6672 | 8420 |
| | 209-232 | XP_003540784 | 356544697 | 1 | Glycine max | 6673 | 8421 |
| | | XP_003539180 | 356541429 | 0.8869 | Glycine max | 6674 | 8422 |
| | 40-63 | XP_003556473 | 356576709 | 1 | Glycine max | 6675 | 8423 |
| | | XP_003535369 | 356533638 | 0.8958 | Glycine max | 6676 | 8424 |
| | 47-70 | XP_003527776 | 356518214 | 1 | Glycine max | 6677 | 8425 |
| | 77-100 | XP_003550061 | 356563623 | 1 | Glycine max | 6678 | 8426 |
| | | XP_003525811 | 356514233 | 0.9621 | Glycine max | 6679 | 8427 |
| | | XP_002310135 | 255761085 | 0.7098 | Populus trichocarpa | 6680 | |
| | | XP_002523601 | 255761086 | 0.7035 | Ricinus communis | 6681 | |
| | 173-196 | XP_003525811 | 356514233 | 1 | Glycine max | 6682 | 8428 |
| | | XP_003550061 | 356563623 | 0.9591 | Glycine max | 6683 | 8429 |
| | 208-231 | XP_003542594 | 356548408 | 1 | Glycine max | 6684 | 8430 |
| | | XP_003537062 | 356537086 | 0.7495 | Glycine max | 6685 | 8431 |
| | 179-202 | XP_003539180 | 356541429 | 1 | Glycine max | 6686 | 8432 |
| | | XP_003540784 | 356544697 | 0.8923 | Glycine max | 6687 | 8433 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 209-232 | BAD18437 | 47077005 | 1 | Homo sapiens | 6688 | 8434 |
| | | XP_003522605 | 356507705 | 1 | Glycine max | 6689 | 8435 |
| | | XP_003526400 | 356515423 | 0.9316 | Glycine max | 6690 | 8436 |
| | 232-255 | XP_003537062 | 356537086 | 1 | Glycine max | 6691 | 8437 |
| | | XP_003542594 | 356548408 | 0.7416 | Glycine max | 6692 | 8438 |
| ghr-miR2950 | 37-57 | XP_003518096 | 356498514 | 1 | Glycine max | 6693 | 8439 |
| | | XP_003537196 | 356537360 | 0.9379 | Glycine max | 6694 | 8440 |
| | | XP_003516696 | 356495666 | 0.7495 | Glycine max | 6695 | 8441 |
| | 909-929 | XP_003529456 | 356521627 | 1 | Glycine max | 6696 | 8442 |
| | | XP_003556690 | 356577148 | 0.8891 | Glycine max | 6697 | 8443 |
| | | XP_003601600 | 357462636 | 0.8073 | Medicago truncatula | 6698 | 8444 |
| | | XP_003601595 | 357462626 | 0.8073 | Medicago truncatula | 6699 | 8445 |
| | | XP_003601599 | 357462634 | 0.8073 | Medicago truncatula | 6700 | 8446 |
| | | XP_003601596 | 357462628 | 0.8036 | Medicago truncatula | 6701 | 8447 |
| | | XP_003607816 | 357475060 | 0.7764 | Medicago truncatula | 6702 | 8448 |
| | | XP_003601601 | 357462638 | 0.7982 | Medicago truncatula | 6703 | 8449 |
| | | XP_003538519 | 356540080 | 0.7436 | Glycine max | 6704 | 8450 |
| | | XP_002303974 | 255761085 | 0.7491 | Populus trichocarpa | 6705 | |
| | 1446-1466 | BAG68945 | 197209811 | 1 | Lotus japonicus | 6706 | 8451 |
| | | XP_003549436 | 356562352 | 0.881 | Glycine max | 6707 | 8452 |
| | | AAC09468 | 6503252 | 0.8541 | Pisum sativum | 6708 | 8453 |
| | | XP_003541616 | 356546403 | 0.8824 | Glycine max | 6709 | 8454 |
| | | XP_003610109 | 357479646 | 0.8598 | Medicago truncatula | 6710 | 8455 |
| | | XP_002270732 | 225446043 | 0.8116 | Vitis vinifera | 6711 | 8456 |
| | | ACN54324 | 224551851 | 0.7805 | Gossypium hirsutum | 6712 | 8457 |
| | | AAK15261 | 13183565 | 0.7748 | Populus trichocarpa × Populus deltoides | 6713 | 8458 |
| | | CBI17838 | 270228824 | 0.7734 | Vitis vinifera | 6714 | |
| | | XP_002324469 | 255761085 | 0.7677 | Populus trichocarpa | 6715 | |
| | 177-197 | XP_003554852 | 356573405 | 1 | Glycine max | 6716 | 8459 |
| | | XP_003543493 | 356550234 | 0.8998 | Glycine max | 6717 | 8460 |
| | 461-481 | XP_003536297 | 356535528 | 1 | Glycine max | 6718 | 8461 |
| | | XP_003556292 | 356576342 | 0.9205 | Glycine max | 6719 | 8462 |
| | 238-258 | XP_003518581 | 356499506 | 1 | Glycine max | 6720 | 8463 |
| | | XP_003618091 | 357495604 | 0.7113 | Medicago truncatula | 6721 | 8464 |
| gma-miR156g | 75-94 | XP_003520455 | 356503312 | 1 | Glycine max | 6722 | 8465 |
| | | XP_003530170 | 356523079 | 0.848 | Glycine max | 6723 | 8466 |
| | 371-390 | XP_003553428 | 356570509 | 1 | Glycine max | 6724 | 8467 |
| | | XP_003520534 | 356503475 | 0.9081 | Glycine max | 6725 | 8468 |
| | 759-778 | XP_003520534 | 356503475 | 1 | Glycine max | 6726 | 8469 |
| | | XP_003553428 | 356570509 | 0.9081 | Glycine max | 6727 | 8470 |
| | 108-127 | XP_003553944 | 356571558 | 1 | Glycine max | 6728 | 8471 |
| | | XP_003549130 | 356561725 | 0.9452 | Glycine max | 6729 | 8472 |
| | 237-256 | XP_003551188 | 356565928 | 1 | Glycine max | 6730 | 8473 |
| | | XP_003538544 | 356540131 | 0.9106 | Glycine max | 6731 | 8474 |
| | | ACU18328 | 255635963 | 0.9083 | Glycine max | 6732 | 8475 |
| | | XP_003601767 | 357462970 | 0.7064 | Medicago truncatula | 6733 | 8476 |
| | 36-55 | AAM12880 | 20149261 | 1 | Helianthus annuus | 6734 | 8477 |
| | | CBI28152 | 270240501 | 0.991 | Vitis vinifera | 6735 | |
| | | XP_002284967 | 225430201 | 0.991 | Vitis vinifera | 6736 | 8478 |
| | | CBI21000 | 270231236 | 0.991 | Vitis vinifera | 6737 | |
| | | CBI36254 | 270253379 | 0.9819 | Vitis vinifera | 6738 | 8479 |
| | | NP_200330 | 145359269 | 0.9864 | Arabidopsis thaliana | 6739 | 8480 |
| | | XP_003522628 | 356507751 | 0.9819 | Glycine max | 6740 | 8481 |
| | | AEM97804 | 344189954 | 0.9864 | Dimocarpus longan | 6741 | 8482 |
| | | XP_002864382 | 297853636 | 0.9864 | Arabidopsis lyrata subsp. lyrata | 6742 | |
| | | XP_002285307 | 225442824 | 0.9819 | Vitis vinifera | 6743 | 8483 |
| | 1020-1039 | XP_003532399 | 356527605 | 1 | Glycine max | 6744 | 8484 |
| | | XP_003525415 | 356513426 | 0.8914 | Glycine max | 6745 | 8485 |
| | 114-133 | ACU18105 | 255635506 | 1 | Glycine max | 6746 | 8486 |
| | 756-775 | XP_003518080 | 356498481 | 1 | Glycine max | 6747 | 8487 |
| | | XP_003551421 | 356566402 | 0.8408 | Glycine max | 6748 | 8488 |
| | 118-137 | XP_003549130 | 356561725 | 1 | Glycine max | 6749 | 8489 |
| | | XP_003553944 | 356571558 | 0.9452 | Glycine max | 6750 | 8490 |
| | 662-681 | XP_003550514 | 356564545 | 1 | Glycine max | 6751 | 8491 |
| | | XP_003528668 | 356520027 | 0.9389 | Glycine max | 6752 | 8492 |
| | | XP_003541638 | 356546447 | 0.8242 | Glycine max | 6753 | 8493 |
| | | XP_003547234 | 356557871 | 0.808 | Glycine max | 6754 | 8494 |
| | | XP_003594096 | 357447640 | 0.803 | Medicago truncatula | 6755 | 8495 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002279739 | 225432499 | 0.7382 | Vitis vinifera | 6756 | 8496 |
| | | CAN70618 | 147801938 | 0.7406 | Vitis vinifera | 6757 | 8497 |
| | | XP_002314424 | 255761085 | 0.7406 | Populus trichocarpa | 6758 | |
| | | XP_002516799 | 255761086 | 0.7219 | Ricinus communis | 6759 | |
| | | XP_002312735 | 255761085 | 0.7157 | Populus trichocarpa | 6760 | |
| | 691-710 | XP_003525415 | 356513426 | 1 | Glycine max | 6761 | 8498 |
| | | XP_003532399 | 356527605 | 0.9051 | Glycine max | 6762 | 8499 |
| | 114-133 | XP_003538544 | 356540131 | 1 | Glycine max | 6763 | 8500 |
| | | XP_003551188 | 356565928 | 0.9097 | Glycine max | 6764 | 8501 |
| | 1068-1087 | XP_003525436 | 356513468 | 1 | Glycine max | 6765 | 8502 |
| | | XP_003550708 | 356564947 | 0.9204 | Glycine max | 6766 | 8503 |
| | | XP_003522278 | 356507037 | 0.7595 | Glycine max | 6767 | 8504 |
| | 999-1018 | XP_003550708 | 356564947 | 1 | Glycine max | 6768 | 8505 |
| | | XP_003525436 | 356513468 | 0.9373 | Glycine max | 6769 | 8506 |
| | 1098-1117 | XP_003520128 | 356502644 | 1 | Glycine max | 6770 | 8507 |
| | | XP_003517860 | 356498034 | 0.9129 | Glycine max | 6771 | 8508 |
| | 179-198 | XP_003523155 | 356508826 | 1 | Glycine max | 6772 | 8509 |
| | 711-730 | XP_003551421 | 356566402 | 1 | Glycine max | 6773 | 8510 |
| | | XP_003518080 | 356498481 | 0.7962 | Glycine max | 6774 | 8511 |
| gma-miR157c | 164-183 | XP_003549130 | 356561725 | 1 | Glycine max | 6775 | 8512 |
| | | XP_003553944 | 356571558 | 0.9452 | Glycine max | 6776 | 8513 |
| | 593-612 | NP_001236309 | 351724988 | 1 | Glycine max | 6777 | 8514 |
| | | XP_003529339 | 356521389 | 0.838 | Glycine max | 6778 | 8515 |
| gma-miR159a-3p | 305-325 | XP_003551790 | 356567161 | 1 | Glycine max | 6779 | 8516 |
| | 305-325 | XP_003541823 | 356546825 | 1 | Glycine max | 6780 | 8517 |
| | 124-144 | XP_003543825 | 356550908 | 1 | Glycine max | 6781 | 8518 |
| | | XP_003556814 | 356577399 | 0.813 | Glycine max | 6782 | 8519 |
| | 405-425 | XP_003542140 | 356547479 | 1 | Glycine max | 6783 | 8520 |
| | | XP_003546908 | 356557204 | 0.8696 | Glycine max | 6784 | 8521 |
| | 305-325 | XP_003541823 | 356546825 | 1 | Glycine max | 6785 | 8522 |
| | 124-144 | XP_003543825 | 356550908 | 1 | Glycine max | 6786 | 8523 |
| | 839-859 | XP_003526354 | 356515330 | 1 | Glycine max | 6787 | 8524 |
| | | XP_003523913 | 356510372 | 0.9333 | Glycine max | 6788 | 8525 |
| | 73-93 | XP_003535315 | 356533526 | 1 | Glycine max | 6789 | 8526 |
| | | XP_003555178 | 356574075 | 0.9462 | Glycine max | 6790 | 8527 |
| | | XP_003591226 | 357441896 | 0.7849 | Medicago truncatula | 6791 | 8528 |
| | | XP_002512536 | 255761086 | 0.7465 | Ricinus communis | 6792 | |
| | | CBI39621 | 270257428 | 0.7465 | Vitis vinifera | 6793 | 8529 |
| | | CAP59645 | 163913883 | 0.7558 | Vitis vinifera | 6794 | 8530 |
| | | XP_002277312 | 225450534 | 0.7496 | Vitis vinifera | 6795 | 8531 |
| | | XP_002280462 | 225432056 | 0.7404 | Vitis vinifera | 6796 | 8532 |
| | | CAP59646 | 163913885 | 0.7512 | Vitis vinifera | 6797 | 8533 |
| | | CAN63178 | 123711273 | 0.7373 | Vitis vinifera | 6798 | 8534 |
| | 614-634 | XP_003541563 | 356546291 | 1 | Glycine max | 6799 | 8535 |
| | | XP_003545791 | 356554924 | 0.805 | Glycine max | 6800 | 8536 |
| | 905-925 | XP_003556814 | 356577399 | 1 | Glycine max | 6801 | 8537 |
| | | XP_003543825 | 356550908 | 0.8659 | Glycine max | 6802 | 8538 |
| | 2016-2036 | XP_003538988 | 356541033 | 1 | Glycine max | 6803 | 8539 |
| | | XP_003607189 | 357473808 | 0.7407 | Medicago truncatula | 6804 | 8540 |
| | | XP_003604038 | 357467506 | 0.7035 | Medicago truncatula | 6805 | 8541 |
| | 926-946 | XP_003545791 | 356554924 | 1 | Glycine max | 6806 | 8542 |
| | | XP_003541563 | 356546291 | 0.8662 | Glycine max | 6807 | 8543 |
| | 842-862 | XP_003523913 | 356510372 | 1 | Glycine max | 6808 | 8544 |
| | | XP_003526354 | 356515330 | 0.9333 | Glycine max | 6809 | 8545 |
| iba-miR157 | 164-184 | XP_003549130 | 356561725 | 1 | Glycine max | 6810 | 8546 |
| | | XP_003553944 | 356571558 | 0.9452 | Glycine max | 6811 | 8547 |
| | 238-258 | XP_003551188 | 356565928 | 1 | Glycine max | 6812 | 8548 |
| | | XP_003538544 | 356540131 | 0.9106 | Glycine max | 6813 | 8549 |
| | | ACU18328 | 255635963 | 0.9083 | Glycine max | 6814 | 8550 |
| | | XP_003601767 | 357462970 | 0.7064 | Medicago truncatula | 6815 | 8551 |
| | 1129-1149 | XP_003525415 | 356513426 | 1 | Glycine max | 6816 | 8552 |
| | | XP_003532399 | 356527605 | 0.9051 | Glycine max | 6817 | 8553 |
| | 898-918 | XP_003540473 | 356544059 | 1 | Glycine max | 6818 | 8554 |
| | | XP_003543233 | 356549706 | 0.9305 | Glycine max | 6819 | 8555 |
| | | ACU24116 | 255647298 | 0.9251 | Glycine max | 6820 | 8556 |
| | 118-138 | XP_003525436 | 356513468 | 1 | Glycine max | 6821 | 8557 |
| | | XP_003550708 | 356564947 | 0.9204 | Glycine max | 6822 | 8558 |
| | | XP_003522278 | 356507037 | 0.7595 | Glycine max | 6823 | 8559 |
| | 77-97 | XP_003520455 | 356503312 | 1 | Glycine max | 6824 | 8560 |
| | | XP_003530170 | 356523079 | 0.848 | Glycine max | 6825 | 8561 |
| | 498-518 | XP_003553428 | 356570509 | 1 | Glycine max | 6826 | 8562 |
| | | XP_003520534 | 356503475 | 0.9081 | Glycine max | 6827 | 8563 |
| | 50-70 | XP_003550708 | 356564947 | 1 | Glycine max | 6828 | 8564 |
| | | XP_003525436 | 356513468 | 0.9373 | Glycine max | 6829 | 8565 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 170-190 | XP_003538544 | 356540131 | 1 | Glycine max | 6830 | 8566 |
| | | XP_003551188 | 356565928 | 0.9097 | Glycine max | 6831 | 8567 |
| | 593-613 | NP_001236309 | 351724988 | 1 | Glycine max | 6832 | 8568 |
| | | XP_003529339 | 356521389 | 0.838 | Glycine max | 6833 | 8569 |
| | 144-164 | XP_002275728 | 225446415 | 1 | Vitis vinifera | 6834 | 8570 |
| | | AAY16440 | 62856978 | 0.7396 | Betula platyphylla | 6835 | 8571 |
| | 112-132 | XP_003522278 | 356507037 | 1 | Glycine max | 6836 | 8572 |
| | 396-416 | XP_003520128 | 356502644 | 1 | Glycine max | 6837 | 8573 |
| | | XP_003517860 | 356498034 | 0.9129 | Glycine max | 6838 | 8574 |
| | 181-201 | XP_003523155 | 356508826 | 1 | Glycine max | 6839 | 8575 |
| | 77-97 | XP_003520455 | 356503312 | 1 | Glycine max | 6840 | 8576 |
| | 373-393 | XP_003553428 | 356570509 | 1 | Glycine max | 6841 | 8577 |
| | 761-781 | XP_003520534 | 356503475 | 1 | Glycine max | 6842 | 8578 |
| | | XP_003553428 | 356570509 | 0.9081 | Glycine max | 6843 | 8579 |
| | 110-130 | XP_003553944 | 356571558 | 1 | Glycine max | 6844 | 8580 |
| | 239-259 | XP_003551188 | 356565928 | 1 | Glycine max | 6845 | 8581 |
| | 1022-1042 | XP_003532399 | 356527605 | 1 | Glycine max | 6846 | 8582 |
| | | XP_003525415 | 356513426 | 0.8914 | Glycine max | 6847 | 8583 |
| | 593-613 | NP_001236309 | 351724988 | 1 | Glycine max | 6848 | 8584 |
| | 116-136 | ACU18105 | 255635506 | 1 | Glycine max | 6849 | 8585 |
| | 758-778 | XP_003518080 | 356498481 | 1 | Glycine max | 6850 | 8586 |
| | | XP_003551421 | 356566402 | 0.8408 | Glycine max | 6851 | 8587 |
| | 120-140 | XP_003549130 | 356561725 | 1 | Glycine max | 6852 | 8588 |
| | 693-713 | XP_003525415 | 356513426 | 1 | Glycine max | 6853 | 8589 |
| | 656-676 | XP_003517558 | 356497418 | 1 | Glycine max | 6854 | 8590 |
| | | XP_003537666 | 356538348 | 0.9182 | Glycine max | 6855 | 8591 |
| | | XP_003539001 | 356541059 | 0.7453 | Glycine max | 6856 | 8592 |
| | | XP_003540042 | 356543182 | 0.7421 | Glycine max | 6857 | 8593 |
| | 116-136 | XP_003538544 | 356540131 | 1 | Glycine max | 6858 | 8594 |
| | 1070-1090 | XP_003525436 | 356513468 | 1 | Glycine max | 6859 | 8595 |
| | 404-424 | XP_003526029 | 356514674 | 1 | Glycine max | 6860 | 8596 |
| | | XP_003540122 | 356543345 | 0.8919 | Glycine max | 6861 | 8597 |
| | 1100-1120 | XP_003520128 | 356502644 | 1 | Glycine max | 6862 | 8598 |
| | 1001-1021 | XP_003550708 | 356564947 | 1 | Glycine max | 6863 | 8599 |
| | 243-263 | XP_003540122 | 356543345 | 1 | Glycine max | 6864 | 8600 |
| | | XP_003526029 | 356514674 | 0.8684 | Glycine max | 6865 | 8601 |
| | 555-575 | XP_003524444 | 356511459 | 1 | Glycine max | 6866 | 8602 |
| | | XP_003533073 | 356528975 | 0.7951 | Glycine max | 6867 | 8603 |
| | 181-201 | XP_003523155 | 356508826 | 1 | Glycine max | 6868 | 8604 |
| | 713-733 | XP_003551421 | 356566402 | 1 | Glycine max | 6869 | 8605 |
| | | XP_003518080 | 356498481 | 0.7962 | Glycine max | 6870 | 8606 |
| mdm-miR482a-5p | 517-537 | XP_003528897 | 356520494 | 1 | Glycine max | 6871 | 8607 |
| | | ACU19201 | 255637757 | 0.988 | Glycine max | 6872 | 8608 |
| | | XP_003529981 | 356522693 | 0.7784 | Glycine max | 6873 | 8609 |
| | | XP_003521936 | 356506325 | 0.7695 | Glycine max | 6874 | 8610 |
| | 626-646 | XP_003554327 | 356572340 | 1 | Glycine max | 6875 | 8611 |
| | | XP_003521338 | 356505115 | 0.984 | Glycine max | 6876 | 8612 |
| | | XP_003554326 | 356572338 | 1 | Glycine max | 6877 | 8613 |
| | | XP_003521337 | 356505113 | 0.984 | Glycine max | 6878 | 8614 |
| | | AES81717 | 357510420 | 0.869 | Medicago truncatula | 6879 | 8615 |
| | | ACJ84304 | 217071887 | 0.8658 | Medicago truncatula | 6880 | 8616 |
| | | ABN05708 | 46063642 | 0.8594 | Medicago truncatula | 6881 | 8617 |
| | | AES84650 | 339649035 | 0.8339 | Medicago truncatula | 6882 | 8618 |
| | | XP_003542462 | 356548141 | 0.8115 | Glycine max | 6883 | 8619 |
| | | XP_003542461 | 356548139 | 0.8115 | Glycine max | 6884 | 8620 |
| | 204-224 | XP_003625987 | 357511396 | 1 | Medicago truncatula | 6885 | 8621 |
| | | AES82205 | 357511396 | 1 | Medicago truncatula | 6886 | 8622 |
| | | XP_003520757 | 356503939 | 0.8043 | Glycine max | 6887 | 8623 |
| | | XP_003554555 | 356572802 | 0.802 | Glycine max | 6888 | 8624 |
| | 175-195 | XP_003554555 | 356572802 | 1 | Glycine max | 6889 | 8625 |
| | | XP_002271147 | 225437597 | 0.7397 | Vitis vinifera | 6890 | 8626 |
| | | XP_002515261 | 255761086 | 0.7188 | Ricinus communis | 6891 | |
| | 716-736 | XP_003539613 | 356542313 | 1 | Glycine max | 6892 | 8627 |
| | | XP_003543221 | 356549682 | 0.8767 | Glycine max | 6893 | 8628 |
| | 778-798 | XP_003625499 | 357510420 | 1 | Medicago truncatula | 6894 | 8629 |
| | | XP_003554327 | 356572340 | 0.8395 | Glycine max | 6895 | 8630 |
| | | XP_003537175 | 356537316 | 0.8056 | Glycine max | 6896 | 8631 |
| osa-miR159e | 500-520 | XP_003541668 | 356546507 | 1 | Glycine max | 6897 | 8632 |
| | | XP_003547199 | 356557800 | 0.8383 | Glycine max | 6898 | 8633 |
| | 495-515 | XP_003524148 | 356510852 | 1 | Glycine max | 6899 | 8634 |
| | | XP_003531162 | 356525093 | 0.7762 | Glycine max | 6900 | 8635 |
| | 26-46 | XP_003547199 | 356557800 | 1 | Glycine max | 6901 | 8636 |
| | 124-144 | XP_003543825 | 356550908 | 1 | Glycine max | 6902 | 8637 |
| | | XP_003556814 | 356577399 | 0.813 | Glycine max | 6903 | 8638 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 817-837 | XP_003525997 | 356514606 | 1 | *Glycine max* | 6904 | 8639 |
| | | XP_003540066 | 356543230 | 0.8441 | *Glycine max* | 6905 | 8640 |
| | 289-309 | XP_003518627 | 356499601 | 1 | *Glycine max* | 6906 | 8641 |
| | | XP_003542153 | 356547506 | 0.9478 | *Glycine max* | 6907 | 8642 |
| | | ADN33938 | 307136081 | 0.7937 | *Cucumis melo* subsp. *melo* | 6908 | 8643 |
| | | XP_002518919 | 255761086 | 0.7755 | *Ricinus communis* | 6909 | |
| | | XP_002279642 | 225426567 | 0.7755 | *Vitis vinifera* | 6910 | 8644 |
| | | XP_002870592 | 297853636 | 0.7664 | *Arabidopsis lyrata* subsp. *lyrata* | 6911 | |
| | | NP_199024 | 30693991 | 0.7642 | *Arabidopsis thaliana* | 6912 | 8645 |
| | | AAM63843 | 21405504 | 0.7596 | *Arabidopsis thaliana* | 6913 | 8646 |
| | | XP_002299422 | 255761085 | 0.7528 | *Populus trichocarpa* | 6914 | |
| | | XP_002303695 | 255761085 | 0.7574 | *Populus trichocarpa* | 6915 | |
| | 124-144 | XP_003543825 | 356550908 | 1 | *Glycine max* | 6916 | 8647 |
| | 461-481 | XP_003542153 | 356547506 | 1 | *Glycine max* | 6917 | 8648 |
| | | XP_003518627 | 356499601 | 0.9436 | *Glycine max* | 6918 | 8649 |
| | 1162-1182 | XP_003531162 | 356525093 | 1 | *Glycine max* | 6919 | 8650 |
| | | XP_003524148 | 356510852 | 0.7692 | *Glycine max* | 6920 | 8651 |
| | 839-859 | XP_003526354 | 356515330 | 1 | *Glycine max* | 6921 | 8652 |
| | | XP_003523913 | 356510372 | 0.9333 | *Glycine max* | 6922 | 8653 |
| | 495-515 | XP_003524148 | 356510852 | 1 | *Glycine max* | 6923 | 8654 |
| | 949-969 | XP_003547199 | 356557800 | 1 | *Glycine max* | 6924 | 8655 |
| | 614-634 | XP_003541563 | 356546291 | 1 | *Glycine max* | 6925 | 8656 |
| | | XP_003545791 | 356554924 | 0.805 | *Glycine max* | 6926 | 8657 |
| | 905-925 | XP_003556814 | 356577399 | 1 | *Glycine max* | 6927 | 8658 |
| | | XP_003543825 | 356550908 | 0.8659 | *Glycine max* | 6928 | 8659 |
| | 2016-2036 | XP_003538988 | 356541033 | 1 | *Glycine max* | 6929 | 8660 |
| | | XP_003607189 | 357473808 | 0.7407 | *Medicago truncatula* | 6930 | 8661 |
| | | XP_003604038 | 357467506 | 0.7035 | *Medicago truncatula* | 6931 | 8662 |
| | 1330-1350 | XP_003541668 | 356546507 | 1 | *Glycine max* | 6932 | 8663 |
| | 842-862 | XP_003523913 | 356510372 | 1 | *Glycine max* | 6933 | 8664 |
| | | XP_003526354 | 356515330 | 0.9333 | *Glycine max* | 6934 | 8665 |
| | 926-946 | XP_003545791 | 356554924 | 1 | *Glycine max* | 6935 | 8666 |
| | | XP_003541563 | 356546291 | 0.8662 | *Glycine max* | 6936 | 8667 |
| osa-miR159f | 124-144 | XP_003543825 | 356550908 | 1 | *Glycine max* | 6937 | 8668 |
| | | XP_003556814 | 356577399 | 0.813 | *Glycine max* | 6938 | 8669 |
| | 305-325 | XP_003541823 | 356546825 | 1 | *Glycine max* | 6939 | 8670 |
| | 124-144 | XP_003543825 | 356550908 | 1 | *Glycine max* | 6940 | 8671 |
| | 839-859 | XP_003526354 | 356515330 | 1 | *Glycine max* | 6941 | 8672 |
| | | XP_003523913 | 356510372 | 0.9333 | *Glycine max* | 6942 | 8673 |
| | 614-634 | XP_003541563 | 356546291 | 1 | *Glycine max* | 6943 | 8674 |
| | | XP_003545791 | 356554924 | 0.805 | *Glycine max* | 6944 | 8675 |
| | 905-925 | XP_003556814 | 356577399 | 1 | *Glycine max* | 6945 | 8676 |
| | 2016-2036 | XP_003538988 | 356541033 | 1 | *Glycine max* | 6946 | 8677 |
| | | XP_003607189 | 357473808 | 0.7407 | *Medicago truncatula* | 6947 | 8678 |
| | | XP_003604038 | 357467506 | 0.7035 | *Medicago truncatula* | 6948 | 8679 |
| | 842-862 | XP_003523913 | 356510372 | 1 | *Glycine max* | 6949 | 8680 |
| | | XP_003526354 | 356515330 | 0.9333 | *Glycine max* | 6950 | 8681 |
| | 926-946 | XP_003545791 | 356554924 | 1 | *Glycine max* | 6951 | 8682 |
| | | XP_003541563 | 356546291 | 0.8662 | *Glycine max* | 6952 | 8683 |
| osa-miR1850.1 | 796-816 | ABC49719 | 84028520 | 1 | *Arachis hypogaea* | 6953 | 8684 |
| | | NP_001236448 | 351734389 | 0.9568 | *Glycine max* | 6954 | 8685 |
| | | XP_003535034 | 356532953 | 0.9496 | *Glycine max* | 6955 | 8686 |
| | | XP_003594440 | 357448328 | 0.8993 | *Medicago truncatula* | 6956 | 8687 |
| | | ACJ84098 | 217071475 | 0.8921 | *Medicago truncatula* | 6957 | 8688 |
| | | XP_003629907 | 357519236 | 0.8705 | *Medicago truncatula* | 6958 | 8689 |
| | | ABD63906 | 89212811 | 0.8921 | *Gossypium hirsutum* | 6959 | 8690 |
| | | ABD66505 | 89276296 | 0.8849 | *Gossypium hirsutum* | 6960 | 8691 |
| | | ADN34239 | 307136431 | 0.8633 | *Cucumis melo* subsp. *melo* | 6961 | 8692 |
| | | ABD66508 | 89276302 | 0.8849 | *Gossypium hirsutum* | 6962 | 8693 |
| | 746-766 | XP_003535034 | 356532953 | 1 | *Glycine max* | 6963 | 8694 |
| | | CAJ38384 | 106879600 | 0.8849 | *Plantago major* | 6964 | 8695 |
| | | XP_002299887 | 255761085 | 0.9065 | *Populus trichocarpa* | 6965 | |
| | 17-37 | XP_003534041 | 356530948 | 1 | *Glycine max* | 6966 | 8696 |
| | 117-137 | XP_003524950 | 356512486 | 1 | *Glycine max* | 6967 | 8697 |
| | 243-263 | XP_003548988 | 356561437 | 1 | *Glycine max* | 6968 | 8698 |
| | | XP_003548995 | 356561451 | 0.7944 | *Glycine max* | 6969 | 8699 |
| | | XP_003548992 | 356561445 | 0.728 | *Glycine max* | 6970 | 8700 |
| | | XP_003548994 | 356561449 | 0.7846 | *Glycine max* | 6971 | 8701 |
| | | XP_003548993 | 356561447 | 0.921 | *Glycine max* | 6972 | 8702 |
| | | XP_003548986 | 356561433 | 0.8079 | *Glycine max* | 6973 | 8703 |
| | | XP_003548991 | 356561443 | 0.807 | *Glycine max* | 6974 | 8704 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_003617757 | 357494936 | 0.8241 | *Medicago truncatula* | 6975 | 8705 |
| | | XP_003616414 | 357492250 | 0.7971 | *Medicago truncatula* | 6976 | 8706 |
| | 53-73 | XP_003552127 | 356567847 | 1 | *Glycine max* | 6977 | 8707 |
| | | XP_003532277 | 356527355 | 0.9545 | *Glycine max* | 6978 | 8708 |
| | | ADB79567 | 284156655 | 0.7995 | *Arachis hypogaea* | 6979 | 8709 |
| | | XP_002262721 | 225470104 | 0.7433 | *Vitis vinifera* | 6980 | 8710 |
| | | ABX82799 | 296916970 | 0.7219 | *Jatropha curcas* | 6981 | 8711 |
| | | XP_002532744 | 255761086 | 0.7166 | *Ricinus communis* | 6982 | |
| | | XP_002863277 | 297853636 | 0.7112 | *Arabidopsis lyrata* subsp. *lyrata* | 6983 | |
| | | AAC49002 | 595956 | 0.7059 | *Brassica rapa* | 6984 | 8712 |
| | 141-161 | XP_003555849 | 356575439 | 1 | *Glycine max* | 6985 | 8713 |
| | | XP_003592693 | 357444830 | 0.8289 | *Medicago truncatula* | 6986 | 8714 |
| | | XP_002529805 | 255761086 | 0.7425 | *Ricinus communis* | 6987 | |
| | | XP_002306206 | 255761085 | 0.7331 | *Populus trichocarpa* | 6988 | |
| | | XP_002264823 | 225467465 | 0.7221 | *Vitis vinifera* | 6989 | 8715 |
| | | XP_002278507 | 225428128 | 0.719 | *Vitis vinifera* | 6990 | 8716 |
| | | XP_002312937 | 255761085 | 0.7159 | *Populus trichocarpa* | 6991 | |
| | 2940-2960 | XP_003550417 | 356564348 | 1 | *Glycine max* | 6992 | 8717 |
| | | XP_003523561 | 356509653 | 0.7407 | *Glycine max* | 6993 | 8718 |
| | | XP_003523562 | 356509655 | 0.7323 | *Glycine max* | 6994 | 8719 |
| osa-miR1858a | 90-110 | XP_003520359 | 356503118 | 1 | *Glycine max* | 6995 | 8720 |
| | | XP_003547751 | 356558921 | 0.94 | *Glycine max* | 6996 | 8721 |
| | | AES83637 | 339648991 | 0.7389 | *Medicago truncatula* | 6997 | |
| | | XP_003522288 | 356507057 | 0.7176 | *Glycine max* | 6998 | 8722 |
| | | XP_003604071 | 357467572 | 0.706 | *Medicago truncatula* | 6999 | 8723 |
| | 24-44 | XP_003553781 | 356571227 | 1 | *Glycine max* | 7000 | 8724 |
| | | NP_001235053 | 351725668 | 0.8396 | *Glycine max* | 7001 | 8725 |
| | | BAF49302 | 133874197 | 0.7167 | *Clitoria ternatea* | 7002 | 8726 |
| | 364-384 | XP_003554024 | 356571724 | 1 | *Glycine max* | 7003 | 8727 |
| | | XP_003554025 | 356571726 | 0.9937 | *Glycine max* | 7004 | 8728 |
| | | XP_003548728 | 356560906 | 0.9669 | *Glycine max* | 7005 | 8729 |
| | | XP_003624635 | 357508692 | 0.8873 | *Medicago truncatula* | 7006 | 8730 |
| | | XP_002285720 | 225435753 | 0.8202 | *Vitis vinifera* | 7007 | 8731 |
| | | XP_002281591 | 225441588 | 0.8229 | *Vitis vinifera* | 7008 | 8732 |
| | | XP_003531251 | 356525273 | 0.8157 | *Glycine max* | 7009 | 8733 |
| | | XP_002304857 | 255761085 | 0.797 | *Populus trichocarpa* | 7010 | |
| | | XP_002299105 | 255761085 | 0.7898 | *Populus trichocarpa* | 7011 | |
| | | XP_003629733 | 357518888 | 0.7987 | *Medicago truncatula* | 7012 | 8734 |
| | 345-365 | XP_003548728 | 356560906 | 1 | *Glycine max* | 7013 | 8735 |
| | | XP_003554024 | 356571724 | 0.9704 | *Glycine max* | 7014 | 8736 |
| | 24-44 | XP_003553781 | 356571227 | 1 | *Glycine max* | 7015 | 8737 |
| | 56-76 | XP_003521247 | 356504932 | 1 | *Glycine max* | 7016 | 8738 |
| | | XP_003554255 | 356572193 | 0.9395 | *Glycine max* | 7017 | 8739 |
| | | XP_002520726 | 255761086 | 0.7893 | *Ricinus communis* | 7018 | |
| | | XP_002278267 | 225437025 | 0.8136 | *Vitis vinifera* | 7019 | 8740 |
| | | XP_002307588 | 255761085 | 0.7966 | *Populus trichocarpa* | 7020 | |
| | | XP_002892149 | 297853636 | 0.7215 | *Arabidopsis lyrata* subsp. *lyrata* | 7021 | |
| | | NP_563676 | 30678481 | 0.7361 | *Arabidopsis thaliana* | 7022 | 8741 |
| | 360-380 | NP_001237118 | 351726189 | 1 | *Glycine max* | 7023 | 8742 |
| | | XP_003556230 | 356576216 | 0.9243 | *Glycine max* | 7024 | 8743 |
| | | XP_002529571 | 255761086 | 0.7775 | *Ricinus communis* | 7025 | |
| | | XP_002315301 | 255761085 | 0.7706 | *Populus trichocarpa* | 7026 | |
| | | XP_002275232 | 225449067 | 0.7752 | *Vitis vinifera* | 7027 | 8744 |
| | | XP_002312018 | 255761085 | 0.7569 | *Populus trichocarpa* | 7028 | |
| | | ACM45079 | 222136858 | 0.7729 | *Vitis vinifera* | 7029 | 8745 |
| | | XP_002894135 | 297853636 | 0.7729 | *Arabidopsis lyrata* subsp. *lyrata* | 7030 | |
| | | ABA54870 | 76782199 | 0.7638 | *Fagus sylvatica* | 7031 | 8746 |
| | | CAN73646 | 123693264 | 0.7706 | *Vitis vinifera* | 7032 | |
| | 277-297 | XP_003591923 | 357443290 | 1 | *Medicago truncatula* | 7033 | 8747 |
| | 180-200 | XP_003524517 | 356511610 | 1 | *Glycine max* | 7034 | 8748 |
| | | XP_003549799 | 356563090 | 0.9173 | *Glycine max* | 7035 | 8749 |
| | 564-584 | NP_001235053 | 351725668 | 1 | *Glycine max* | 7036 | 8750 |
| | | XP_003553781 | 356571227 | 0.8319 | *Glycine max* | 7037 | 8751 |
| | | XP_003626556 | 357512534 | 0.7059 | *Medicago truncatula* | 7038 | 8752 |
| | | ACJ85806 | 217074891 | 0.7017 | *Medicago truncatula* | 7039 | 8753 |
| | 369-389 | XP_003530234 | 356523208 | 1 | *Glycine max* | 7040 | 8754 |
| | | XP_003551508 | 356566578 | 0.9298 | *Glycine max* | 7041 | 8755 |
| | 188-208 | XP_002529571 | 255761086 | 1 | *Ricinus communis* | 7042 | |
| | | NP_564534 | 145336530 | 0.8046 | *Arabidopsis thaliana* | 7043 | 8756 |
| | | AAG50662 | 12321108 | 0.8023 | *Arabidopsis thaliana* | 7044 | 8757 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 378-398 | XP_003551508 | 356566578 | 1 | Glycine max | 7045 | 8758 |
| | | XP_003530234 | 356523208 | 0.8745 | Glycine max | 7046 | 8759 |
| | 231-251 | XP_003528545 | 356519775 | 1 | Glycine max | 7047 | 8760 |
| | | XP_003556667 | 356577102 | 0.9204 | Glycine max | 7048 | 8761 |
| | | XP_003607899 | 357475226 | 0.7898 | Medicago truncatula | 7049 | 8762 |
| | 156-176 | XP_003547641 | 356558699 | 1 | Glycine max | 7050 | 8763 |
| | | XP_003548802 | 356561057 | 0.9768 | Glycine max | 7051 | 8764 |
| | 141-161 | XP_003543554 | 356550357 | 1 | Glycine max | 7052 | 8765 |
| | | XP_003554155 | 356571993 | 0.932 | Glycine max | 7053 | 8766 |
| | 180-200 | XP_003549799 | 356563090 | 1 | Glycine max | 7054 | 8767 |
| | | XP_003524517 | 356511610 | 0.9176 | Glycine max | 7055 | 8768 |
| | 192-212 | XP_003531267 | 356525308 | 1 | Glycine max | 7056 | 8769 |
| | | XP_003624841 | 357509104 | 0.7936 | Medicago truncatula | 7057 | 8770 |
| | | XP_003522101 | 356506673 | 0.7277 | Glycine max | 7058 | 8771 |
| | 132-152 | XP_003556667 | 356577102 | 1 | Glycine max | 7059 | 8772 |
| | | XP_003528545 | 356519775 | 0.9129 | Glycine max | 7060 | 8773 |
| psi-miR159 | 124-144 | XP_003543825 | 356550908 | 1 | Glycine max | 7061 | 8774 |
| | | XP_003556814 | 356577399 | 0.813 | Glycine max | 7062 | 8775 |
| | 289-309 | XP_003518627 | 356499601 | 1 | Glycine max | 7063 | 8776 |
| | | XP_003542153 | 356547506 | 0.9478 | Glycine max | 7064 | 8777 |
| | | ADN33938 | 307136081 | 0.7937 | Cucumis melo subsp. melo | 7065 | 8778 |
| | | XP_002518919 | 255761086 | 0.7755 | Ricinus communis | 7066 | |
| | | XP_002279642 | 225426567 | 0.7755 | Vitis vinifera | 7067 | 8779 |
| | | XP_002870592 | 297853636 | 0.7664 | Arabidopsis lyrata subsp. lyrata | 7068 | |
| | | NP_199024 | 30693991 | 0.7642 | Arabidopsis thaliana | 7069 | 8780 |
| | | AAM63843 | 21405504 | 0.7596 | Arabidopsis thaliana | 7070 | 8781 |
| | | XP_002299422 | 255761085 | 0.7528 | Populus trichocarpa | 7071 | |
| | | XP_002303695 | 255761085 | 0.7574 | Populus trichocarpa | 7072 | |
| | 124-144 | XP_003543825 | 356550908 | 1 | Glycine max | 7073 | 8782 |
| | 461-481 | XP_003542153 | 356547506 | 1 | Glycine max | 7074 | 8783 |
| | | XP_003518627 | 356499601 | 0.9436 | Glycine max | 7075 | 8784 |
| | 839-859 | XP_003526354 | 356515330 | 1 | Glycine max | 7076 | 8785 |
| | | XP_003523913 | 356510372 | 0.9333 | Glycine max | 7077 | 8786 |
| | 614-634 | XP_003541563 | 356546291 | 1 | Glycine max | 7078 | 8787 |
| | | XP_003545791 | 356554924 | 0.805 | Glycine max | 7079 | 8788 |
| | 905-925 | XP_003556814 | 356577399 | 1 | Glycine max | 7080 | 8789 |
| | 19-39 | NP_001236539 | 351724240 | 1 | Glycine max | 7081 | 8790 |
| | | NP_001237767 | 351722762 | 0.9915 | Glycine max | 7082 | 8791 |
| | | NP_001237736 | 351721871 | 0.7778 | Glycine max | 7083 | 8792 |
| | | BAF50740 | 139005586 | 0.7436 | Apios americana | 7084 | 8793 |
| | | XP_003623947 | 357507316 | 0.7094 | Medicago truncatula | 7085 | 8794 |
| | 2016-2036 | XP_003538988 | 356541033 | 1 | Glycine max | 7086 | 8795 |
| | | XP_003607189 | 357473808 | 0.7407 | Medicago truncatula | 7087 | 8796 |
| | | XP_003604038 | 357467506 | 0.7035 | Medicago truncatula | 7088 | 8797 |
| | 926-946 | XP_003545791 | 356554924 | 1 | Glycine max | 7089 | 8798 |
| | | XP_003541563 | 356546291 | 0.8662 | Glycine max | 7090 | 8799 |
| | 842-862 | XP_003523913 | 356510372 | 1 | Glycine max | 7091 | 8800 |
| | | XP_003526354 | 356515330 | 0.9333 | Glycine max | 7092 | 8801 |
| pta-miR156a | 161-180 | XP_003549130 | 356561725 | 1 | Glycine max | 7093 | 8802 |
| | | XP_003553944 | 356571558 | 0.9452 | Glycine max | 7094 | 8803 |
| | 106-125 | XP_003520455 | 356503312 | 1 | Glycine max | 7095 | 8804 |
| | | XP_003530170 | 356523079 | 0.848 | Glycine max | 7096 | 8805 |
| | 115-134 | XP_003525436 | 356513468 | 1 | Glycine max | 7097 | 8806 |
| | | XP_003550708 | 356564947 | 0.9204 | Glycine max | 7098 | 8807 |
| | | XP_003522278 | 356507037 | 0.7595 | Glycine max | 7099 | 8808 |
| | 47-66 | XP_003550708 | 356564947 | 1 | Glycine max | 7100 | 8809 |
| | | XP_003525436 | 356513468 | 0.9373 | Glycine max | 7101 | 8810 |
| | 495-514 | XP_003553428 | 356570509 | 1 | Glycine max | 7102 | 8811 |
| | | XP_003520534 | 356503475 | 0.9081 | Glycine max | 7103 | 8812 |
| | 303-322 | XP_003530747 | 356524258 | 1 | Glycine max | 7104 | |
| | | XP_003553084 | 356569799 | 0.9116 | Glycine max | 7105 | |
| | 393-412 | XP_003520128 | 356502644 | 1 | Glycine max | 7106 | 8813 |
| | | XP_003517860 | 356498034 | 0.9129 | Glycine max | 7107 | 8814 |
| | 109-128 | XP_003522278 | 356507037 | 1 | Glycine max | 7108 | 8815 |
| | 178-197 | XP_003523155 | 356508826 | 1 | Glycine max | 7109 | 8816 |
| | 755-774 | XP_003518080 | 356498481 | 1 | Glycine max | 7110 | 8817 |
| | | XP_003551421 | 356566402 | 0.8408 | Glycine max | 7111 | 8818 |
| | 117-136 | XP_003549130 | 356561725 | 1 | Glycine max | 7112 | 8819 |
| | 734-753 | XP_003553428 | 356570509 | 1 | Glycine max | 7113 | 8820 |
| | 815-834 | XP_003553944 | 356571558 | 1 | Glycine max | 7114 | 8821 |
| | 121-140 | ACU18105 | 255635506 | 1 | Glycine max | 7115 | 8822 |
| | 1067-1086 | XP_003525436 | 356513468 | 1 | Glycine max | 7116 | 8823 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 106-125 | XP_003520455 | 356503312 | 1 | *Glycine max* | 7117 | 8824 |
| | 1097-1116 | XP_003520128 | 356502644 | 1 | *Glycine max* | 7118 | 8825 |
| | 998-1017 | XP_003550708 | 356564947 | 1 | *Glycine max* | 7119 | 8826 |
| | 178-197 | XP_003523155 | 356508826 | 1 | *Glycine max* | 7120 | 8827 |
| | 590-609 | NP_001236309 | 351724988 | 1 | *Glycine max* | 7121 | 8828 |
| | | XP_003529339 | 356521389 | 0.838 | *Glycine max* | 7122 | 8829 |
| | 710-729 | XP_003551421 | 356566402 | 1 | *Glycine max* | 7123 | 8830 |
| | | XP_003518080 | 356498481 | 0.7962 | *Glycine max* | 7124 | 8831 |
| pta-miR156b | 161-180 | XP_003549130 | 356561725 | 1 | *Glycine max* | 7125 | 8832 |
| | | XP_003553944 | 356571558 | 0.9452 | *Glycine max* | 7126 | 8833 |
| | 320-339 | XP_003531511 | 356525799 | 1 | *Glycine max* | 7127 | 8834 |
| | | XP_003546792 | 356556969 | 0.7324 | *Glycine max* | 7128 | 8835 |
| | 115-134 | XP_003525436 | 356513468 | 1 | *Glycine max* | 7129 | 8836 |
| | | XP_003550708 | 356564947 | 0.9204 | *Glycine max* | 7130 | 8837 |
| | | XP_003522278 | 356507037 | 0.7595 | *Glycine max* | 7131 | 8838 |
| | 106-125 | XP_003520455 | 356503312 | 1 | *Glycine max* | 7132 | 8839 |
| | | XP_003530170 | 356523079 | 0.848 | *Glycine max* | 7133 | 8840 |
| | 47-66 | XP_003550708 | 356564947 | 1 | *Glycine max* | 7134 | 8841 |
| | | XP_003525436 | 356513468 | 0.9373 | *Glycine max* | 7135 | 8842 |
| | 495-514 | XP_003553428 | 356570509 | 1 | *Glycine max* | 7136 | 8843 |
| | | XP_003520534 | 356503475 | 0.9081 | *Glycine max* | 7137 | 8844 |
| | 396-415 | ABW03160 | 157922334 | 1 | *Pisum sativum* | 7138 | 8845 |
| | | XP_003546545 | 356556463 | 0.9946 | lipoamide | 7139 | 8846 |
| | | ACU19644 | 255638677 | 0.9919 | *Glycine max* | 7140 | 8847 |
| | | XP_003533815 | 356530492 | 0.9621 | lipoamide | 7141 | 8848 |
| | | CAG14980 | 45720177 | 0.8916 | *Cicer arietinum* | 7142 | 8849 |
| | | ABW03161 | 157922336 | 0.8862 | *Pisum sativum* | 7143 | 8850 |
| | | XP_003595440 | 357450326 | 0.878 | *Medicago truncatula* | 7144 | 8851 |
| | | XP_002314330 | 255761085 | 0.8699 | *Populus trichocarpa* | 7145 | |
| | | XP_003621874 | 357503170 | 0.8564 | *Medicago truncatula* | 7146 | 8852 |
| | | XP_002267959 | 225432170 | 0.8618 | *Vitis vinifera* | 7147 | 8853 |
| | 1563-1582 | XP_002526256 | 255761086 | 1 | *Ricinus communis* | 7148 | |
| | | XP_002318437 | 255761085 | 0.9495 | *Populus trichocarpa* | 7149 | |
| | | XP_002276600 | 225455335 | 0.946 | *Vitis vinifera* | 7150 | 8854 |
| | | CBI23029 | 270234399 | 0.946 | *Vitis vinifera* | 7151 | 8855 |
| | | XP_002515853 | 255761086 | 0.9414 | *Ricinus communis* | 7152 | |
| | | XP_003530452 | 356523654 | 0.8886 | *Glycine max* | 7153 | 8856 |
| | | XP_003525330 | 356513256 | 0.884 | *Glycine max* | 7154 | 8857 |
| | | XP_002864245 | 297853636 | 0.8794 | *Arabidopsis lyrata* subsp. *lyrata* | 7155 | |
| | | NP_200160 | 42568511 | 0.876 | *Arabidopsis thaliana* | 7156 | 8858 |
| | | BAJ93177 | 326526000 | 0.8324 | *Hordeum vulgare* subsp. *vulgare* | 7157 | 8859 |
| | 393-412 | XP_003520128 | 356502644 | 1 | *Glycine max* | 7158 | 8860 |
| | | XP_003517860 | 356498034 | 0.9129 | *Glycine max* | 7159 | 8861 |
| | 109-128 | XP_003522278 | 356507037 | 1 | *Glycine max* | 7160 | 8862 |
| | 178-197 | XP_003523155 | 356508826 | 1 | *Glycine max* | 7161 | 8863 |
| | 203-222 | XP_003551276 | 356566105 | 1 | *Glycine max* | 7162 | 8864 |
| | | XP_003538548 | 356540139 | 0.9368 | *Glycine max* | 7163 | 8865 |
| | | XP_003601783 | 357463002 | 0.8103 | *Medicago truncatula* | 7164 | 8866 |
| | | XP_003524894 | 356512372 | 0.7615 | *Glycine max* | 7165 | 8867 |
| | | XP_003531195 | 356525159 | 0.7759 | *Glycine max* | 7166 | 8868 |
| | | XP_002514915 | 255761086 | 0.7557 | *Ricinus communis* | 7167 | |
| | | XP_002297844 | 255761085 | 0.7471 | *Populus trichocarpa* | 7168 | |
| | | XP_002304680 | 255761085 | 0.7414 | *Populus trichocarpa* | 7169 | |
| | | XP_002271442 | 225425417 | 0.7098 | *Vitis vinifera* | 7170 | 8869 |
| | 74-93 | XP_003520455 | 356503312 | 1 | *Glycine max* | 7171 | 8870 |
| | 370-389 | XP_003553428 | 356570509 | 1 | *Glycine max* | 7172 | 8871 |
| | 758-777 | XP_003520534 | 356503475 | 1 | *Glycine max* | 7173 | 8872 |
| | | XP_003553428 | 356570509 | 0.9081 | *Glycine max* | 7174 | 8873 |
| | 107-126 | XP_003553944 | 356571558 | 1 | *Glycine max* | 7175 | 8874 |
| | 35-54 | AAM12880 | 20149261 | 1 | *Helianthus annuus* | 7176 | 8875 |
| | | CBI28152 | 270240501 | 0.991 | *Vitis vinifera* | 7177 | |
| | | XP_002284967 | 225430201 | 0.991 | *Vitis vinifera* | 7178 | 8876 |
| | | CBI21000 | 270231236 | 0.991 | *Vitis vinifera* | 7179 | |
| | | CBI36254 | 270253379 | 0.9819 | *Vitis vinifera* | 7180 | 8877 |
| | | NP_200330 | 145359269 | 0.9864 | *Arabidopsis thaliana* | 7181 | 8878 |
| | | XP_003522628 | 356507751 | 0.9819 | *Glycine max* | 7182 | 8879 |
| | | AEM97804 | 344189954 | 0.9864 | *Dimocarpus longan* | 7183 | 8880 |
| | | XP_002864382 | 297853636 | 0.9864 | *Arabidopsis lyrata* subsp. *lyrata* | 7184 | |
| | | XP_002285307 | 225442824 | 0.9819 | *Vitis vinifera* | 7185 | 8881 |
| | 1019-1038 | XP_003532399 | 356527605 | 1 | *Glycine max* | 7186 | 8882 |
| | | XP_003525415 | 356513426 | 0.8914 | *Glycine max* | 7187 | 8883 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 113-132 | ACU18105 | 255635506 | 1 | Glycine max | 7188 | 8884 |
| | 755-774 | XP_003518080 | 356498481 | 1 | Glycine max | 7189 | 8885 |
| | | XP_003551421 | 356566402 | 0.8408 | Glycine max | 7190 | 8886 |
| | 117-136 | XP_003549130 | 356561725 | 1 | Glycine max | 7191 | 8887 |
| | 690-709 | XP_003525415 | 356513426 | 1 | Glycine max | 7192 | 8888 |
| | | XP_003532399 | 356527605 | 0.9051 | Glycine max | 7193 | 8889 |
| | 1067-1086 | XP_003525436 | 356513468 | 1 | Glycine max | 7194 | 8890 |
| | 1097-1116 | XP_003520128 | 356502644 | 1 | Glycine max | 7195 | 8891 |
| | 998-1017 | XP_003550708 | 356564947 | 1 | Glycine max | 7196 | 8892 |
| | 178-197 | XP_003523155 | 356508826 | 1 | Glycine max | 7197 | 8893 |
| | 467-486 | XP_003610314 | 357480056 | 1 | Medicago truncatula | 7198 | 8894 |
| | | XP_003549541 | 356562566 | 0.8796 | Glycine max | 7199 | 8895 |
| | | XP_003519149 | 356500658 | 0.8728 | Glycine max | 7200 | 8896 |
| | | XP_003540100 | 356543299 | 0.8605 | Glycine max | 7201 | 8897 |
| | | XP_002278464 | 225445858 | 0.8098 | Vitis vinifera | 7202 | 8898 |
| | | XP_002529385 | 255761086 | 0.8167 | Ricinus communis | 7203 | |
| | | XP_002325129 | 255761085 | 0.7852 | Populus trichocarpa | 7204 | |
| | | NP_851209 | 42570605 | 0.762 | Arabidopsis thaliana | 7205 | 8899 |
| | | XP_002864540 | 297853636 | 0.7579 | Arabidopsis lyrata subsp. lyrata | 7206 | |
| | | NP_974953 | 42573713 | 0.7565 | Arabidopsis thaliana | 7207 | 8900 |
| | 710-729 | XP_003551421 | 356566402 | 1 | Glycine max | 7208 | 8901 |
| | | XP_003518080 | 356498481 | 0.7962 | Glycine max | 7209 | 8902 |
| ptc-miRf10226-akr | 312-334 | XP_003547131 | 356557655 | 1 | Glycine max | 7210 | 8903 |
| | | XP_003541752 | 356546681 | 0.9148 | Glycine max | 7211 | 8904 |
| | 247-269 | XP_003542817 | 356548860 | 1 | Glycine max | 7212 | 8905 |
| | | XP_003546711 | 356556804 | 0.9141 | Glycine max | 7213 | 8906 |
| | | AET02361 | 357515192 | 0.7607 | Medicago truncatula | 7214 | 8907 |
| | 131-153 | XP_003523607 | | 1 | Glycine max | 7215 | |
| | | XP_003525906 | | 0.9439 | Glycine max | 7216 | |
| | 106-128 | XP_003549610 | 356562705 | 1 | Glycine max | 7217 | 8908 |
| | | XP_003529657 | 356522038 | 0.8762 | Glycine max | 7218 | 8909 |
| | 161-183 | XP_003525906 | 356514424 | 1 | Glycine max | 7219 | 8910 |
| | | XP_003523607 | 356509746 | 0.9381 | Glycine max | 7220 | 8911 |
| ptc-miRf10271-akr | 123-143 | XP_003543825 | 356550908 | 1 | Glycine max | 7221 | 8912 |
| | | XP_003556814 | 356577399 | 0.813 | Glycine max | 7222 | 8913 |
| | 423-443 | XP_002325684 | 255761085 | 1 | Populus trichocarpa | 7223 | |
| | | XP_002319934 | 255761085 | 0.9342 | Populus trichocarpa | 7224 | |
| | | ACU14088 | 255627486 | 0.8202 | Glycine max | 7225 | 8914 |
| | | XP_003543368 | 356549979 | 0.8114 | Glycine max | 7226 | 8915 |
| | | NP_001237648 | 351726723 | 0.7982 | Glycine max | 7227 | 8916 |
| | | ACU20677 | 255640786 | 0.7807 | Glycine max | 7228 | 8917 |
| | | XP_002284361 | 225461286 | 0.7719 | Vitis vinifera | 7229 | 8918 |
| | | ADU05416 | 315364829 | 0.7851 | Citrullus lanatus | 7230 | 8919 |
| | | XP_002265183 | 225465748 | 0.75 | Vitis vinifera | 7231 | 8920 |
| | | XP_002513246 | 255761086 | 0.807 | Ricinus communis | 7232 | |
| | 544-564 | ACU20677 | 255640786 | 1 | Glycine max | 7233 | 8921 |
| | | P26291 | | 0.7099 | Pisum sativum | 7234 | |
| | | XP_003597086 | 357453610 | 0.7023 | Medicago truncatula | 7235 | 8922 |
| | 304-324 | XP_003541823 | 356546825 | 1 | Glycine max | 7236 | 8923 |
| | 288-308 | XP_003518627 | 356499601 | 1 | Glycine max | 7237 | 8924 |
| | | XP_003542153 | 356547506 | 0.9478 | Glycine max | 7238 | 8925 |
| | | ADN33938 | 307136081 | 0.7937 | Cucumis melo subsp. melo | 7239 | 8926 |
| | | XP_002518919 | 255761086 | 0.7755 | Ricinus communis | 7240 | |
| | | XP_002279642 | 225426567 | 0.7755 | Vitis vinifera | 7241 | 8927 |
| | | XP_002870592 | 297853636 | 0.7664 | Arabidopsis lyrata subsp. lyrata | 7242 | |
| | | NP_199024 | 30693991 | 0.7642 | Arabidopsis thaliana | 7243 | 8928 |
| | | AAM63843 | 21405504 | 0.7596 | Arabidopsis thaliana | 7244 | 8929 |
| | | XP_002299422 | 255761085 | 0.7528 | Populus trichocarpa | 7245 | |
| | | XP_002303695 | 255761085 | 0.7574 | Populus trichocarpa | 7246 | |
| | 123-143 | XP_003543825 | 356550908 | 1 | Glycine max | 7247 | 8930 |
| | 460-480 | XP_003542153 | 356547506 | 1 | Glycine max | 7248 | 8931 |
| | | XP_003518627 | 356499601 | 0.9436 | Glycine max | 7249 | 8932 |
| | 838-858 | XP_003526354 | 356515330 | 1 | Glycine max | 7250 | 8933 |
| | | XP_003523913 | 356510372 | 0.9333 | Glycine max | 7251 | 8934 |
| | 72-92 | XP_003535315 | 356533526 | 1 | Glycine max | 7252 | 8935 |
| | | XP_003555178 | 356574075 | 0.9462 | Glycine max | 7253 | 8936 |
| | | XP_003591226 | 357441896 | 0.7849 | Medicago truncatula | 7254 | 8937 |
| | | XP_002512536 | 255761086 | 0.7465 | Ricinus communis | 7255 | |
| | | CBI39621 | 270257428 | 0.7465 | Vitis vinifera | 7256 | 8938 |
| | | CAP59645 | 163913883 | 0.7558 | Vitis vinifera | 7257 | 8939 |
| | | XP_002277312 | 225450534 | 0.7496 | Vitis vinifera | 7258 | 8940 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002280462 | 225432056 | 0.7404 | *Vitis vinifera* | 7259 | 8941 |
| | | CAP59646 | 163913885 | 0.7512 | *Vitis vinifera* | 7260 | 8942 |
| | | CAN63178 | 123711273 | 0.7373 | *Vitis vinifera* | 7261 | 8943 |
| | 157-177 | XP_003594856 | 357449158 | 1 | *Medicago truncatula* | 7262 | 8944 |
| | | XP_003533661 | 356530178 | 0.913 | *Glycine max* | 7263 | 8945 |
| | | ACU18911 | 255637160 | 0.9091 | *Glycine max* | 7264 | 8946 |
| | | ACU19698 | 255638787 | 0.9051 | *Glycine max* | 7265 | 8947 |
| | | XP_002273965 | 225423594 | 0.83 | *Vitis vinifera* | 7266 | 8948 |
| | | NP_001058303 | 115469407 | 0.7984 | *Oryza sativa* Japonica Group | 7267 | 8949 |
| | | XP_002528147 | 255761086 | 0.8063 | *Ricinus communis* | 7268 | |
| | | AEL99129 | 343172851 | 0.8142 | *Silene latifolia* | 7269 | 8950 |
| | | AEL99130 | 343172853 | 0.8103 | *Silene latifolia* | 7270 | 8951 |
| | | XP_002438809 | 255761094 | 0.7787 | *Sorghum bicolor* | 7271 | |
| | 613-633 | XP_003541563 | 356546291 | 1 | *Glycine max* | 7272 | 8952 |
| | | XP_003545791 | 356554924 | 0.805 | *Glycine max* | 7273 | 8953 |
| | 904-924 | XP_003556814 | 356577399 | 1 | *Glycine max* | 7274 | 8954 |
| | 2015-2035 | XP_003538988 | 356541033 | 1 | *Glycine max* | 7275 | 8955 |
| | | XP_003607189 | 357473808 | 0.7407 | *Medicago truncatula* | 7276 | 8956 |
| | | XP_003604038 | 357467506 | 0.7035 | *Medicago truncatula* | 7277 | 8957 |
| | 841-861 | XP_003523913 | 356510372 | 1 | *Glycine max* | 7278 | 8958 |
| | | XP_003526354 | 356515330 | 0.9333 | *Glycine max* | 7279 | 8959 |
| | 925-945 | XP_003545791 | 356554924 | 1 | *Glycine max* | 7280 | 8960 |
| | | XP_003541563 | 356546291 | 0.8662 | *Glycine max* | 7281 | 8961 |
| ptc-miRf10734-akr | 371-391 | XP_003518621 | 356499589 | 1 | *Glycine max* | 7282 | 8962 |
| | | XP_003529232 | 356521172 | 0.9575 | *Glycine max* | 7283 | 8963 |
| | | ABI48270 | 113911567 | 0.8826 | *Lotus japonicus* | 7284 | 8964 |
| | | XP_003525213 | 356513021 | 0.8512 | *Glycine max* | 7285 | 8965 |
| | | XP_003530935 | 356524637 | 0.8502 | *Glycine max* | 7286 | 8966 |
| | | XP_003631014 | 357521450 | 0.836 | *Medicago truncatula* | 7287 | 8967 |
| | | XP_002285117 | 225424439 | 0.8117 | *Vitis vinifera* | 7288 | 8968 |
| | | ACE63259 | 190148352 | 0.8067 | *Betula pendula* | 7289 | 8969 |
| | | ABI48271 | 113911569 | 0.8259 | *Lotus japonicus* | 7290 | 8970 |
| | | XP_002314765 | 255761085 | 0.7783 | *Populus trichocarpa* | 7291 | |
| | 1151-1171 | XP_003520774 | 356503973 | 1 | *Glycine max* | 7292 | 8971 |
| | 1761-1781 | XP_003523576 | 356509683 | 1 | *Glycine max* | 7293 | |
| | | XP_003527692 | 356518039 | 0.8899 | *Glycine max* | 7294 | |
| | 1929-1949 | XP_003527692 | 356518039 | 1 | *Glycine max* | 7295 | |
| | | XP_003523576 | 356509683 | 0.8906 | *Glycine max* | 7296 | |
| | 1230-1250 | XP_003538849 | 356540752 | 1 | *Glycine max* | 7297 | 8972 |
| | | XP_003520774 | 356503973 | 0.7213 | *Glycine max* | 7298 | 8973 |
| ptc-miRf10985-akr | 161-180 | XP_003549130 | 356561725 | 1 | *Glycine max* | 7299 | 8974 |
| | | XP_003553944 | 356571558 | 0.9452 | *Glycine max* | 7300 | 8975 |
| | 1659-1678 | AAF67341 | 7682676 | 1 | *Vigna radiata* | 7301 | 8976 |
| | | ACF22882 | 193850556 | 0.9362 | *Glycine max* | 7302 | |
| | | XP_003546457 | 356556285 | 0.9334 | *Glycine max* | 7303 | 8977 |
| | | XP_003550633 | 356564793 | 0.8239 | *Glycine max* | 7304 | 8978 |
| | | CAA09457 | 3641864 | 0.8017 | *Cicer arietinum* | 7305 | 8979 |
| | | CAA06309 | 14274980 | 0.7961 | *Cicer arietinum* | 7306 | 8980 |
| | | CAA09467 | 3860419 | 0.8058 | *Lupinus angustifolius* | 7307 | 8981 |
| | | XP_002514108 | 255761086 | 0.7878 | *Ricinus communis* | 7308 | |
| | | XP_003595162 | 357449770 | 0.7906 | *Medicago truncatula* | 7309 | 8982 |
| | | XP_002308268 | 255761085 | 0.7684 | *Populus trichocarpa* | 7310 | |
| | 235-254 | BAF31130 | 114213453 | 1 | *Vicia faba* | 7311 | 8983 |
| | | P48488 | | 0.9751 | *Medicago sativa* subsp. × *varia* | 7312 | |
| | | ACJ84258 | 217071795 | 0.972 | *Medicago truncatula* | 7313 | 8984 |
| | | XP_003532976 | 356528780 | 0.9346 | *Glycine max* | 7314 | 8985 |
| | | XP_003525372 | 356513340 | 0.9283 | *Glycine max* | 7315 | 8986 |
| | | ACU20069 | 255639548 | 0.9252 | *Glycine max* | 7316 | 8987 |
| | | XP_002509868 | 255761086 | 0.9034 | *Ricinus communis* | 7317 | |
| | | XP_002298008 | 255761085 | 0.8972 | *Populus trichocarpa* | 7318 | |
| | | XP_002277816 | 225426133 | 0.9034 | *Vitis vinifera* | 7319 | 8988 |
| | | NP_176587 | 145337150 | 0.8442 | *Arabidopsis thaliana* | 7320 | 8989 |
| | 235-254 | XP_003551188 | 356565928 | 1 | *Glycine max* | 7321 | 8990 |
| | | XP_003538544 | 356540131 | 0.9106 | *Glycine max* | 7322 | 8991 |
| | | ACU18328 | 255635963 | 0.9083 | *Glycine max* | 7323 | 8992 |
| | | XP_003601767 | 357462970 | 0.7064 | *Medicago truncatula* | 7324 | 8993 |
| | 495-514 | XP_003553428 | 356570509 | 1 | *Glycine max* | 7325 | 8994 |
| | | XP_003520534 | 356503475 | 0.9081 | *Glycine max* | 7326 | 8995 |
| | 51-70 | XP_003545057 | 356553424 | 1 | *Glycine max* | 7327 | 8996 |
| | | XP_003519693 | 356501762 | 0.9036 | *Glycine max* | 7328 | 8997 |
| | | XP_002312804 | 255761085 | 0.7267 | *Populus trichocarpa* | 7329 | |
| | | XP_002279611 | 225428277 | 0.7199 | *Vitis vinifera* | 7330 | 8998 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 167-186 | XP_003538544 | 356540131 | 1 | Glycine max | 7331 | 8999 |
| | | XP_003551188 | 356565928 | 0.9097 | Glycine max | 7332 | 9000 |
| | 109-128 | XP_003522278 | 356507037 | 1 | Glycine max | 7333 | 9001 |
| | | XP_003525436 | 356513468 | 0.7319 | Glycine max | 7334 | 9002 |
| | | XP_003550708 | 356564947 | 0.7072 | Glycine max | 7335 | 9003 |
| | 393-412 | XP_003520128 | 356502644 | 1 | Glycine max | 7336 | 9004 |
| | | XP_003517860 | 356498034 | 0.9129 | Glycine max | 7337 | 9005 |
| | 217-236 | AES84797 | 339649045 | 1 | Medicago truncatula | 7338 | 9006 |
| | | XP_003518611 | 356499568 | 0.8041 | Glycine max | 7339 | 9007 |
| | | XP_003529219 | 356521146 | 0.7947 | Glycine max | 7340 | 9008 |
| | | XP_003525231 | 356513057 | 0.7665 | Glycine max | 7341 | 9009 |
| | | XP_003630941 | 357521304 | 0.7834 | Medicago truncatula | 7342 | 9010 |
| | | XP_003530877 | 356524520 | 0.7552 | Glycine max | 7343 | 9011 |
| | | XP_002525995 | 255761086 | 0.7269 | Ricinus communis | 7344 | |
| | | XP_002315857 | 255761085 | 0.7213 | Populus trichocarpa | 7345 | |
| | | ABK94575 | 118485436 | 0.7213 | Populus trichocarpa | 7346 | 9012 |
| | | XP_002311530 | 255761085 | 0.7175 | Populus trichocarpa | 7347 | |
| | 398-417 | XP_003588450 | 357436348 | 1 | Medicago truncatula | 7348 | 9013 |
| | | XP_003526513 | 356515652 | 0.8496 | Glycine max | 7349 | 9014 |
| | | XP_003522729 | 356507956 | 0.8453 | Glycine max | 7350 | 9015 |
| | | XP_003603665 | 357466760 | 0.839 | Medicago truncatula | 7351 | 9016 |
| | | ACU21356 | 255642182 | 0.8432 | Glycine max | 7352 | 9017 |
| | | XP_003550117 | 356563738 | 0.8305 | Glycine max | 7353 | 9018 |
| | | CAD92450 | 31455392 | 0.7479 | Brassica napus | 7354 | 9019 |
| | | ADB92670 | 284519839 | 0.75 | Populus tremula × Populus alba | 7355 | 9020 |
| | | XP_002510013 | 255761086 | 0.7373 | Ricinus communis | 7356 | |
| | | XP_002301129 | 255761085 | 0.7373 | Populus trichocarpa | 7357 | |
| | 370-389 | XP_003553428 | 356570509 | 1 | Glycine max | 7358 | 9021 |
| | 758-777 | XP_003520534 | 356503475 | 1 | Glycine max | 7359 | 9022 |
| | | XP_003553428 | 356570509 | 0.9081 | Glycine max | 7360 | 9023 |
| | 236-255 | XP_003551188 | 356565928 | 1 | Glycine max | 7361 | 9024 |
| | 35-54 | AAM12880 | 20149261 | 1 | Helianthus annuus | 7362 | 9025 |
| | | CBI28152 | 270240501 | 0.991 | Vitis vinifera | 7363 | |
| | | XP_002284967 | 225430201 | 0.991 | Vitis vinifera | 7364 | 9026 |
| | | CBI21000 | 270231236 | 0.991 | Vitis vinifera | 7365 | |
| | | CBI36254 | 270253379 | 0.9819 | Vitis vinifera | 7366 | 9027 |
| | | NP_200330 | 145359269 | 0.9864 | Arabidopsis thaliana | 7367 | 9028 |
| | | XP_003522628 | 356507751 | 0.9819 | Glycine max | 7368 | 9029 |
| | | AEM97804 | 344189954 | 0.9864 | Dimocarpus longan | 7369 | 9030 |
| | | XP_002864382 | 297853636 | 0.9864 | Arabidopsis lyrata subsp. lyrata | 7370 | |
| | | XP_002285307 | 225442824 | 0.9819 | Vitis vinifera | 7371 | 9031 |
| | 755-774 | XP_003518080 | 356498481 | 1 | Glycine max | 7372 | 9032 |
| | | XP_003551421 | 356566402 | 0.8408 | Glycine max | 7373 | 9033 |
| | 56-75 | XP_003522398 | 356507283 | 1 | Glycine max | 7374 | 9034 |
| | | XP_003526192 | 356515005 | 0.9095 | Glycine max | 7375 | 9035 |
| | | XP_003526191 | 356515003 | 0.9128 | Glycine max | 7376 | 9036 |
| | | XP_003527777 | 356518217 | 0.7966 | Glycine max | 7377 | 9037 |
| | 113-132 | XP_003538544 | 356540131 | 1 | Glycine max | 7378 | 9038 |
| | 1097-1116 | XP_003520128 | 356502644 | 1 | Glycine max | 7379 | 9039 |
| | 1482-1501 | XP_003546504 | 356556379 | 1 | Glycine max | 7380 | 9040 |
| | | XP_003550617 | 356564761 | 0.7923 | Glycine max | 7381 | 9041 |
| | | XP_003542359 | 356547932 | 0.7889 | Glycine max | 7382 | 9042 |
| | | XP_002279041 | 225444747 | 0.7337 | Vitis vinifera | 7383 | 9043 |
| | | XP_002870435 | 297853636 | 0.7119 | Arabidopsis lyrata subsp. lyrata | 7384 | |
| | | XP_002516284 | 255761086 | 0.7102 | Ricinus communis | 7385 | |
| | | NP_568528 | 22327353 | 0.7018 | Arabidopsis thaliana | 7386 | 9044 |
| | | XP_002326282 | 255761085 | 0.7002 | Populus trichocarpa | 7387 | |
| ptc-miRf11315-akr | 264-283 | XP_003518840 | 356500034 | 1 | Glycine max | 7388 | 9045 |
| | | XP_003529395 | 356521503 | 0.9171 | Glycine max | 7389 | 9046 |
| | | XP_003607985 | 357475398 | 0.8275 | Medicago truncatula | 7390 | 9047 |
| | | XP_002518769 | 255761086 | 0.7579 | Ricinus communis | 7391 | |
| | | XP_002313117 | 255761085 | 0.7496 | Populus trichocarpa | 7392 | |
| | | AAQ90244 | 37223341 | 0.7446 | Solanum lycopersicum | 7393 | 9048 |
| | | NP_001234399 | 350534489 | 0.7446 | Solanum lycopersicum | 7394 | 9049 |
| | | NP_188555 | 30685246 | 0.7247 | Arabidopsis thaliana | 7395 | 9050 |
| | | XP_002883169 | 297853636 | 0.7164 | Arabidopsis lyrata subsp. lyrata | 7396 | |
| | | CBI32416 | 270245997 | 0.7313 | Vitis vinifera | 7397 | 9051 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 324-343 | XP_003550774 | 356565082 | 1 | Glycine max | 7398 | 9052 |
| | | XP_003525472 | 356513541 | 0.8489 | Glycine max | 7399 | 9053 |
| | 324-343 | XP_003550774 | 356565082 | 1 | Glycine max | 7400 | 9054 |
| | 680-699 | XP_003554964 | 356573636 | 1 | Glycine max | 7401 | 9055 |
| ptc-miRf11757-akr | 404-426 | XP_003612685 | 357484794 | 1 | Medicago truncatula | 7402 | 9056 |
| | | XP_003516858 | 356495999 | 0.8914 | Glycine max | 7403 | 9057 |
| | | XP_003534304 | 356531476 | 0.8801 | Glycine max | 7404 | 9058 |
| | | BAH03477 | 218744535 | 0.8015 | Nicotiana tabacum | 7405 | 9059 |
| | | XP_002519001 | 255761086 | 0.824 | Ricinus communis | 7406 | |
| | | XP_002303454 | 255761085 | 0.8127 | Populus trichocarpa | 7407 | |
| | | ABK93338 | 118482845 | 0.8052 | Populus trichocarpa | 7408 | 9060 |
| | | XP_002326571 | 255761085 | 0.8015 | Populus trichocarpa | 7409 | |
| | | XP_002274060 | 225427054 | 0.764 | Vitis vinifera | 7410 | 9061 |
| | | XP_002890966 | 297853636 | 0.7603 | Arabidopsis lyrata subsp. lyrata | 7411 | |
| ath-miR157a | 164-184 | XP_003549130 | 356561725 | 1 | Glycine max | 7412 | 9062 |
| | | XP_003553944 | 356571558 | 0.9452 | Glycine max | 7413 | 9063 |
| | 238-258 | XP_003551188 | 356565928 | 1 | Glycine max | 7414 | 9064 |
| | | XP_003538544 | 356540131 | 0.9106 | Glycine max | 7415 | 9065 |
| | | ACU18328 | 255635963 | 0.9083 | Glycine max | 7416 | 9066 |
| | | XP_003601767 | 357462970 | 0.7064 | Medicago truncatula | 7417 | 9067 |
| | 1129-1149 | XP_003525415 | 356513426 | 1 | Glycine max | 7418 | 9068 |
| | | XP_003532399 | 356527605 | 0.9051 | Glycine max | 7419 | 9069 |
| | 898-918 | XP_003540473 | 356544059 | 1 | Glycine max | 7420 | 9070 |
| | | XP_003543233 | 356549706 | 0.9305 | Glycine max | 7421 | 9071 |
| | | ACU24116 | 255647298 | 0.9251 | Glycine max | 7422 | 9072 |
| | 118-138 | XP_003525436 | 356513468 | 1 | Glycine max | 7423 | 9073 |
| | | XP_003550708 | 356564947 | 0.9204 | Glycine max | 7424 | 9074 |
| | | XP_003522278 | 356507037 | 0.7595 | Glycine max | 7425 | 9075 |
| | 77-97 | XP_003520455 | 356503312 | 1 | Glycine max | 7426 | 9076 |
| | | XP_003530170 | 356523079 | 0.848 | Glycine max | 7427 | 9077 |
| | 498-518 | XP_003553428 | 356570509 | 1 | Glycine max | 7428 | 9078 |
| | | XP_003520534 | 356503475 | 0.9081 | Glycine max | 7429 | 9079 |
| | 50-70 | XP_003550708 | 356564947 | 1 | Glycine max | 7430 | 9080 |
| | | XP_003525436 | 356513468 | 0.9373 | Glycine max | 7431 | 9081 |
| | 854-875 | XP_003555667 | 356575073 | 1 | Glycine max | 7432 | 9082 |
| | 170-190 | XP_003538544 | 356540131 | 1 | Glycine max | 7433 | 9083 |
| | | XP_003551188 | 356565928 | 0.9097 | Glycine max | 7434 | 9084 |
| | 593-613 | NP_001236309 | 351724988 | 1 | Glycine max | 7435 | 9085 |
| | | XP_003529339 | 356521389 | 0.838 | Glycine max | 7436 | 9086 |
| | 144-164 | XP_002275728 | 225446415 | 1 | Vitis vinifera | 7437 | 9087 |
| | | AAY16440 | 62856978 | 0.7396 | Betula platyphylla | 7438 | 9088 |
| | 112-132 | XP_003522278 | 356507037 | 1 | Glycine max | 7439 | 9089 |
| | 396-416 | XP_003520128 | 356502644 | 1 | Glycine max | 7440 | 9090 |
| | | XP_003517860 | 356498034 | 0.9129 | Glycine max | 7441 | 9091 |
| | 181-201 | XP_003523155 | 356508826 | 1 | Glycine max | 7442 | 9092 |
| | 593-613 | NP_001236309 | 351724988 | 1 | Glycine max | 7443 | 9093 |
| | 116-136 | ACU18105 | 255635506 | 1 | Glycine max | 7444 | 9094 |
| | 758-778 | XP_003518080 | 356498481 | 1 | Glycine max | 7445 | 9095 |
| | | XP_003551421 | 356566402 | 0.8408 | Glycine max | 7446 | 9096 |
| | 120-140 | XP_003549130 | 356561725 | 1 | Glycine max | 7447 | |
| | 693-713 | XP_003525415 | 356513426 | 1 | Glycine max | 7448 | 9097 |
| | 737-757 | XP_003553428 | 356570509 | 1 | Glycine max | 7449 | 9098 |
| | 116-136 | XP_003538544 | 356540131 | 1 | Glycine max | 7450 | 9099 |
| | 818-838 | XP_003553944 | 356571558 | 1 | Glycine max | 7451 | 9100 |
| | 238-258 | XP_003551188 | 356565928 | 1 | Glycine max | 7452 | 9101 |
| | 1070-1090 | XP_003525436 | 356513468 | 1 | Glycine max | 7453 | 9102 |
| | 109-129 | XP_003520455 | 356503312 | 1 | Glycine max | 7454 | 9103 |
| | 404-424 | XP_003526029 | 356514674 | 1 | Glycine max | 7455 | 9104 |
| | | XP_003540122 | 356543345 | 0.8919 | Glycine max | 7456 | 9105 |
| | 181-201 | XP_003523155 | 356508826 | 1 | Glycine max | 7457 | 9106 |
| | 713-733 | XP_003551421 | 356566402 | 1 | Glycine max | 7458 | 9107 |
| | | XP_003518080 | 356498481 | 0.7962 | Glycine max | 7459 | 9108 |
| sbi-miR159a | 305-325 | XP_003541823 | 356546825 | 1 | Glycine max | 7460 | 9109 |
| | 305-325 | XP_003541823 | 356546825 | 1 | Glycine max | 7461 | 9110 |
| | 289-309 | XP_003518627 | 356499601 | 1 | Glycine max | 7462 | 9111 |
| | | XP_003542153 | 356547506 | 0.9478 | Glycine max | 7463 | 9112 |
| | | ADN33938 | 307136081 | 0.7937 | Cucumis melo subsp. melo | 7464 | 9113 |
| | | XP_002518919 | 255761086 | 0.7755 | Ricinus communis | 7465 | |
| | | XP_002279642 | 225426567 | 0.7755 | Vitis vinifera | 7466 | 9114 |
| | | XP_002870592 | 297853636 | 0.7664 | Arabidopsis lyrata subsp. lyrata | 7467 | |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | NP_199024 | 30693991 | 0.7642 | Arabidopsis thaliana | 7468 | 9115 |
| | | AAM63843 | 21405504 | 0.7596 | Arabidopsis thaliana | 7469 | 9116 |
| | | XP_002299422 | 255761085 | 0.7528 | Populus trichocarpa | 7470 | |
| | | XP_002303695 | 255761085 | 0.7574 | Populus trichocarpa | 7471 | |
| | 124-144 | XP_003543825 | 356550908 | 1 | Glycine max | 7472 | 9117 |
| | | XP_003556814 | 356577399 | 0.813 | Glycine max | 7473 | 9118 |
| | 461-481 | XP_003542153 | 356547506 | 1 | Glycine max | 7474 | 9119 |
| | | XP_003518627 | 356499601 | 0.9436 | Glycine max | 7475 | 9120 |
| | 839-859 | XP_003526354 | 356515330 | 1 | Glycine max | 7476 | 9121 |
| | | XP_003523913 | 356510372 | 0.9333 | Glycine max | 7477 | 9122 |
| | 73-93 | XP_003535315 | 356533526 | 1 | Glycine max | 7478 | 9123 |
| | | XP_003555178 | 356574075 | 0.9462 | Glycine max | 7479 | 9124 |
| | | XP_003591226 | 357441896 | 0.7849 | Medicago truncatula | 7480 | 9125 |
| | | XP_002512536 | 255761086 | 0.7465 | Ricinus communis | 7481 | |
| | | CBI39621 | 270257428 | 0.7465 | Vitis vinifera | 7482 | 9126 |
| | | CAP59645 | 163913883 | 0.7558 | Vitis vinifera | 7483 | 9127 |
| | | XP_002277312 | 225450534 | 0.7496 | Vitis vinifera | 7484 | 9128 |
| | | XP_002280462 | 225432056 | 0.7404 | Vitis vinifera | 7485 | 9129 |
| | | CAP59646 | 163913885 | 0.7512 | Vitis vinifera | 7486 | 9130 |
| | | CAN63178 | 123711273 | 0.7373 | Vitis vinifera | 7487 | 9131 |
| | 614-634 | XP_003541563 | 356546291 | 1 | Glycine max | 7488 | 9132 |
| | | XP_003545791 | 356554924 | 0.805 | Glycine max | 7489 | 9133 |
| | 905-925 | XP_003556814 | 356577399 | 1 | Glycine max | 7490 | 9134 |
| | | XP_003543825 | 356550908 | 0.8659 | Glycine max | 7491 | 9135 |
| smo-miR156b | 164-184 | XP_003549130 | 356561725 | 1 | Glycine max | 7492 | 9136 |
| | | XP_003553944 | 356571558 | 0.9452 | Glycine max | 7493 | 9137 |
| | 238-258 | XP_003551188 | 356565928 | 1 | Glycine max | 7494 | 9138 |
| | | XP_003538544 | 356540131 | 0.9106 | Glycine max | 7495 | 9139 |
| | | ACU18328 | 255635963 | 0.9083 | Glycine max | 7496 | 9140 |
| | | XP_003601767 | 357462970 | 0.7064 | Medicago truncatula | 7497 | 9141 |
| | 1129-1149 | XP_003525415 | 356513426 | 1 | Glycine max | 7498 | 9142 |
| | | XP_003532399 | 356527605 | 0.9051 | Glycine max | 7499 | 9143 |
| | 118-138 | XP_003525436 | 356513468 | 1 | Glycine max | 7500 | 9144 |
| | | XP_003550708 | 356564947 | 0.9204 | Glycine max | 7501 | 9145 |
| | | XP_003522278 | 356507037 | 0.7595 | Glycine max | 7502 | 9146 |
| | 77-97 | XP_003520455 | 356503312 | 1 | Glycine max | 7503 | 9147 |
| | | XP_003530170 | 356523079 | 0.848 | Glycine max | 7504 | 9148 |
| | 50-70 | XP_003550708 | 356564947 | 1 | Glycine max | 7505 | 9149 |
| | | XP_003525436 | 356513468 | 0.9373 | Glycine max | 7506 | 9150 |
| | 498-518 | XP_003553428 | 356570509 | 1 | Glycine max | 7507 | 9151 |
| | | XP_003520534 | 356503475 | 0.9081 | Glycine max | 7508 | 9152 |
| | 170-190 | XP_003538544 | 356540131 | 1 | Glycine max | 7509 | 9153 |
| | | XP_003551188 | 356565928 | 0.9097 | Glycine max | 7510 | 9154 |
| | 593-613 | NP_001236309 | 351724988 | 1 | Glycine max | 7511 | 9155 |
| | | XP_003529339 | 356521389 | 0.838 | Glycine max | 7512 | 9156 |
| | 475-495 | XP_003528960 | 356520620 | 1 | Glycine max | 7513 | 9157 |
| | | NP_001235425 | 351721650 | 0.9279 | Glycine max | 7514 | 9158 |
| | 144-164 | XP_002275728 | 225446415 | 1 | Vitis vinifera | 7515 | 9159 |
| | | AAY16440 | 62856978 | 0.7396 | Betula platyphylla | 7516 | 9160 |
| | 112-132 | XP_003522278 | 356507037 | 1 | Glycine max | 7517 | 9161 |
| | 396-416 | XP_003520128 | 356502644 | 1 | Glycine max | 7518 | 9162 |
| | | XP_003517860 | 356498034 | 0.9129 | Glycine max | 7519 | 9163 |
| | 243-263 | XP_003540122 | 356543345 | 1 | Glycine max | 7520 | 9164 |
| | | XP_003526029 | 356514674 | 0.8684 | Glycine max | 7521 | 9165 |
| | 181-201 | XP_003523155 | 356508826 | 1 | Glycine max | 7522 | 9166 |
| | 77-97 | XP_003520455 | 356503312 | 1 | Glycine max | 7523 | 9167 |
| | 373-393 | XP_003553428 | 356570509 | 1 | Glycine max | 7524 | 9168 |
| | 761-781 | XP_003520534 | 356503475 | 1 | Glycine max | 7525 | 9169 |
| | | XP_003553428 | 356570509 | 0.9081 | Glycine max | 7526 | 9170 |
| | 110-130 | XP_003553944 | 356571558 | 1 | Glycine max | 7527 | 9171 |
| | 239-259 | XP_003551188 | 356565928 | 1 | Glycine max | 7528 | 9172 |
| | 1022-1042 | XP_003532399 | 356527605 | 1 | Glycine max | 7529 | 9173 |
| | | XP_003525415 | 356513426 | 0.8914 | Glycine max | 7530 | 9174 |
| | 593-613 | NP_001236309 | 351724988 | 1 | Glycine max | 7531 | 9175 |
| | 116-136 | ACU18105 | 255635506 | 1 | Glycine max | 7532 | 9176 |
| | 758-778 | XP_003518080 | 356498481 | 1 | Glycine max | 7533 | 9177 |
| | | XP_003551421 | 356566402 | 0.8408 | Glycine max | 7534 | 9178 |
| | 1231-1251 | XP_003525415 | 356513426 | 1 | Glycine max | 7535 | 9179 |
| | 20-40 | XP_003549130 | 356561725 | 1 | Glycine max | 7536 | 9180 |
| | 1070-1090 | XP_003525436 | 356513468 | 1 | Glycine max | 7537 | 9181 |
| | 404-424 | XP_003526029 | 356514674 | 1 | Glycine max | 7538 | 9182 |
| | | XP_003540122 | 356543345 | 0.8919 | Glycine max | 7539 | 9183 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 185-205 | XP_003538544 | 356540131 | 1 | *Glycine max* | 7540 | 9184 |
| | 713-733 | XP_003551421 | 356566402 | 1 | *Glycine max* | 7541 | 9185 |
| | | XP_003518080 | 356498481 | 0.7962 | *Glycine max* | 7542 | 9186 |
| osa-miRf10839-akr | 32-52 | AAM97011 | 22531013 | 1 | *Arabidopsis thaliana* | 7543 | 9187 |
| | | NP_563815 | 145335272 | 0.9929 | *Arabidopsis thaliana* | 7544 | 9188 |
| | | XP_002892455 | 297853636 | 0.9786 | *Arabidopsis lyrata* subsp. *lyrata* | 7545 | |
| | | BAJ33638 | 312281544 | 0.9429 | *Thellungiella halophila* | 7546 | 9189 |
| | | XP_002523852 | 255761086 | 0.7714 | *Ricinus communis* | 7547 | |
| | | AEL99169 | 343172931 | 0.75 | *Silene latifolia* | 7548 | 9190 |
| | | XP_002313603 | 255761085 | 0.7429 | *Populus trichocarpa* | 7549 | |
| | | ACJ86143 | 217075565 | 0.7214 | *Medicago truncatula* | 7550 | 9191 |
| | | ADI45844 | 297525844 | 0.7429 | *Silene vulgaris* | 7551 | 9192 |
| | | XP_002328107 | 255761085 | 0.75 | *Populus trichocarpa* | 7552 | |
| ptc-miRf10300-akr | 35-54 | ACJ37435 | 212717187 | 1 | *Glycine max* | 7553 | 9193 |
| | | ACU23160 | 255645326 | 0.9948 | *Glycine max* | 7554 | 9194 |
| | | ACJ37436 | 212717189 | 0.933 | *Glycine max* | 7555 | 9195 |
| | 537-556 | NP_001235206 | 351722714 | 1 | *Glycine max* | 7556 | 9196 |
| | | NP_001236569 | 351725110 | 0.9581 | *Glycine max* | 7557 | 9197 |
| | | XP_002866588 | 297853636 | 0.7126 | *Arabidopsis lyrata* subsp. *lyrata* | 7558 | |
| | | XP_002309915 | 255761085 | 0.7665 | *Populus trichocarpa* | 7559 | |
| | | NP_201209 | 145359627 | 0.7066 | *Arabidopsis thaliana* | 7560 | 9198 |
| | | ABK96256 | 118488893 | 0.7605 | *Populus trichocarpa* x *Populus deltoides* | 7561 | 9199 |
| | | XP_002526638 | 255761086 | 0.7485 | *Ricinus communis* | 7562 | |
| | | XP_002306249 | 255761085 | 0.7784 | *Populus trichocarpa* | 7563 | |
| | | 2WSC_N | | 0.7844 | *Phaseolus vulgaris* | 7564 | |
| | | BAJ33864 | 312281996 | 0.7066 | *Thellungiella halophila* | 7565 | 9200 |
| | 39-58 | XP_002283864 | 225429937 | 1 | *Vitis vinifera* | 7566 | 9201 |
| ptc-miRf10619-akr | 318-339 | BAG09382 | 167961874 | 1 | *Glycine max* | 7567 | 9202 |
| | | NP_001238412 | 351726609 | 0.9838 | *Glycine max* | 7568 | 9203 |
| | | ACU19205 | 255637765 | 0.9704 | *Glycine max* | 7569 | 9204 |
| | | CAN67413 | 123711204 | 0.9272 | *Vitis vinifera* | 7570 | 9205 |
| | | ACD93720 | 223987377 | 0.903 | *Mikania micrantha* | 7571 | 9206 |
| | | XP_002862992 | 297853636 | 0.9191 | *Arabidopsis lyrata* subsp. *lyrata* | 7572 | |
| | | XP_002277249 | 225462095 | 0.9299 | *Vitis vinifera* | 7573 | 9207 |
| | | XP_002317470 | 255761085 | 0.9218 | *Populus trichocarpa* | 7574 | |
| | | 1803516A | | 0.9191 | *Lens culinaris* | 7575 | |
| | | XP_002519658 | 255761086 | 0.9084 | *Ricinus communis* | 7576 | |
| | 32-53 | ACU18791 | 255636916 | 1 | *Glycine max* | 7577 | 9208 |
| | 1512-1532 | ACQ44234 | 228485370 | 1 | *Glycine max* | 7578 | 9209 |
| | 55-75 | XP_002512977 | 255761086 | 1 | *Ricinus communis* | 7579 | |
| ptc-miRf11847-akr | 418-438 | ACU17540 | 255634349 | 1 | *Glycine max* | 7580 | 9210 |
| ath-miRf10701-akr | 293-314 | ACU18306 | 255635917 | 1 | *Glycine max* | 7581 | 9211 |
| | 918-939 | NP_001237102 | 351725712 | 1 | *Glycine max* | 7582 | 9212 |
| | | XP_002284425 | 225445231 | 0.7562 | *Vitis vinifera* | 7583 | 9213 |
| | 348-369 | NP_001236604 | 351726125 | 1 | *Glycine max* | 7584 | 9214 |
| | 1178-1199 | ACU21144 | 255641746 | 1 | *Glycine max* | 7585 | 9215 |
| | | XP_002277008 | 225444658 | 0.7859 | *Vitis vinifera* | 7586 | 9216 |
| | | XP_002276983 | 225444660 | 0.7859 | *Vitis vinifera* | 7587 | 9217 |
| | | CAB75429 | 6996559 | 0.7204 | *Nicotiana plumbaginifolia* | 7588 | 9218 |
| | | XP_002331184 | 255761085 | 0.733 | *Populus trichocarpa* | 7589 | |
| | | XP_002529199 | 255761086 | 0.7355 | *Ricinus communis* | 7590 | |
| | | XP_002516242 | 255761086 | 0.7179 | *Ricinus communis* | 7591 | |
| | | XP_002270823 | 225442060 | 0.7254 | *Vitis vinifera* | 7592 | 9219 |
| | | CBI35841 | 270253379 | 0.7179 | *Vitis vinifera* | 7593 | |
| | | CAN65009 | 147797980 | 0.7229 | *Vitis vinifera* | 7594 | 9220 |
| osa-miRf11595-akr | 321-339 | ABB02162 | 77744234 | 1 | *Medicago sativa* | 7595 | 9221 |
| | | ABB02161 | 77744232 | 0.975 | *Medicago sativa* | 7596 | 9222 |
| | | ACJ85732 | 217074743 | 0.9711 | *Medicago truncatula* | 7597 | 9223 |
| | | AEO21428 | 346229108 | 0.8227 | *Glycine max* | 7598 | 9224 |
| | | ABC59101 | 84514184 | 0.8073 | *Medicago truncatula* | 7599 | 9225 |
| | | ABC68398 | 85001688 | 0.7842 | *Glycine max* | 7600 | 9226 |
| | | ABS53040 | 153869430 | 0.8073 | *Leucaena leucocephala* | 7601 | 9227 |
| | | AAT39511 | 47933889 | 0.7553 | *Camptotheca acuminata* | 7602 | 9228 |
| | | XP_002327769 | 255761085 | 0.7572 | *Populus trichocarpa* | 7603 | |
| | | XP_002327770 | 255761085 | 0.7437 | *Populus trichocarpa* | 7604 | |
| | 107-125 | NP_001236740 | 351722666 | 1 | *Glycine max* | 7605 | 9229 |
| | 56-74 | CAE02645 | 34495198 | 1 | *Lotus japonicus* | 7606 | 9230 |
| | | CAA65585 | 2347053 | 0.7513 | *Vitis vinifera* | 7607 | 9231 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | AAP36992 | 46371994 | 0.753 | Cucumis sativus | 7608 | 9232 |
| | | BAE71301 | 84468435 | 0.7598 | Trifolium pratense | 7609 | 9233 |
| | | XP_002269030 | 225427781 | 0.7445 | Vitis vinifera | 7610 | 9234 |
| | | BAE71251 | 84468335 | 0.7581 | Trifolium pratense | 7611 | 9235 |
| | | BAG68575 | 195976672 | 0.7496 | Prunus persica | 7612 | 9236 |
| | | BAD06581 | 40645471 | 0.7394 | Nicotiana tabacum | 7613 | 9237 |
| | | CAN65288 | 147782233 | 0.7291 | Vitis vinifera | 7614 | 9238 |
| | | CAB64599 | 6646839 | 0.7359 | Datura stramonium | 7615 | 9239 |
| | 311-329 | ACU18654 | 255636632 | 1 | Glycine max | 7616 | 9240 |
| | 515-533 | NP_001235161 | 351721419 | 1 | Glycine max | 7617 | 9241 |
| | | BAB86923 | 19911192 | 0.711 | Vigna angularis | 7618 | 9242 |
| | 22-40 | NP_001237655 | 351726929 | 1 | Glycine max | 7619 | 9243 |
| | 421-439 | ACU22898 | 255644792 | 1 | Glycine max | 7620 | 9244 |
| osa-miRf11013-akr | 407-428 | NP_001237033 | 351723724 | 1 | Glycine max | 7621 | 9245 |
| | 32-53 | ABY84658 | 166203235 | 1 | Glycine max | 7622 | 9246 |
| | | NP_001236902 | 351727360 | 0.9715 | Glycine max | 7623 | 9247 |
| | | AAL32033 | 18158618 | 0.7967 | Retama raetam | 7624 | 9248 |
| | 597-618 | ACU23333 | 255645678 | 1 | Glycine max | 7625 | 9249 |
| | 29-50 | NP_001236902 | 351727360 | 1 | Glycine max | 7626 | 9250 |
| | | ABY84658 | 166203235 | 0.9696 | Glycine max | 7627 | 9251 |
| ptc-miRf10148-akr | 679-698 | NP_001238384 | 351725780 | 1 | Glycine max | 7628 | 9252 |
| | 547-566 | XP_002283799 | 225435835 | 1 | Vitis vinifera | 7629 | 9253 |
| | | CAN72395 | 147774368 | 0.9606 | Vitis vinifera | 7630 | |
| | | ACU20767 | 255640974 | 0.9462 | Glycine max | 7631 | 9254 |
| | | XP_002304844 | 255761085 | 1.0896 | Populus trichocarpa | 7632 | |
| | | CBI16575 | 270227042 | 0.9176 | Vitis vinifera | 7633 | |
| | | XP_002523383 | 255761086 | 0.8746 | Ricinus communis | 7634 | |
| | | XP_002299088 | 255761085 | 0.8853 | Populus trichocarpa | 7635 | |
| | | NP_850182 | 42570348 | 0.81 | Arabidopsis thaliana | 7636 | 9255 |
| | | NP_565736 | 42569548 | 0.8065 | Arabidopsis thaliana | 7637 | 9256 |
| | | XP_002862885 | 297853636 | 0.8029 | Arabidopsis lyrata subsp. lyrata | 7638 | |
| | 135-154 | ACU17996 | 255635284 | 1 | Glycine max | 7639 | 9257 |
| | | ACU23482 | 255645988 | 0.8725 | Glycine max | 7640 | 9258 |
| | | XP_002307595 | 255761085 | 0.8406 | Populus trichocarpa | 7641 | |
| | | XP_002524761 | 255761086 | 0.8319 | Ricinus communis | 7642 | |
| | | XP_002300832 | 255761085 | 0.8261 | Populus trichocarpa | 7643 | |
| | | XP_002279156 | 225437057 | 0.8029 | Vitis vinifera | 7644 | 9259 |
| | | XP_002878504 | 297853636 | 0.7072 | Arabidopsis lyrata subsp. lyrata | 7645 | |
| | 141-160 | XP_002283799 | 225435835 | 1 | Vitis vinifera | 7646 | 9260 |
| | 367-386 | ACU17970 | 255635230 | 1 | Glycine max | 7647 | 9261 |
| | | ACU18145 | 255635589 | 0.9494 | Glycine max | 7648 | 9262 |
| | | XP_002510492 | 255761086 | 0.7946 | Ricinus communis | 7649 | |
| | | XP_002278539 | 225458064 | 0.7798 | Vitis vinifera | 7650 | 9263 |
| | | XP_002306908 | 255761085 | 0.7619 | Populus trichocarpa | 7651 | |
| | | ABL10371 | 118723367 | 0.75 | Medicago truncatula | 7652 | 9264 |
| | | XP_002301996 | 255761085 | 0.7738 | Populus trichocarpa | 7653 | |
| | | NP_568605 | 145358761 | 0.7024 | Arabidopsis thaliana | 7654 | 9265 |
| | 110-129 | ACU17996 | 255635284 | 1 | Glycine max | 7655 | 9266 |
| zma-miR482-5p | 122-140 | ACU21375 | 255642220 | 1 | Glycine max | 7656 | 9267 |
| | 128-146 | XP_002314999 | 255761085 | 1 | Populus trichocarpa | 7657 | |
| | | XP_002312287 | 255761085 | 0.9432 | Populus trichocarpa | 7658 | |
| | | XP_002285502 | 225424638 | 0.8428 | Vitis vinifera | 7659 | 9268 |
| | | XP_002520520 | 255761086 | 0.8341 | Ricinus communis | 7660 | |
| | | XP_002876891 | 297853636 | 0.8035 | Arabidopsis lyrata subsp. lyrata | 7661 | |
| | | NP_178465 | 30678070 | 0.7948 | Arabidopsis thaliana | 7662 | 9269 |
| | | NP_001149451 | 226506925 | 0.7773 | Zea mays | 7663 | 9270 |
| | | XP_002875224 | 297853636 | 0.7904 | Arabidopsis lyrata subsp. lyrata | 7664 | |
| | | NP_001054237 | 115461273 | 0.7686 | Oryza sativa Japonica Group | 7665 | 9271 |
| | | CAH68184 | 90399185 | 0.7642 | Oryza sativa Indica Group | 7666 | 9272 |
| | 745-763 | NP_001235027 | 351724922 | 1 | Glycine max | 7667 | 9273 |
| | | NP_001238461 | 351728042 | 0.9389 | Glycine max | 7668 | 9274 |
| | | NP_001235888 | 351727642 | 0.9389 | Glycine max | 7669 | 9275 |
| | | NP_001235511 | 351724120 | 0.9313 | Glycine max | 7670 | 9276 |
| | | ADD11814 | 289586041 | 0.8244 | Cajanus cajan | 7671 | 9277 |
| | | AAC49369 | 1420884 | 0.7939 | Phaseolus vulgaris | 7672 | 9278 |
| | 40-58 | ACU20629 | 255640688 | 1 | Glycine max | 7673 | 9279 |
| | 27-45 | ACU20555 | 255640539 | 1 | Glycine max | 7674 | 9280 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 19-37 | ACU23548 | 255646123 | 1 | Glycine max | 7675 | 9281 |
| | | Q96452 | | 0.9922 | Glycine max | 7676 | |
| | | NP_001235679 | 351721598 | 1 | Glycine max | 7677 | 9282 |
| | | ACU19187 | 255637728 | 0.9457 | Glycine max | 7678 | 9283 |
| | | ACU17765 | 255634808 | 0.8876 | Glycine max | 7679 | 9284 |
| | | XP_002523376 | 255761086 | 0.8411 | Ricinus communis | 7680 | |
| | | ACQ45020 | 228552591 | 0.845 | Cicer arietinum | 7681 | 9285 |
| | | XP_002285427 | 225461653 | 0.8256 | Vitis vinifera | 7682 | 9286 |
| | | P42654 | | 0.8372 | Vicia faba | 7683 | |
| | | XP_002316863 | 255761085 | 0.8333 | Populus trichocarpa | 7684 | |
| | 59-77 | ACU24228 | 255647528 | 1 | Glycine max | 7685 | 9287 |
| | | ACU18882 | 255637100 | 0.7652 | Glycine max | 7686 | 9288 |
| | | XP_002276186 | 225429425 | 0.7652 | Vitis vinifera | 7687 | 9289 |
| | | XP_002516481 | 255761086 | 0.7391 | Ricinus communis | 7688 | |
| | | XP_002324746 | 255761085 | 0.7304 | Populus trichocarpa | 7689 | |
| | | NP_565612 | 145360329 | 0.7217 | Arabidopsis thaliana | 7690 | 9290 |
| | | XP_002880724 | 297853636 | 0.7275 | Arabidopsis lyrata subsp. lyrata | 7691 | |
| | | XP_002281479 | 225442372 | 0.7362 | Vitis vinifera | 7692 | 9291 |
| | | ABB86253 | 82621129 | 0.7014 | Solanum tuberosum | 7693 | 9292 |
| | | CBI35995 | 270253379 | 0.7362 | Vitis vinifera | 7694 | |
| | 296-314 | NP_001237978 | 351721473 | 1 | Glycine max | 7695 | 9293 |
| | 59-77 | ACU18882 | 255637100 | 1 | Glycine max | 7696 | 9294 |
| | | ACU24228 | 255647528 | 0.9209 | Glycine max | 7697 | 9295 |
| | | NP_001031418 | 79323070 | 0.723 | Arabidopsis thaliana | 7698 | 9296 |
| | 204-222 | ACU20859 | 255641163 | 1 | Glycine max | 7699 | 9297 |
| | 91-109 | ACU15870 | 255631011 | 1 | Glycine max | 7700 | 9298 |
| | 390-408 | CAI43251 | 57283984 | 1 | Phaseolus vulgaris var. nanus | 7701 | 9299 |
| | | ABA86966 | 77540215 | 0.937 | Glycine max | 7702 | 9300 |
| | | NP_001237472 | 351721637 | 0.937 | Glycine max | 7703 | 9301 |
| | | ACU23435 | 255645890 | 0.9213 | Glycine max | 7704 | 9302 |
| | | XP_002283671 | 225434934 | 0.8228 | Vitis vinifera | 7705 | 9303 |
| | | ACJ11723 | 211906459 | 0.8386 | Gossypium hirsutum | 7706 | 9304 |
| | | ABA46792 | 76573374 | 0.8228 | Solanum tuberosum | 7707 | 9305 |
| | | XP_002299871 | 255761085 | 0.815 | Populus trichocarpa | 7708 | |
| | | CAN67342 | 147772559 | 0.815 | Vitis vinifera | 7709 | |
| | | XP_002876302 | 297853636 | 0.811 | Arabidopsis lyrata subsp. lyrata | 7710 | |
| | 61-79 | ACU17423 | 255634119 | 1 | Glycine max | 7711 | 9306 |
| | 140-158 | ABA86966 | 77540215 | 1 | Glycine max | 7712 | 9307 |
| | | CAI43251 | 57283984 | 0.9407 | Phaseolus vulgaris var. nanus | 7713 | 9308 |
| | | XP_002283693 | 225449540 | 0.8261 | Vitis vinifera | 7714 | 9309 |
| | 309-327 | AAV87173 | 56404220 | 1 | Phaseolus vulgaris | 7715 | 9310 |
| | | BAD97829 | 63002633 | 0.7487 | Prunus persica | 7716 | 9311 |
| ptc-miRf10522-akr | 79-98 | ACU20325 | 255640067 | 1 | Glycine max | 7717 | 9312 |
| | 321-340 | ADM32504 | 304421409 | 1 | Glycine max | 7718 | 9313 |
| | | CAD12837 | 18075959 | 0.8679 | Lupinus luteus | 7719 | 9314 |
| | | CBI27290 | 270239516 | 0.7896 | Vitis vinifera | 7720 | |
| | | XP_002316086 | 255761085 | 0.7847 | Populus trichocarpa | 7721 | |
| | | XP_002512077 | 255761086 | 0.7765 | Ricinus communis | 7722 | |
| | | CAD12836 | 18075957 | 0.7471 | Lupinus luteus | 7723 | 9315 |
| | | XP_002311341 | 255761085 | 0.7553 | Populus trichocarpa | 7724 | |
| | | NP_172830 | 145335664 | 0.7259 | Arabidopsis thaliana | 7725 | 9316 |
| | | XP_002892769 | 297853636 | 0.7243 | Arabidopsis lyrata subsp. lyrata | 7726 | |
| | 1811-1830 | NP_001237605 | 351725462 | 1 | Glycine max | 7727 | 9317 |
| | | NP_001235120 | 351727636 | 0.7738 | Glycine max | 7728 | 9318 |
| osa-miRf10362-akr | 663-683 | ACU20209 | 255639831 | 1 | Glycine max | 7729 | 9319 |
| | 309-329 | XP_002531192 | 255761086 | 1 | Ricinus communis | 7730 | |
| | | XP_002298817 | 255761085 | 0.7018 | Populus trichocarpa | 7731 | |
| | 415-435 | NP_001238595 | 351724492 | 1 | Glycine max | 7732 | 9320 |
| ath-miRf10702-akr | 261-280 | ACU23703 | 255646448 | 1 | Glycine max | 7733 | 9321 |
| | 328-347 | ABD28727 | 49405947 | 1 | Medicago truncatula | 7734 | |
| | | NP_001236252 | 351723348 | 0.9592 | Glycine max | 7735 | 9322 |
| | | NP_001236882 | 351726775 | 0.9456 | Glycine max | 7736 | 9323 |
| | | CAG14986 | 45720189 | 0.9184 | Cicer arietinum | 7737 | 9324 |
| | | XP_002268544 | 225442984 | 0.8844 | Vitis vinifera | 7738 | 9325 |
| | | XP_002517623 | 255761086 | 0.8912 | Ricinus communis | 7739 | |
| | | XP_002298252 | 255761085 | 0.8707 | Populus trichocarpa | 7740 | |
| | | NP_172989 | 145335736 | 0.8639 | Arabidopsis thaliana | 7741 | 9326 |
| | | EEC76567 | 54362548 | 0.8571 | Oryza sativa Indica Group | 7742 | |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | BAJ92153 | 326514005 | 0.8435 | *Hordeum vulgare* subsp. *vulgare* | 7743 | 9327 |
| | 690-709 | ACU24052 | 255647167 | 1 | *Glycine max* | 7744 | 9328 |
| | | NP_001237955 | 351720763 | 0.8561 | *Glycine max* | 7745 | 9329 |
| ath-miRf10148-akr | 343-362 | NP_001234975 | 351723428 | 1 | *Glycine max* | 7746 | 9330 |
| | | XP_002314377 | 255761085 | 0.8174 | *Populus trichocarpa* | 7747 | |
| | | XP_002270067 | 225431754 | 0.8119 | *Vitis vinifera* | 7748 | 9331 |
| | | CBI22983 | 270234210 | 0.8119 | *Vitis vinifera* | 7749 | |
| | | XP_002328602 | 255761085 | 0.7953 | *Populus trichocarpa* | 7750 | |
| | | BAG16526 | 171854672 | 0.7898 | *Capsicum chinense* | 7751 | 9332 |
| | | Q39659 | | 0.7621 | *Cucumis sativus* | 7752 | |
| | | NP_187342 | 145338207 | 0.7759 | *Arabidopsis thaliana* | 7753 | 9333 |
| | | XP_002882497 | 297853636 | 0.7718 | *Arabidopsis lyrata* subsp. *lyrata* | 7754 | |
| | | O49809 | | 0.7552 | *Brassica napus* | 7755 | |
| | 176-195 | NP_001235442 | 351722139 | 1 | *Glycine max* | 7756 | 9334 |
| | | NP_001236219 | 351722401 | 0.9712 | *Glycine max* | 7757 | 9335 |
| | | ABC46708 | 83776785 | 0.8417 | *Arachis hypogaea* | 7758 | 9336 |
| | | Q40519 | | 0.8201 | *Nicotiana tabacum* | 7759 | |
| | | NP_001234042 | 350537546 | 0.8273 | *Solanum lycopersicum* | 7760 | 9337 |
| | | P06183 | | 0.8201 | *Solanum tuberosum* | 7761 | |
| | | ADB93062 | 284520973 | 0.8273 | *Jatropha curcas* | 7762 | 9338 |
| | | CAA27989 | 21490 | 0.8058 | *Solanum tuberosum* | 7763 | 9339 |
| | | XP_002332206 | 255761085 | 0.7914 | *Populus trichocarpa* | 7764 | |
| | | ABK96223 | 118488825 | 0.7914 | *Populus trichocarpa* × *Populus deltoides* | 7765 | 9340 |
| | 80-99 | ACJ85304 | 217073887 | 1 | *Medicago truncatula* | 7766 | 9341 |
| | | ABF66654 | 120650107 | 0.9086 | *Ammopiptanthus mongolicus* | 7767 | 9342 |
| | | ACU19677 | 255638744 | 0.9213 | *Glycine max* | 7768 | 9343 |
| | | CBI18248 | 270229319 | 0.8807 | *Vitis vinifera* | 7769 | |
| | | XP_002530504 | 255761086 | 0.8858 | *Ricinus communis* | 7770 | |
| | | XP_002308228 | 255761085 | 0.8756 | *Populus trichocarpa* | 7771 | |
| | | XP_002262986 | 225439379 | 0.8807 | *Vitis vinifera* | 7772 | 9344 |
| | | ACU23134 | 255645273 | 0.8858 | *Glycine max* | 7773 | 9345 |
| | | ABJ97690 | 116292767 | 0.8503 | *Solanum tuberosum* | 7774 | 9346 |
| | | XP_002322994 | 255761085 | 0.7995 | *Populus trichocarpa* | 7775 | |
| | 488-507 | ACU23010 | 255645020 | 1 | *Glycine max* | 7776 | 9347 |
| | 989-1008 | XP_002314377 | 255761085 | 1 | *Populus trichocarpa* | 7777 | |
| | | NP_001234975 | 351723428 | 0.814 | *Glycine max* | 7778 | 9348 |
| | 82-101 | ABF66654 | 120650107 | 1 | *Ammopiptanthus mongolicus* | 7779 | 9349 |
| | | ACJ85304 | 217073887 | 0.9266 | *Medicago truncatula* | 7780 | 9350 |
| | 91-110 | ACU22749 | 255644490 | 1 | *Glycine max* | 7781 | 9351 |
| ath-miRf10451-akr | 256-277 | NP_001238139 | 351726107 | 1 | *Glycine max* | 7782 | 9352 |
| | | NP_001237827 | 351724486 | 0.9394 | *Glycine max* | 7783 | 9353 |
| | | NP_001237200 | 351721157 | 0.8838 | *Glycine max* | 7784 | 9354 |
| | | NP_001236083 | 351725850 | 0.8333 | *Glycine max* | 7785 | 9355 |
| | 143-164 | NP_001238139 | 351726107 | 1 | *Glycine max* | 7786 | 9356 |
| ath-miRf10751-akr | 188-207 | ACU18963 | 255637265 | 1 | *Glycine max* | 7787 | 9357 |
| | | ACU21242 | 255641949 | 0.7764 | *Glycine max* | 7788 | 9358 |
| | 23-42 | ACU20965 | 255641375 | 1 | *Glycine max* | 7789 | 9359 |
| | | XP_002301406 | 255761085 | 0.8099 | *Populus trichocarpa* | 7790 | |
| | | XP_002320196 | 255761085 | 0.7851 | *Populus trichocarpa* | 7791 | |
| | | XP_002281449 | 225454509 | 0.7879 | *Vitis vinifera* | 7792 | 9360 |
| | | NP_566074 | 145361064 | 0.7245 | *Arabidopsis thaliana* | 7793 | 9361 |
| | | XP_002880239 | 297853636 | 0.7245 | *Arabidopsis lyrata* subsp. *lyrata* | 7794 | |
| | | AAU93592 | 53793715 | 0.7135 | *Solanum demissum* | 7795 | 9362 |
| | | XP_002876635 | 297853636 | 0.719 | *Arabidopsis lyrata* subsp. *lyrata* | 7796 | |
| | | NP_191729 | 145339747 | 0.7107 | *Arabidopsis thaliana* | 7797 | 9363 |
| | 1857-1876 | XP_002525341 | 255761086 | 1 | *Ricinus communis* | 7798 | |
| | | XP_002326656 | 255761085 | 0.8901 | *Populus trichocarpa* | 7799 | |
| | | CAN79431 | 147866563 | 0.8524 | *Vitis vinifera* | 7800 | |
| | | NP_001235564 | 351725644 | 0.8599 | *Glycine max* | 7801 | 9364 |
| | | ADW84019 | 321438026 | 0.8419 | *Gossypium hirsutum* | 7802 | 9365 |
| | | XP_002303363 | 255761085 | 0.8584 | *Populus trichocarpa* | 7803 | |
| | | 2FON_A | | 0.8238 | *Solanum lycopersicum* | 7804 | |
| | | NP_001234198 | 350535510 | 0.8238 | *Solanum lycopersicum* | 7805 | 9366 |
| | | AAW78691 | 58531951 | 0.8223 | *Solanum cheesmaniae* | 7806 | |
| | | XP_002868103 | 297853636 | 0.8313 | *Arabidopsis lyrata* subsp. *lyrata* | 7807 | |
| | 738-757 | CAD31838 | 21068663 | 1 | *Cicer arietinum* | 7808 | 9367 |
| | | NP_001237954 | 351720733 | 0.9412 | *Glycine max* | 7809 | 9368 |
| | | ACU19740 | 255638874 | 0.9314 | *Glycine max* | 7810 | 9369 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | NP_001237941 | 351727802 | 0.9118 | Glycine max | 7811 | 9370 |
| | | XP_002518592 | 255761086 | 0.8824 | Ricinus communis | 7812 | |
| | | XP_002534445 | 255761086 | 0.8873 | Ricinus communis | 7813 | |
| | | AAD38143 | 5031274 | 0.8676 | Prunus armeniaca | 7814 | 9371 |
| | | XP_002283286 | 225461208 | 0.8627 | Vitis vinifera | 7815 | 9372 |
| | | ABN12320 | 124488471 | 0.848 | Gossypium hirsutum | 7816 | 9373 |
| | | XP_002867516 | 297853636 | 0.8578 | Arabidopsis lyrata subsp. lyrata | 7817 | |
| | 188-207 | ACU18963 | 255637265 | 1 | Glycine max | 7818 | 9374 |
| | 87-106 | ACU21242 | 255641949 | 1 | Glycine max | 7819 | 9375 |
| | | XP_002285386 | 225430399 | 0.7263 | Vitis vinifera | 7820 | 9376 |
| | | CBI21096 | 270231236 | 0.7263 | Vitis vinifera | 7821 | |
| | 387-406 | ABP88240 | 145652370 | 1 | Glycine max | 7822 | 9377 |
| ppt-miR1220a | 182-202 | ACU23202 | 255645411 | 1 | Glycine max | 7823 | 9378 |
| | | BAG06274 | 318612463 | 0.8691 | Vigna unguiculata | 7824 | 9379 |
| | | CBI31552 | 270244444 | 0.7404 | Vitis vinifera | 7825 | |
| | | XP_002280217 | 225449239 | 0.7404 | Vitis vinifera | 7826 | 9380 |
| | | XP_002316242 | 255761085 | 0.7652 | Populus trichocarpa | 7827 | |
| | | NP_181518 | 30688068 | 0.7111 | Arabidopsis thaliana | 7828 | 9381 |
| | | XP_002879830 | 297853636 | 0.7133 | Arabidopsis lyrata subsp. lyrata | 7829 | |
| | | AAM65420 | 21406633 | 0.7088 | Arabidopsis thaliana | 7830 | 9382 |
| | | NP_191133 | 42565959 | 0.7314 | Arabidopsis thaliana | 7831 | 9383 |
| | | XP_002876330 | 297853636 | 0.7246 | Arabidopsis lyrata subsp. lyrata | 7832 | |
| | 539-559 | NP_001234951 | 351722740 | 1 | Glycine max | 7833 | 9384 |
| | 182-202 | ACU23202 | 255645411 | 1 | Glycine max | 7834 | 9385 |
| | 233-253 | ACU22926 | 255644851 | 1 | Glycine max | 7835 | 9386 |
| | | ACU23107 | 255645218 | 0.8212 | Glycine max | 7836 | 9387 |
| | | ABU93486 | 156739649 | 0.7848 | Vigna angularis | 7837 | 9388 |
| | | ABK30788 | 116871383 | 0.745 | Litchi chinensis | 7838 | 9389 |
| | | AAK51119 | 14029148 | 0.7152 | Carica papaya | 7839 | 9390 |
| | | XP_002523709 | 255761086 | 0.7053 | Ricinus communis | 7840 | |
| | | CAA48324 | 311834 | 0.7119 | Tropaeolum majus | 7841 | 9391 |
| | | XP_002275862 | 225436483 | 0.7219 | Vitis vinifera | 7842 | 9392 |
| | | BAG06274 | 318612463 | 1 | Vigna unguiculata | 7843 | 9393 |
| ath-miRf10068-akr | 125-145 17-36 | ABY78023 | 166014266 | 1 | Glycine max | 7844 | 9394 |
| | | XP_002310310 | 255761085 | 0.815 | Populus trichocarpa | 7845 | |
| | | XP_002269295 | 225467972 | 0.7974 | Vitis vinifera | 7846 | 9395 |
| | | AAX47170 | 61611670 | 0.7665 | Pisum sativum | 7847 | 9396 |
| | | ACY82403 | 267850662 | 0.793 | Petunia x hybrida | 7848 | 9397 |
| | | CAG27846 | 83999599 | 0.7665 | Antirrhinum majus | 7849 | 9398 |
| | | CAL36572 | 113207064 | 0.7621 | Misopates orontium | 7850 | 9399 |
| | | ABD66219 | 122056646 | 0.7665 | Malus x domestica | 7851 | 9400 |
| | | AAF22455 | 6652755 | 0.7709 | Paulownia kawakamii | 7852 | 9401 |
| | | AAP40641 | 30983947 | 0.7533 | Eucalyptus occidentalis | 7853 | 9402 |
| | 816-835 | AEH04452 | 334813894 | 1 | Arachis hypogaea | 7854 | 9403 |
| | | XP_002512790 | 255761086 | 0.9358 | Ricinus communis | 7855 | |
| | | ACU21011 | 255641470 | 0.9309 | Glycine max | 7856 | 9404 |
| | | NP_001238484 | 351721287 | 0.9309 | Glycine max | 7857 | 9405 |
| | | P12858 | | 0.9185 | Pisum sativum | 7858 | |
| | | CAA33264 | 20728 | 0.916 | Pisum sativum | 7859 | 9406 |
| | | ACV32597 | 256862073 | 0.9185 | Medicago sativa | 7860 | 9407 |
| | | BAJ34149 | 312282566 | 0.8938 | Thellungiella halophila | 7861 | 9408 |
| | | ACT21568 | 251831337 | 0.8963 | Bruguiera gymnorhiza | 7862 | 9409 |
| | | ADX97321 | 323650480 | 0.9185 | Mangifera indica | 7863 | 9410 |
| | 898-917 | AEH04452 | 334813894 | 1 | Arachis hypogaea | 7864 | 9411 |
| | 121-140 | ABC68403 | 85001696 | 1 | Glycine max | 7865 | 9412 |
| | | XP_002275806 | 225426452 | 0.7992 | Vitis vinifera | 7866 | 9413 |
| | | CAN80040 | 147844259 | 0.7992 | Vitis vinifera | 7867 | 9414 |
| | | XP_002509820 | 255761086 | 0.803 | Ricinus communis | 7868 | |
| | | XP_002304502 | 255761085 | 0.7765 | Populus trichocarpa | 7869 | |
| | | AAZ39642 | 71726941 | 0.7708 | Petunia x hybrida | 7870 | 9415 |
| | | XP_002320802 | 255761085 | 0.7557 | Populus trichocarpa | 7871 | |
| | | XP_002275115 | 225454267 | 0.7614 | Vitis vinifera | 7872 | 9416 |
| | | CAN80156 | 147852118 | 0.7557 | Vitis vinifera | 7873 | 9417 |
| | | XP_002882043 | 297853636 | 0.75 | Arabidopsis lyrata subsp. lyrata | 7874 | |
| | 621-640 | NP_001238484 | 351721287 | 1 | Glycine max | 7875 | 9418 |
| | | AEH04452 | 334813894 | 0.9355 | Arachis hypogaea | 7876 | 9419 |
| | | ABK96233 | 118488846 | 0.8958 | Populus trichocarpa x Populus deltoides | 7877 | 9420 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 419-438 | ACU19391 | 255638154 | 1 | Glycine max | 7878 | 9421 |
| | 511-530 | CAC80373 | 18072796 | 1 | Capsicum annuum | 7879 | 9422 |
| | | CAC80372 | 18072794 | 0.9583 | Capsicum annuum | 7880 | 9423 |
| | | P09043 | | 0.9263 | Nicotiana tabacum | 7881 | |
| osa-miRf11352-akr | 56-78 | ACU19975 | 255639357 | 1 | Glycine max | 7882 | 9424 |
| | | ACU19227 | 255637811 | 0.9593 | Glycine max | 7883 | 9425 |
| | | ACU19215 | 255637786 | 0.7647 | Glycine max | 7884 | 9426 |
| | | XP_002513621 | 255761086 | 0.7059 | Ricinus communis | 7885 | |
| | | XP_002318354 | 255761085 | 0.724 | Populus trichocarpa | 7886 | |
| ath-miRf11021-akr | 134-154 | NP_001236767 | 351723442 | 1 | Glycine max | 7887 | 9427 |
| | 18-38 | ACJ84983 | 217073247 | 1 | Medicago truncatula | 7888 | 9428 |
| | | O48905 | | 0.991 | Medicago sativa | 7889 | |
| | | CAC10208 | 10334492 | 0.9639 | Cicer arietinum | 7890 | 9429 |
| | | NP_001236661 | 351727792 | 0.9518 | Glycine max | 7891 | 9430 |
| | | XP_002332745 | 255761085 | 0.9428 | Populus trichocarpa | 7892 | |
| | | XP_002533463 | 255761086 | 0.9398 | Ricinus communis | 7893 | |
| | | AEB60994 | 328908588 | 0.9488 | Lupinus angustifolius | 7894 | 9431 |
| | | XP_002312583 | 255761085 | 0.9367 | Populus trichocarpa | 7895 | |
| | | CAH58641 | 52851185 | 0.9247 | Plantago major | 7896 | 9432 |
| | | ABC01890 | 83283964 | 0.9337 | Solanum tuberosum | 7897 | 9433 |
| aly-miR831-5p | 234-256 | XP_002513787 | 255761086 | 1 | Ricinus communis | 7898 | |
| | | XP_002337051 | 255761085 | 0.7 | Populus trichocarpa | 7899 | |
| | | XP_002300997 | 255761085 | 0.7174 | Populus trichocarpa | 7900 | |
| far-miR1134 | 222-245 | ACF22880 | 193850552 | 1 | Glycine max | 7901 | 9434 |
| | | XP_002325840 | 255761085 | 0.7248 | Populus trichocarpa | 7902 | |
| | | XP_002281809 | 225441606 | 0.7202 | Vitis vinifera | 7903 | 9435 |
| | | ABK95741 | 118487835 | 0.7294 | Populus trichocarpa | 7904 | 9436 |
| | | XP_002319160 | 255761085 | 0.7248 | Populus trichocarpa | 7905 | |
| | | XP_002525421 | 255761086 | 0.7018 | Ricinus communis | 7906 | |
| | 48-71 | CAD31838 | 21068663 | 1 | Cicer arietinum | 7907 | 9437 |
| | | NP_001237954 | 351720733 | 0.9412 | Glycine max | 7908 | 9438 |
| | | ACU19740 | 255638874 | 0.9314 | Glycine max | 7909 | 9439 |
| | | NP_001237941 | 351727802 | 0.9118 | Glycine max | 7910 | 9440 |
| | | XP_002518592 | 255761086 | 0.8824 | Ricinus communis | 7911 | |
| | | XP_002534445 | 255761086 | 0.8873 | Ricinus communis | 7912 | |
| | | AAD38143 | 5031274 | 0.8676 | Prunus armeniaca | 7913 | 9441 |
| | | XP_002283286 | 225461208 | 0.8627 | Vitis vinifera | 7914 | 9442 |
| | | ABN12320 | 124488471 | 0.848 | Gossypium hirsutum | 7915 | 9443 |
| | | XP_002867516 | 297853636 | 0.8578 | Arabidopsis lyrata subsp. lyrata | 7916 | |
| | 39-62 | AAD49742 | 5733805 | 1 | Pisum sativum | 7917 | 9444 |
| | | AAM97354 | 22476945 | 0.9894 | Pisum sativum | 7918 | 9445 |
| | | AAD33959 | 4929351 | 0.9814 | Pisum sativum | 7919 | 9446 |
| | | ACU21225 | 255641912 | 0.9204 | Glycine max | 7920 | 9447 |
| | | XP_002313052 | 255761085 | 0.9072 | Populus trichocarpa | 7921 | |
| | | XP_002284375 | 225428500 | 0.8992 | Vitis vinifera | 7922 | 9448 |
| | | XP_002509478 | 255761086 | 0.8992 | Ricinus communis | 7923 | |
| | | XP_002306098 | 255761085 | 0.8992 | Populus trichocarpa | 7924 | |
| | | P93563 | | 0.8674 | Solanum tuberosum | 7925 | |
| | | P93397 | | 0.87 | Nicotiana tabacum | 7926 | |
| | 180-203 | ACC85689 | 186477889 | 1 | Medicago truncatula | 7927 | 9449 |
| | | NP_001235733 | 351734425 | 0.8957 | Glycine max | 7928 | 9450 |
| | | XP_002318640 | 255761085 | 0.872 | Populus trichocarpa | 7929 | |
| | | XP_002322155 | 255761085 | 0.8768 | Populus trichocarpa | 7930 | |
| | | AEQ62558 | 352740725 | 0.8815 | Aquilaria microcarpa | 7931 | 9451 |
| | | NP_001048088 | 115448616 | 0.8483 | Oryza sativa Japonica Group | 7932 | 9452 |
| | | NP_201093 | 186532680 | 0.8531 | Arabidopsis thaliana | 7933 | 9453 |
| | | NP_566897 | 30692961 | 0.8483 | Arabidopsis thaliana | 7934 | 9454 |
| | | CAD42725 | 27527522 | 0.8436 | Nicotiana tabacum | 7935 | 9455 |
| | | XP_002511439 | 255761086 | 0.8578 | Ricinus communis | 7936 | |
| | 819-842 | NP_001235100 | 351727055 | 1 | Glycine max | 7937 | 9456 |
| | | CBZ41765 | 323669526 | 0.8864 | Glycine max | 7938 | 9457 |
| | | CCD42020 | 347630190 | 0.8701 | Glycine max | 7939 | 9458 |
| | 180-203 | ACC85689 | 186477889 | 1 | Medicago truncatula | 7940 | 9459 |
| | 429-452 | NP_001238108 | 351725208 | 1 | Glycine max | 7941 | 9460 |
| | | NP_001238275 | 351722648 | 0.9264 | Glycine max | 7942 | 9461 |
| ath-miRf10687-akr | 1224-1244 | ACO48252 | 226320261 | 1 | Arachis hypogaea | 7943 | 9462 |
| | | NP_001237378 | 351726308 | 0.889 | Glycine max | 7944 | 9463 |
| | | ABR29877 | 149789411 | 0.8301 | Ricinus communis | 7945 | 9464 |
| | | XP_002280842 | 225423836 | 0.8205 | Vitis vinifera | 7946 | 9465 |
| | | CAN62388 | 147809569 | 0.8127 | Vitis vinifera | 7947 | |
| | | XP_002893416 | 297853636 | 0.7954 | Arabidopsis lyrata subsp. lyrata | 7948 | |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002888679 | 297853636 | 0.7597 | *Arabidopsis lyrata* subsp. *lyrata* | 7949 | |
| | | NP_177043 | 42563058 | 0.7558 | *Arabidopsis thaliana* | 7950 | 9466 |
| | | ACT54615 | 254032061 | 0.779 | *Brassica napus* | 7951 | 9467 |
| | | ACN39927 | 224284384 | 0.7413 | *Picea sitchensis* | 7952 | 9468 |
| | 735-755 | ACU24612 | 255648320 | 1 | *Glycine max* | 7953 | 9469 |
| | | ACU19270 | 255637904 | 0.771 | *Glycine max* | 7954 | 9470 |
| | | XP_002311695 | 255761085 | 0.7252 | *Populus trichocarpa* | 7955 | |
| | 585-605 | ACU18495 | 255636311 | 1 | *Glycine max* | 7956 | 9471 |
| | 1116-1136 | ACJ85683 | 217074645 | 1 | *Medicago truncatula* | 7957 | 9472 |
| | | NP_001235116 | 351727520 | 0.8244 | *Glycine max* | 7958 | 9473 |
| | | BAD81043 | 56744206 | 0.8189 | *Glycine max* | 7959 | 9474 |
| | | O82709 | | 0.8743 | *Pisum sativum* | 7960 | |
| | | AAK84429 | 31321895 | 0.7301 | *Brassica napus* | 7961 | 9475 |
| | | XP_002866454 | 297853636 | 0.7227 | *Arabidopsis lyrata* subsp. *lyrata* | 7962 | |
| | | NP_200987 | 145359541 | 0.7246 | *Arabidopsis thaliana* | 7963 | 9476 |
| | | XP_002511066 | 255761086 | 0.7301 | *Ricinus communis* | 7964 | |
| | | XP_002277666 | 225447724 | 0.7227 | *Vitis vinifera* | 7965 | 9477 |
| | | CAN83091 | 147858622 | 0.7227 | *Vitis vinifera* | 7966 | 9478 |
| | 363-383 | NP_001238368 | 351734499 | 1 | *Glycine max* | 7967 | 9479 |
| | 291-311 | NP_001237352 | 351734505 | 1 | *Glycine max* | 7968 | 9480 |
| | | AAC32262 | 3426303 | 0.7348 | *Pisum sativum* | 7969 | 9481 |
| | | NP_001238058 | 351723760 | 0.7652 | *Glycine max* | 7970 | 9482 |
| | | AAV28488 | 54042994 | 0.7099 | *Populus tremula* x *Populus alba* | 7971 | 9483 |
| | | XP_002518420 | 255761086 | 0.7155 | *Ricinus communis* | 7972 | |
| | | AAV49801 | 55276119 | 0.7127 | *Populus trichocarpa* x *Populus deltoides* | 7973 | 9484 |
| | | ABO33478 | 132424650 | 0.732 | *Medicago truncatula* | 7974 | 9485 |
| | | ADC35600 | 285804238 | 0.7155 | *Prunus persica* | 7975 | 9486 |
| | | AAG27464 | 11037019 | 0.7293 | *Medicago truncatula* | 7976 | 9487 |
| | | XP_002271944 | 225444459 | 0.7182 | *Vitis vinifera* | 7977 | 9488 |
| | 24-44 | XP_002509851 | 255761086 | 1 | *Ricinus communis* | 7978 | |
| | | XP_002304516 | 255761085 | 0.863 | *Populus trichocarpa* | 7979 | |
| | | XP_002298015 | 255761085 | 0.8527 | *Populus trichocarpa* | 7980 | |
| | | XP_002278860 | 225426165 | 0.8424 | *Vitis vinifera* | 7981 | 9489 |
| | | AAN65180 | 25052803 | 0.8346 | *Petroselinum crispum* | 7982 | 9490 |
| | | XP_002302599 | 255761085 | 0.832 | *Populus trichocarpa* | 7983 | |
| | | XP_002277669 | 225454333 | 0.8269 | *Vitis vinifera* | 7984 | 9491 |
| | | XP_002511904 | 255761086 | 0.8217 | *Ricinus communis* | 7985 | |
| | | ACU20804 | 255641048 | 0.8191 | *Glycine max* | 7986 | 9492 |
| | | Q40353 | | 0.801 | *Medicago sativa* | 7987 | |
| ath-miRf11037-akr | 93-113 | AEA92304 | 327505552 | 1 | *Hevea brasiliensis* | 7988 | 9493 |
| | | ADL59582 | 302595186 | 0.9815 | *Hevea brasiliensis* | 7989 | 9494 |
| | | XP_002284365 | 225435057 | 0.9213 | *Vitis vinifera* | 7990 | 9495 |
| | | CAN64127 | 147783306 | 0.9213 | *Vitis vinifera* | 7991 | 9496 |
| | | XP_002534292 | 255761086 | 0.9259 | *Ricinus communis* | 7992 | |
| | | BAB84326 | 18447920 | 0.9491 | *Nicotiana tabacum* | 7993 | 9497 |
| | | AEA92307 | 327505558 | 0.9213 | *Hevea brasiliensis* | 7994 | 9498 |
| | | BAB84324 | 18447916 | 0.912 | *Nicotiana tabacum* | 7995 | 9499 |
| | | XP_002284071 | 225449602 | 0.9167 | *Vitis vinifera* | 7996 | 9500 |
| | | ACU20932 | 255641309 | 0.9213 | *Glycine max* | 7997 | 9501 |
| mtr-miR2119 | 498-518 | ACJ84572 | 217072423 | 1 | *Medicago truncatula* | 7998 | 9502 |
| | | ACU20200 | 255639813 | 0.8895 | *Glycine max* | 7999 | 9503 |
| | | XP_002520842 | 255761086 | 0.8226 | *Ricinus communis* | 8000 | |
| | | CBI25388 | 270236032 | 0.8072 | *Vitis vinifera* | 8001 | 9504 |
| | | XP_002325811 | 255761085 | 0.8046 | *Populus trichocarpa* | 8002 | |
| | | Q42967 | | 0.7841 | *Nicotiana tabacum* | 8003 | |
| | | 1J93_A | | 0.7738 | *Nicotiana tabacum* | 8004 | |
| | | XP_002274385 | 225448634 | 0.7584 | *Vitis vinifera* | 8005 | 9505 |
| | | XP_002879873 | 297853636 | 0.7661 | *Arabidopsis lyrata* subsp. *lyrata* | 8006 | |
| | | NP_001050049 | 115452896 | 0.7506 | *Oryza sativa* Japonica Group | 8007 | 9506 |
| | 153-173 | CAA80691 | 452768 | 1 | *Phaseolus acutifolius* | 8008 | 9507 |
| | | CAA80692 | 452766 | 0.9974 | *Phaseolus acutifolius* | 8009 | 9508 |
| | | AAO72531 | 29373060 | 0.9421 | *Lotus corniculatus* | 8010 | 9509 |
| | | CAG30579 | 51587337 | 0.9395 | *Lotus japonicus* | 8011 | 9510 |
| | | P13603 | | 0.9237 | *Trifolium repens* | 8012 | |
| | | P12886 | | 0.9184 | *Pisum sativum* | 8013 | |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002309899 | 255761085 | 0.8868 | Populus trichocarpa | 8014 | |
| | | XP_002328464 | 255761085 | 0.8737 | Populus trichocarpa | 8015 | |
| | | ABK95643 | 118487635 | 0.8789 | Populus trichocarpa | 8016 | 9511 |
| | | XP_002309900 | 255761085 | 0.8763 | Populus trichocarpa | 8017 | |
| osa-miR2055 | 514-534 | ACU20018 | 255639446 | 1 | Glycine max | 8018 | 9512 |
| ptc-miRf10132-akr | 129-151 | XP_003527653 | 356517960 | 1 | Glycine max | 8019 | 9513 |
| | | XP_003523542 | 356509614 | 0.7828 | Glycine max | 8020 | 9514 |
| tae-miR2003 | 89-110 | ABC47858 | 83853825 | 1 | Glycine max | 8021 | 9515 |
| | 1828-1849 | ABC47841 | 83853806 | 1 | Glycine max | 8022 | 9516 |
| | | XP_002283105 | 225438780 | 0.7143 | Vitis vinifera | 8023 | 9517 |
| | | BAJ53195 | 317106690 | 0.7032 | Jatropha curcas | 8024 | |
| | | XP_002284923 | 225458677 | 0.746 | Vitis vinifera | 8025 | 9518 |
| | | BAJ53194 | 317106690 | 0.7095 | Jatropha curcas | 8026 | |
| | | XP_002301171 | 255761085 | 0.7524 | Populus trichocarpa | 8027 | |
| | | XP_002327166 | 255761085 | 0.746 | Populus trichocarpa | 8028 | |
| | | CBI19489 | 270252251 | 0.7397 | Vitis vinifera | 8029 | |
| | | XP_002510185 | 255761086 | 0.7111 | Ricinus communis | 8030 | |
| | | AAK30205 | 13560782 | 0.7016 | Daucus carota | 8031 | 9519 |
| osa-miRf11829-akr | 166-186 | AAA74456 | 500752 | 1 | Phaseolus vulgaris | 8032 | 9520 |
| | | XP_003529397 | 356521507 | 0.933 | Glycine max | 8033 | 9521 |
| | | XP_003518837 | 356500028 | 0.9175 | Glycine max | 8034 | 9522 |
| | | XP_003607969 | 357475366 | 0.8763 | Medicago truncatula | 8035 | 9523 |
| | | AAB50233 | 1906001 | 0.9021 | Glycine max | 8036 | 9524 |
| | | CAC06095 | 9968472 | 0.8797 | Lotus japonicus | 8037 | 9525 |
| | | ADJ68001 | 300119951 | 0.8488 | Gossypium hirsutum | 8038 | 9526 |
| | | XP_002518763 | 255761086 | 0.8265 | Ricinus communis | 8039 | |
| | | XP_002330328 | 255761085 | 0.8196 | Populus trichocarpa | 8040 | |
| | | ABK95605 | 118487556 | 0.8179 | Populus trichocarpa | 8041 | 9527 |
| | 134-154 | CBI32147 | 270260094 | 1 | Vitis vinifera | 8042 | 9528 |
| | | XP_002315592 | 255761085 | 0.8512 | Populus trichocarpa | 8043 | |
| | | XP_003556331 | 356576422 | 0.8095 | Glycine max | 8044 | 9529 |
| | | XP_002262666 | 225424668 | 0.9683 | Vitis vinifera | 8045 | 9530 |
| | | XP_002312609 | 255761085 | 0.8333 | Populus trichocarpa | 8046 | |
| | | XP_003536266 | 356535465 | 0.8036 | Glycine max | 8047 | 9531 |
| | | XP_003590703 | 357440850 | 0.8472 | Medicago truncatula | 8048 | 9532 |
| | | ADN33838 | 307135962 | 0.871 | Cucumis melo subsp. melo | 8049 | 9533 |
| | | ACF86937 | 194705705 | 0.756 | Zea mays | 8050 | 9534 |
| | | NP_001152185 | 226494944 | 0.7421 | Zea mays | 8051 | 9535 |
| | 345-365 | XP_003522862 | 356508229 | 1 | Glycine max | 8052 | 9536 |
| | | XP_003533465 | 356529778 | 0.9262 | Glycine max | 8053 | 9537 |
| | 302-322 | XP_003546711 | 356556804 | 1 | Glycine max | 8054 | 9538 |
| | | XP_003542817 | 356548860 | 0.9169 | Glycine max | 8055 | 9539 |
| | | XP_003627885 | 357515192 | 0.7569 | Medicago truncatula | 8056 | 9540 |
| | 236-256 | XP_003526444 | 356515512 | 1 | Glycine max | 8057 | |
| | | CBI20954 | 270231236 | 0.7572 | Vitis vinifera | 8058 | |
| | | XP_003603503 | 357466436 | 0.758 | Medicago truncatula | 8059 | |
| | | XP_002516594 | 255761086 | 0.7337 | Ricinus communis | 8060 | |
| | | XP_002308627 | 255761085 | 0.7281 | Populus trichocarpa | 8061 | |
| | | XP_002282016 | 225430126 | 0.756 | Vitis vinifera | 8062 | |
| | 564-584 | XP_002509464 | 255761086 | 1 | Ricinus communis | 8063 | |
| | | XP_002329785 | 255761085 | 0.8641 | Populus trichocarpa | 8064 | |
| | | XP_003543041 | 356549318 | 0.8345 | Glycine max | 8065 | 9541 |
| | | XP_002305792 | 255761085 | 0.8746 | Populus trichocarpa | 8066 | |
| | | XP_003545990 | 356555337 | 0.8537 | Glycine max | 8067 | 9542 |
| | | NP_193830 | 30685267 | 0.8084 | Arabidopsis thaliana | 8068 | 9543 |
| | | AAL38704 | 17528987 | 0.8066 | Arabidopsis thaliana | 8069 | 9544 |
| | | XP_002869916 | 297853636 | 0.8049 | Arabidopsis lyrata subsp. lyrata | 8070 | |
| | | ABF69959 | 102139737 | 0.7787 | Musa acuminata | 8071 | 9545 |
| | | XP_002863589 | 297853636 | 0.7805 | Arabidopsis lyrata subsp. lyrata | 8072 | |
| | 92-112 | AAT35563 | 47558925 | 1 | Phaseolus vulgaris | 8073 | 9546 |
| | | NP_001237920 | 351727189 | 0.8889 | Glycine max | 8074 | 9547 |
| | | XP_003556188 | 356576132 | 0.8468 | Glycine max | 8075 | 9548 |
| | | CAA06615 | 3413499 | 0.7387 | Pisum sativum | 8076 | 9549 |
| | 30-50 | XP_003530858 | 356524482 | 1 | Glycine max | 8077 | 9550 |
| | 123-143 | XP_003629209 | 357517840 | 1 | Medicago truncatula | 8078 | 9551 |
| | | XP_003520082 | 356502550 | 0.8531 | Glycine max | 8079 | 9552 |
| | | XP_003547906 | 356559235 | 0.8431 | Glycine max | 8080 | 9553 |
| | | CBI20672 | 270231236 | 0.7496 | Vitis vinifera | 8081 | |
| | | XP_002279909 | 225429561 | 0.7613 | Vitis vinifera | 8082 | 9554 |

TABLE 9-continued

Target Genes of upregulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002516094 | 255761086 | 0.7963 | Ricinus communis | 8083 | |
| | | BAK61816 | 343887266 | 0.7947 | Citrus unshiu | 8084 | 9555 |
| | | XP_002308543 | 255761085 | 0.7813 | Populus trichocarpa | 8085 | |
| | | XP_002873542 | 297853636 | 0.7496 | Arabidopsis lyrata subsp. lyrata | 8086 | |
| | | NP_568256 | 18416731 | 0.7379 | Arabidopsis thaliana | 8087 | 9556 |
| | 427-447 | ACI23460 | 207113464 | 1 | Glycine soja | 8088 | 9557 |
| | | XP_003544485 | 356552257 | 0.9828 | Glycine max | 8089 | 9558 |
| | | NP_001235613 | 351727089 | 0.8798 | Glycine max | 8090 | 9559 |
| | | ACU20715 | 255640864 | 0.8197 | Glycine max | 8091 | 9560 |
| | 212-232 | NP_001236871 | 351726450 | 1 | Glycine max | 8092 | 9561 |
| | | XP_003523441 | 356509406 | 0.9197 | Glycine max | 8093 | 9562 |
| | | ACS94038 | 242877144 | 0.8294 | Cicer arietinum | 8094 | 9563 |
| | | XP_003602038 | 357463512 | 0.8261 | Medicago truncatula | 8095 | 9564 |
| | | ACD39411 | 187940570 | 0.7759 | Arachis hypogaea | 8096 | 9565 |
| | | AER45736 | 354992034 | 0.786 | Medicago sativa | 8097 | 9566 |
| | | XP_002520341 | 255761086 | 0.7425 | Ricinus communis | 8098 | |
| | | AEF80001 | 333696915 | 0.7258 | Corylus heterophylla | 8099 | 9567 |
| | | ACI15342 | 206584338 | 0.7324 | Gossypium hirsutum | 8100 | 9568 |
| | | ADL36795 | 302399000 | 0.7492 | Malus x domestica | 8101 | 9569 |
| | 616-636 | XP_003534059 | 356530984 | 1 | Glycine max | 8102 | 9570 |
| | | XP_003548267 | 356559966 | 0.8665 | Glycine max | 8103 | 9571 |
| | | XP_003619718 | 357498858 | 0.7211 | Medicago truncatula | 8104 | 9572 |
| | 118-138 | XP_003589961 | 357439368 | 1 | Medicago truncatula | 8105 | 9573 |
| | | XP_003535239 | 356533372 | 0.8081 | Glycine max | 8106 | 9574 |
| | | XP_003519713 | 356501802 | 0.8046 | Glycine max | 8107 | 9575 |
| | | XP_002514955 | 255761086 | 0.7729 | Ricinus communis | 8108 | |
| | | XP_002315622 | 255761085 | 0.7817 | Populus trichocarpa | 8109 | |
| | | CAA58823 | 639833 | 0.7676 | Solanum tuberosum | 8110 | 9576 |
| | | NP_001148767 | 226532264 | 0.7588 | Zea mays | 8111 | 9577 |
| | | XP_003557368 | 357111130 | 0.7588 | Brachypodium distachyon | 8112 | 9578 |
| | | BAJ94094 | 326490040 | 0.7711 | Hordeum vulgare subsp. vulgare | 8113 | 9579 |
| | | NP_196470 | 145357793 | 0.7835 | Arabidopsis thaliana | 8114 | 9580 |
| | 92-112 | XP_003597553 | 357454544 | 1 | Medicago truncatula | 8115 | 9581 |
| | | XP_003542066 | 356547327 | 0.8553 | Glycine max | 8116 | 9582 |
| | | XP_003546745 | 356556873 | 0.8496 | Glycine max | 8117 | 9583 |
| | | XP_002514088 | 255761086 | 0.8177 | Ricinus communis | 8118 | |
| | | Q9MT28 | | 0.7857 | Solanum tuberosum | 8119 | |
| | | XP_002285366 | 225430389 | 0.8233 | Vitis vinifera | 8120 | 9584 |
| | | NP_194713 | 145349228 | 0.7989 | Arabidopsis thaliana | 8121 | 9585 |
| | | AAB04607 | 1448916 | 0.7989 | Arabidopsis thaliana | 8122 | 9586 |
| | | XP_002867385 | 297853636 | 0.7989 | Arabidopsis lyrata subsp. lyrata | 8123 | |
| | | 2C2B_A | | 0.7763 | Arabidopsis thaliana | 8124 | |
| | 135-155 | XP_003541398 | 356545954 | 1 | Glycine max | 8125 | 9587 |
| | 142-162 | AAB50233 | 1906001 | 1 | Glycine max | 8126 | 9588 |
| | | P38500 | | 0.8037 | Betula pendula | 8127 | |
| | 123-143 | XP_003547906 | 356559235 | 1 | Glycine max | 8128 | 9589 |
| | | XP_003629209 | 357517840 | 0.8837 | Medicago truncatula | 8129 | 9590 |

TABLE 10

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| aly-miR160c-3p | 116-136 | XP_003531153 | 356525075 | 1 | Glycine max | 9591 | 10365 |
| | | XP_003524859 | 356512301 | 0.936170213 | Glycine max | 9592 | 10366 |
| | | ABO61516 | 134142361 | 0.932301741 | Glycine max | 9593 | 10367 |
| | | BAF62636 | 148189857 | 0.868471954 | Phaseolus vulgaris | 9594 | 10368 |
| | | ABI34432 | 113206403 | 0.785299807 | Pisum sativum | 9595 | 10369 |
| | | XP_002312450 | 255761085 | 0.767891683 | Populus trichocarpa | 9596 | |
| | | XP_002284648 | 225424290 | 0.735009671 | Vitis vinifera | 9597 | 10370 |
| | | BAG16374 | 171702836 | 0.721470019 | Brassica oleracea var. italica | 9598 | 10371 |
| | | AEK06229 | 339779228 | 0.733075435 | Vitis vinifera | 9599 | 10372 |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| bdi-miR2508 | 699-720 | XP_003600994 | 357461424 | 1 | Medicago truncatula | 9600 | 10373 |
| | | XP_003538485 | 356540010 | 0.862608696 | Glycine max | 9601 | 10374 |
| | | NP_001236616 | 351726477 | 0.850434783 | Glycine max | 9602 | 10375 |
| | | XP_003519418 | 356501206 | 0.810434783 | Glycine max | 9603 | 10376 |
| | | XP_003544045 | 356551362 | 0.812173913 | Glycine max | 9604 | 10377 |
| | | XP_003616702 | 357492826 | 0.803478261 | Medicago truncatula | 9605 | 10378 |
| | | XP_002520796 | 255761086 | 0.76 | Ricinus communis | 9606 | |
| | | XP_002315131 | 255761085 | 0.766956522 | Populus trichocarpa | 9607 | |
| | | ABK92474 | 118481040 | 0.768695652 | Populus trichocarpa | 9608 | 10379 |
| | | XP_002312186 | 255761085 | 0.765217391 | Populus trichocarpa | 9609 | |
| | 719-740 | XP_003520941 | 356504312 | 1 | Glycine max | 9610 | 10380 |
| | | XP_003520942 | 356504314 | 0.820557491 | Glycine max | 9611 | 10381 |
| | | XP_003516921 | 356496125 | 0.740418118 | Glycine max | 9612 | 10382 |
| | 73-94 | XP_003540719 | 356544563 | 1 | Glycine max | 9613 | 10383 |
| | | XP_003539077 | 356541217 | 0.940068493 | Glycine max | 9614 | 10384 |
| | | XP_003606701 | 357472832 | 0.821917808 | Medicago truncatula | 9615 | 10385 |
| | | CBI16224 | 270227042 | 0.741438356 | Vitis vinifera | 9616 | |
| | | CAN60348 | 147789065 | 0.731164384 | Vitis vinifera | 9617 | 10386 |
| | | XP_003313424 | 255761085 | 0.75 | Populus trichocarpa | 9618 | |
| | | XP_002284473 | 225435091 | 0.729452055 | Vitis vinifera | 9619 | 10387 |
| | | XP_002278215 | 225449449 | 0.731164384 | Vitis vinifera | 9620 | 10388 |
| | | CBI16199 | 270227042 | 0.724315068 | Vitis vinifera | 9621 | |
| | 651-672 | XP_003516921 | 356496125 | 1 | Glycine max | 9622 | 10389 |
| | | XP_003520941 | 356504312 | 0.75308642 | Glycine max | 9623 | 10390 |
| | 77-98 | XP_003522150 | 356506771 | 1 | Glycine max | 9624 | 10391 |
| | | XP_003516941 | 356496165 | 0.967684022 | Glycine max | 9625 | 10392 |
| | | XP_003604619 | 357468668 | 0.845601436 | Medicago truncatula | 9626 | 10393 |
| | | XP_002322961 | 255761085 | 0.782764811 | Populus trichocarpa | 9627 | |
| | | XP_002533894 | 255761086 | 0.763016158 | Ricinus communis | 9628 | |
| | | XP_002278638 | 225440625 | 0.782764811 | Vitis vinifera | 9629 | 10394 |
| | | XP_002322962 | 255761085 | 0.777378815 | Populus trichocarpa | 9630 | |
| | | XP_002308209 | 255761085 | 0.771992819 | Populus trichocarpa | 9631 | |
| | | XP_003552227 | 356568050 | 0.822262118 | Glycine max | 9632 | 10395 |
| | | AAC49536 | 1685086 | 0.755834829 | Nicotiana tabacum | 9633 | 10396 |
| | 86-107 | CAN73336 | 147800866 | 1 | Vitis vinifera | 9634 | |
| | | XP_002282815 | 225449411 | 0.990859232 | Vitis vinifera | 9635 | 10397 |
| | | XP_002282823 | 225449413 | 0.946983547 | Vitis vinifera | 9636 | 10398 |
| | | XP_002278232 | 225449451 | 0.936014625 | Vitis vinifera | 9637 | 10399 |
| | | CAN60069 | 147779995 | 0.92321755 | Vitis vinifera | 9638 | |
| | | CAN72263 | 147821463 | 0.92321755 | Vitis vinifera | 9639 | 10400 |
| | | XP_002278275 | 225449453 | 0.91773309 | Vitis vinifera | 9640 | 10401 |
| | 585-606 | XP_003516921 | 356496125 | 1 | Glycine max | 9641 | 10402 |
| | 549-570 | XP_003606701 | 357472832 | 1 | Medicago truncatula | 9642 | 10403 |
| | | XP_003540719 | 356544563 | 0.839316239 | Glycine max | 9643 | 10404 |
| | | XP_003623041 | 357505504 | 0.733333333 | Medicago truncatula | 9644 | 10405 |
| | | XP_003551448 | 356566457 | 0.714529915 | Glycine max | 9645 | 10406 |
| | | XP_003532315 | 356527432 | 0.712820513 | Glycine max | 9646 | 10407 |
| | 164-185 | XP_003529133 | 356520972 | 1 | Glycine max | 9647 | 10408 |
| | | XP_003552215 | 356568025 | 0.954385965 | Glycine max | 9648 | 10409 |
| | | XP_003529131 | 356520968 | 0.722807018 | Glycine max | 9649 | 10410 |
| | | ABC59623 | 84626065 | 0.721052632 | Pisum sativum | 9650 | 10411 |
| | 3846-3867 | XP_003551446 | 356566453 | 1 | Glycine max | 9651 | |
| | 699-720 | XP_003600994 | 357461424 | 1 | Medicago truncatula | 9652 | 10412 |
| | 261-282 | XP_003520941 | 356504312 | 1 | Glycine max | 9653 | 10413 |
| | 576-597 | XP_003604619 | 357468668 | 1 | Medicago truncatula | 9654 | 10414 |
| | | XP_003522150 | 356506771 | 0.845601436 | Glycine max | 9655 | 10415 |
| | | XP_002308208 | 255761085 | 0.777378815 | Populus trichocarpa | 9656 | |
| | 0-21 | XP_003516941 | 356496165 | 1 | Glycine max | 9657 | 10416 |
| | 645-666 | CBI16199 | 270227042 | 1 | Vitis vinifera | 9658 | |
| | | CAN80346 | 147858024 | 0.924028269 | Vitis vinifera | 9659 | 10417 |
| | | XP_003552160 | 356567914 | 0.85335689 | Glycine max | 9660 | 10418 |
| | | XP_002329138 | 255761085 | 0.846289753 | Populus trichocarpa | 9661 | |
| | | XP_002299296 | 255761085 | 0.85335689 | Populus trichocarpa | 9662 | |
| | | XP_002531824 | 255761086 | 0.848056537 | Ricinus communis | 9663 | |
| | 690-711 | XP_003530212 | 356523164 | 1 | Glycine max | 9664 | 10419 |
| | | XP_003551482 | 356566526 | 0.955094991 | Glycine max | 9665 | 10420 |
| | | XP_002308164 | 255761085 | 0.778929188 | Populus trichocarpa | 9666 | |
| | | XP_002531565 | 255761086 | 0.772020725 | Ricinus communis | 9667 | |
| | | CAA74105 | 3805963 | 0.773747841 | Populus trichocarpa | 9668 | 10421 |
| | | XP_002300066 | 255761085 | 0.730569948 | Populus trichocarpa | 9669 | |
| | 681-702 | XP_003530213 | 356523166 | 1 | Glycine max | 9670 | 10422 |
| | | XP_003552179 | 356567952 | 0.915447154 | Glycine max | 9671 | 10423 |
| | | XP_003532290 | 356527381 | 0.765853659 | Glycine max | 9672 | 10424 |
| | | XP_002309069 | 255761085 | 0.733333333 | Populus trichocarpa | 9673 | |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002531562 | 255761086 | 0.726829268 | Ricinus communis | 9674 | |
| | | XP_002271006 | 225440401 | 0.713821138 | Vitis vinifera | 9675 | 10425 |
| | | XP_002268628 | 225440403 | 0.713821138 | Vitis vinifera | 9676 | 10426 |
| | | XP_002269038 | 225440405 | 0.707317073 | Vitis vinifera | 9677 | 10427 |
| | | CBI30529 | 270242856 | 0.704065041 | Vitis vinifera | 9678 | |
| | 651-672 | XP_003551482 | 356566526 | 1 | Glycine max | 9679 | 10428 |
| | | XP_003530212 | 356523164 | 0.960069444 | Glycine max | 9680 | 10429 |
| | 666-687 | XP_003539958 | 356543013 | 1 | Glycine max | 9681 | 10430 |
| | | XP_003551299 | 356566152 | 0.941605839 | Glycine max | 9682 | 10431 |
| | | XP_003518300 | 356498931 | 0.879562044 | Glycine max | 9683 | 10432 |
| | | XP_003544873 | 356553053 | 0.881386861 | Glycine max | 9684 | 10433 |
| | | XP_003615575 | 357490574 | 0.855839416 | Medicago truncatula | 9685 | 10434 |
| | | XP_002520425 | 255761086 | 0.822992701 | Ricinus communis | 9686 | |
| | | XP_002314124 | 255761085 | 0.812043796 | Populus trichocarpa | 9687 | |
| | | XP_002299828 | 255761085 | 0.813868613 | Populus trichocarpa | 9688 | |
| | | XP_002280416 | 225434677 | 0.79379562 | Vitis vinifera | 9689 | 10435 |
| | 86-107 | CAN73336 | 147800866 | 1 | Vitis vinifera | 9690 | |
| | 121-142 | XP_003615575 | 357490574 | 1 | Medicago truncatula | 9691 | 10436 |
| | | XP_003539958 | 356543013 | 0.777403035 | Glycine max | 9692 | 10437 |
| | 1113-1134 | XP_003548937 | 356561332 | 1 | Glycine max | 9693 | 10438 |
| | | XP_003519950 | 356502284 | 0.814741036 | Glycine max | 9694 | 10439 |
| | | XP_002319173 | 255761085 | 0.802788845 | Populus trichocarpa | 9695 | |
| | | XP_002325825 | 255761085 | 0.794820717 | Populus trichocarpa | 9696 | |
| | | CAN70030 | 147821579 | 0.790836653 | Vitis vinifera | 9697 | 10440 |
| | | XP_002525455 | 255761086 | 0.778884462 | Ricinus communis | 9698 | |
| | | XP_002304847 | 255761085 | 0.780876494 | Populus trichocarpa | 9699 | |
| | | XP_003625586 | 357510594 | 0.784860558 | Medicago truncatula | 9700 | 10441 |
| | | XP_003607828 | 357475084 | 0.778884462 | Medicago truncatula | 9701 | 10442 |
| | | XP_002523396 | 255761086 | 0.782868526 | Ricinus communis | 9702 | |
| | 633-654 | XP_003551299 | 356566152 | 1 | Glycine max | 9703 | 10443 |
| | 1051-1072 | XP_003520176 | 356502743 | 1 | Glycine max | 9704 | 10444 |
| | | XP_003528495 | 356519673 | 0.93444227 | Glycine max | 9705 | 10445 |
| | | XP_003608057 | 357475542 | 0.777886497 | Medicago truncatula | 9706 | 10446 |
| | 636-657 | XP_003552213 | 356568021 | 1 | Glycine max | 9707 | 10447 |
| | | XP_003529132 | 356520970 | 0.732517483 | Glycine max | 9708 | 10448 |
| | | XP_003552214 | 356568023 | 0.723776224 | Glycine max | 9709 | 10449 |
| | | XP_003529133 | 356520972 | 0.708041958 | Glycine max | 9710 | 10450 |
| | 666-687 | XP_003544873 | 356553053 | 1 | Glycine max | 9711 | 10451 |
| | 666-687 | XP_003552227 | 356568050 | 1 | Glycine max | 9712 | 10452 |
| | 777-798 | XP_003529132 | 356520970 | 1 | Glycine max | 9713 | 10453 |
| | | XP_003552213 | 356568021 | 0.708551483 | Glycine max | 9714 | 10454 |
| | 654-675 | XP_003552215 | 356568025 | 1 | Glycine max | 9715 | 10455 |
| | 660-681 | XP_003529131 | 356520968 | 1 | Glycine max | 9716 | 10456 |
| | 636-657 | XP_003539077 | 356541217 | 1 | Glycine max | 9717 | 10457 |
| | | XP_003551449 | 356566459 | 0.712328767 | Glycine max | 9718 | 10458 |
| | 693-714 | XP_003538485 | 356540010 | 1 | Glycine max | 9719 | 10459 |
| | | CBI25418 | 270236032 | 0.785349233 | Vitis vinifera | 9720 | 10460 |
| | 567-588 | XP_003552179 | 356567952 | 1 | Glycine max | 9721 | 10461 |
| | | XP_003530213 | 356523166 | 0.964041096 | Glycine max | 9722 | 10462 |
| gma-miR2119 | 138-158 | XP_003527195 | 356517033 | 1 | Glycine max | 9723 | 10463 |
| | | XP_003527162 | 356516966 | 0.885620915 | Glycine max | 9724 | 10464 |
| | | XP_003527196 | 356517035 | 0.866013072 | Glycine max | 9725 | 10465 |
| | | XP_003522929 | 356508367 | 0.81372549 | Glycine max | 9726 | 10466 |
| | | XP_003522930 | 356508369 | 0.839869281 | Glycine max | 9727 | 10467 |
| | | ACU24029 | 255647121 | 0.833333333 | Glycine max | 9728 | 10468 |
| | 157-177 | XP_003542005 | 356547201 | 1 | Glycine max | 9729 | 10469 |
| | | ACU18712 | 255636755 | 0.994722955 | Glycine max | 9730 | 10470 |
| | | XP_003545664 | 356554663 | 0.939313984 | Glycine max | 9731 | 10471 |
| | | AAN03476 | 22597177 | 0.936675462 | Glycine max | 9732 | 10472 |
| | | XP_003544738 | 356552774 | 0.802110818 | Glycine max | 9733 | 10473 |
| | | AAO72531 | 29373060 | 0.807387863 | Lotus corniculatus | 9734 | 10474 |
| | | CAA80691 | 452768 | 0.799472296 | Phaseolus acutifolius | 9735 | 10475 |
| | | CAG30579 | 51587337 | 0.80474934 | Lotus japonicus | 9736 | 10476 |
| | | AET21261 | 356582741 | 0.802110818 | Lotus japonicus | 9737 | 10477 |
| | | P13603 | | 0.799472296 | Trifolium repens | 9738 | |
| | 526-546 | XP_003521584 | 356505611 | 1 | Glycine max | 9739 | 10478 |
| | | XP_003554536 | 356572764 | 0.971098266 | Glycine max | 9740 | 10479 |
| | | XP_003536003 | 356534928 | 0.809248555 | Glycine max | 9741 | 10480 |
| | | XP_003518934 | 356500225 | 0.800578035 | Glycine max | 9742 | 10481 |
| | | XP_002302739 | 255761085 | 0.789017341 | Populus trichocarpa | 9743 | |
| | | XP_002320324 | 255761085 | 0.777456647 | Populus trichocarpa | 9744 | |
| | | NP_191825 | 145339785 | 0.757225434 | Arabidopsis thaliana | 9745 | 10482 |
| | | XP_002876684 | 297853636 | 0.757225434 | Arabidopsis lyrata subsp. lyrata | 9746 | |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002872855 | 297853636 | 0.760115607 | Arabidopsis lyrata subsp. lyrata | 9747 | |
| | | CAB83116 | 7362737 | 0.748554913 | Arabidopsis thaliana | 9748 | 10483 |
| | 2061-2081 | XP_003524240 | 356511040 | 1 | Glycine max | 9749 | 10484 |
| | | XP_003532800 | 356528417 | 0.955097087 | Glycine max | 9750 | 10485 |
| | | XP_003630005 | 357519432 | 0.82038835 | Medicago truncatula | 9751 | 10486 |
| | | XP_002317684 | 255761085 | 0.770631068 | Populus trichocarpa | 9752 | |
| | | XP_002332198 | 255761085 | 0.766990291 | Populus trichocarpa | 9753 | |
| | | XP_003533825 | 356530512 | 0.769417476 | Glycine max | 9754 | 10487 |
| | | XP_003547559 | 356558531 | 0.764563107 | Glycine max | 9755 | 10488 |
| | | XP_002271023 | 225444212 | 0.751213592 | Vitis vinifera | 9756 | 10489 |
| | 399-419 | XP_003539263 | 356541601 | 1 | Glycine max | 9757 | 10490 |
| | | XP_003517354 | 356497002 | 0.913716814 | Glycine max | 9758 | 10491 |
| | | XP_003611556 | 357482538 | 0.767699115 | Medicago truncatula | 9759 | 10492 |
| | | CAI79403 | 62700758 | 0.71460177 | Senna occidentalis | 9760 | 10493 |
| | 265-285 | XP_003554536 | 356572764 | 1 | Glycine max | 9761 | 10494 |
| | | XP_003521584 | 356505611 | 0.971098266 | Glycine max | 9762 | 10495 |
| | | XP_003625940 | 357511302 | 0.75433526 | Medicago truncatula | 9763 | 10496 |
| | 159-179 | XP_003545664 | 356554663 | 1 | Glycine max | 9764 | 10497 |
| | | XP_003542005 | 356547201 | 0.959568733 | Glycine max | 9765 | 10498 |
| | | P12886 | | 0.789757412 | Pisum sativum | 9766 | |
| | 360-380 | AAO83155 | 29365515 | 1 | Phaseolus vulgaris | 9767 | 10499 |
| | | XP_003534097 | 356531061 | 0.870201097 | Glycine max | 9768 | 10500 |
| | | XP_003548308 | 356560048 | 0.886654479 | Glycine max | 9769 | 10501 |
| | 2055-2075 | XP_003532800 | 356528417 | 1 | Glycine max | 9770 | 10502 |
| | | XP_003524240 | 356511040 | 0.955097087 | Glycine max | 9771 | 10503 |
| | 2157-2177 | XP_003547559 | 356558531 | 1 | Glycine max | 9772 | 10504 |
| | 174-194 | XP_003517354 | 356497002 | 1 | Glycine max | 9773 | 10505 |
| | | XP_003539263 | 356541601 | 0.919821826 | Glycine max | 9774 | 10506 |
| gso-miR482a | 22-42 | AAU95080 | 53830374 | 1 | Glycine max | 9775 | 10507 |
| | 22-42 | AAF44087 | 7263110 | 1 | Glycine max | 9776 | 10508 |
| | | AAX81296 | 62361234 | 0.714285714 | Arachis hypogaea | 9777 | 10509 |
| | 1195-1215 | NP_001237600 | 351725318 | 1 | Glycine max | 9778 | 10510 |
| | | XP_003556265 | 356576288 | 0.891737892 | Glycine max | 9779 | 10511 |
| | | XP_003591822 | 357443088 | 0.811965812 | Medicago truncatula | 9780 | 10512 |
| | | ACI46678 | 209419748 | 0.811965812 | Galega orientalis | 9781 | 10513 |
| | | XP_003518682 | 356499714 | 0.740740741 | Glycine max | 9782 | 10514 |
| | | XP_003516851 | 356495985 | 0.752136752 | Glycine max | 9783 | 10515 |
| | | XP_003614455 | 357488334 | 0.732193732 | Medicago truncatula | 9784 | 10516 |
| | 503-523 | XP_003533606 | 356530067 | 1 | Glycine max | 9785 | 10517 |
| | 59-79 | XP_003518623 | 356499593 | 1 | Glycine max | 9786 | 10518 |
| | | XP_003591325 | 357442094 | 0.832673267 | Medicago truncatula | 9787 | 10519 |
| | | XP_003626036 | 357511494 | 0.751485149 | Medicago truncatula | 9788 | 10520 |
| | | XP_002515202 | 255761086 | 0.7 | Ricinus communis | 9789 | |
| | 22-42 | AAF44087 | 7263110 | 1 | Glycine max | 9790 | 10521 |
| osa-miR162a | 342-362 | XP_003590416 | 357440276 | 1 | Medicago truncatula | 9791 | 10522 |
| | | XP_003554409 | 356572505 | 0.775075988 | Glycine max | 9792 | 10523 |
| | | XP_003521428 | 356505296 | 0.767477204 | Glycine max | 9793 | 10524 |
| | | XP_003625731 | 357510884 | 0.770516717 | Medicago truncatula | 9794 | 10525 |
| | | XP_002264567 | 225441081 | 0.734042553 | Vitis vinifera | 9795 | 10526 |
| | | XP_003541439 | 356546037 | 0.759878419 | Glycine max | 9796 | 10527 |
| | | CAN74141 | 147838148 | 0.705167173 | Vitis vinifera | 9797 | |
| | | XP_002519415 | 255761086 | 0.703647416 | Ricinus communis | 9798 | |
| | 619-639 | XP_003528812 | 356520321 | 1 | Glycine max | 9799 | 10528 |
| | | XP_003528810 | 356520317 | 0.979865772 | Glycine max | 9800 | 10529 |
| | | XP_003548576 | 356560594 | 0.976510067 | Glycine max | 9801 | 10530 |
| | | XP_003543259 | 356549760 | 0.963087248 | Glycine max | 9802 | 10531 |
| | | XP_003543258 | 356549758 | 0.959731544 | Glycine max | 9803 | 10532 |
| | | ACU23594 | 255646218 | 0.966442953 | Glycine max | 9804 | 10533 |
| | | ACJ85054 | 217073389 | 0.89261745 | Medicago truncatula | 9805 | 10534 |
| | | XP_002329431 | 255761085 | 0.879194631 | Populus trichocarpa | 9806 | |
| | | XP_003604056 | 357467542 | 0.848993289 | Medicago truncatula | 9807 | 10535 |
| | | XP_002524558 | 255761086 | 0.82885906 | Ricinus communis | 9808 | |
| | 585-605 | XP_003543259 | 356549760 | 1 | Glycine max | 9809 | 10536 |
| | | XP_003528812 | 356520321 | 0.963087248 | Glycine max | 9810 | 10537 |
| | | XP_002330691 | 255761085 | 0.859060403 | Populus trichocarpa | 9811 | |
| | 1037-1057 | XP_002311013 | 255761085 | 1 | Populus trichocarpa | 9812 | |
| | | XP_002315438 | 255761085 | 0.935779817 | Populus trichocarpa | 9813 | |
| | | XP_002521182 | 255761086 | 0.862385321 | Ricinus communis | 9814 | |
| | | XP_003536707 | 356536360 | 0.834862385 | Glycine max | 9815 | 10538 |
| | | XP_003555872 | 356575487 | 0.830275229 | Glycine max | 9816 | 10539 |
| | | XP_002268975 | 225450253 | 0.811926606 | Vitis vinifera | 9817 | 10540 |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 144-164 | XP_003548576 | 356560594 | 1 | *Glycine max* | 9818 | 10541 |
| | 63-83 | XP_003528812 | 356520321 | 1 | *Glycine max* | 9819 | 10542 |
| | 217-237 | NP_001237819 | 351724250 | 1 | *Glycine max* | 9820 | 10543 |
| | | NP_001238239 | 351721616 | 0.964285714 | *Glycine max* | 9821 | 10544 |
| | | ACF06595 | 192912973 | 0.898809524 | *Elaeis guineensis* | 9822 | 10545 |
| | | Q5J907 | | 0.892857143 | *Elaeis guineensis* | 9823 | |
| | | ACF06596 | 192912975 | 0.904761905 | *Elaeis guineensis* | 9824 | 10546 |
| | | ACF06557 | 192910897 | 0.875 | *Elaeis guineensis* | 9825 | 10547 |
| | | XP_003577266 | 357155873 | 0.845238095 | *Brachypodium distachyon* | 9826 | 10548 |
| | | XP_002516930 | 255761086 | 0.857142857 | *Ricinus communis* | 9827 | |
| | | AEH05972 | 334854631 | 0.863095238 | *Hevea brasiliensis* | 9828 | 10549 |
| | | NP_001235906 | 351720717 | 0.851190476 | *Glycine max* | 9829 | 10550 |
| osa-miR1846e | 615-634 | XP_003531377 | 356525528 | 1 | *Glycine max* | 9830 | 10551 |
| | | XP_003525073 | 356512737 | 0.958823529 | *Glycine max* | 9831 | 10552 |
| | | XP_002310600 | 255761085 | 0.785294118 | *Populus trichocarpa* | 9832 | |
| | | XP_002307126 | 255761085 | 0.8 | *Populus trichocarpa* | 9833 | |
| | | XP_002280295 | 225438578 | 0.808823529 | *Vitis vinifera* | 9834 | 10553 |
| | | XP_003523264 | 356509047 | 0.826470588 | *Glycine max* | 9835 | 10554 |
| | | AAZ66923 | 37694873 | 0.708823529 | *Brassica rapa* | 9836 | 10555 |
| | | ACK44524 | 217426787 | 0.708823529 | *Arabidopsis arenosa* | 9837 | 10556 |
| | | XP_002871399 | 297853636 | 0.7 | *Arabidopsis lyrata* subsp. *lyrata* | 9838 | |
| | | NP_196563 | 145357839 | 0.702941176 | *Arabidopsis thaliana* | 9839 | 10557 |
| | 379-398 | XP_003531668 | 356526120 | 1 | *Glycine max* | 9840 | 10558 |
| | | XP_003529761 | 356522251 | 0.915980231 | *Glycine max* | 9841 | 10559 |
| | | XP_003530142 | 356523023 | 0.756177924 | *Glycine max* | 9842 | 10560 |
| | | XP_003546477 | 356556325 | 0.73476112 | *Glycine max* | 9843 | 10561 |
| | | XP_003531667 | 356526118 | 0.731466227 | *Glycine max* | 9844 | 10562 |
| | 114-133 | XP_003529761 | 356522251 | 1 | *Glycine max* | 9845 | 10563 |
| | | XP_003531668 | 356526120 | 0.917491749 | *Glycine max* | 9846 | 10564 |
| | | XP_003597728 | 357454894 | 0.724422442 | *Medicago truncatula* | 9847 | 10565 |
| | 367-386 | XP_003530142 | 356523023 | 1 | *Glycine max* | 9848 | 10566 |
| | | XP_003597726 | 357454890 | 0.700490998 | *Medicago truncatula* | 9849 | 10567 |
| osa-miR2104 | 256-277 | NP_001105847 | 162464254 | 1 | *Zea mays* | 9850 | |
| | | ABA42672 | 76443928 | 0.881188119 | *Zea mays* | 9851 | |
| | | Q2N2K2 | | 0.927392739 | *Glycine max* | 9852 | |
| | | XP_002447301 | 255761094 | 0.907590759 | *Sorghum bicolor* | 9853 | |
| | | ACG23902 | 195604143 | 0.811881188 | *Zea mays* | 9854 | 10568 |
| | 256-277 | NP_001105847 | 162464254 | 1 | *Zea mays* | 9855 | 10569 |
| osa-miRf11415-akr | 103-122 | ABU94631 | 156754274 | 1 | *Phaseolus vulgaris* | 9856 | 10570 |
| | | XP_003536353 | 356535640 | 0.944250871 | *Glycine max* | 9857 | 10571 |
| | | XP_003556232 | 356576220 | 0.951219512 | *Glycine max* | 9858 | 10572 |
| | | ACU24483 | 255648054 | 0.947735192 | *Glycine max* | 9859 | 10573 |
| | | AAC17529 | 3158475 | 0.919860627 | *Samanea saman* | 9860 | 10574 |
| | | ACJ85173 | 217073625 | 0.905923345 | *Medicago truncatula* | 9861 | 10575 |
| | | XP_003548070 | 356559566 | 0.891986063 | *Glycine max* | 9862 | 10576 |
| | | BAB40143 | 13486941 | 0.888501742 | *Pyrus communis* | 9863 | 10577 |
| | | ACU20229 | 255639872 | 0.891986063 | *Glycine max* | 9864 | 10578 |
| | | BAD90699 | 60498688 | 0.898954704 | *Mimosa pudica* | 9865 | 10579 |
| ctr-miR171 | 477-497 | XP_003538071 | 356539165 | 1 | *Glycine max* | 9866 | 10580 |
| | | XP_003517966 | 356498249 | 0.849056604 | *Glycine max* | 9867 | 10581 |
| pta-miR166c | 17-37 | XP_003627005 | 357513432 | 1 | *Medicago truncatula* | 9868 | 10582 |
| | | XP_003531652 | 356526088 | 0.921875 | *Glycine max* | 9869 | 10583 |
| | | XP_003530109 | 356522957 | 0.923076923 | *Glycine max* | 9870 | 10584 |
| | | XP_003530112 | 356522963 | 0.913461538 | *Glycine max* | 9871 | 10585 |
| | | ACI13685 | 206572104 | 0.889423077 | *Malus × domestica* | 9872 | 10586 |
| | | XP_003597690 | 357454818 | 0.894230769 | *Medicago truncatula* | 9873 | 10587 |
| | | XP_002515977 | 255761086 | 0.887019231 | *Ricinus communis* | 9874 | |
| | | XP_002284003 | 225442500 | 0.890625 | *Vitis vinifera* | 9875 | 10588 |
| | | CBI36079 | 270253379 | 0.890625 | *Vitis vinifera* | 9876 | |
| | | XP_003531653 | 356526090 | 0.900240385 | *Glycine max* | 9877 | 10589 |
| | 87-107 | CAN73584 | 147820217 | 1 | *Vitis vinifera* | 9878 | |
| | | XP_002281868 | 225444032 | 1 | *Vitis vinifera* | 9879 | 10590 |
| | | XP_002298892 | 255761085 | 0.918343195 | *Populus trichocarpa* | 9880 | |
| | | XP_002332526 | 255761085 | 0.90887574 | *Populus trichocarpa* | 9881 | |
| | | XP_003535078 | 356533042 | 0.880473373 | *Glycine max* | 9882 | 10591 |
| | | XP_003546255 | 356555874 | 0.882840237 | *Glycine max* | 9883 | 10592 |
| | | AAS66760 | 45479745 | 0.878106509 | *Nicotiana sylvestris* | 9884 | 10593 |
| | | XP_003532788 | 356528393 | 0.852071006 | *Glycine max* | 9885 | 10594 |
| | | XP_003524993 | 356512573 | 0.840236686 | *Glycine max* | 9886 | 10595 |
| | | ACI13683 | 206572100 | 0.820118343 | *Malus × domestica* | 9887 | 10596 |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 40-60 | AAS10176 | 41745611 | 1 | Antirrhinum majus | 9888 | 10597 |
| | 1228-1248 | XP_002285176 | 225435326 | 1 | Vitis vinifera | 9889 | 10598 |
| | | CAN61612 | 147783603 | 0.981042654 | Vitis vinifera | 9890 | |
| | | XP_002529946 | 255761086 | 0.918246445 | Ricinus communis | 9891 | |
| | | XP_003538150 | 356539326 | 0.892180095 | Glycine max | 9892 | 10599 |
| | | XP_003539764 | 356542618 | 0.895734597 | Glycine max | 9893 | 10600 |
| | | ACI13684 | 206572102 | 0.888625592 | Malus × domestica | 9894 | 10601 |
| | | XP_003539765 | 356542620 | 0.890995261 | Glycine max | 9895 | 10602 |
| | | AAX19050 | 60327620 | 0.881516588 | Populus trichocarpa | 9896 | 10603 |
| | | DAA05766 | 109729904 | 0.853080569 | Lotus japonicus | 9897 | |
| | | AAY33856 | 63115353 | 0.8507109 | Gossypium barbadense | 9898 | 10604 |
| | 557-577 | XP_002298892 | 255761085 | 1 | Populus trichocarpa | 9899 | |
| | | CAN73584 | 147820217 | 0.91943128 | Vitis vinifera | 9900 | |
| | 515-535 | XP_003597690 | 357454818 | 1 | Medicago truncatula | 9901 | 10605 |
| | | XP_002284014 | 225442502 | 0.897129187 | Vitis vinifera | 9902 | 10606 |
| | | XP_002304217 | 255761085 | 0.888755981 | Populus trichocarpa | 9903 | |
| | 560-580 | XP_002285176 | 225435326 | 1 | Vitis vinifera | 9904 | 10607 |
| | 554-574 | XP_003603630 | 357466690 | 1 | Medicago truncatula | 9905 | 10608 |
| | | XP_003522716 | 356507930 | 0.943645084 | Glycine max | 9906 | 10609 |
| | | XP_003526496 | 356515618 | 0.940047962 | Glycine max | 9907 | 10610 |
| | | ACI13686 | 206572106 | 0.872901679 | Malus × domestica | 9908 | 10611 |
| | | ADL36609 | 302398628 | 0.863309353 | Malus × domestica | 9909 | 10612 |
| | | CBI20838 | 270231236 | 0.862110312 | Vitis vinifera | 9910 | |
| | | XP_002283717 | 225429913 | 0.862110312 | Vitis vinifera | 9911 | 10613 |
| | | ACL51017 | 219879369 | 0.858513189 | Citrus trifoliata | 9912 | 10614 |
| | | XP_002309538 | 255761085 | 0.868105516 | Populus trichocarpa | 9913 | |
| | | XP_002324794 | 255761085 | 0.857314149 | Populus trichocarpa | 9914 | |
| | 40-60 | AAS10176 | 41745611 | 1 | Antirrhinum majus | 9915 | 10615 |
| | 554-574 | XP_003530109 | 356522957 | 1 | Glycine max | 9916 | 10616 |
| | 590-610 | XP_003524993 | 356512573 | 1 | Glycine max | 9917 | 10617 |
| | | XP_003594520 | 357448488 | 0.781946073 | Medicago truncatula | 9918 | 10618 |
| | 25-45 | XP_003522716 | 356507930 | 1 | Glycine max | 9919 | 10619 |
| | | XP_003603630 | 357466690 | 0.932464455 | Medicago truncatula | 9920 | 10620 |
| | 560-580 | XP_003530112 | 356522963 | 1 | Glycine max | 9921 | 10621 |
| | 530-550 | XP_003532788 | 356528393 | 1 | Glycine max | 9922 | 10622 |
| | 87-107 | CAN73584 | 147820217 | 1 | Vitis vinifera | 9923 | |
| | 566-586 | XP_003531653 | 356526090 | 1 | Glycine max | 9924 | 10623 |
| | 560-580 | XP_003539764 | 356542618 | 1 | Glycine max | 9925 | 10624 |
| | | XP_002285176 | 225435326 | 0.894674556 | Vitis vinifera | 9926 | 10625 |
| | | CAC84906 | 18076735 | 0.829585799 | Zinnia violacea | 9927 | 10626 |
| | 828-848 | XP_003539765 | 356542620 | 1 | Glycine max | 9928 | 10627 |
| ptc-miRf10976-akr | 81-100 | XP_003548151 | 356559731 | 1 | Glycine max | 9929 | 10628 |
| | | XP_003529873 | 356522477 | 0.888 | Glycine max | 9930 | 10629 |
| | | XP_003548400 | 356560236 | 0.849333333 | Glycine max | 9931 | 10630 |
| | 249-268 | NP_001238468 | 351720798 | 1 | Glycine max | 9932 | 10631 |
| | 242-261 | XP_003520705 | 356503828 | 1 | Glycine max | 9933 | 10632 |
| | | XP_003553607 | 356570870 | 0.874626866 | Glycine max | 9934 | 10633 |
| | 295-314 | XP_003533044 | 356528917 | 1 | Glycine max | 9935 | 10634 |
| | | XP_003529756 | 356522241 | 0.905759162 | Glycine max | 9936 | 10635 |
| | | XP_003543627 | 356550505 | 0.732984293 | Glycine max | 9937 | 10636 |
| | | XP_003546548 | 356556469 | 0.722513089 | Glycine max | 9938 | 10637 |
| | | XP_003597684 | 357454806 | 0.712041885 | Medicago truncatula | 9939 | 10638 |
| | | XP_003597685 | 357454808 | 0.701570681 | Medicago truncatula | 9940 | 10639 |
| | 268-287 | XP_003528486 | 356519654 | 1 | Glycine max | 9941 | 10640 |
| | | XP_003520183 | 356502757 | 0.899071926 | Glycine max | 9942 | 10641 |
| ptc-miRf11018-akr | 66-85 | XP_003524954 | 356512494 | 1 | Glycine max | 9943 | 10642 |
| | | XP_003531241 | 356525252 | 0.920604915 | Glycine max | 9944 | 10643 |
| | | AET04202 | 357518874 | 0.797731569 | Medicago truncatula | 9945 | 10644 |
| | | AET04197 | 357518864 | 0.752362949 | Medicago truncatula | 9946 | 10645 |
| | | AET04200 | 357518870 | 0.756143667 | Medicago truncatula | 9947 | 10646 |
| ptc-miRf11669-akr | 1236-1255 | XP_002275990 | 225451234 | 1 | Vitis vinifera | 9948 | 10647 |
| | | XP_002512253 | 255761086 | 0.916923077 | Ricinus communis | 9949 | |
| | | XP_003554689 | 356573071 | 0.895384615 | Glycine max | 9950 | 10648 |
| | | XP_002319618 | 255761085 | 0.916923077 | Populus trichocarpa | 9951 | |
| | | XP_002336146 | 255761085 | 0.895384615 | Populus trichocarpa | 9952 | |
| | | XP_002328363 | 255761085 | 0.895384615 | Populus trichocarpa | 9953 | |
| | | ACU22789 | 255644572 | 0.886153846 | Glycine max | 9954 | 10649 |
| | | ADN33908 | 307136046 | 0.898461538 | Cucumis melo subsp. melo | 9955 | 10650 |
| | | Q43317 | | 0.898461538 | Citrullus lanatus subsp. vulgaris | 9956 | |
| | | XP_002311629 | 255761085 | 0.901538462 | Populus trichocarpa | 9957 | |
| | 259-278 | XP_003624868 | 357509158 | 1 | Medicago truncatula | 9958 | 10651 |
| | | ACJ85972 | 217075223 | 0.995098039 | Medicago truncatula | 9959 | 10652 |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_003608106 | 357475640 | 0.965686275 | Medicago truncatula | 9960 | 10653 |
| | | NP_001237278 | 351723416 | 0.965686275 | Glycine max | 9961 | 10654 |
| | | NP_564149 | 30687501 | 0.931372549 | Arabidopsis thaliana | 9962 | 10655 |
| | | NP_001237990 | 351721817 | 0.941176471 | Glycine max | 9963 | 10656 |
| | | XP_002890456 | 297853636 | 0.926470588 | Arabidopsis lyrata subsp. lyrata | 9964 | |
| | | NP_565156 | 186496015 | 0.93627451 | Arabidopsis thaliana | 9965 | 10657 |
| | | XP_002887683 | 297853636 | 0.931372549 | Arabidopsis lyrata subsp. lyrata | 9966 | |
| | | AAM62756 | 21404242 | 0.926470588 | Arabidopsis thaliana | 9967 | 10658 |
| | 170-189 | XP_003535921 | 356534761 | 1 | Glycine max | 9968 | 10659 |
| | | XP_003519071 | 356500502 | 0.968379447 | Glycine max | 9969 | 10660 |
| | | XP_002284060 | 225441833 | 0.773386034 | Vitis vinifera | 9970 | 10661 |
| | | CAN82225 | 147852313 | 0.770750988 | Vitis vinifera | 9971 | 10662 |
| | | XP_002532077 | 255761086 | 0.744400527 | Ricinus communis | 9972 | |
| | | XP_002323318 | 255761085 | 0.737812912 | Populus trichocarpa | 9973 | |
| | | XP_002308029 | 255761085 | 0.749670619 | Populus trichocarpa | 9974 | |
| | | CBI29841 | 270242856 | 0.753623188 | Vitis vinifera | 9975 | 10663 |
| | | NP_565960 | 18405800 | 0.723320158 | Arabidopsis thaliana | 9976 | 10664 |
| | | XP_002878149 | 297853636 | 0.72859025 | Arabidopsis lyrata subsp. lyrata | 9977 | |
| | 120-139 | AAQ57205 | 34099832 | 1 | Populus tremula × Populus alba | 9978 | 10665 |
| | 877-896 | XP_003526542 | 356515711 | 1 | Glycine max | 9979 | 10666 |
| | | XP_003523783 | 356510109 | 0.846153846 | Glycine max | 9980 | 10667 |
| | 588-607 | XP_002264051 | 225429233 | 1 | Vitis vinifera | 9981 | 10668 |
| | | CAN64867 | 123673833 | 0.996763754 | Vitis vinifera | 9982 | |
| | | XP_002513130 | 255761086 | 0.877022654 | Ricinus communis | 9983 | |
| | | XP_003525216 | 356513027 | 0.83171521 | Glycine max | 9984 | 10669 |
| | | XP_003530931 | 356524629 | 0.828478964 | Glycine max | 9985 | 10670 |
| | | ACU18834 | 255637002 | 0.828478964 | Glycine max | 9986 | 10671 |
| | | XP_002319995 | 255761085 | 0.834951456 | Populus trichocarpa | 9987 | |
| | | BAH79622 | 240846167 | 0.822006472 | Glycine max | 9988 | |
| | | XP_002310364 | 255761085 | 0.805825243 | Populus trichocarpa | 9989 | |
| | | XP_003631000 | 357521422 | 0.812297735 | Medicago truncatula | 9990 | 10672 |
| | 917-936 | XP_003548812 | 356561077 | 1 | Glycine max | 9991 | 10673 |
| | | XP_003525850 | 356514311 | 0.700787402 | Glycine max | 9992 | 10674 |
| | 1246-1265 | XP_003555457 | 356574646 | 1 | Glycine max | 9993 | 10675 |
| | | XP_003543286 | 356549814 | 0.955497382 | Glycine max | 9994 | 10676 |
| | | XP_003617150 | 357493722 | 0.756544503 | Medicago truncatula | 9995 | 10677 |
| | | XP_002272310 | 225435984 | 0.712041885 | Vitis vinifera | 9996 | 10678 |
| | | CBI24343 | 270235077 | 0.712041885 | Vitis vinifera | 9997 | |
| | 1320-1339 | XP_003519686 | 356501748 | 1 | Glycine max | 9998 | 10679 |
| | | XP_003547896 | 356559215 | 0.95412844 | Glycine max | 9999 | 10680 |
| | | XP_003547897 | 356559217 | 0.95412844 | Glycine max | 10000 | 10681 |
| | | XP_003517138 | 356496566 | 0.812844037 | Glycine max | 10001 | 10682 |
| | | XP_003612325 | 357484076 | 0.783486239 | Medicago truncatula | 10002 | 10683 |
| | | XP_003629155 | 357517732 | 0.798165138 | Medicago truncatula | 10003 | 10684 |
| | | XP_003537681 | 356538378 | 0.8 | Glycine max | 10004 | 10685 |
| | 602-621 | XP_003520116 | 356502619 | 1 | Glycine max | 10005 | 10686 |
| | | XP_002280702 | 225438602 | 0.856050955 | Vitis vinifera | 10006 | 10687 |
| | | EAZ28751 | 54398660 | 0.829299363 | Oryza sativa Japonica Group | 10007 | |
| | 214-233 | XP_003554103 | 356571887 | 1 | Glycine max | 10008 | 10688 |
| | | XP_003521108 | 356504648 | 0.923076923 | Glycine max | 10009 | 10689 |
| | | ACU18694 | 255636716 | 0.919230769 | Glycine max | 10010 | 10690 |
| | | XP_003624904 | 357509230 | 0.807692308 | Medicago truncatula | 10011 | 10691 |
| | | XP_002526199 | 255761086 | 0.734615385 | Ricinus communis | 10012 | |
| | | XP_002283307 | 225440154 | 0.761538462 | Vitis vinifera | 10013 | 10692 |
| | | XP_002307956 | 255761085 | 0.726923077 | Populus trichocarpa | 10014 | |
| | | XP_002876377 | 297853636 | 0.703846154 | Arabidopsis lyrata subsp. lyrata | 10015 | |
| | 329-348 | XP_003547896 | 356559215 | 1 | Glycine max | 10016 | 10693 |
| | | XP_003519686 | 356501748 | 0.961182994 | Glycine max | 10017 | 10694 |
| | | XP_002521706 | 255761086 | 0.715341959 | Ricinus communis | 10018 | |
| | | XP_002306425 | 255761085 | 0.71349353 | Populus trichocarpa | 10019 | |
| vvi-miR394b | 209-228 | XP_003601765 | 357462966 | 1 | Medicago truncatula | 10020 | 10695 |
| | | XP_003538543 | 356540129 | 0.843010753 | Glycine max | 10021 | 10696 |
| | | XP_003551172 | 356565895 | 0.868817204 | Glycine max | 10022 | 10697 |
| | | ACU23751 | 255646552 | 0.864516129 | Glycine max | 10023 | 10698 |
| | | ACL51019 | 219879373 | 0.767741935 | Citrus trifoliata | 10024 | 10699 |
| | | ACI13687 | 206572108 | 0.761290323 | Malus × domestica | 10025 | 10700 |
| | | XP_002514903 | 255761086 | 0.746236559 | Ricinus communis | 10026 | |
| | | XP_002271194 | 225425399 | 0.739784946 | Vitis vinifera | 10027 | 10701 |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002297845 | 255761085 | 0.750537634 | Populus trichocarpa | 10028 | |
| | | XP_003531199 | 356525167 | 0.735483871 | Glycine max | 10029 | 10702 |
| | 1188-1207 | XP_003551172 | 356565895 | 1 | Glycine max | 10030 | 10703 |
| | 256-275 | XP_003593155 | 357445754 | 1 | Medicago truncatula | 10031 | 10704 |
| | | XP_003547599 | 356558613 | 0.890145396 | Glycine max | 10032 | 10705 |
| | | XP_003547600 | 356558615 | 0.890145396 | Glycine max | 10033 | 10706 |
| | | XP_003593158 | 357445760 | 0.843295638 | Medicago truncatula | 10034 | 10707 |
| | | NP_567920 | 186515898 | 0.81098546 | Arabidopsis thaliana | 10035 | 10708 |
| | | AEG25668 | 333952413 | 0.814216478 | Gossypium hirsutum | 10036 | 10709 |
| | | AAK68074 | 14573458 | 0.809369952 | Arabidopsis thaliana | 10037 | 10710 |
| | | ADE22249 | 292385867 | 0.822294023 | Ageratina adenophora | 10038 | 10711 |
| | | XP_002867182 | 297853636 | 0.809369952 | Arabidopsis lyrata subsp. lyrata | 10039 | |
| | | AEA76434 | 327422166 | 0.81098546 | Gossypium hirsutum | 10040 | 10712 |
| | 268-287 | XP_003524786 | 356512154 | 1 | Glycine max | 10041 | 10713 |
| | | XP_002331852 | 255761085 | 0.762032086 | Populus trichocarpa | 10042 | |
| | | XP_002316738 | 255761085 | 0.751336898 | Populus trichocarpa | 10043 | |
| | | XP_002519740 | 255761086 | 0.748663102 | Ricinus communis | 10044 | |
| | | XP_003532647 | 356528107 | 0.71657754 | Glycine max | 10045 | 10714 |
| | | CAN63784 | 147790991 | 0.703208556 | Vitis vinifera | 10046 | 10715 |
| | | XP_002273992 | 225463405 | 0.703208556 | Vitis vinifera | 10047 | 10716 |
| | 435-454 | XP_003556143 | 356576040 | 1 | Glycine max | 10048 | 10717 |
| | | XP_003556144 | 356576042 | 0.964285714 | Glycine max | 10049 | 10718 |
| | | XP_003536435 | 356535807 | 0.932539683 | Glycine max | 10050 | 10719 |
| | | XP_003536434 | 356535805 | 0.924603175 | Glycine max | 10051 | 10720 |
| | | ACU19073 | 255637492 | 0.920634921 | Glycine max | 10052 | 10721 |
| | | XP_003556145 | 356576044 | 0.94047619 | Glycine max | 10053 | 10722 |
| | | XP_003536436 | 356535809 | 0.900793651 | Glycine max | 10054 | 10723 |
| | | XP_003556146 | 356576046 | 0.912698413 | Glycine max | 10055 | 10724 |
| | | XP_003592142 | 357443728 | 0.793650794 | Medicago truncatula | 10056 | 10725 |
| | | ACU23298 | 255645607 | 0.777777778 | Glycine max | 10057 | 10726 |
| | 475-494 | XP_003531199 | 356525167 | 1 | Glycine max | 10058 | 10727 |
| | | XP_003524898 | 356512380 | 0.911699779 | Glycine max | 10059 | 10728 |
| | | ACU17886 | 255635055 | 0.905077263 | Glycine max | 10060 | 10729 |
| | 1104-1123 | XP_003538543 | 356540129 | 1 | Glycine max | 10061 | 10730 |
| | 123-142 | XP_003553643 | 356570944 | 1 | Glycine max | 10062 | 10731 |
| | | XP_003521540 | 356505523 | 0.763779528 | Glycine max | 10063 | 10732 |
| | 29-48 | NP_001058751 | 115470304 | 1 | Oryza sativa Japonica Group | 10064 | 10733 |
| | | EAZ02551 | 54362548 | 0.987012987 | Oryza sativa Indica Group | 10065 | |
| | | ACG30543 | 195617425 | 0.896103896 | Zea mays | 10066 | 10734 |
| | | BAJ93722 | 326533897 | 0.896103896 | Hordeum vulgare subsp. vulgare | 10067 | 10735 |
| | | XP_002459234 | 255761094 | 0.883116883 | Sorghum bicolor | 10068 | |
| | | XP_003557668 | 357111736 | 0.896103896 | Brachypodium distachyon | 10069 | 10736 |
| | | ACG28009 | 195612357 | 0.883116883 | Zea mays | 10070 | 10737 |
| | | ACG24589 | 195605517 | 0.844155844 | Zea mays | 10071 | 10738 |
| | | XP_003555981 | 356575711 | 0.87012987 | Glycine max | 10072 | 10739 |
| | | XP_002284176 | 225438945 | 0.87012987 | Vitis vinifera | 10073 | 10740 |
| | 1029-1048 | XP_003524898 | 356512380 | 1 | Glycine max | 10074 | 10741 |
| | 1245-1264 | XP_003601765 | 357462966 | 1 | Medicago truncatula | 10075 | 10742 |
| zma-miR167u | 68-87 | XP_002519732 | 255761086 | 1 | Ricinus communis | 10076 | |
| | | XP_002298511 | 255761085 | 0.8183391 | Populus trichocarpa | 10077 | |
| | | XP_002317300 | 255761085 | 0.801038062 | Populus trichocarpa | 10078 | |
| | | XP_002272126 | 225463413 | 0.788927336 | Vitis vinifera | 10079 | 10743 |
| | | XP_003524790 | 356512162 | 0.780276817 | Glycine max | 10080 | 10744 |
| | | NP_180988 | 145360605 | 0.761245675 | Arabidopsis thaliana | 10081 | 10745 |
| | | XP_003532649 | 356528111 | 0.780276817 | Glycine max | 10082 | 10746 |
| | | XP_002879497 | 297853636 | 0.757785467 | Arabidopsis lyrata subsp. lyrata | 10083 | |
| | | NP_568662 | 30694937 | 0.742214533 | Arabidopsis thaliana | 10084 | 10747 |
| | | AAL11600 | 15983463 | 0.740484429 | Arabidopsis thaliana | 10085 | 10748 |
| | 503-522 | XP_003556422 | 356576607 | 1 | Glycine max | 10086 | 10749 |
| | | XP_003556421 | 356576605 | 1 | Glycine max | 10087 | 10750 |
| | | XP_003536179 | 356535285 | 0.754266212 | Glycine max | 10088 | 10751 |
| | 109-128 | XP_003533248 | 356529329 | 1 | Glycine max | 10089 | 10752 |
| | | XP_003547372 | 356558152 | 0.944690265 | Glycine max | 10090 | 10753 |
| | | XP_003550546 | 356564612 | 0.778761062 | Glycine max | 10091 | 10754 |
| | | XP_003528627 | 356519941 | 0.783185841 | Glycine max | 10092 | 10755 |
| | | XP_003609706 | 357478840 | 0.765486726 | Medicago truncatula | 10093 | 10756 |
| | | XP_002273305 | 225431819 | 0.727876106 | Vitis vinifera | 10094 | 10757 |
| | | CBI22951 | 270234210 | 0.727876106 | Vitis vinifera | 10095 | |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | 1585-1604 | XP_003550723 | 356564979 | 1 | Glycine max | 10096 | 10758 |
| | | XP_003550724 | 356564981 | 0.985380117 | Glycine max | 10097 | 10759 |
| | | XP_003529499 | 356521718 | 0.956140351 | Glycine max | 10098 | 10760 |
| | | XP_003529500 | 356521720 | 0.946393762 | Glycine max | 10099 | 10761 |
| | | XP_003546300 | 356555968 | 0.819688109 | Glycine max | 10100 | 10762 |
| | | XP_002314972 | 255761085 | 0.726120858 | Populus trichocarpa | 10101 | |
| | | CBI22841 | 270234210 | 0.730994152 | Vitis vinifera | 10102 | |
| | | XP_002519280 | 255761086 | 0.717348928 | Ricinus communis | 10103 | |
| | 335-354 | XP_003516798 | 356495878 | 1 | Glycine max | 10104 | 10763 |
| | 29-48 | XP_003525532 | 356513666 | 1 | Glycine max | 10105 | 10764 |
| | 24-43 | XP_003529500 | 356521720 | 1 | Glycine max | 10106 | 10765 |
| | | XP_003550723 | 356564979 | 0.959486166 | Glycine max | 10107 | 10766 |
| | | XP_002883053 | 297853636 | 0.707509881 | Arabidopsis lyrata subsp. lyrata | 10108 | |
| | | NP_001118648 | 186510162 | 0.70256917 | Arabidopsis thaliana | 10109 | 10767 |
| | 671-690 | XP_003533338 | 356529518 | 1 | Glycine max | 10110 | 10768 |
| | 314-333 | XP_003529470 | 356521656 | 1 | Glycine max | 10111 | 10769 |
| | | XP_003556768 | 356577305 | 0.95687885 | Glycine max | 10112 | 10770 |
| | | Q43088 | | 0.80698152 | Ribulose-bisphosphate carboxylase | 10113 | |
| | | 1MLV_A | | 0.747433265 | Pisum sativum | 10114 | |
| | | 2H21_A | | 0.743326489 | Pisum sativum | 10115 | |
| zma-miR396b-3p | 330-350 | ABE91847 | 61675805 | 1 | Medicago truncatula | 10116 | 10771 |
| | 330-350 | ABE91847 | 61675805 | 1 | Medicago truncatula | 10117 | 10772 |
| aly-miR396a-3p | 330-350 | ABE91847 | 61675805 | 1 | Medicago truncatula | 10118 | 10773 |
| | 330-350 | ABE91847 | 61675805 | 1 | Medicago truncatula | 10119 | 10774 |
| gma-miR4412-3p | 224-244 | NP_001235045 | 351725442 | 1 | Glycine max | 10120 | 10775 |
| | | XP_002274402 | 225425717 | 0.733905579 | Vitis vinifera | 10121 | 10776 |
| | | XP_002315800 | 255761085 | 0.703862661 | Populus trichocarpa | 10122 | |
| | 1796-1816 | NP_001235618 | 351727227 | 1 | Glycine max | 10123 | 10777 |
| gma-miR482b-5p | 177-198 | AAX13306 | 60100357 | 1 | Lotus japonicus | 10124 | 10778 |
| | | NP_001236130 | 351727233 | 0.959641256 | Glycine max | 10125 | 10779 |
| | | AAN15183 | 23194452 | 0.865470852 | Gossypium hirsutum | 10126 | 10780 |
| | | AAY30856 | 63094568 | 0.874439462 | Prunus dulcis | 10127 | 10781 |
| | | ABV60385 | 157674586 | 0.874439462 | Carica papaya | 10128 | |
| | | ABM69043 | 122938394 | 0.860986547 | Gossypium hirsutum | 10129 | 10782 |
| | | ADD91578 | 291278193 | 0.878923767 | Prunus serrulata var. lannesiana | 10130 | 10783 |
| | | AAO20104 | 27763669 | 0.860986547 | Momordica charantia | 10131 | 10784 |
| | | AAD01742 | 4103341 | 0.869955157 | Cucumis sativus | 10132 | 10785 |
| | | ABQ85556 | 148535235 | 0.874439462 | Prunus persica | 10133 | 10786 |
| | 339-360 | BAG06679 | 166788446 | 1 | Phaseolus vulgaris | 10134 | 10787 |
| | | ACU20774 | 255640988 | 0.995575221 | Glycine max | 10135 | 10788 |
| | | ACU24523 | 255648136 | 0.977876106 | Glycine max | 10136 | 10789 |
| | | AAM91028 | 57472398 | 0.977876106 | Pisum sativum | 10137 | 10790 |
| | | XP_002272971 | 225462010 | 0.96460177 | Vitis vinifera | 10138 | 10791 |
| | | ABW06389 | 157955930 | 0.938053097 | Gossypium hirsutum | 10139 | 10792 |
| | | ABW06392 | 157955936 | 0.933628319 | Gossypium hirsutum | 10140 | 10793 |
| | | ACJ86177 | 217075633 | 0.938053097 | Medicago truncatula | 10141 | 10794 |
| | | XP_002532178 | 255761086 | 0.951327434 | Ricinus communis | 10142 | |
| | | ABW06390 | 157955932 | 0.938053097 | Gossypium hirsutum | 10143 | 10795 |
| | 35-56 | CAN81115 | 147863854 | 1 | Vitis vinifera | 10144 | 10796 |
| ptc-miRf11953-akr | 753-772 | XP_002271271 | 225468315 | 1 | Vitis vinifera | 10145 | 10797 |
| | | XP_002532424 | 255761086 | 0.945652174 | Ricinus communis | 10146 | |
| | | ACU20760 | 255640960 | 0.945652174 | Glycine max | 10147 | 10798 |
| | | XP_002877709 | 297853636 | 0.940217391 | Arabidopsis lyrata subsp. lyrata | 10148 | |
| | | NP_001235421 | 351721538 | 0.934782609 | Glycine max | 10149 | 10799 |
| | | NP_001236131 | 351727263 | 0.940217391 | Glycine max | 10150 | 10800 |
| | | NP_190556 | 145339306 | 0.934782609 | Arabidopsis thaliana | 10151 | 10801 |
| | | ACU14878 | 255629066 | 0.940217391 | Glycine max | 10152 | 10802 |
| | | XP_002866698 | 297853636 | 0.923913043 | Arabidopsis lyrata subsp. lyrata | 10153 | |
| | | NP_569051 | 186532841 | 0.918478261 | Arabidopsis thaliana | 10154 | 10803 |
| | 309-328 | ACU18943 | 255637224 | 1 | Glycine max | 10155 | 10804 |
| | | ACU23146 | 255645298 | 0.953405018 | Glycine max | 10156 | 10805 |
| | | ACJ84492 | 217072263 | 0.810035842 | Medicago truncatula | 10157 | 10806 |
| | | ABK94686 | 118485671 | 0.784946237 | Populus trichocarpa | 10158 | 10807 |
| | | XP_002528545 | 255761086 | 0.76702509 | Ricinus communis | 10159 | |
| | | XP_002326541 | 255761085 | 0.741935484 | Populus trichocarpa | 10160 | |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_002278543 | 225427135 | 0.752688172 | Vitis vinifera | 10161 | 10808 |
| | | XP_002274164 | 225454758 | 0.734767025 | Vitis vinifera | 10162 | 10809 |
| | | XP_002303431 | 255761085 | 0.749103943 | Populus trichocarpa | 10163 | |
| | 218-237 | ACU18943 | 255637224 | 1 | Glycine max | 10164 | 10810 |
| | 1421-1440 | P08926 | | 1 | Pisum sativum | 10165 | |
| | | BAE71311 | 84468455 | 0.957410562 | Trifolium pratense | 10166 | 10811 |
| | | BAE71231 | 84468295 | 0.955706985 | Trifolium pratense | 10167 | 10812 |
| | | BAE71302 | 84468437 | 0.954003407 | Trifolium pratense | 10168 | 10813 |
| | | BAE71227 | 84468287 | 0.93867121 | Trifolium pratense | 10169 | 10814 |
| | | ACJ85785 | 217074849 | 0.94548552 | Medicago truncatula | 10170 | 10815 |
| | | AEO21430 | 346229112 | 0.906303237 | Glycine max | 10171 | 10816 |
| | | XP_002313525 | 255761085 | 0.877342419 | Populus trichocarpa | 10172 | |
| | | AAC68501 | 3790440 | 0.889267462 | Canavalia lineata | 10173 | 10817 |
| | | XP_002328161 | 255761085 | 0.865417376 | Populus trichocarpa | 10174 | |
| | 165-184 | ACU23935 | 255646930 | 1 | Glycine max | 10175 | 10818 |
| | 60-79 | BAE71304 | 84468441 | 1 | Trifolium pratense | 10176 | 10819 |
| | | P08926 | | 0.947939262 | Pisum sativum | 10177 | |
| bna-miR2111b-5p | 163-183 | ACU23935 | 255646930 | 1 | Glycine max | 10178 | 10820 |
| | 1419-1439 | P08926 | | 1 | Pisum sativum | 10179 | |
| | | BAE71311 | 84468455 | 0.957410562 | Trifolium pratense | 10180 | 10821 |
| | | BAE71231 | 84468295 | 0.955706985 | Trifolium pratense | 10181 | 10822 |
| | | BAE71302 | 84468437 | 0.954003407 | Trifolium pratense | 10182 | 10823 |
| | | BAE71227 | 84468287 | 0.93867121 | Trifolium pratense | 10183 | 10824 |
| | | ACJ85785 | 217074849 | 0.94548552 | Medicago truncatula | 10184 | 10825 |
| | | AEO21430 | 346229112 | 0.906303237 | Glycine max | 10185 | 10826 |
| | | XP_002313525 | 255761085 | 0.877342419 | Populus trichocarpa | 10186 | |
| | | AAC68501 | 3790440 | 0.889267462 | Canavalia lineata | 10187 | 10827 |
| | | XP_002328161 | 255761085 | 0.865417376 | Populus trichocarpa | 10188 | |
| | 153-173 | ACU23159 | 255645324 | 1 | Glycine max | 10189 | 10828 |
| | | CAF04055 | 119391878 | 0.745098039 | Nicotiana benthamiana | 10190 | 10829 |
| | | CAF25317 | 119391874 | 0.735294118 | Capsicum annuum | 10191 | 10830 |
| | | XP_002306360 | 255761085 | 0.715686275 | Populus trichocarpa | 10192 | |
| | | XP_002279217 | 225438516 | 0.732026144 | Vitis vinifera | 10193 | 10831 |
| | | XP_002530256 | 255761086 | 0.715686275 | Ricinus communis | 10194 | |
| | | CBI22773 | 270234152 | 0.722222222 | Vitis vinifera | 10195 | |
| | | CBI21530 | 270232045 | 0.732026144 | Vitis vinifera | 10196 | |
| | 163-183 | ACU23935 | 255646930 | 1 | Glycine max | 10197 | 10832 |
| | 58-78 | BAE71304 | 84468441 | 1 | Trifolium pratense | 10198 | 10833 |
| | | P08926 | | 0.947939262 | Pisum sativum | 10199 | |
| ptc-miRf11079-akr | 720-743 | ACU24381 | 255647842 | 1 | Glycine max | 10200 | 10834 |
| | | NP_001238255 | 351722074 | 0.996688742 | Glycine max | 10201 | 10835 |
| | | NP_001235901 | 351728022 | 0.943708609 | Glycine max | 10202 | 10836 |
| | | AAK84883 | 15148911 | 0.917218543 | Phaseolus vulgaris | 10203 | 10837 |
| | | AEE99077 | 332739375 | 0.870860927 | Medicago truncatula | 10204 | 10838 |
| | | XP_002529954 | 255761086 | 0.768211921 | Ricinus communis | 10205 | |
| | | XP_002310688 | 255761085 | 0.771523179 | Populus trichocarpa | 10206 | |
| | | XP_002307195 | 255761085 | 0.741721854 | Populus trichocarpa | 10207 | |
| | 69-92 | AAK84883 | 15148911 | 1 | Phaseolus vulgaris | 10208 | 10839 |
| | 603-626 | AAK84883 | 15148911 | 1 | Phaseolus vulgaris | 10209 | 10840 |
| | 720-743 | NP_001235901 | 351728022 | 1 | Glycine max | 10210 | 10841 |
| | 721-744 | ACU24381 | 255647842 | 1 | Glycine max | 10211 | 10842 |
| bra-miR160a-3p | 989-1009 | XP_003530952 | 356524671 | 1 | Glycine max | 10212 | 10843 |
| | | XP_003525194 | 356512983 | 0.970842333 | Glycine max | 10213 | 10844 |
| | | XP_003521511 | 356505464 | 0.904967603 | Glycine max | 10214 | 10845 |
| | | XP_003592908 | 357445260 | 0.792656587 | Medicago truncatula | 10215 | 10846 |
| | | ABE91931 | 61675804 | 0.792656587 | Medicago truncatula | 10216 | 10847 |
| | | XP_003626539 | 357512500 | 0.795896328 | Medicago truncatula | 10217 | 10848 |
| | | XP_002281426 | 225441572 | 0.791576674 | Vitis vinifera | 10218 | 10849 |
| | | Q9XHM1 | | 0.789416847 | Medicago truncatula | 10219 | |
| | | XP_003589347 | 357438142 | 0.782937365 | Medicago truncatula | 10220 | 10850 |
| | | CAN81874 | 147860525 | 0.761339093 | Vitis vinifera | 10221 | 10851 |
| gma-miR1507a | 328-349 | XP_003521176 | 356504786 | 1 | Glycine max | 10222 | 10852 |
| gma-miR1524 | 507-527 | XP_003554498 | 356572687 | 1 | Glycine max | 10223 | 10853 |
| | | XP_003521507 | 356505456 | 0.941358025 | Glycine max | 10224 | 10854 |
| | | XP_003535834 | 356534585 | 0.712962963 | Glycine max | 10225 | 10855 |
| | | XP_003519022 | 356500404 | 0.712962963 | Glycine max | 10226 | 10856 |
| ppt-miR166m | 189-209 | XP_003553029 | 356569688 | 1 | Glycine max | 10227 | 10857 |
| | | XP_003537529 | 356538072 | 0.931216931 | Glycine max | 10228 | 10858 |
| | | XP_003601737 | 357462910 | 0.727513228 | Medicago truncatula | 10229 | 10859 |
| | 557-577 | XP_002298892 | 255761085 | 1 | Populus trichocarpa | 10230 | |
| | | CAN73584 | 147820217 | 0.91943128 | Vitis vinifera | 10231 | |
| | | XP_002332526 | 255761085 | 0.94549763 | Populus trichocarpa | 10232 | |
| | | XP_002281868 | 225444032 | 0.91943128 | Vitis vinifera | 10233 | 10860 |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_003535078 | 356533042 | 0.892180095 | Glycine max | 10234 | 10861 |
| | | XP_003546255 | 356555874 | 0.893364929 | Glycine max | 10235 | 10862 |
| | | AAS66760 | 45479745 | 0.86492891 | Nicotiana sylvestris | 10236 | 10863 |
| | | XP_003532788 | 356528393 | 0.849526066 | Glycine max | 10237 | 10864 |
| | | XP_003524993 | 356512573 | 0.845971564 | Glycine max | 10238 | 10865 |
| | | ACI13683 | 206572100 | 0.816350711 | Malus × domestica | 10239 | 10866 |
| | 515-535 | XP_003597690 | 357454818 | 1 | Medicago truncatula | 10240 | 10867 |
| | | XP_003531652 | 356526088 | 0.918660287 | Glycine max | 10241 | 10868 |
| | | XP_003530109 | 356522957 | 0.921052632 | Glycine max | 10242 | 10869 |
| | | XP_002284003 | 225442500 | 0.897129187 | Vitis vinifera | 10243 | 10870 |
| | | CBI36079 | 270253379 | 0.897129187 | Vitis vinifera | 10244 | |
| | | XP_002515977 | 255761086 | 0.901913876 | Ricinus communis | 10245 | |
| | | XP_003530112 | 356522963 | 0.916267943 | Glycine max | 10246 | 10871 |
| | | XP_002284014 | 225442502 | 0.897129187 | Vitis vinifera | 10247 | 10872 |
| | | ACI13685 | 206572104 | 0.89354067 | Malus × domestica | 10248 | 10873 |
| | | XP_002304217 | 255761085 | 0.888755981 | Populus trichocarpa | 10249 | |
| | 560-580 | XP_002285176 | 225435326 | 1 | Vitis vinifera | 10250 | 10874 |
| | | CAN61612 | 147783603 | 0.981042654 | Vitis vinifera | 10251 | |
| | | XP_002529946 | 255761086 | 0.918246445 | Ricinus communis | 10252 | |
| | | XP_003538150 | 356539326 | 0.892180095 | Glycine max | 10253 | 10875 |
| | | XP_003539764 | 356542618 | 0.895734597 | Glycine max | 10254 | 10876 |
| | | ACI13684 | 206572102 | 0.888625592 | Malus × domestica | 10255 | 10877 |
| | | XP_003539765 | 356542620 | 0.890995261 | Glycine max | 10256 | 10878 |
| | | AAX19050 | 60327620 | 0.881516588 | Populus trichocarpa | 10257 | 10879 |
| | | DAA05766 | 109729904 | 0.853080569 | Lotus japonicus | 10258 | |
| | | AAY33856 | 63115353 | 0.8507109 | Gossypium barbadense | 10259 | 10880 |
| | 554-574 | XP_003603630 | 357466690 | 1 | Medicago truncatula | 10260 | 10881 |
| | | XP_003522716 | 356507930 | 0.943645084 | Glycine max | 10261 | 10882 |
| | | XP_003526496 | 356515618 | 0.940047962 | Glycine max | 10262 | 10883 |
| | | ACI13686 | 206572106 | 0.872901679 | Malus × domestica | 10263 | 10884 |
| | | ADL36609 | 302398628 | 0.863309353 | Malus × domestica | 10264 | 10885 |
| | | CBI20838 | 270231236 | 0.862110312 | Vitis vinifera | 10265 | |
| | | XP_002283717 | 225429913 | 0.862110312 | Vitis vinifera | 10266 | 10886 |
| | | ACL51017 | 219879369 | 0.858513189 | Citrus trifoliata | 10267 | 10887 |
| | | XP_002309538 | 255761085 | 0.868105516 | Populus trichocarpa | 10268 | |
| | | XP_002324794 | 255761085 | 0.857314149 | Populus trichocarpa | 10269 | |
| | 40-60 | AAS10176 | 41745611 | 1 | Antirrhinum majus | 10270 | 10888 |
| | 554-574 | XP_003530109 | 356522957 | 1 | Glycine max | 10271 | 10889 |
| | | XP_003531653 | 356526090 | 0.95823389 | Glycine max | 10272 | 10890 |
| | | XP_003627005 | 357513432 | 0.91646778 | Medicago truncatula | 10273 | 10891 |
| | | XP_003597690 | 357454818 | 0.918854415 | Medicago truncatula | 10274 | 10892 |
| | 590-610 | XP_003524993 | 356512573 | 1 | Glycine max | 10275 | 10893 |
| | | XP_002298892 | 255761085 | 0.832356389 | Populus trichocarpa | 10276 | |
| | | XP_003594520 | 357448488 | 0.781946073 | Medicago truncatula | 10277 | 10894 |
| | 25-45 | XP_003522716 | 356507930 | 1 | Glycine max | 10278 | 10895 |
| | | XP_003603630 | 357466690 | 0.932464455 | Medicago truncatula | 10279 | 10896 |
| | 560-580 | XP_003530112 | 356522963 | 1 | Glycine max | 10280 | 10897 |
| | 572-592 | P00965 | | 1 | Phaseolus vulgaris | 10281 | |
| | | XP_003544980 | 356553268 | 0.935393258 | Glycine max | 10282 | 10898 |
| | | XP_003519325 | 356501016 | 0.935393258 | Glycine max | 10283 | 10899 |
| | | ACU19484 | 255638343 | 0.926966292 | Glycine max | 10284 | 10900 |
| | | XP_003519326 | 356501018 | 0.935393258 | Glycine max | 10285 | 10901 |
| | | AAB61597 | 2213876 | 0.901685393 | Hevea brasiliensis | 10286 | 10902 |
| | | P32289 | | 0.901685393 | Vigna aconitifolia | 10287 | |
| | | ABW89460 | 159138920 | 0.904494382 | Gossypium herbaceum | 10288 | 10903 |
| | | P04770 | | 0.896067416 | Phaseolus vulgaris | 10289 | |
| | | ABW89461 | 159138922 | 0.901685393 | Gossypium hirsutum | 10290 | 10904 |
| | 87-107 | CAN73584 | 147820217 | 1 | Vitis vinifera | 10291 | |
| | 530-550 | XP_003532788 | 356528393 | 1 | Glycine max | 10292 | 10905 |
| | 516-536 | XP_003537529 | 356538072 | 1 | Glycine max | 10293 | 10906 |
| | 566-586 | XP_003531653 | 356526090 | 1 | Glycine max | 10294 | 10907 |
| | 560-580 | XP_003539764 | 356542618 | 1 | Glycine max | 10295 | 10908 |
| | | XP_002285176 | 225435326 | 0.894674556 | Vitis vinifera | 10296 | 10909 |
| | | CAC84906 | 18076735 | 0.829585799 | Zinnia violacea | 10297 | 10910 |
| | 828-848 | XP_003539765 | 356542620 | 1 | Glycine max | 10298 | 10911 |
| ptc-miR166p | 557-577 | XP_002298892 | 255761085 | 1 | Populus trichocarpa | 10299 | |
| | | CAN73584 | 147820217 | 0.91943128 | Vitis vinifera | 10300 | |
| | | XP_002332526 | 255761085 | 0.94549763 | Populus trichocarpa | 10301 | |
| | | XP_002281868 | 225444032 | 0.91943128 | Vitis vinifera | 10302 | 10912 |
| | | XP_003535078 | 356533042 | 0.892180095 | Glycine max | 10303 | 10913 |
| | | XP_003546255 | 356555874 | 0.893364929 | Glycine max | 10304 | 10914 |
| | | AAS66760 | 45479745 | 0.86492891 | Nicotiana sylvestris | 10305 | 10915 |

TABLE 10-continued

Target Genes of down-regulated Small RNA Molecules Associated with Abiotic Stress Tolerance in Soybean Plants.

| Mir Name | Mir Binding Position | Homolog NCBI Accession | Nucleotide NCBI GI number | Identity | Organism | Protein Seq id no: | Nucleotide Seq id no: |
|---|---|---|---|---|---|---|---|
| | | XP_003532788 | 356528393 | 0.849526066 | Glycine max | 10306 | 10916 |
| | | XP_003524993 | 356512573 | 0.845971564 | Glycine max | 10307 | 10917 |
| | | ACI13683 | 206572100 | 0.816350711 | Malus × domestica | 10308 | 10918 |
| | 515-535 | XP_003597690 | 357454818 | 1 | Medicago truncatula | 10309 | 10919 |
| | | XP_003531652 | 356526088 | 0.918660287 | Glycine max | 10310 | 10920 |
| | | XP_003530109 | 356522957 | 0.921052632 | Glycine max | 10311 | 10921 |
| | | XP_002284003 | 225442500 | 0.897129187 | Vitis vinifera | 10312 | 10922 |
| | | CBI36079 | 270253379 | 0.897129187 | Vitis vinifera | 10313 | |
| | | XP_002515977 | 255761086 | 0.901913876 | Ricinus communis | 10314 | |
| | | XP_003530112 | 356522963 | 0.916267943 | Glycine max | 10315 | 10923 |
| | | XP_002284014 | 225442502 | 0.897129187 | Vitis vinifera | 10316 | 10924 |
| | | ACI13685 | 206572104 | 0.89354067 | Malus × domestica | 10317 | 10925 |
| | | XP_002304217 | 255761085 | 0.888755981 | Populus trichocarpa | 10318 | |
| | 560-580 | XP_002285176 | 225435326 | 1 | Vitis vinifera | 10319 | 10926 |
| | | CAN61612 | 147783603 | 0.981042654 | Vitis vinifera | 10320 | |
| | | XP_002529946 | 255761086 | 0.918246445 | Ricinus communis | 10321 | |
| | | XP_003538150 | 356539326 | 0.892180095 | Glycine max | 10322 | 10927 |
| | | XP_003539764 | 356542618 | 0.895734597 | Glycine max | 10323 | 10928 |
| | | ACI13684 | 206572102 | 0.888625592 | Malus × domestica | 10324 | 10929 |
| | | XP_003539765 | 356542620 | 0.890995261 | Glycine max | 10325 | 10930 |
| | | AAX19050 | 60327620 | 0.881516588 | Populus trichocarpa | 10326 | 10931 |
| | | DAA05766 | 109729904 | 0.853080569 | Lotus japonicus | 10327 | |
| | | AAY33856 | 63115353 | 0.8507109 | Gossypium barbadense | 10328 | 10932 |
| | 554-574 | XP_003603630 | 357466690 | 1 | Medicago truncatula | 10329 | 10933 |
| | | XP_003522716 | 356507930 | 0.943645084 | Glycine max | 10330 | 10934 |
| | | XP_003526496 | 356515618 | 0.940047962 | Glycine max | 10331 | 10935 |
| | | ACI13686 | 206572106 | 0.872901679 | Malus × domestica | 10332 | 10936 |
| | | ADL36609 | 302398628 | 0.863309353 | Malus × domestica | 10333 | 10937 |
| | | CBI20838 | 270231236 | 0.862110312 | Vitis vinifera | 10334 | |
| | | XP_002283717 | 225429913 | 0.862110312 | Vitis vinifera | 10335 | 10938 |
| | | ACL51017 | 219879369 | 0.858513189 | Citrus trifoliata | 10336 | 10939 |
| | | XP_002309538 | 255761085 | 0.868105516 | Populus trichocarpa | 10337 | |
| | | XP_002324794 | 255761085 | 0.857314149 | Populus trichocarpa | 10338 | |
| | 40-60 | AAS10176 | 41745611 | 1 | Antirrhinum majus | 10339 | 10940 |
| | 554-574 | XP_003530109 | 356522957 | 1 | Glycine max | 10340 | 10941 |
| | | XP_003531653 | 356526090 | 0.95823389 | Glycine max | 10341 | 10942 |
| | | XP_003627005 | 357513432 | 0.91646778 | Medicago truncatula | 10342 | 10943 |
| | | XP_003597690 | 357454818 | 0.918854415 | Medicago truncatula | 10343 | 10944 |
| | 590-610 | XP_003524993 | 356512573 | 1 | Glycine max | 10344 | 10945 |
| | | XP_003594520 | 357448488 | 0.781946073 | Medicago truncatula | 10345 | 10946 |
| | 25-45 | XP_003522716 | 356507930 | 1 | Glycine max | 10346 | 10947 |
| | | XP_003603630 | 357466690 | 0.932464455 | Medicago truncatula | 10347 | 10948 |
| | 560-580 | XP_003530112 | 356522963 | 1 | Glycine max | 10348 | 10949 |
| | 530-550 | XP_003532788 | 356528393 | 1 | Glycine max | 10349 | 10950 |
| | 87-107 | CAN73584 | 147820217 | 1 | Vitis vinifera | 10350 | |
| | 113-133 | XP_003516553 | 356495373 | 1 | Glycine max | 10351 | 10951 |
| | | XP_003537620 | 356538255 | 0.909756098 | Glycine max | 10352 | 10952 |
| | 566-586 | XP_003531653 | 356526090 | 1 | Glycine max | 10353 | 10953 |
| | 560-580 | XP_003539764 | 356542618 | 1 | Glycine max | 10354 | 10954 |
| | | XP_002285176 | 225435326 | 0.894674556 | Vitis vinifera | 10355 | 10955 |
| | | CAC84906 | 18076735 | 0.829585799 | Zinnia violacea | 10356 | 10956 |
| | 828-848 | XP_003539765 | 356542620 | 1 | Glycine max | 10357 | 10957 |
| ptc-miRf10007-akr | 368-388 | XP_003550796 | 356565126 | 1 | Glycine max | 10358 | 10958 |
| | | XP_003528595 | 356519875 | 0.931982634 | Glycine max | 10359 | 10959 |
| | | XP_003609844 | 357479116 | 0.714905933 | Medicago truncatula | 10360 | 10960 |
| ptc-miRf11396-akr | 600-621 | XP_003520116 | 356502619 | 1 | Glycine max | 10361 | 10961 |
| | | XP_002280702 | 225438602 | 0.856050955 | Vitis vinifera | 10362 | 10962 |
| | | EAZ28751 | 54398660 | 0.829299363 | Oryza sativa Japonica Group | 10363 | |
| ptc-miRf12069-akr | 88-108 | NP_001236364 | 351726593 | 1 | Glycine max | 10364 | 10963 |

Example 4

Verification of Expression of miRNA Molecules Associated with Abiotic Stress

Following identification of small RNA molecules potentially involved in improvement of soybean abiotic stress tolerance and their target genes (mRNAs) using bioinformatics tools, as described in Example 4 above, the actual mRNA levels in an experiment are determined using reverse transcription assay followed by quantitative Real-Time PCR (qRT-PCR) analysis. RNA levels are compared between different tissues, developmental stages, growing conditions and/or genetic backgrounds incorporated in each experiment. A correlation analysis between mRNA levels in different experimental conditions/genetic backgrounds is applied and used as evidence for the role of the gene in the plant.

Methods

Root and leaf samples are freshly excised from soybean plants grown as described above on Murashige-Skoog (Duchefa). Experimental plants are grown either under optimal irrigation conditions, salt levels or temperatures to be used as a control group, or under stressful conditions of prolonged water deprivation, high salt concentrations and a heat shock treatment at a temperature higher than 34° C. to be used as stress-induced groups to assess the drought, salinity and heat shock tolerance, respectively, of control versus transgenic plants. Total RNA is extracted from the different tissues, using mirVana™ commercial kit (Ambion) following the protocol provided by the manufacturer. For measurement and verification of messenger RNA (mRNA) expression level of all genes, reverse transcription followed by quantitative real time PCR (qRT-PCR) is performed on total RNA extracted from each plant tissue (i.e., roots and leaves) from each experimental group as described above. To elaborate, reverse transcription is performed on 1 µg total RNA, using a miScript Reverse Transcriptase kit (Qiagen), following the protocol suggested by the manufacturer. Quantitative RT-PCR is performed on cDNA (0.1 ng/µl final concentration), using a miScript SYBR GREEN PCR (Qiagen) forward (based on the miR sequence itself) and reverse primers (supplied with the kit). All qRT-PCR reactions are performed in triplicates using an ABI7500 real-time PCR machine, following the recommended protocol for the machine. To normalize the expression level of miRNAs associated with enhanced abiotic stress tolerance between the different tissues and growing conditions of the soybean plants, normalizer miRNAs are selected and used for comparison. Normalizer miRNAs, which are miRNAs with unchanged expression level between tissues and growing conditions, are custom selected for each experiment. The normalization procedure consists of second-degree polynomial fitting to a reference data (which is the median vector of all the data—excluding outliers) as described by Rosenfeld et al (2008, *Nat Biotechnol*, 26(4):462-469). A summary of primers for the differential small RNA molecules that will be used in the qRT-PCR validation and analysis is presented in Table 11a below.

TABLE 11a

Primers of Differential miRNA Molecules for qRT-PCR Validation Step.

| Mir Name | Primer Sequence (SEQ ID NO:) | Primer Length | Tm |
|---|---|---|---|
| ahy-miR3514-5p | TGGCAGGATTCTGTATTAACGGTGGA (10964) | 26 | 59.6 |
| aly-miR160c-3p | GCGTACAAGGAGCCAAGCATG (10965) | 21 | 58.5 |
| aly-miR396a-3p | GGCGTTCAATAAAGCTGTGGGAAG (10966) | 24 | 58.7 |
| aly-miR396b-3p | GCGCTCAAGAAAGCTGTGGGAAA (10967) | 23 | 60.3 |
| aly-miR831-5p | GGCAGAAGAGGTACAAGGAGATGAGA (10968) | 26 | 59.2 |
| aqc-miR159 | GGCTTTGGACTGAAGGGAGCTCTA (10969) | 24 | 59.8 |
| ath-miR157a | TTTGGCTTGACAGAAGATAGAGAGCAC (10970) | 27 | 58.8 |
| ath-miR159b | GGCTTTGGATTGAAGGGAGCTCTT (10971) | 24 | 59.0 |
| ath-miR159c | GCTTTGGATTGAAGGGAGCTCCT (10972) | 23 | 58.7 |
| ath-miRf10068-akr | CACCGGTGGAGGAGTGAGAG (10973) | 20 | 58.0 |
| ath-miRf10148-akr | GGCGGTGGTGGAAAGATCAAGAT (10974) | 23 | 59.1 |
| ath-miRf10197-akr | CACTCGACCAAGGGGGTCGAGTGA (10975) | 24 | 63.6 |
| ath-miRf10209-akr | ATGGTGGTACTCGGCCAGGTGGT (10976) | 23 | 63.5 |
| ath-miRf10239-akr | GCCGCCTTGCATCAACTGAATC (10977) | 22 | 59.2 |
| ath-miRf10240-akr | GCATCGAAGGAGATGGAGGACG (10978) | 22 | 59.0 |
| ath-miRf10279-akr | ACTCAGCCTGGGGGTCGAG (10979) | 19 | 59.7 |
| ath-miRf10368-akr | GGCACTTGGGTGGTGCTGATTAT (10980) | 23 | 59.3 |
| ath-miRf10451-akr | GGCAAGAAGGAGGAACAACCTGTTG (10981) | 25 | 60.0 |
| ath-miRf10633-akr | TGGCGGTGGATACTTCTTGATCGG (10982) | 24 | 60.5 |
| ath-miRf10687-akr | GGCTTAGCTGAAGAAGCAGAGGAG (10983) | 24 | 58.9 |
| ath-miRf10701-akr | TGCAGTTCCTGGAGGTGGAGG (10984) | 21 | 60.0 |
| ath-miRf10702-akr | CGTGGGAGGACTCCAAGTGTG (10985) | 21 | 58.9 |
| ath-miRf10751-akr | GCCTTGTGGAGAGGAAGCAAGA (10986) | 22 | 58.6 |

TABLE 11a-continued

Primers of Differential miRNA Molecules for qRT-PCR Validation Step.

| Mir Name | Primer Sequence (SEQ ID NO:) | Primer Length | Tm |
|---|---|---|---|
| ath-miRf10763-akr | GCGGTGGTGAAGAAGCATGGTT (10987) | 22 | 60.1 |
| ath-miRf10924-akr | GCTGAGGCGTATCAGGAGGTAGT (10988) | 23 | 59.4 |
| ath-miRf11021-akr | GGCGAGGTTTGCGATGAGAAAGAG (10989) | 24 | 60.2 |
| ath-miRf11037-akr | GCTCATCGGAGAAACAGAGGAGC (10990) | 23 | 59.2 |
| ath-miRf11042-akr | GGAAGAGGCAGTGCATGGGTA (10991) | 21 | 58.3 |
| ath-miRf11045-akr | GGCTTTCTTGTGGAGGAAGCAAGAT (10992) | 25 | 59.3 |
| bdi-miR2508 | GCATTGAGTGCAGCGTTGATGAAC (10993) | 24 | 59.7 |
| bna-miR2111b-5p | CATTTGGCTAATCTGCATCCTGAGGTTTA (10994) | 29 | 59.1 |
| bra-miR160a-3p | CGCGTATGAGGAGCCATGCATA (10995) | 22 | 59.0 |
| csi-miR162-5p | TGGAGGCAGCGGTTCATCGATC (10996) | 22 | 61.1 |
| csi-miR3946 | GGCTTGTAGAGAAAGAGAAGAGAGCAC (10997) | 27 | 58.8 |
| csi-miR3948 | TGGAGTGGGAGTGGGAGTAGGGTG (10998) | 24 | 62.6 |
| ctr-miR171 | GCTTGAGCCGCGTCAATATCTCC (10999) | 23 | 60.1 |
| far-miR1134 | GCCGACAACAACAACAAGAAGAAGAG (11000) | 26 | 58.9 |
| ghr-miR2950 | TGGTGTGCAGGGGGTGGAATA (11001) | 21 | 59.6 |
| gma-miR1507a | TGGCTCTCATTCCATACATCGTCTGA (11002) | 26 | 59.2 |
| gma-miR1524 | CGAGTCCGAGGAAGGAACTCC (11003) | 21 | 58.2 |
| gma-miR156g | TTTGGCACAGAAGATAGAGAGCACAG (11004) | 26 | 58.7 |
| gma-miR157c | TGGCTGACAGAAGACTAGAGAGCAC (11005) | 25 | 59.6 |
| gma-miR159a-3p | TGGCTTTGGATTGAAGGGAGCTCTA (11006) | 25 | 59.5 |
| gma-miR159d | GCAGCTGCTTAGCTATGGATCCC (11007) | 23 | 59.3 |
| gma-miR2119 | GGCTCAAAGGGAGTTGTAGGGGAA (11008) | 24 | 60.0 |
| gma-miR396d | GCAAGAAAGCTGTGGGAGAATATGGC (11009) | 26 | 60.2 |
| gma-miR4371b | AAGTGATGACGTGGTAGACGGAGT (11010) | 24 | 59.3 |
| gma-miR4376-5p | TACGCAGGAGAGATGACGCTGT (11011) | 22 | 59.6 |
| gma-miR4412-3p | AGTGGCGTAGATCCCCACAAC (11012) | 21 | 58.4 |
| gma-miR4416a | ACGGGTCGCTCTCACCTAGG (11013) | 20 | 59.5 |
| gma-miR482a-3p | TCTTCCCAATTCCGCCCATTCCTA (11014) | 24 | 59.6 |
| gma-miR482b-5p | GCTATGGGGGATTGGGAAGGAAT (11015) | 24 | 59.9 |
| gso-miR169g* | TCGGCAAGTTGGCCTTGGCT (11016) | 20 | 61.5 |
| gso-miR482a | GGCTCTTCCCTACACCTCCCATAC (11017) | 24 | 59.7 |
| iba-miR157 | CATTTGGCTTGACAGAAGATAGAGAGCAT (11018) | 29 | 58.9 |
| mdm-miR482a-5p | CGGAATGGGCTGTTTGGGAACA (11019) | 22 | 59.7 |
| mtr-miR2119 | GCTCAAAGGGAGGTGTGGAGTAG (11020) | 23 | 58.5 |
| osa-miR159e | GCATTGGATTGAAGGGAGCTCCT (11021) | 23 | 58.8 |
| osa-miR159f | GGCCTTGGATTGAAGGGAGCTCTA (11022) | 24 | 59.9 |

TABLE 11a-continued

Primers of Differential miRNA Molecules for qRT-PCR Validation Step.

| Mir Name | Primer Sequence (SEQ ID NO:) | Primer Length | Tm |
|---|---|---|---|
| osa-miR162a | GGCTCGATAAACCTCTGCATCCAG (11023) | 24 | 59.3 |
| osa-miR1846e | CAACGAGGAGGCCGGGACCA (11024) | 20 | 62.8 |
| osa-miR1850.1 | GCTGGAAAGTTGGGAGATTGGGG (11025) | 23 | 59.6 |
| osa-miR1858a | GAGAGGAGGACGGAGTGGGGC (11026) | 21 | 62.2 |
| osa-miR1869 | GCTGAGAACAATAGGCATGGAGGTA (11027) | 26 | 60.0 |
| osa-miR1874-3p | GCTATGGATGGAGGTGTAACCCGATG (11028) | 26 | 60.6 |
| osa-miR1879 | CGTGTTTGGTTTAGGGATGAGGTGG (11029) | 25 | 59.6 |
| osa-miR1881 | GCAATGTTATTGTAGCGTGGTGGTGT (11030) | 26 | 60.1 |
| osa-miR2055 | GGCTTTCCTTGGGAAGGTGGTTTC (11031) | 24 | 60.0 |
| osa-miR2104 | GCGGCGAGGGGATGCGAGCG (11032) | 20 | 67.4 |
| osa-miRf10105-akr | TTGGCCTCGTCGAAGAAGGAGA (11033) | 22 | 59.5 |
| osa-miRf10151-akr | GGCTGGCTATATTTTGGGACGGAG (11034) | 24 | 59.3 |
| osa-miRf10362-akr | GCTGGAGGATGCGACGGTGCT (11035) | 21 | 63.6 |
| osa-miRf10839-akr | CCCTGTGACGTTGGTGAAGGTG (11036) | 22 | 59.7 |
| osa-miRf10849-akr | TGGACTGTTTGGGGGAGCTTCT (11037) | 22 | 59.6 |
| osa-miRf11013-akr | GGTTTGCCGGAGTTGGAGGAGA (11038) | 22 | 60.6 |
| osa-miRf11341-akr | CGCGCCGACGATGACGGTGGAGT (11039) | 23 | 67.4 |
| osa-miRf11352-akr | GCAGGGATTTTGGAAGGAGGTGACA (11040) | 25 | 60.8 |
| osa-miRf11355-akr | GGTGGAGGTGGAGCTGTGCCAAA (11041) | 23 | 63.2 |
| osa-miRf11415-akr | GAGAGCAGGATGCAGCCAAGG (11042) | 21 | 59.6 |
| osa-miRf11595-akr | CCATCGGTGTTGGAGGTGGC (11043) | 20 | 59.8 |
| osa-miRf11649-akr | AAACCGTGCAAAGGAGGTCCC (11044) | 21 | 59.4 |
| osa-miRf11829-akr | ACGCGGAGGAGGTGGTGTTCT (11045) | 21 | 62.0 |
| osa-miRf11996-akr | GCGTCTTATAACCTGAAACGGGGG (11046) | 24 | 59.5 |
| pab-miR3711 | TGGCGCTAGAAGGAGGGCCT (11047) | 20 | 61.6 |
| ppt-miR1220a | GCTTCCGGTGGTGAGGAAGATAG (11048) | 23 | 58.6 |
| ppt-miR166m | GCTCGGACCAGGCATCATTCCTT (11049) | 23 | 61.0 |
| ppt-miR533b-5p | GAGCTGTCCAGGCTGTGAGGG (11050) | 21 | 61.0 |
| ppt-miR895 | GCGTAGCTTAGCGAGGTGTTGGTA (11051) | 24 | 60.7 |
| psi-miR159 | GCCTTGGATTGAAGGGAGCTCCA (11052) | 23 | 60.6 |
| pta-miR156a | TTTGGCCAGAAGATAGAGAGCACATC (11053) | 26 | 58.5 |
| pta-miR156b | TTGCCAGAAGATAGAGAGCACAAC (11054) | 25 | 58.6 |
| pta-miR166c | CCGGACCAGGCTTCATCCCAG (11055) | 21 | 61.1 |
| ptc-miR166p | TCGGACCAGGCTCCATTCCTT (11056) | 21 | 59.4 |
| ptc-miRf10007-akr | GCCATTGACAGGGAAACTCACCA (11057) | 23 | 59.2 |
| ptc-miRf10132-akr | TTGGCGGTGATTGAACGGAGGGT (11058) | 23 | 62.7 |
| ptc-miRf10148-akr | TGGTGCACCTGGTGGTGGAG (11059) | 20 | 60.8 |

TABLE 11a-continued

Primers of Differential miRNA Molecules for qRT-PCR Validation Step.

| Mir Name | Primer Sequence (SEQ ID NO:) | Primer Length | Tm |
|---|---|---|---|
| ptc-miRf10226-akr | TCCTTTGGGGAGATGGAGAGCTT (11060) | 23 | 58.9 |
| ptc-miRf10271-akr | TGGCTTGGATTGAAGGGAGCTCTAA (11061) | 25 | 59.5 |
| ptc-miRf10300-akr | GGCTTTGGAAAGCAAGTGAGGTG (11062) | 23 | 58.7 |
| ptc-miRf10522-akr | TTGGGGAGCTGGACTCTGGA (11063) | 20 | 58.6 |
| ptc-miRf10619-akr | GTTGGGCTTGCTGCTGGAGGA (11064) | 21 | 61.5 |
| ptc-miRf10734-akr | GCCATCTAGGTGGTGGTCCAGTG (11065) | 23 | 60.7 |
| ptc-miRf10976-akr | TGGGAACGTGGCTGTGGCTA (11066) | 20 | 60.3 |
| ptc-miRf10985-akr | TGGCCAGAAGATAGAGAGCACTGA (11067) | 24 | 58.8 |
| ptc-miRf11018-akr | CCTGCAAACCTAAGGGAGCGG (11068) | 21 | 59.6 |
| ptc-miRf11079-akr | AAGATGGAGAAGCAGGGCACGTGC (11069) | 24 | 63.4 |
| ptc-miRf11315-akr | GCCAACTTAGAGTTGGGGGTGG (11070) | 22 | 59.2 |
| ptc-miRf11324-akr | CTTGTCGCAGGAGAGATGGCGCT (11071) | 23 | 63.1 |
| ptc-miRf11396-akr | GCCAAGGCTCTGATACCATGTCAA (11072) | 24 | 58.9 |
| ptc-miRf11669-akr | GGCCAAGGCTCTGATACCATGTT (11073) | 23 | 58.8 |
| ptc-miRf11757-akr | CCTTGGTGAATGGTTGGGAGGAAT (11074) | 24 | 58.7 |
| ptc-miRf11844-akr | CCCAACTTGGAGGTGGGTGTGG (11075) | 22 | 61.4 |
| ptc-miRf11847-akr | GCGAAAGTGTGGAGAAGGTTGCC (11076) | 23 | 60.6 |
| ptc-miRf11855-akr | GGCAGAGCATGGATGGAGCTA (11077) | 21 | 58.2 |
| ptc-miRf11953-akr | GGCGTAATCTGCATCCTGAGGTT (11078) | 23 | 58.9 |
| ptc-miRf12069-akr | GGAGGGGCTGCAAGACCCAAG (11079) | 21 | 61.5 |
| ptc-miRf12389-akr | GTCGACCTGGCGAGTCAACCGGG (11080) | 23 | 65.3 |
| sbi-miR159a | GGCTTTGGATTGAAGGGAGCTCTG (11081) | 24 | 59.6 |
| smo-miR1103-3p | GCTGGAAAAAGGAGGTGCATTCTTGT (11082) | 26 | 60.0 |
| smo-miR156b | TGGCCTGACAGAAGATAGAGAGCAC (11083) | 25 | 59.7 |
| tae-miR2003 | CGGTTGGGCTGTATGATGGCGA (11084) | 22 | 61.3 |
| vvi-miR2111-5p | TGGCTAATCTGCATCCTGAGGTCTA (11085) | 25 | 58.7 |
| vvi-miR394b | GCTTGGCATTCTGTCCACCTCC (11086) | 22 | 59.9 |
| zma-miR167u | GGCTGAAGCTGCCACATGATCTG (11087) | 23 | 60.2 |
| zma-miR396b-3p | GGCTTCCACAGCTTTCTTGAACTG (11088) | 24 | 58.5 |
| zma-miR398a-5p | TGTGTTCTCAGGTCGCCCCCG (11089) | 21 | 62.9 |
| zma-miR482-5p | TGGCTCTTCCTTGTTCCTCCCATT (11090) | 24 | 59.7 |

Alternative RT-PCR Validation Method of Selected microRNAs of the Invention

A novel microRNA quantification method has been applied using stem-loop RT followed by PCR analysis (Chen C, Ridzon D A, Broomer A J, Zhou Z, Lee D H, Nguyen J T, Barbisin M, Xu N L, Mahuvakar V R, Andersen M R, Lao K Q, Livak K J, Guegler K J. 2005, Nucleic Acids Res 33(20):e179; Varkonyi-Gasic E, Wu R, Wood M, Walton E F, Hellens R P. 2007, Plant Methods 3:12). This highly accurate method allows the detection of less abundant miRNAs. In this method, stem-loop RT primers are used, which provide higher specificity and efficiency to the reverse transcription process. While the conventional method relies on polyadenylated (poly (A)) tail and thus becomes sensitive to methylation because of the susceptibility of the enzymes involved, in this novel method the reverse transcription step is transcript-specific and insensitive to methylation. Reverse transcriptase reactions contained RNA samples including purified total RNA, 50 nM stem-loop RT primer (50-51 nucleotide long, see Table 11b, synthesized by Sigma), and using the SuperScript II reverse transcriptase (Invitrogen). A mix of up to 12 stem-loop RT primers may be used in each reaction, and the forward primers are such that the last 6 nucleotides are replaced with a GC rich sequence. For the PCR step, each miRNA has a custom forward primer (18-24 nucleotide long) and a universal stem loop reverse primer (5'-GTGCAGGGTCCGAGGT-3'-SEQ ID NO: 11617). Table 11b below lists the primers used for PCR validation using this method. Note, SL-RT stands for stem loop reverse transcription primer, and SL-F stands for stem loop forward primer.

TABLE 11b

Stem Loop Reverse Transcriptase Primers for RT-PCR Validation of Differential Mirs under Abiotic Stress.

| Mir Name | Stem Loop Primer (SEQ ID NO:) | Forward Primer (SEQ ID NO:) | Forward Primer Length |
|---|---|---|---|
| ahy-miR3514-5p | GTCGTATCCAGTGCAGGGTCCGAGGTATTC GCACTGGATACGACTCCACC (11618) | CGGCGGAGGATTCTGTAT TAAC (11619) | 22 |
| aly-miR396a-3p | GTCGTATCCAGTGCAGGGTCCGAGGTATTC GCACTGGATACGACCTTCCC (11620) | CGGCGGGTTCAATAAAG CTGT (11621) | 21 |
| aly-miR396b-3p | GTCGTATCCAGTGCAGGGTCCGAGGTATTC GCACTGGATACGACTTTCCC (11622) | CGGCGGGCTCAAGAAAG CTGT (11623) | 21 |
| aly-miR831-5p | GTCGTATCCAGTGCAGGGTCCGAGGTATTC GCACTGGATACGACTCTCAT (11624) | CGGCGGAGAAGAGGTAC AAGGAG (11625) | 23 |
| ath-miRf10197-akr | GTCGTATCCAGTGCAGGGTCCGAGGTATTC GCACTGGATACGACTCACTCG (11626) | CGCTCACTCGACCAAGG GGGT (11627) | 21 |
| ath-miRf10279-akr | GTCGTATCCAGTGCAGGGTCCGAGGTATTC GCACTGGATACGACATCACT (11628) | TTCCACTCAGCCTGGGGG TCG (11629) | 21 |
| ath-miRf10687-akr | GTCGTATCCAGTGCAGGGTCCGAGGTATTC GCACTGGATACGACCTCCTC (11630) | CGGCGGTTAGCTGAAGA AGCA (11631) | 21 |
| gma-miRf10687-akr-homolog | GTCGTATCCAGTGCAGGGTCCGAGGTATTC GCACTGGATACGACCTCCTC (11632) | GAGCTTAGCCGCAGAGG CA (11633) | 19 |
| ath-miRf11021-akr | GTCGTATCCAGTGCAGGGTCCGAGGTATTC GCACTGGATACGACCTCTTT (11634) | CGGCGAGGTTTGCGATG AG (11635) | 19 |
| ath-miRf11045-akr | GTCGTATCCAGTGCAGGGTCCGAGGTATTC GCACTGGATACGACATCTTG (11636) | CGGCGGTTTCTTGTGGAG GAAG (11637) | 22 |
| csi-miR162-5p | GTCGTATCCAGTGCAGGGTCCGAGGTATTC GCACTGGATACGACGATCGA (11638) | CGTCTGGAGGCAGCGGTT CA (11639) | 20 |
| far-miR1134 | GTCGTATCCAGTGCAGGGTCCGAGGTATTC GCACTGGATACGACCTCTTC (11640) | CGCGCCGACAACAACAA CAAGAA (11641) | 23 |
| gma-miR159d | GTCGTATCCAGTGCAGGGTCCGAGGTATTC GCACTGGATACGACGGGATC (11642) | CGGCGGAGCTGCTTAGCT ATG (11643) | 21 |
| gma-miR396d | GTCGTATCCAGTGCAGGGTCCGAGGTATTC GCACTGGATACGACGCCATA (11644) | CGCGCAAGAAAGCTGTG GGAGAA (11645) | 23 |
| gma-miR4376-5p | GTCGTATCCAGTGCAGGGTCCGAGGTATTC GCACTGGATACGACACAGCG (11646) | GGCCGGTACGCAGGAGA GATGA (11647) | 22 |
| gma-miR4412-3p | GTCGTATCCAGTGCAGGGTCCGAGGTATTC GCACTGGATACGACGTTGTG (11648) | TTCCAGTGGCGTAGATCC C (11649) | 19 |
| gma-miR4416a | GTCGTATCCAGTGCAGGGTCCGAGGTATTC GCACTGGATACGACCCTAGG (11650) | CGGCACGGGTCGCTCTCA (11651) | 18 |
| gma-miR482a-3p | GTCGTATCCAGTGCAGGGTCCGAGGTATTC GCACTGGATACGACTAGGAA (11652) | CGTCTCTTCCCAATTCCG CCCA (11653) | 22 |
| gso-miR169g* | GTCGTATCCAGTGCAGGGTCCGAGGTATTC GCACTGGATACGACAGCCAAG (11654) | GTTACTCGGCAAGTTGGC (11655) | 18 |
| mtr-miR2119 | GTCGTATCCAGTGCAGGGTCCGAGGTATTC GCACTGGATACGACCTACTC (11656) | CGGCGGTCAAAGGGAGG TGTG (11657) | 21 |
| osa-miR1874-3p | GTCGTATCCAGTGCAGGGTCCGAGGTATTC GCACTGGATACGACCATCGG (11658) | CGGCGGTATGGATGGAG GTGTAAC (11659) | 24 |

TABLE 11b-continued

Stem Loop Reverse Transcriptase Primers for RT-PCR Validation of Differential Mirs under Abiotic Stress.

| Mir Name | Stem Loop Primer (SEQ ID NO:) | Forward Primer (SEQ ID NO:) | Forward Primer Length |
|---|---|---|---|
| osa-miRf10105-akr | GTCGTATCCAGTGCAGGGTCCGAGGTATTCGCACTGGATACGACTCTCCT (11660) | CCGGTTGGCCTCGTCGAAGA (11661) | 20 |
| osa-miRf10151-akr | GTCGTATCCAGTGCAGGGTCCGAGGTATTCGCACTGGATACGACCTCCGT (11662) | CGGCGGTGGCTATATTTTGGG (11663) | 21 |
| osa-miRf10362-akr | GTCGTATCCAGTGCAGGGTCCGAGGTATTCGCACTGGATACGACAGCACC (11664) | CGATGCTGGAGGATGCGAC (11665) | 19 |
| osa-miRf10839-akr | GTCGTATCCAGTGCAGGGTCCGAGGTATTCGCACTGGATACGACCACCTT (11666) | CGGCCCTGTGACGTTGTG (11667) | 19 |
| osa-miRf11649-akr | GTCGTATCCAGTGCAGGGTCCGAGGTATTCGCACTGGATACGACGGGACC (11668) | GCGCAAACCGTGCAAAGGA (11669) | 19 |
| pab-miR3711 | GTCGTATCCAGTGCAGGGTCCGAGGTATTCGCACTGGATACGACAGGCCC (11670) | GGCCCTGGCGCTAGAAGGA (11671) | 19 |
| ppt-miR533b-5p | GTCGTATCCAGTGCAGGGTCCGAGGTATTCGCACTGGATACGACCCCTCA (11672) | CGGCGAGCTGTCCAGGCTG (11673) | 19 |
| ppt-miR895 | GTCGTATCCAGTGCAGGGTCCGAGGTATTCGCACTGGATACGACTACCAA (11674) | CGGCGGGTAGCTTAGCGAGGTG (11675) | 22 |
| ptc-miRf10300-akr | GTCGTATCCAGTGCAGGGTCCGAGGTATTCGCACTGGATACGACCACCTC (11676) | CGGCGGTTTGGAAAGCAAGT (11677) | 20 |
| ptc-miRf10522-akr | GTCGTATCCAGTGCAGGGTCCGAGGTATTCGCACTGGATACGACTCCAGA (11678) | CGCGCTTGGGGAGCTGGAC (11679) | 19 |
| ptc-miRf10619-akr | GTCGTATCCAGTGCAGGGTCCGAGGTATTCGCACTGGATACGACTCCTCC (11680) | CGGCGTTGGGCTTGCTGCT (11681) | 19 |
| ptc-miRf11855-akr | GTCGTATCCAGTGCAGGGTCCGAGGTATTCGCACTGGATACGACTAGCTC (11682) | CGGCGGCAGAGCATGGATG (11683) | 19 |
| ptc-miRf12069-akr | GTCGTATCCAGTGCAGGGTCCGAGGTATTCGCACTGGATACGACCTTGGG (11684) | CGTCGGAGGGGCTGCAAGA (11685) | 19 |
| smo-miR1103-3p | GTCGTATCCAGTGCAGGGTCCGAGGTATTCGCACTGGATACGACACAAGA (11686) | CGGCTGGAAAAAGGAGGTGCAT (11687) | 22 |
| zma-miR396b-3p | GTCGTATCCAGTGCAGGGTCCGAGGTATTCGCACTGGATACGACTTTCCC (11688) | CGGCGGGTTCAATAAAGCTGT (11689) | 21 |
| zma-miR482-5p | GTCGTATCCAGTGCAGGGTCCGAGGTATTCGCACTGGATACGACAAGGCT (11690) | CGGCGGTGGGAGATGAAGG (11691) | 19 |
| aly-miR160c-3p | GTCGTATCCAGTGCAGGGTCCGAGGTATTCGCACTGGATACGACCATGCT (11692) | GAATCGCGTACAAGGAGCCA (11693) | 20 |
| aqc-miR159 | GTCGTATCCAGTGCAGGGTCCGAGGTATTCGCACTGGATACGACTAGAGC (11694) | CGGCGGTTTGGACTGAAGGGA (11695) | 21 |
| ath-miR157a | GTCGTATCCAGTGCAGGGTCCGAGGTATTCGCACTGGATACGACGTGCTC (11696) | CGGCGGTTGACAGAAGATAGA (11697) | 21 |
| ath-miR159b | GTCGTATCCAGTGCAGGGTCCGAGGTATTCGCACTGGATACGACAAGAGC (11698) | CGGCGGTTTGGATTGAAGGGA (11699) | 21 |
| ath-miR159c | GTCGTATCCAGTGCAGGGTCCGAGGTATTCGCACTGGATACGACAGGAGC (11700) | CGGCGGTTTGGATTGAAGGGA (11701) | 21 |
| ath-miRf10068-akr | GTCGTATCCAGTGCAGGGTCCGAGGTATTCGCACTGGATACGACCTCTCA (11702) | GGCCCACCGGTGGAGGAG (11703) | 18 |
| ath-miRf10148-akr | GTCGTATCCAGTGCAGGGTCCGAGGTATTCGCACTGGATACGACATCTTG (11704) | CGGCGGGGTGGTGGAAAGAT (11705) | 20 |
| ath-miRf10209-akr | GTCGTATCCAGTGCAGGGTCCGAGGTATTCGCACTGGATACGACACCACC (11706) | CGTCATGGTGGTACTCGGCCA (11707) | 21 |

TABLE 11b-continued

Stem Loop Reverse Transcriptase Primers for RT-PCR Validation of Differential Mirs under Abiotic Stress.

| Mir Name | Stem Loop Primer (SEQ ID NO:) | Forward Primer (SEQ ID NO:) | Forward Primer Length |
|---|---|---|---|
| ath-miRf10239-akr | GTCGTATCCAGTGCAGGGTCCGAGGTATTCGCACTGGATACGACGATTCA (11708) | CGGCCGCCTTGCATCAAC (11709) | 18 |
| ath-miRf10240-akr | GTCGTATCCAGTGCAGGGTCCGAGGTATTCGCACTGGATACGACCGTCCT (11710) | CGGCGGATCGAAGGAGATGG (11711) | 20 |
| ath-miRf10368-akr | GTCGTATCCAGTGCAGGGTCCGAGGTATTCGCACTGGATACGACATAATC (11712) | AAGGCCTACTTGGGTGGTGCT (11713) | 21 |
| ath-miRf10451-akr | GTCGTATCCAGTGCAGGGTCCGAGGTATTCGCACTGGATACGACCAACAG (11714) | CGGCGGAAGAAGGAGAACAAC (11715) | 22 |
| ath-miRf10633-akr | GTCGTATCCAGTGCAGGGTCCGAGGTATTCGCACTGGATACGACCCGATC (11716) | CGGCTGGCGGTGGATACTTCTT (11717) | 22 |
| ath-miRf10701-akr | GTCGTATCCAGTGCAGGGTCCGAGGTATTCGCACTGGATACGACTCCTCC (11718) | CGCGCTGCAGTTCCTGGAGGT (11719) | 21 |
| ath-miRf10702-akr | GTCGTATCCAGTGCAGGGTCCGAGGTATTCGCACTGGATACGACCACACT (11720) | CGGCGTGGGAGGACTCCA (11721) | 18 |
| ath-miRf10751-akr | GTCGTATCCAGTGCAGGGTCCGAGGTATTCGCACTGGATACGACTCTTGC (11722) | CGGCGGCTTGTGGAGAGGAA (11723) | 20 |
| ath-miRf10763-akr | GTCGTATCCAGTGCAGGGTCCGAGGTATTCGCACTGGATACGACAACCAT (11724) | CGCGCGGTGGTGAAGAAGC (11725) | 19 |
| ath-miRf10924-akr | GTCGTATCCAGTGCAGGGTCCGAGGTATTCGCACTGGATACGACACTACC (11726) | CGTAGGTGAGGCGTATCAGGA (11727) | 21 |
| ath-miRf11037-akr | GTCGTATCCAGTGCAGGGTCCGAGGTATTCGCACTGGATACGACGCTCCT (11728) | CGGCGGTCATCGGAGAAACAG (11729) | 21 |
| ath-miRf11042-akr | GTCGTATCCAGTGCAGGGTCCGAGGTATTCGCACTGGATACGACTACCCAT (11730) | AATCCTGGAAGAGGCAGTGC (11731) | 20 |
| bdi-miR2508 | GTCGTATCCAGTGCAGGGTCCGAGGTATTCGCACTGGATACGACGTTCAT (11732) | CGGCATTGAGTGCAGCGTTG (11733) | 20 |
| bna-miR2111b-5p | GTCGTATCCAGTGCAGGGTCCGAGGTATTCGCACTGGATACGACTAAACC (11734) | CGGCGGTAATCTGCATCCTGA (11735) | 21 |
| bra-miR160a-3p | GTCGTATCCAGTGCAGGGTCCGAGGTATTCGCACTGGATACGACTATGCA (11736) | GAATCGCGTATGAGGAGCCA (11737) | 20 |
| csi-miR3946 | GTCGTATCCAGTGCAGGGTCCGAGGTATTCGCACTGGATACGACGTGCTC (11738) | CGGCGGTTGTAGAGAAAGAGAAGA (11739) | 24 |
| csi-miR3948 | GTCGTATCCAGTGCAGGGTCCGAGGTATTCGCACTGGATACGACCACCCT (11740) | CGGCTGGAGTGGGAGTGGGAGT (11741) | 22 |
| ctr-miR171 | GTCGTATCCAGTGCAGGGTCCGAGGTATTCGCACTGGATACGACGGAGAT (11742) | AATCCTTTGAGCCGCGTCAAT (11743) | 21 |
| ghr-miR2950 | GTCGTATCCAGTGCAGGGTCCGAGGTATTCGCACTGGATACGACTATTCC (11744) | CGTCTGGTGTGCAGGGGGT (11745) | 19 |
| gma-miR1507a | GTCGTATCCAGTGCAGGGTCCGAGGTATTCGCACTGGATACGACTCAGAC (11746) | CGGCGGTCTCATTCCATACATC (11747) | 22 |
| gma-miR1524 | GTCGTATCCAGTGCAGGGTCCGAGGTATTCGCACTGGATACGACGGAGTT (11748) | GCGCCGAGTCCGAGGAAGG (11749) | 19 |
| gma-miR156g | GTCGTATCCAGTGCAGGGTCCGAGGTATTCGCACTGGATACGACCTGTGC (11750) | GCGGCGGACAGAAGATAGAGA (11751) | 21 |
| gma-miR157c | GTCGTATCCAGTGCAGGGTCCGAGGTATTCGCACTGGATACGACGTGCTC (11752) | CGGCGGTGACAGAAGACTAGA (11753) | 21 |
| gma-miR159a-3p | GTCGTATCCAGTGCAGGGTCCGAGGTATTCGCACTGGATACGACTAGAGC (11754) | CGGCGGTTTGGATTGAAGGGA (11755) | 21 |

TABLE 11b-continued

Stem Loop Reverse Transcriptase Primers for RT-PCR Validation of Differential Mirs under Abiotic Stress.

| Mir Name | Stem Loop Primer (SEQ ID NO:) | Forward Primer (SEQ ID NO:) | Forward Primer Length |
|---|---|---|---|
| gma-miR2119 | GTCGTATCCAGTGCAGGGTCCGAGGTATTCGCACTGGATACGACTTCCCC (11756) | CGGCGGTCAAAGGGAGTTGTA (11757) | 21 |
| gma-miR4371b | GTCGTATCCAGTGCAGGGTCCGAGGTATTCGCACTGGATACGACACTCCG (11758) | CGGCGGAAGTGATGACGTGGTAGA (11759) | 24 |
| gma-miR482b-5p | GTCGTATCCAGTGCAGGGTCCGAGGTATTCGCACTGGATACGACATTCCT (11760) | CGGCTATGGGGGATTGGGA (11761) | 20 |
| gso-miR482a | GTCGTATCCAGTGCAGGGTCCGAGGTATTCGCACTGGATACGACGTATGG (11762) | CGGCGGTCTTCCCTACACCTC (11763) | 21 |
| iba-miR157 | GTCGTATCCAGTGCAGGGTCCGAGGTATTCGCACTGGATACGACATGCTC (11764) | CGGCGGTTGACAGAAGATAGA (11765) | 21 |
| mdm-miR482a-5p | GTCGTATCCAGTGCAGGGTCCGAGGTATTCGCACTGGATACGACTGTTCC (11766) | CGGCGGAATGGGCTGTTTG (11767) | 19 |
| osa-miR159e | GTCGTATCCAGTGCAGGGTCCGAGGTATTCGCACTGGATACGACAGGAGC (11768) | CGGCGGATTGGATTGAAGGGA (11769) | 21 |
| osa-miR159f | GTCGTATCCAGTGCAGGGTCCGAGGTATTCGCACTGGATACGACTAGAGC (11770) | AAGGCCTCTTGGATTGAAGGGA (11771) | 22 |
| osa-miR162a | GTCGTATCCAGTGCAGGGTCCGAGGTATTCGCACTGGATACGACCTGGAT (11772) | CGGCGGTCGATAAACCTCTGC (11773) | 21 |
| osa-miR1846e | GTCGTATCCAGTGCAGGGTCCGAGGTATTCGCACTGGATACGACTGGTCC (11774) | CGTCCAACGAGGAGGCCG (11775) | 18 |
| osa-miR1850.1 | GTCGTATCCAGTGCAGGGTCCGAGGTATTCGCACTGGATACGACCCCCAA (11776) | CGGCGGTGGAAAGTTGGGAGA (11777) | 21 |
| osa-miR1858a | GTCGTATCCAGTGCAGGGTCCGAGGTATTCGCACTGGATACGACGCCCCA (11778) | CGGCGAGAGGAGGACGGAG (11779) | 19 |
| osa-miR1869 | GTCGTATCCAGTGCAGGGTCCGAGGTATTCGCACTGGATACGACTACCTC (11780) | CGCGCTGAGAACAATAGGCATGG (11781) | 23 |
| osa-miR1879 | GTCGTATCCAGTGCAGGGTCCGAGGTATTCGCACTGGATACGACCCACCT (11782) | CGCGCGTGTTTGGTTTAGGGATG (11783) | 23 |
| osa-miR1881 | GTCGTATCCAGTGCAGGGTCCGAGGTATTCGCACTGGATACGACACACCA (11784) | CGGCGGAATGTTATTGTAGCGTGG (11785) | 24 |
| osa-miR2055 | GTCGTATCCAGTGCAGGGTCCGAGGTATTCGCACTGGATACGACGAAACC (11786) | AAGGCCTTTTCCTTGGGAAGGT (11787) | 22 |
| osa-miR2104 | GTCGTATCCAGTGCAGGGTCCGAGGTATTCGCACTGGATACGACCACGCT (11788) | TTAGCGGCGAGGGGATGCG (11789) | 19 |
| osa-miRf10849-akr | GTCGTATCCAGTGCAGGGTCCGAGGTATTCGCACTGGATACGACAGAAGC (11790) | CGGCTGGACTGTTTGGGGGA (11791) | 20 |
| osa-miRf11013-akr | GTCGTATCCAGTGCAGGGTCCGAGGTATTCGCACTGGATACGACTCTCCT (11792) | TAGGGTTTGCCGGAGTTGG (11793) | 19 |
| osa-miRf11341-akr | GTCGTATCCAGTGCAGGGTCCGAGGTATTCGCACTGGATACGACACTCCAC (11794) | TAGCGCGCCGACGATGACG (11795) | 19 |
| osa-miRf11352-akr | GTCGTATCCAGTGCAGGGTCCGAGGTATTCGCACTGGATACGACTGTCAC (11796) | CGCGCAGGGATTTTGAAGGAG (11797) | 22 |
| osa-miRf11355-akr | GTCGTATCCAGTGCAGGGTCCGAGGTATTCGCACTGGATACGACTTTGGC (11798) | CGTCGGTGGAGGTGGAGCTGT (11799) | 21 |
| osa-miRf11415-akr | GTCGTATCCAGTGCAGGGTCCGAGGTATTCGCACTGGATACGACCCTTGG (11800) | CGGCGAGAGCAGGATGCAG (11801) | 19 |
| osa-miRf11595-akr | GTCGTATCCAGTGCAGGGTCCGAGGTATTCGCACTGGATACGACGCCACC (11802) | CGCGCCATCGGTGTTGGA (11803) | 18 |

TABLE 11b-continued

Stem Loop Reverse Transcriptase Primers for RT-PCR Validation of
Differential Mirs under Abiotic Stress.

| Mir Name | Stem Loop Primer (SEQ ID NO:) | Forward Primer (SEQ ID NO:) | Forward Primer Length |
|---|---|---|---|
| osa-miRf11829-akr | GTCGTATCCAGTGCAGGGTCCGAGGTATTC GCACTGGATACGACAGAACA (11804) | CGTCACGCGGAGGAGGT GG (11805) | 19 |
| osa-miRf11996-akr | GTCGTATCCAGTGCAGGGTCCGAGGTATTC GCACTGGATACGACCCCCCG (11806) | CGGCGGGTCTTATAACCT GAAA (11807) | 22 |
| ppt-miR1220a | GTCGTATCCAGTGCAGGGTCCGAGGTATTC GCACTGGATACGACCTATCT (11808) | GCGCTTCCGGTGGTGAGG A (11809) | 19 |
| ppt-miR166m | GTCGTATCCAGTGCAGGGTCCGAGGTATTC GCACTGGATACGACAAGGAA (11810) | CGGCTCGGACCAGGCAT CA (11811) | 19 |
| psi-miR159 | GTCGTATCCAGTGCAGGGTCCGAGGTATTC GCACTGGATACGACTGGAGC (11812) | AAGGCCTCTTGGATTGAA GGGA (11813) | 22 |
| pta-miR156a | GTCGTATCCAGTGCAGGGTCCGAGGTATTC GCACTGGATACGACGATGTG (11814) | CGGCGGCAGAAGATAGA GAG (11815) | 20 |
| pta-miR156b | GTCGTATCCAGTGCAGGGTCCGAGGTATTC GCACTGGATACGACGTTGTG (11816) | CGGCGGCAGAAGATAGA GAG (11817) | 20 |
| pta-miR166c | GTCGTATCCAGTGCAGGGTCCGAGGTATTC GCACTGGATACGACCTGGGA (11818) | CGTCCCGGACCAGGCTTC A (11819) | 19 |
| ptc-miR166p | GTCGTATCCAGTGCAGGGTCCGAGGTATTC GCACTGGATACGACAAGGAA (11820) | CGTCTCGGACCAGGCTCC A (11821) | 19 |
| ptc-miRf10007-akr | GTCGTATCCAGTGCAGGGTCCGAGGTATTC GCACTGGATACGACTGGTGA (11822) | CGGCGGCATTGACAGGG AAAC (11823) | 21 |
| ptc-miRf10132-akr | GTCGTATCCAGTGCAGGGTCCGAGGTATTC GCACTGGATACGACACCCTC (11824) | CGTCTTGGCGGTGATTGA ACG (11825) | 21 |
| ptc-miRf10148-akr | GTCGTATCCAGTGCAGGGTCCGAGGTATTC GCACTGGATACGACCTCCAC (11826) | CGGCTGGTGCACCTGGTG (11827) | 18 |
| ptc-miRf10226-akr | GTCGTATCCAGTGCAGGGTCCGAGGTATTC GCACTGGATACGACAAGCTC (11828) | AATCCTTCCTTTGGGGAG ATGGA (11829) | 23 |
| ptc-miRf10271-akr | GTCGTATCCAGTGCAGGGTCCGAGGTATTC GCACTGGATACGACTTAGAG (11830) | CGGCGGTTGGATTGAAG GGAG (11831) | 21 |
| ptc-miRf10734-akr | GTCGTATCCAGTGCAGGGTCCGAGGTATTC GCACTGGATACGACCACTGG (11832) | CGGCGGCATCTAGGTGGT GGT (11833) | 21 |
| ptc-miRf10976-akr | GTCGTATCCAGTGCAGGGTCCGAGGTATTC GCACTGGATACGACTAGCCA (11834) | CGGCTGGGAACGTGGCT G (11835) | 18 |
| ptc-miRf10985-akr | GTCGTATCCAGTGCAGGGTCCGAGGTATTC GCACTGGATACGACTCAGTG (11836) | CGGCGGCAGAAGATAGA GAG (11837) | 20 |
| ptc-miRf11018-akr | GTCGTATCCAGTGCAGGGTCCGAGGTATTC GCACTGGATACGACCCGCTC (11838) | CGGCGGCTGCAAACCTA AGG (11839) | 20 |
| ptc-miRf11079-akr | GTCGTATCCAGTGCAGGGTCCGAGGTATTC GCACTGGATACGACGCACGT (11840) | CGGCAAGATGGAGAAGC AGGGC (11841) | 22 |
| ptc-miRf11315-akr | GTCGTATCCAGTGCAGGGTCCGAGGTATTC GCACTGGATACGACCCACCC (11842) | CGCCGATCAACTTAGAGT TGG (11843) | 21 |
| ptc-miRf11324-akr | GTCGTATCCAGTGCAGGGTCCGAGGTATTC GCACTGGATACGACAGCGCC (11844) | CGGCCTTGTCGCAGGAG AGAT (11845) | 21 |
| ptc-miRf11396-akr | GTCGTATCCAGTGCAGGGTCCGAGGTATTC GCACTGGATACGACTTGACA (11846) | CGCGCCAAGGCTCTGATA CCA (11847) | 21 |
| ptc-miRf11669-akr | GTCGTATCCAGTGCAGGGTCCGAGGTATTC GCACTGGATACGACAACATG (11848) | CGGCGGCAAGGCTCTGA TAC (11849) | 20 |
| ptc-miRf11757-akr | GTCGTATCCAGTGCAGGGTCCGAGGTATTC GCACTGGATACGACATTCCT (11850) | CGGCCTTGGTGAATGGTT GGG (11851) | 21 |

TABLE 11b-continued

Stem Loop Reverse Transcriptase Primers for RT-PCR Validation of Differential Mirs under Abiotic Stress.

| Mir Name | Stem Loop Primer (SEQ ID NO:) | Forward Primer (SEQ ID NO:) | Forward Primer Length |
|---|---|---|---|
| ptc-miRf11844-akr | GTCGTATCCAGTGCAGGGTCCGAGGTATTCGCACTGGATACGACCCACAC (11852) | CGGCCCCAACTTGGAGGTGG (11853) | 20 |
| ptc-miRf11847-akr | GTCGTATCCAGTGCAGGGTCCGAGGTATTCGCACTGGATACGACGGCAAC (11854) | CGGCGGGAAAGTGTGGAGAAG (11855) | 21 |
| ptc-miRf11953-akr | GTCGTATCCAGTGCAGGGTCCGAGGTATTCGCACTGGATACGACAACCTC (11856) | CGGCGGGTAATCTGCATCCT (11857) | 20 |
| ptc-miRf12389-akr | GTCGTATCCAGTGCAGGGTCCGAGGTATTCGCACTGGATACGACCCCGGT (11858) | TTCCGTCGACCTGGCGAGTCA (11859) | 21 |
| sbi-miR159a | GTCGTATCCAGTGCAGGGTCCGAGGTATTCGCACTGGATACGACCAGAGC (11860) | CGGCGGTTTGGATTGAAGGGA (11861) | 21 |
| smo-miR156b | GTCGTATCCAGTGCAGGGTCCGAGGTATTCGCACTGGATACGACGTGCTC (11862) | CGGCGGCTGACAGAAGATAGA (11863) | 21 |
| tae-miR2003 | GTCGTATCCAGTGCAGGGTCCGAGGTATTCGCACTGGATACGACTCGCCA (11864) | AACCGGTTGGGCTGTATGA (11865) | 19 |
| vvi-miR2111-5p | GTCGTATCCAGTGCAGGGTCCGAGGTATTCGCACTGGATACGACTAGACC (11866) | CGGCGGTAATCTGCATCCTGA (11867) | 21 |
| vvi-miR394b | GTCGTATCCAGTGCAGGGTCCGAGGTATTCGCACTGGATACGACGGAGGT (11868) | CGGCGGTTGGCATTCTGTCC (11869) | 20 |
| zma-miR167u | GTCGTATCCAGTGCAGGGTCCGAGGTATTCGCACTGGATACGACCAGATC (11870) | CCGGGGTGAAGCTGCCACAT (11871) | 20 |
| zma-miR398a-5p | GTCGTATCCAGTGCAGGGTCCGAGGTATTCGCACTGGATACGACCATGTG (11872) | CGGCGGGCGAACTGAGAA (11873) | 19 |

Example 5

Results of RT-PCR Validation of Selected miRNAs of the Invention

An RT-PCR analysis was run on selected microRNAs of the invention, using the stem-loop RT primers as described in Table 11b in Example 4 above. Total RNA was extracted from leaf tissues of soybean plants grown as described above, and was used as a template for RT-PCR analysis. Expression level and directionality of several up-regulated and down-regulated microRNAs that were found to be differential on the microarray analysis were verified. Results are summarized in Table 12 below.

TABLE 12

Summary of RT-PCR Verification Results on Selected miRNAs using Stem Loop RT (Alternative) Method

| Trait | Mir Name | p-Value | Fold Change |
|---|---|---|---|
| Drought | gma-miR4376-5p | 8.50E−03 | 2.38 (−) |
|  | zma-miR396b-3p | 4.60E−03 | 1.41 (−) |
|  | aly-miR396b-3p | 3.80E−06 | 3.48 (−) |
|  | gma-miR156g | 5.40E−02 | 1.48 (+) |
|  | gma-miRf10687-akr-homolog | 7.80E−02 | 1.95 (+) |
| Salt | gma-miR159d | 5.60E−05 | 3.35 (−) |
|  | aly-miR396b-3p | 3.80E−07 | 5.45 (−) |
|  | gma-miR4416a | 5.20E−04 | 2.58 (−) |
|  | aly-miR396a-3p | 1.20E−08 | 13.50 (−) |
|  | zma-miR396b-3p | 4.90E−05 | 9.58 (−) |
| Heat Shock | gma-miR4412-3p | 1.50E−03 | 2.31 (−) |
|  | csi-miR162-5p | 2.60E−03 | 1.86 (−) |
|  | ath-miRf10279-akr | 2.40E−02 | 1.40 (−) |

Example 6

Generation of Transgenic Plants

Gene Cloning Strategies for miRNA Molecules and Creation of Binary Vectors for Expression in Plants The best validated miRNA sequences are cloned into pORE-E1 binary vectors (FIG. 1) for the generation of transgenic plants. The full-length precursor sequence comprising of the hairpin sequence of each selected miRNA, is synthesized by Genscript (USA). The resulting clone is digested with appropriate restriction enzymes and inserted into the Multi Cloning Site (MCS) of a similarly digested binary vector through ligation using T4 DNA ligase enzyme (Promega, Madison, Wis., USA).

Example 7

Generation of Transgenic Model Plants Expressing Abiotic Stress Associated miRNAs

*Arabidopsis thaliana* Transformation Protocol

Figure 3:
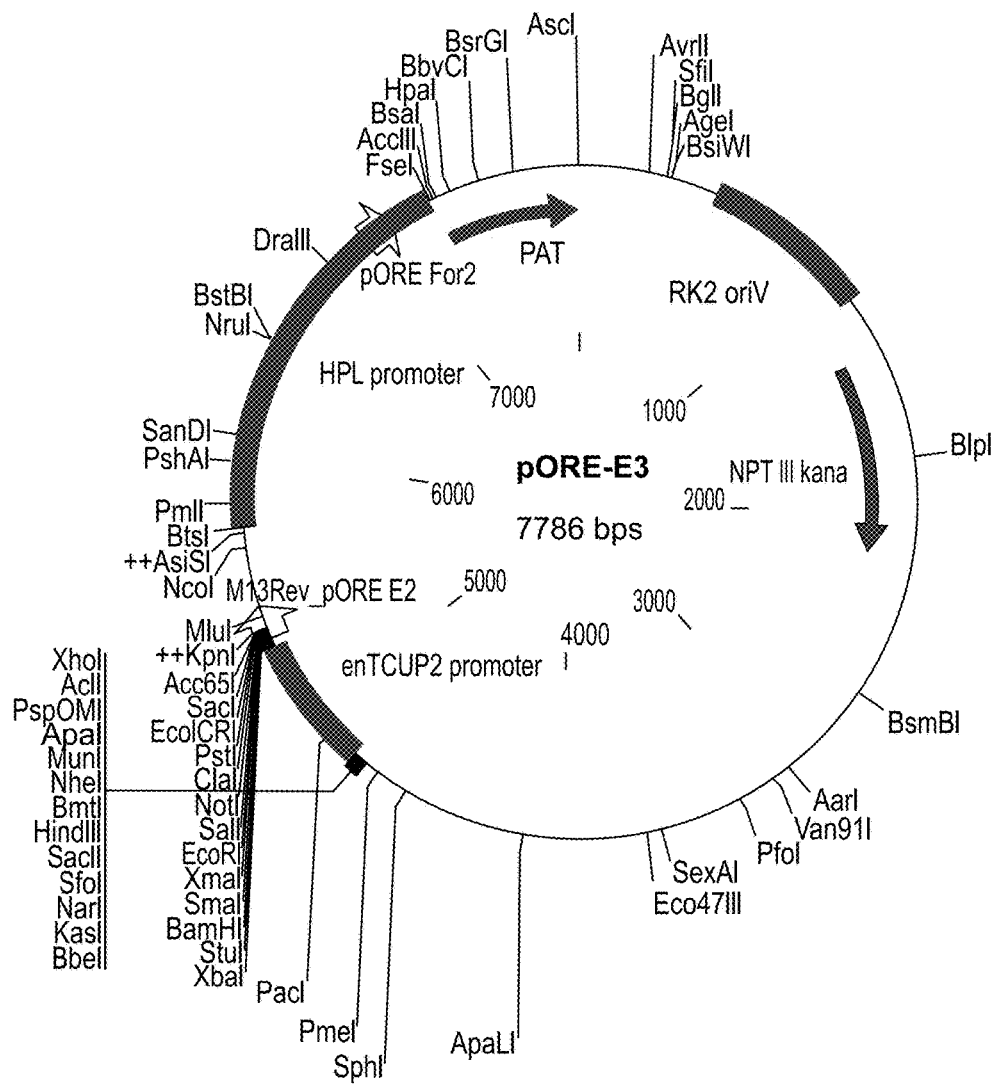
FIG. 3 is a schematic illustration of a plasmid map of the binary vector pORE-E3 used for plant transformation according to some embodiments of the invention.

*Araboposis thaliana* transformation is performed using the floral dip procedure following a slightly modified version of the published protocol (Clough and Bent, 1998, *Plant J* 16(6): 735-43; and Desfeux et al., 2000, *Plant Physiol* 123(3): 895-904). Briefly, T0 Plants are planted in small pots filled with soil. The pots are covered with aluminum foil and a plastic dome, kept at 4° C. for 3-4 days, then uncovered and incubated in a growth chamber at 24° C. under 16 hr light:8 hr dark cycles. A week prior to transformation all individual flowering stems are removed to allow for growth of multiple flowering stems instead. A single colony of *Agrobacterium* (GV3101) carrying the binary vectors (pORE-E1 or pORE-E3, see FIGS. 1 and 3, respectively), harboring the selected miRNA hairpin sequences with additional flanking sequences both upstream and downstream of it, is cultured in LB medium supplemented with kanamycin (50 mg/L) and gentamycin (25 mg/L). Three days prior to transformation, each culture is incubated at 28° C. for 48 hrs, shaking at 180 rpm. The starter culture is split the day before transformation into two cultures, which are allowed to grow further at 28° C. for 24 hours at 180 rpm. Pellets containing the *agrobacterium* cells are obtained by centrifugation of the cultures at 5000 rpm for 15 minutes. The pellets are re-suspended in an infiltration medium (10 mM $MgCl_2$, 5% sucrose, 0.044 µM BAP (Sigma) and 0.03% Tween 20) prepared with double-distilled water.

Transformation of T0 plants is performed by inverting each plant into the *agrobacterium* suspension, keeping the flowering stem submerged for 5 minutes. Following inoculation, each plant is blotted dry for 5 minutes on both sides, and placed sideways on a fresh covered tray for 24 hours at 22° C. Transformed (transgenic) plants are then uncovered and transferred to a greenhouse for recovery and maturation. The transgenic T0 plants are grown in the greenhouse for 3-5 weeks until the seeds are ready, which are then harvested from plants and kept at room temperature until sowing.

Tomato (*Solanum lycopersicum*) Transformation Protocol

Figure 2:
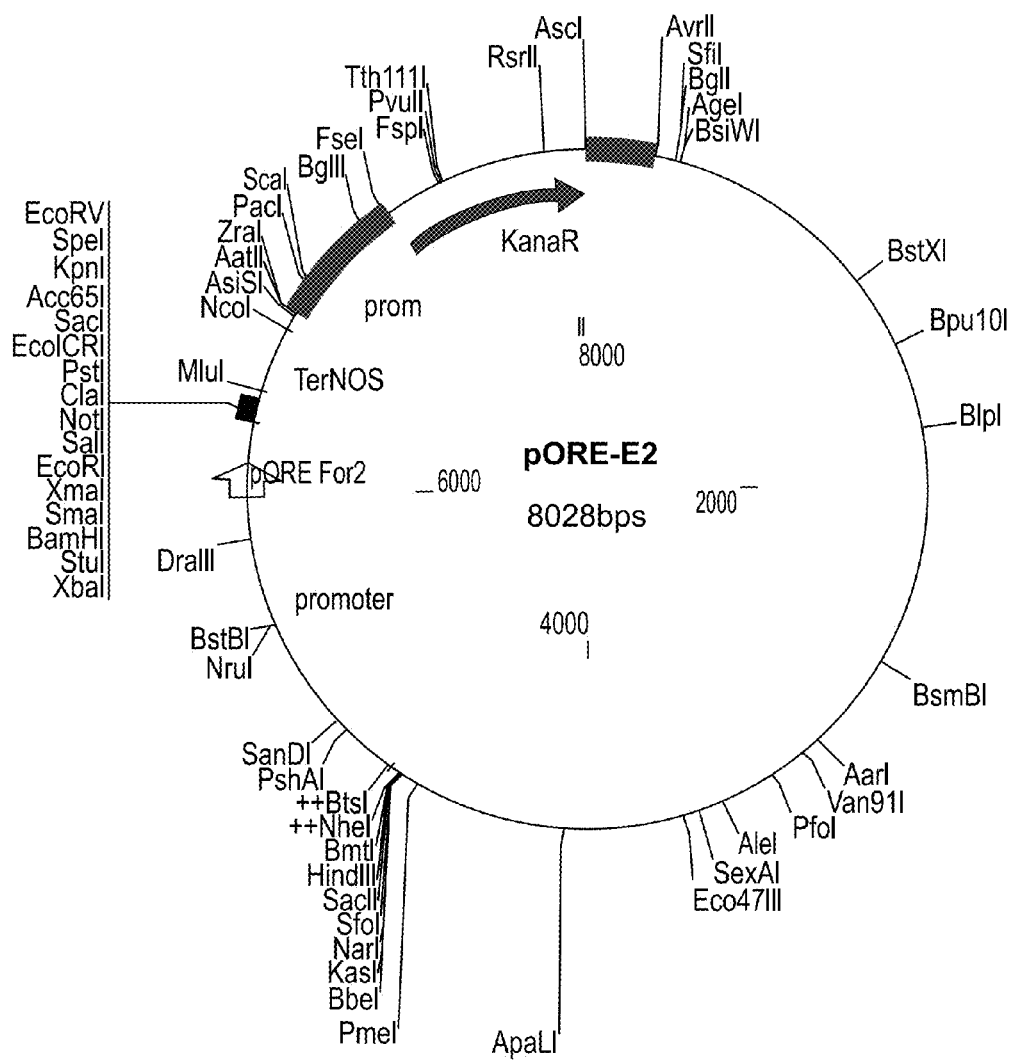
FIG. 2 is a schematic illustration of a plasmid map of the binary vector pORE-E2 used for plant transformation according to some embodiments of the invention.

M82 tomato (*Solanum lycopersicum*) transformation is performed using a slightly modified protocol described previously (McCormick 1991, Plant Tissue Culture Manual, Vol. B6, Lindsey, K., ed. Dordrecht, The Netherlands: Kluwer Academic Publishers, pp. 1-9). Briefly, seeds are surface-sterilized 10 days prior to transformation by soaking and shaking in 70% ethanol followed by a 3% bleach solution. After washing, seeds are sown and allowed to grow into seedlings. Cotyledons are cut and treated with an *agrobacterium* (GV3101, carrying the binary vector pORE-E2, see FIG. 2) solution using a gentle agitation, dried and left on feeder medium for two days in the dark. Then, cotyledons are transferred to a first selection medium (Jones I) for two weeks, followed by a two-week incubation in a second selection medium (Jones II) for callus initiation. Cotyledons are transferred every two weeks to a fresh selection medium (Jones II) until plantlet forms. Plantlets with active meristems are separated from the callus and transferred to a third selection medium (Jones III), and transferred into a rooting medium. Once roots form, the plantlets are planted in soil.

Transgenic *Arabidopsis* Plants Over-Expressing Selected microRNA Sequences

Several microRNAs of the invention were selected for over-expression in both *Arabidopsis*. Transformation protocols are followed as described above for each plant, and *agrobacterium* is utilized, carrying one of three binary vectors: pORE-E1, pORE-E2, or pORE-E3.

*Arabidopsis* transgenic plants were created with osa-miRf11996-akr of the invention. This miRNA was down-regulated under drought and salinity stresses compared to optimal conditions. Thus, the researchers tested the effects of modifying its expression level in model *Arabidopsis* plants. Four transgenic plants over-expressing osa-miRf11996-akr (in binary vector pORE-E3) were created and compared to control Columbia plants. Transgenic and control plants were grown under 16 h light:8 h dark regime at 22° C. in controlled growth rooms until seedlings were four weeks old. Next, plants were divided into two groups: control plants were irrigated with tap water twice a week and treated plants were either subjected to drought and received no irrigation for 5 days, or irrigated with 300 mM NaCl solution for 10 days for salinity stress induction. At the end of each treatment, plants were harvested and dry weight was recorded.

An ANOVA test was applied for statistical analysis of the data and results are summarized in Table 13 below. Control plants' dry weight was averaged and recorded as 100%, to be used as a reference for comparison to the average of each treated strain for each condition. Interestingly, the dry weight of all transgenic strains over-expressing osa-miRf11996-akr was significantly ($p<1.0E-6$) decreased compared to wild type control plants under all conditions. These results correlate with the fact that osa-miRf11996-akr was shown to be down-regulated under various abiotic stresses (e.g., Tables 2 and 4), thus indicating that its expression level needs to be decreased to improve a plant's tolerance to abiotic stress. Accordingly, the researchers also down-regulate osa-miRf11996-akr in *Arabidopsis* plants by using target mimic, as described and explained in Example 12 below.

TABLE 13

Dry Weight Results of Control and Transgenic (Over-expressing osa-miRf11996-akr) *Arabidopsis* Plants.

| Treatment | Strain | Dry weight +− SD | Number of Plants | Dry Weight % of Control |
|---|---|---|---|---|
| No treatment | Control | 483.353 +− 113.070 | 17 | |
| | 11996-2 | 305.909 +− 88.033 | 22 | 63.29% |
| | 11996-3 | 231.500 +− 72.002 | 26 | 47.90% |
| | 11996-5 | 179.194 +− 71.185 | 31 | 37.07% |
| | 11996-7 | 285.158 +− 101.236 | 19 | 59.00% |
| Drought | Control | 225.478 +− 99.687 | 23 | |
| | 11996-2 | 170.000 +− 60.393 | 21 | 75.40% |
| | 11996-3 | 157.269 +− 63.415 | 26 | 69.75% |
| | 11996-5 | 186.353 +− 92.723 | 20 | 82.65% |
| | 11996-7 | 179.818 +− 68.019 | 22 | 79.75% |
| Salinity | Control | 210.895 +− 76.991 | 19 | |
| | 11996-2 | 77.143 +− 41.214 | 21 | 36.58% |
| | 11996-3 | 109.130 +− 60.144 | 23 | 51.75% |
| | 11996-5 | 103.480 +− 44.930 | 25 | 49.07% |
| | 11996-7 | 116.789 +− 64.514 | 19 | 55.38% |

Example 8

Selection of Transgenic *Arabidopsis* Plants Expressing Abiotic Stress Genes According to Expression Level

*Arabidopsis* seeds are sown and Basta is sprayed for the first time on 1-2 weeks old seedlings, at least twice every few days. Only resistant plants, which are heterozygous for the transgene, survive. PCR on the genomic gene sequence is performed on the surviving seedlings using primers pORE-F2 (fwd, 5'-TTTAGCGATGAACTTCACTC-3', SEQ ID NO: 11614) and a custom designed reverse primer based on each small RNA sequence.

Example 9

Evaluating Changes in Root Architecture of Transgenic Plants

Many key traits in modern agriculture can be explained by changes in the root architecture of the plant. Root size and depth have been shown to logically correlate with drought tolerance and fertilizer use efficiency, since deeper and more branched root systems provide better coverage of the soil and can access water and nutrients stored in deeper soil layers.

To test whether the transgenic plants produce a modified root structure, plants can be grown in agar plates placed vertically. A digital picture of the plates is taken every few days and the maximal length and total area covered by the plant roots are assessed. From every construct created, several independent transformation events are checked in replicates. To assess significant differences between root features, statistical test, such as a Student's t-test, is employed in order to identify enhanced root features and to provide a statistical value to the findings.

Example 10

Abiotic Stress Tolerance Assessments of Control and Transgenic Plants

Transgenic plants expressing the polynucleotides of some embodiments of the invention exhibit tolerance to abiotic stress in the form of extreme deficiency in water, high salt concentrations, or heat shock and exhibit better overall survival and growth compared to control non-transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Under normal conditions (non-stress, optimal growth conditions), transgenic plants exhibit a phenotype equivalent or superior to that of the wild type plants. Following stress induction, transformed plants not exhibiting substantial physiological and/or morphological effects, or exhibiting higher biomass than wild-type plants, are identified as abiotic stress tolerant plants. Following are a number of screens aimed at identifying the transgenic plants which exhibit abiotic stress tolerance according to some embodiments of the invention.

Soil-Based Drought Tolerance Assay

Screens are performed with plants over-expressing the differential small RNAs detailed above. Briefly, seeds from control *Arabidopsis* plants, or other transgenic plants over-expressing the small RNA molecule of the invention are germinated and transferred to pots. Drought stress is obtained when irrigation is ceased and the two plant types (transgenic and control plants) are compared when most control plants develop severe wilting, at which point rehydration of the plants is initiated. Transgenic plants are ranked on two levels compared to controls: (1) tolerance to drought conditions, and (2) recovery (survival) following re-watering.

To illustrate and elaborate on the above drought tolerance assays of any given wild type plant compared to a corresponding transgenic plant (in which a drought-associated miRNA has been over-expressed), two different approaches are taken as follows:

Lethal drought stress—whereby wild type (used as a control) and transgenic plants (1-3 weeks old) are grown under prolonged extreme drought conditions (duration varies in accordance with plant species). Next, a recovery attempt is implemented during which plants are regularly irrigated and survival level is estimated in the two plant groups 1-2 days post irrigation initiation. While the control (wild type) plant is not expected to survive this extreme stress, the transgenic plant is expected to demonstrate some improved drought tolerance, usually within hours of re-hydration.

Non-lethal drought stress—whereby wild type (used as a control) and transgenic plants (1-3 weeks old) are grown under regular short-term cycles of drought and re-hydration steps, such that re-hydration is applied when general visible drought symptoms (e.g., evident decrease in turgor pressure of lower leaves) emerge in the experimental plants. This drought/irrigation alternating treatment continues until the flowering stage of the plants is reached, followed by an evaluation of dry matter weight. Both wild type and transgenic plants are expected to survive this non-lethal stress, however, measurable differences in drought tolerance are demonstrated by increased yield of the transgenic compared with the wild type plants.

Drought Tolerance Assay Using Sorbitol

Another assay designed to assess whether transgenic plants are more tolerant to drought or severe water deprivation compared to control plants, involves induction of an osmotic stress by the non-ionic osmolyte sorbitol. Control and transgenic plants are germinated and grown in plant-agar plates for 4 days, after which they are transferred to plates containing 500 mM sorbitol, to cause delayed growth. Following the stress treatment, control and transgenic plants are compared by measuring plant weight (wet and dry), yield, and growth rate measured as time to flowering.

Methods for Salinity Tolerance Assessment

Osmotic stress assays, such as chloride and mannitol assays, are aimed to determine whether an osmotic stress phenotype is sodium chloride-specific or a result of a general osmotic stress. Plants which are tolerant to osmotic stress may also exhibit tolerance to drought and/or freezing. For salt and osmotic stress germination experiments, the medium is supplemented with 50, 100, or 200 mM NaCl or 100 mM, 200 mM NaCl, 400 mM mannitol.

Methods for Heat Stress Tolerance Assessment

Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold nor heat stress.

Methods for Cold Stress Tolerance Assessment

To analyze cold stress, mature (25 day old) plants are transferred to 4° C. chambers for 1 or 2 weeks, with constitutive light. Next, plants are moved back to the greenhouse for 2 weeks to recover. Following the recovery period, chilling damages such as growth retardation are determined based on measurements of plant weight (wet and dry) and growth rates (e.g. time to flowering, plant size, yield, etc) taken on control and transgenic plants.

Example 11

Testing Morphologic Parameters in Transgenic Plants

To analyze whether the transgenic *Arabidopsis* plants are more tolerant to abiotic stresses, plants are grown under optimal versus stress conditions, i.e either drought for five days without irrigation, or high salt conditions for ten days, or a one-hour heat shock. Plants are allowed to grow until seed production, followed by an analysis of their overall size, time to flowering, yield, and protein content of shoot and/or grain. Additional parameters checked can be the overall size of the plant, wet and dry weight, the weight of the seeds yielded, the average seed size and the number of seeds produced per plant. Transformed plants not exhibiting substantial physiological and/or morphological effects, or exhibiting higher measured parameters levels compared to wild-type plants, are identified as abiotic stress tolerant plants.

Example 12

Method for Generating Transgenic Plants with Enhanced or Reduced miRNA Regulation of Target Genes Target prediction enables two contrasting strategies; an enhancement (positive) or a reduction (negative) of small RNA regulation. Both these strategies have been used in plants and have resulted in significant phenotype alterations. For complete in-vivo assessment of the phenotypic effects of the differential small RNAs of this invention, the inventors plan to implement both over-expression and down-regulation methods on the small RNA molecules found to associate with abiotic stress tolerance as listed in Tables 1-6. In the case of small RNAs that were up-regulated under abiotic stress conditions, an enhancement in abiotic stress tolerance can theoretically be achieved by maintaining their directionality, i.e. over-expressing them. Conversely, in the case of small RNAs that were down-regulated under abiotic stress conditions, enhancement in tolerance can be achieved by reducing their regulation. Regulation reduction of small RNA target genes can be accomplished in one of two approaches:

Expressing a miRNA-Resistant Target

In this method, silent mutations are introduced in the miRNA binding site of the target gene so that the DNA and resulting RNA sequences are changed to prevent miRNA binding, but the amino acid sequence of the protein is unchanged.

For design of miRNA-resistant target sequences for the small RNA molecules of the invention, optimization of the nucleic acid sequence in accordance with the preferred codon usage for a particular plant species is required. Tables such as those provided on-line at the Codon Usage Database through the NCBI (National Center for Biotechnology Information) webpage (Hypertext Transfer Protocol://World Wide Web (dot) ncbi (dot) nlm (dot) nih (dot) gov/Taxonomy/Utils/wprintgc (dot) cgi) were used. The Genbank database contains codon usage tables for a number of different species, with its Table 11 (The Bacterial, Archaeal and Plant Plastid Code) being the most relevant for plant species of this invention. Mir-resistant target examples for unregulated and downregulated miRs of the invention are presented in Tables 14-15 below.

TABLE 14 miRNA-Resistant Target Examples for Selected upregulated miRNAs of the Invention.

| Mir name | Homolog NCBI Accession | NCBI Mir Binding Site | mutated nucleotide sequence/SEQ ID NO: |
|---|---|---|---|
| aqc-miR159 | XP_003543825 | | 0 |
| | | 958-978 | 11091 |
| | | 958-978 | 11092 |
| | XP_003541563 | | 0 |
| | | 1111-1131 | 11093 |
| | | 1111-1131 | 11094 |
| | XP_003556814 | | 0 |
| | | 952-972 | 11095 |
| | | 952-972 | 11096 |
| | XP_003526354 | | 0 |
| | | 928-948 | 11097 |
| | | 928-948 | 11098 |
| | XP_003523913 | | 0 |
| | | 931-951 | 11099 |
| | | 931-951 | 11100 |
| | XP_003545791 | | 0 |
| | | 934-954 | 11101 |
| | | 934-954 | 11102 |
| ath-miR159b | XP_003542140 | | 0 |
| | | 404-424 | 11103 |
| | | 404-424 | 11104 |

TABLE 14-continued miRNA-Resistant Target Examples for Selected upregulated miRNAs of the Invention.

| Mir name | Homolog NCBI Accession | NCBI Mir Binding Site | mutated nucleotide sequence/SEQ ID NO: |
|---|---|---|---|
| ath-miR159c | XP_003519140 | | 0 |
| | | 143-163 | 11105 |
| | | 143-163 | 11106 |
| | XP_003531162 | | 0 |
| | | 2030-2050 | 11107 |
| | | 2030-2050 | 11108 |
| | XP_003524148 | | 0 |
| | | 1188-1208 | 11109 |
| | | 1188-1208 | 11110 |
| | XP_003547199 | | 0 |
| | | 1263-1283 | 11111 |
| | | 1263-1283 | 11112 |
| | XP_003541668 | | 0 |
| | | 1329-1349 | 11113 |
| | | 1329-1349 | 11114 |
| ath-miRf10240-akr | XP_003525932 | | 0 |
| | | 357-376 | 11115 |
| | | 357-376 | 11116 |
| | XP_003523287 | | 0 |
| | | 864-883 | 11117 |
| | | 864-883 | 11118 |
| | XP_003547951 | | 0 |
| | | 1451-1470 | 11119 |
| | | 1451-1470 | 11120 |
| | XP_003629354 | | 0 |
| | | 1224-1243 | 11121 |
| | | 1224-1243 | 11122 |
| ath-miRf10368-akr | XP_003543893 | | 0 |
| | | 584-603 | 11123 |
| | | 584-603 | 11124 |
| | XP_003539013 | | 0 |
| | | 599-618 | 11125 |
| | | 599-618 | 11126 |
| | XP_003556840 | | 0 |
| | | 727-746 | 11127 |
| | | 727-746 | 11128 |
| | XP_003538207 | | 0 |
| | | 1733-1752 | 11129 |
| | | 1733-1752 | 11130 |
| ath-miRf10763-akr | XP_003520499 | | 0 |
| | | 245-264 | 11131 |
| | | 245-264 | 11132 |
| | XP_003519685 | | 0 |
| | | 240-259 | 11133 |
| | | 240-259 | 11134 |
| | ACU17625 | | 0 |
| | | 176-195 | 11135 |
| | | 176-195 | 11136 |
| | XP_003527981 | | 0 |
| | | 558-577 | 11137 |
| | | 558-577 | 11138 |
| | XP_003547100 | | 0 |
| | | 1686-1705 | 11139 |
| | | 1686-1705 | 11140 |
| | XP_003524815 | | 0 |
| | | 524-543 | 11141 |
| | | 524-543 | 11142 |
| csi-miR3948 | XP_003547789 | | 0 |
| | | 31-54 | 11143 |
| | | 31-54 | 11144 |
| | XP_003527776 | | 0 |
| | | 46-69 | 11145 |
| | | 46-69 | 11146 |

TABLE 14-continued miRNA-Resistant Target Examples for Selected upregulated miRNAs of the Invention.

| Mir name | Homolog NCBI Accession | NCBI Mir Binding Site | mutated nucleotide sequence/SEQ ID NO: |
|---|---|---|---|
| | XP_003550061 | | 0 |
| | | 178-201 | 11147 |
| | | 178-201 | 11148 |
| | XP_003525811 | | 0 |
| | | 178-201 | 11149 |
| | | 178-201 | 11150 |
| | XP_003539180 | | 0 |
| | | 283-306 | 11151 |
| | | 283-306 | 11152 |
| | BAD18437 | | 0 |
| | | 278-301 | 11153 |
| | | 278-301 | 11154 |
| ghr-miR2950 | XP_003529456 | | 0 |
| | | 1017-1037 | 11155 |
| | | 1017-1037 | 11156 |
| | XP_003554852 | | 0 |
| | | 380-400 | 11157 |
| | | 380-400 | 11158 |
| gma-miR156g | XP_003520455 | | 0 |
| | | 737-756 | 11159 |
| | | 737-756 | 11160 |
| | XP_003553428 | | 0 |
| | | 734-753 | 11161 |
| | | 734-753 | 11162 |
| | XP_003520534 | | 0 |
| | | 734-753 | 11163 |
| | | 734-753 | 11164 |
| | XP_003553944 | | 0 |
| | | 1089-1108 | 11165 |
| | | 1089-1108 | 11166 |
| | XP_003551188 | | 0 |
| | | 1046-1065 | 11167 |
| | | 1046-1065 | 11168 |
| | XP_003532399 | | 0 |
| | | 941-960 | 11169 |
| | | 941-960 | 11170 |
| | XP_003549130 | | 0 |
| | | 1034-1053 | 11171 |
| | | 1034-1053 | 11172 |
| | XP_003550514 | | 0 |
| | | 706-725 | 11173 |
| | | 706-725 | 11174 |
| | XP_003525415 | | 0 |
| | | 1214-1233 | 11175 |
| | | 1214-1233 | 11176 |
| | XP_003538544 | | 0 |
| | | 1269-1288 | 11177 |
| | | 1269-1288 | 11178 |
| | XP_003525436 | | 0 |
| | | 1333-1352 | 11179 |
| | | 1333-1352 | 11180 |
| | XP_003550708 | | 0 |
| | | 1184-1203 | 11181 |
| | | 1184-1203 | 11182 |
| | XP_003520128 | | 0 |
| | | 1007-1026 | 11183 |
| | | 1007-1026 | 11184 |
| | XP_003523155 | | 0 |
| | | 959-978 | 11185 |
| | | 959-978 | 11186 |
| | XP_003551421 | | 0 |
| | | 758-777 | 11187 |
| | | 758-777 | 11188 |
| | XP_003522278 | | 0 |
| | | 1262-1281 | 11189 |
| | | 1262-1281 | 11190 |

TABLE 14-continued miRNA-Resistant Target Examples for Selected upregulated miRNAs of the Invention.

| Mir name | Homolog NCBI Accession | NCBI Mir Binding Site | mutated nucleotide sequence/SEQ ID NO: |
|---|---|---|---|
| gma-miR157c | Redundant target XP_003549130 | | 0 |
| gma-miR159a-3p | Redundant targets: XP_003542140, XP_003543825, XP_003526354, XP_003541563, XP_003556814, XP_003545791, XP_003523913. | | |
| iba-miR157 | Redundant targets: XP_003520455, XP_003553428, XP_003520534, XP_003553944, XP_003551188, XP_003532399, XP_003549130, XP_003525415, XP_003538544, XP_003525436, XP_003520128, XP_003551421, XP_003523155, XP_003550708, XP_003522278 | | |
| mdm-miR482a-5p | XP_003528897 | | |
| | | 940-960 | 11191 |
| | | 940-960 | 11192 |
| | | 940-960 | 11193 |
| | | 940-960 | 11194 |
| osa-miR159e | Redundant targets: XP_003543825, XP_003531162, XP_003526354, XP_003524148, XP_003547199, XP_003541563, XP_003556814, XP_003541668, XP_003523913, XP_003545791. | | |
| osa-miR159f | Redundant targets: XP_003543825, XP_003526354, XP_003541563, XP_003556814, XP_003523913, XP_003545791. | | |
| osa-miR1850.1 | XP_003555849 | | |
| | | 147-167 | 11195 |
| | | 147-167 | 11196 |
| | XP_003534041 | | 0 |
| | | 29-49 | 11197 |
| | | 29-49 | 11198 |
| | XP_003548988 | | 0 |
| | | 451-471 | 11199 |
| | | 451-471 | 11200 |
| osa-miR1858a | XP_003521247 | | 0 |
| | | 287-307 | 11201 |
| | | 287-307 | 11202 |
| | NP_001235053 | | 0 |
| | | 281-301 | 11203 |
| | | 281-301 | 11204 |
| | XP_003530234 | | 0 |
| | | 368-388 | 11205 |
| | | 368-388 | 11206 |
| | XP_003551508 | | 0 |
| | | 377-397 | 11207 |
| | | 377-397 | 11208 |
| | XP_003528545 | | 0 |
| | | 131-151 | 11209 |
| | | 131-151 | 11210 |
| | XP_003547641 | | 0 |
| | | 155-175 | 11211 |
| | | 155-175 | 11212 |
| | XP_003543554 | | 0 |
| | | 185-205 | 11213 |
| | | 185-205 | 11214 |
| | XP_003556667 | | 0 |
| | | 131-151 | 11215 |
| | | 131-151 | 11216 |
| osa-miRf11829-akr | XP_003546711 | | 0 |
| | | 346-366 | 11217 |
| | | 346-366 | 11218 |
| | ACI23460 | | 0 |
| | | 334-354 | 11219 |
| | | 334-354 | 11220 |
| | XP_003541398 | | 0 |
| | | 365-385 | 11221 |
| | | 365-385 | 11222 |

TABLE 14-continued miRNA-Resistant Target Examples for Selected upregulated miRNAs of the Invention.

| Mir name | Homolog NCBI Accession | NCBI Mir Binding Site | mutated nucleotide sequence/SEQ ID NO: |
|---|---|---|---|
| psi-miR159 | Redundant targets: XP_003543825, XP_003526354, XP_003541563, XP_003556814, XP_003545791, XP_003523913. | | |
| pta-miR156a | Redundant targets: XP_003549130, XP_003553428, XP_003553944, XP_003525436, XP_003520455, XP_003520128, XP_003550708, XP_003523155, XP_003551421, XP_003522278. | | |
| pta-miR156b | XP_003551276 | | |
| | | 202-221 | 11223 |
| | | 202-221 | 11224 |
| | | 202-221 | 11225 |
| | | 202-221 | 11226 |
| ptc-miRf10132-akr | XP_003527653 | | |
| | | 128-150 | 11227 |
| | | 128-150 | 11228 |
| | | 128-150 | 11229 |
| ptc-miRf10226-akr | XP_003549610 | | 0 |
| | | 123-145 | 11230 |
| | | 123-145 | 11231 |
| | XP_003525906 | | 0 |
| | | 174-196 | 11232 |
| | | 174-196 | 11233 |
| | XP_003547131 | | 0 |
| | | 2282-2304 | 11234 |
| | | 2282-2304 | 11235 |
| | XP_003542817 | | 0 |
| | | 240-262 | 11236 |
| | | 240-262 | 11237 |
| ptc-miRf10271-akr | Redundant targets: XP_003543825, XP_003526354, XP_003541563, XP_003556814, XP_003523913, XP_003545791. | | |
| ptc-miRf10734-akr | XP_003520774 | | 0 |
| | | 1439-1459 | 11238 |
| | | 1439-1459 | 11239 |
| | XP_003538849 | | 0 |
| | | 1187-1207 | 11240 |
| | | 1187-1207 | 11241 |
| ptc-miRf10985-akr | XP_003546504 | | 0 |
| | | 1472-1491 | 11242 |
| | | 1472-1491 | 11243 |
| | XP_003545057 | | 0 |
| | | 3399-3418 | 11244 |
| | | 3399-3418 | 11245 |
| ptc-miRf11315-akr | XP_003550774 | | 0 |
| | | 311-330 | 11246 |
| | | 311-330 | 11247 |
| | XP_003518840 | | 0 |
| | | 255-274 | 11248 |
| | | 255-274 | 11249 |
| ptc-miRf11757-akr | XP_003612685 | | 0 |
| | | 388-410 | 11250 |
| | | 388-410 | 11251 |
| | | 388-410 | 11252 |
| | | 388-410 | 11253 |

TABLE 14-continued miRNA-Resistant Target Examples for Selected upregulated miRNAs of the Invention.

| Mir name | Homolog NCBI Accession | NCBI Mir Binding Site | mutated nucleotide sequence/SEQ ID NO: |
|---|---|---|---|
| ath-miR157a | Redundant targets: XP_003525415, XP_003553428, XP_003538544, XP_003553944, XP_003551188, XP_003525436, XP_003520455, XP_003523155, XP_003551421, XP_003549130, XP_003522278. | | |
| sbi-miR159a | Redundant targets: XP_003543825, XP_003526354, XP_003541563, XP_003556814. | | |
| smo-miR156b | XP_003528960 | | |
| | | 462-482 | 11254 |
| | | 462-482 | 11255 |
| | | 462-482 | 11256 |
| | | 462-482 | 11257 |

TABLE 15 miRNA-Resistant Target Examples for Selected down-regulated miRNAs of the Invention.

| Mir name | Homolog NCBI Accession | NCBI Mir Binding Site | Mutated Nucleotide Sequence/SEQ ID NO: |
|---|---|---|---|
| bdi-miR2508 | XP_003530212 | | |
| | | 689-710 | 11258 |
| | | 689-710 | 11259 |
| | XP_003530213 | | 0 |
| | | 794-815 | 11260 |
| | | 794-815 | 11261 |
| | XP_003551482 | | 0 |
| | | 689-710 | 11262 |
| | | 689-710 | 11263 |
| | XP_003548937 | | 0 |
| | | 1148-1169 | 11264 |
| | | 1148-1169 | 11265 |
| | XP_003551299 | | 0 |
| | | 733-754 | 11266 |
| | | 733-754 | 11267 |
| | XP_003520176 | | 0 |
| | | 2159-2180 | 11268 |
| | | 2159-2180 | 11269 |
| | XP_003544873 | | 0 |
| | | 656-677 | 11270 |
| | | 656-677 | 11271 |
| | XP_003552227 | | 0 |
| | | 665-686 | 11272 |
| | | 665-686 | 11273 |
| | XP_003539077 | | 0 |
| | | 713-734 | 11274 |
| | | 713-734 | 11275 |
| | XP_003552179 | | 0 |
| | | 701-722 | 11276 |
| | | 701-722 | 11277 |
| | NP_001236616 | | 0 |
| | | 698-719 | 11278 |
| | | 698-719 | 11279 |
| | XP_003540719 | | 0 |
| | | 707-728 | 11280 |
| | | 707-728 | 11281 |
| | XP_003522150 | | 0 |
| | | 662-683 | 11282 |
| | | 662-683 | 11283 |
| bra-miR160a-3p | XP_003530952 | | 0 |
| | | 1283-1303 | 11284 |
| | | 1283-1303 | 11285 |
| gma-miR2119 | XP_003542005 | | 0 |
| | | 212-232 | 11286 |
| | | 212-232 | 11287 |
| | XP_003521584 | | 0 |
| | | 421-441 | 11288 |
| | | 421-441 | 11289 |
| | XP_003524240 | | 0 |
| | | 1982-2002 | 11290 |
| | | 1982-2002 | 11291 |
| | XP_003545664 | | 0 |
| | | 96-116 | 11292 |
| | | 96-116 | 11293 |
| | XP_003532800 | | 0 |
| | | 1982-2002 | 11294 |
| | | 1982-2002 | 11295 |
| | XP_003547559 | | 0 |
| | | 2084-2104 | 11296 |
| | | 2084-2104 | 11297 |
| gso-miR482a | NP_001237600 | | 0 |
| | | 1153-1173 | 11298 |
| | | 1153-1173 | 11299 |
| | XP_003533606 | | 0 |
| | | 523-543 | 11300 |
| | | 523-543 | 11301 |
| | XP_003518623 | | 0 |
| | | 444-464 | 11302 |
| | | 444-464 | 11303 |
| | AAF44087 | | 0 |
| | | Jan-21 | 11304 |
| | | Jan-21 | 11305 |
| osa-miR162a | XP_003528812 | | |
| | | 612-632 | 11306 |
| | | 612-632 | 11307 |
| | | 612-632 | 11308 |
| | | 612-632 | 11309 |
| osa-miR1846e | XP_003531668 | | 0 |
| | | 471-490 | 11310 |
| | | 471-490 | 11311 |
| | XP_003529761 | | 0 |
| | | 363-382 | 11312 |
| | | 363-382 | 11313 |
| | XP_003530142 | | 0 |
| | | 366-385 | 11314 |
| | | 366-385 | 11315 |
| ppt-miR166m | XP_003553029 | | 0 |
| | | 530-550 | 11316 |
| | | 530-550 | 11317 |
| | XP_003597690 | | 0 |
| | | 875-895 | 11318 |
| | | 875-895 | 11319 |

TABLE 15-continued miRNA-Resistant Target Examples for Selected down-regulated miRNAs of the Invention.

| Mir name | Homolog NCBI Accession | NCBI Mir Binding Site | Mutated Nucleotide Sequence/ SEQ ID NO: |
|---|---|---|---|
| | XP_002285176 | | 0 |
| | | 562-582 | 11320 |
| | | 562-582 | 11321 |
| | XP_003530109 | | 0 |
| | | 906-926 | 11322 |
| | | 906-926 | 11323 |
| | XP_003524993 | | 0 |
| | | 1030-1050 | 11324 |
| | | 1030-1050 | 11325 |
| | XP_003522716 | | 0 |
| | | 825-845 | 11326 |
| | | 825-845 | 11327 |
| | XP_003530112 | | 0 |
| | | 606-626 | 11328 |
| | | 606-626 | 11329 |
| | XP_003532788 | | 0 |
| | | 577-597 | 11330 |
| | | 577-597 | 11331 |
| | XP_003537529 | | 0 |
| | | 515-535 | 11332 |
| | | 515-535 | 11333 |
| | XP_003531653 | | 0 |
| | | 777-797 | 11334 |
| | | 777-797 | 11335 |
| | XP_003539764 | | 0 |
| | | 1227-1247 | 11336 |
| | | 1227-1247 | 11337 |
| | XP_003539765 | | 0 |
| | | 1227-1247 | 11338 |
| | | 1227-1247 | 11339 |
| ptc-miRf10007-akr | XP_003550796 | | |
| | | 1378-1398 | 11340 |
| | | 1378-1398 | 11341 |
| | | 1378-1398 | 11342 |
| | | 1378-1398 | 11343 |
| ptc-miRf10976-akr | XP_003533044 | | 0 |
| | | 318-337 | 11344 |
| | | 318-337 | 11345 |
| | XP_003528486 | | 0 |
| | | 267-286 | 11346 |
| | | 267-286 | 11347 |
| | XP_003548151 | | 0 |
| | | 885-904 | 11348 |
| | | 885-904 | 11349 |
| | NP_001238468 | | 0 |
| | | 245-264 | 11350 |
| | | 245-264 | 11351 |
| ptc-miRf11396-akr | XP_003520116 | | |
| | | 764-785 | 11352 |
| | | 764-785 | 11353 |
| | | 764-785 | 11354 |
| | | 764-785 | 11355 |
| ptc-miRf11669-akr | XP_003554103 | | |
| | | 208-227 | 11356 |
| | | 208-227 | 11357 |
| | | 208-227 | 11358 |
| | | 208-227 | 11359 |

Expressing a Target-Mimic Sequence

Plant miRNAs usually lead to cleavage of their targeted gene, with this cleavage typically occurring between bases 10 and 11 of the miRNA. This position is therefore especially sensitive to mismatches between the miRNA and the target. It was found that expressing a DNA sequence that could potentially be targeted by a miRNA, but contains three extra nucleotides (ATC), and thus creating a bulge in a key position (between the two nucleotides that are predicted to hybridize with bases 10-11 of the miRNA), can inhibit the regulation of that miRNA on its native targets (Franco-Zorilla et al., 2007, Nat Genet 39(8):1033-1037).

This type of sequence is referred to as a "target-mimic". Inhibition of the miRNA regulation is presumed to occur through physically capturing the miRNA by the target-mimic sequence and titering-out the miRNA, thereby reducing its abundance. This method was used to reduce the amount and, consequentially, the regulation of miRNA 399 in *Arabidopsis*. Target mimic examples for upregulated and downregulated miRs of the invention are presented in Tables 16-17 below.

TABLE 16

Target Mimic Examples for Selected upregulated miRNAs of the Invention.

| Mir Name | Mimic Reverse Complement Mir/SEQ ID NO: | Full Target Mimic Nucleotide Sequence/ SEQ ID NO: |
|---|---|---|
| ahy-miR3514-5p | 11360 | 11437 |
| aly-miR831-5p | 11361 | 11438 |
| aqc-miR159 | 11362 | 11439 |
| ath-miR157a | 11363 | 11440 |
| ath-miR159b | 11364 | 11441 |
| ath-miR159c | 11365 | 11442 |
| ath-miRf10068-akr | 11366 | 11443 |
| ath-miRf10148-akr | 11367 | 11444 |
| ath-miRf10209-akr | 11368 | 11445 |
| ath-miRf10240-akr | 11369 | 11446 |
| ath-miRf10368-akr | 11370 | 11447 |
| ath-miRf10451-akr | 11371 | 11448 |
| ath-miRf10633-akr | 11372 | 11449 |
| ath-miRf10687-akr | 11373 | 11450 |
| ath-miRf10701-akr | 11374 | 11451 |
| ath-miRf10702-akr | 11375 | 11452 |
| ath-miRf10751-akr | 11376 | 11453 |
| ath-miRf10763-akr | 11377 | 11454 |
| ath-miRf10924-akr | 11378 | 11455 |
| ath-miRf11021-akr | 11379 | 11456 |
| ath-miRf11037-akr | 11380 | 11457 |
| ath-miRf11042-akr | 11381 | 11458 |
| ath-miRf11045-akr | 11382 | 11459 |
| csi-miR3946 | 11383 | 11460 |
| csi-miR3948 | 11384 | 11461 |

TABLE 16-continued

Target Mimic Examples for Selected upregulated miRNAs of the Invention.

| Mir Name | Mimic Reverse Complement Mir/SEQ ID NO: | Full Target Mimic Nucleotide Sequence/ SEQ ID NO: |
|---|---|---|
| far-miR1134 | 11385 | 11462 |
| ghr-miR2950 | 11386 | 11463 |
| gma-miR156g | 11387 | 11464 |
| gma-miR157c | 11388 | 11465 |
| gma-miR159a-3p | 11389 | 11466 |
| iba-miR157 | 11390 | 11467 |
| mdm-miR482a-5p | 11391 | 11468 |
| mtr-miR2119 | 11392 | 11469 |
| osa-miR159e | 11393 | 11470 |
| osa-miR159f | 11394 | 11471 |
| osa-miR1850.1 | 11395 | 11472 |
| osa-miR1858a | 11396 | 11473 |
| osa-miR1869 | 11397 | 11474 |
| osa-miR1874-3p | 11398 | 11475 |
| osa-miR1879 | 11399 | 11476 |
| osa-miR1881 | 11400 | 11477 |
| osa-miR2055 | 11401 | 11478 |
| osa-miRf10105-akr | 11402 | 11479 |
| osa-miRf10362-akr | 11403 | 11480 |
| osa-miRf10839-akr | 11404 | 11481 |
| osa-miRf11013-akr | 11405 | 11482 |
| osa-miRf11341-akr | 11406 | 11483 |
| osa-miRf11352-akr | 11407 | 11484 |
| osa-miRf11355-akr | 11408 | 11485 |
| osa-miRf11595-akr | 11409 | 11486 |
| osa-miRf11649-akr | 11410 | 11487 |
| osa-miRf11829-akr | 11411 | 11488 |
| pab-miR3711 | 11412 | 11489 |
| ppt-miR1220a | 11413 | 11490 |
| ppt-miR895 | 11414 | 11491 |
| psi-miR159 | 11415 | 11492 |
| pta-miR156a | 11416 | 11493 |
| pta-miR156b | 11417 | 11494 |
| ptc-miRf10132-akr | 11418 | 11495 |
| ptc-miRf10148-akr | 11419 | 11496 |
| ptc-miRf10226-akr | 11420 | 11497 |
| ptc-miRf10271-akr | 11421 | 11498 |
| ptc-miRf10300-akr | 11422 | 11499 |
| ptc-miRf10522-akr | 11423 | 11500 |
| ptc-miRf10619-akr | 11424 | 11501 |
| ptc-miRf10734-akr | 11425 | 11502 |
| ptc-miRf10985-akr | 11426 | 11503 |
| ptc-miRf11315-akr | 11427 | 11504 |
| ptc-miRf11757-akr | 11428 | 11505 |
| ptc-miRf11844-akr | 11429 | 11506 |
| ptc-miRf11847-akr | 11430 | 11507 |
| ptc-miRf11855-akr | 11431 | 11508 |
| sbi-miR159a | 11432 | 11509 |
| smo-miR1103-3p | 11433 | 11510 |
| smo-miR156b | 11434 | 11511 |
| tae-miR2003 | 11435 | 11512 |
| zma-miR482-5p | 11436 | 11513 |

TABLE 17

Target Mimic Examples for Selected downregulated miRNAs of the Invention.

| Mir Name | Mimic Reverse Complement Mir/SEQ ID NO: | Full Target Mimic Nucleotide Sequence/SEQ ID NO: |
|---|---|---|
| aly-miR160c-3p | 11514 | 11564 |
| aly-miR396a-3p | 11515 | 11565 |
| aly-miR396b-3p | 11516 | 11566 |
| ath-miRf10197-akr | 11517 | 11567 |
| ath-miRf10239-akr | 11518 | 11568 |
| ath-miRf10279-akr | 11519 | 11569 |
| bdi-miR2508 | 11520 | 11570 |
| bna-miR2111b-5p | 11521 | 11571 |
| bra-miR160a-3p | 11522 | 11572 |
| csi-miR162-5p | 11523 | 11573 |
| ctr-miR171 | 11524 | 11574 |
| gma-miR1507a | 11525 | 11575 |
| gma-miR1524 | 11526 | 11576 |

TABLE 17-continued

Target Mimic Examples for Selected downregulated miRNAs of the Invention.

| Mir Name | Mimic Reverse Complement Mir/SEQ ID NO: | Full Target Mimic Nucleotide Sequence/SEQ ID NO: |
|---|---|---|
| gma-miR159d | 11527 | 11577 |
| gma-miR2119 | 11528 | 11578 |
| gma-miR396d | 11529 | 11579 |
| gma-miR4371b | 11530 | 11580 |
| gma-miR4376-5p | 11531 | 11581 |
| gma-miR4412-3p | 11532 | 11582 |
| gma-miR4416a | 11533 | 11583 |
| gma-miR482a-3p | 11534 | 11584 |
| gma-miR482b-5p | 11535 | 11585 |
| gso-miR169g* | 11536 | 11586 |
| gso-miR482a | 11537 | 11587 |
| osa-miR162a | 11538 | 11588 |
| osa-miR1846e | 11539 | 11589 |
| osa-miR2104 | 11540 | 11590 |
| osa-miRf10151-akr | 11541 | 11591 |
| osa-miRf10849-akr | 11542 | 11592 |
| osa-miRf11415-akr | 11543 | 11593 |
| osa-miRf11996-akr | 11544 | 11594 |
| ppt-miR166m | 11545 | 11595 |
| ppt-miR533b-5p | 11546 | 11596 |
| pta-miR166c | 11547 | 11597 |
| ptc-miR166p | 11548 | 11598 |
| ptc-miRf10007-akr | 11549 | 11599 |
| ptc-miRf10976-akr | 11550 | 11600 |
| ptc-miRf11018-akr | 11551 | 11601 |
| ptc-miRf11079-akr | 11552 | 11602 |
| ptc-miRf11324-akr | 11553 | 11603 |
| ptc-miRf11396-akr | 11554 | 11604 |
| ptc-miRf11669-akr | 11555 | 11605 |
| ptc-miRf11953-akr | 11556 | 11606 |
| ptc-miRf12069-akr | 11557 | 11607 |
| ptc-miRf12389-akr | 11558 | 11608 |
| vvi-miR2111-5p | 11559 | 11609 |
| vvi-miR394b | 11560 | 11610 |
| zma-miR167u | 11561 | 11611 |
| zma-miR396b-3p | 11562 | 11612 |
| zma-miR398a-5p | 11563 | 11613 |

TABLE 18

Abbreviations of plant species

| Common Name | Organism Name | Abbreviation |
|---|---|---|
| Peanut | Arachis hypogaea | ahy |
| Arabidopsis lyrata | Arabidopsis lyrata | aly |
| Rocky Mountain Columbine | Aquilegia coerulea | aqc |
| Tausch's goatgrass | Aegilops taushii | ata |
| Arabidopsis thaliana | Arabidopsis thaliana | ath |
| Grass | Brachypodium distachyon | bdi |
| Brassica napus canola ("liftit") | Brassica napus | bna |
| Brassica oleracea wild cabbage | Brassica oleracea | bol |
| Brassica rapa yellow mustard | Brassica rapa | bra |
| Clementine | Citrus clementine | ccl |
| Orange | Citrus sinensis | csi |
| Trifoliate orange | Citrus trifoliata | ctr |
| Glycine max | Glycine max | gma |
| Wild soybean | Glycine soja | gso |
| Barley | Hordeum vulgare | hvu |
| Lotus japonicus | Lotus japonicus | lja |
| Medicago truncatula - Barrel Clover ("tiltan") | Medicago truncatula | mtr |
| Oryza sativa | Oryza sativa | osa |
| European spruce | Picea abies | pab |
| Physcomitrella patens (moss) | Physcomitrella patens | ppt |
| Pinus taeda - Loblolly Pine | Pinus taeda | pta |
| Populus trichocarpa - black cotton wood | Populus trichocarpa | ptc |
| Castor bean ("kikayon") | Ricinus communis | rco |
| Sorghum bicolor Dura | Sorghum bicolor | sbi |
| tomato microtom | Solanum lycopersicum | sly |
| Selaginella moellendorffii | Selaginella moellendorffii | smo |
| Sugarcane | Saccharum officinarum | sof |
| Sugarcane | Saccharum spp | ssp |
| Triticum aestivum | Triticum aestivum | tae |
| cacao tree and cocoa tree | Theobroma cacao | tcc |
| Vitis vinifera Grapes | Vitis vinifera | vvi |
| corn | Zea mays | zma |

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (11961 sequences)

SEQ ID NO: 1 - DNA, 22 bp, Arachis hypogaea
aggattctgtattaacggtgga

SEQ ID NO: 2 - DNA, 23 bp, Arabidopsis lyrata
agaagaggtacaaggagatgaga

SEQ ID NO: 3 - DNA, 21 bp, Aquilegia coerulea
tttggactgaagggagctcta

SEQ ID NO: 4 - DNA, 21 bp, Arabidopsis thaliana
ttgacagaagatagagagcac

SEQ ID NO: 5 - DNA, 21 bp, Arabidopsis thaliana
tttggattgaagggagctctt

SEQ ID NO: 6 - DNA, 21 bp, Arabidopsis thaliana
tttggattgaagggagctcct

SEQ ID NO: 7 - DNA, 20 bp, Arabidopsis thaliana
caccggtggaggagtgagag

SEQ ID NO: 8 - DNA, 20 bp, Arabidopsis thaliana
atcgaaggagatggaggacg

SEQ ID NO: 9 - DNA, 22 bp, Arabidopsis thaliana
aagaaggaggaacaacctgttg

SEQ ID NO: 10 - DNA, 21 bp, Arabidopsis thaliana
ttagctgaagaagcagaggag

SEQ ID NO: 11 - DNA, 22 bp, Arabidopsis thaliana
tgcagttcctggaggtggagga

SEQ ID NO: 12 - DNA, 20 bp, Arabidopsis thaliana
cttgtggagaggaagcaaga

SEQ ID NO: 13 - DNA, 21 bp, Arabidopsis thaliana
tgaggcgtatcaggaggtagt

SEQ ID NO: 14 - DNA, 21 bp, Arabidopsis thaliana
gaggtttgcgatgagaaagag

SEQ ID NO: 15 - DNA, 21 bp, Arabidopsis thaliana
tcatcggagaaacagaggagc

SEQ ID NO: 16 - DNA, 21 bp, Arabidopsis thaliana
ggaagaggcagtgcatgggta

SEQ ID NO: 17 - DNA, 22 bp, Arabidopsis thaliana
tttcttgtggaggaagcaagat

SEQ ID NO: 18 - DNA, 24 bp, Citrus sinensis
ttgtagagaaagagaagagagcac

SEQ ID NO: 19 - DNA, 20 bp, Glycine max
acagaagatagagagcacag

SEQ ID NO: 20 - DNA, 21 bp, Glycine max
tgacagaagactagagagcac

SEQ ID NO: 21 - DNA, 21 bp, Glycine max
tttggattgaagggagctcta

SEQ ID NO: 22 - DNA, 21 bp, Ipomoea batatas
ttgacagaagatagagagcat

SEQ ID NO: 23 - DNA, 21 bp, Malus domestica
ggaatgggctgtttgggaaca

SEQ ID NO: 24 - DNA, 21 bp, Medicago truncatula
tcaaagggaggtgtggagtag

SEQ ID NO: 25 - DNA, 21 bp, Oryza sativa
attggattgaagggagctcct

SEQ ID NO: 26 - DNA, 21 bp, Oryza sativa
cttggattgaagggagctcta

SEQ ID NO: 27 - DNA, 21 bp, Oryza sativa
gagaggaggacggagtggggc

SEQ ID NO: 28 - DNA, 24 bp, Oryza sativa
tatggatggaggtgtaacccgatg

SEQ ID NO: 29 - DNA, 24 bp, Oryza sativa
gtgtttggtttagggatgaggtgg

SEQ ID NO: 30 - DNA, 21 bp, Oryza sativa
cctgtgacgttggtgaaggtg

SEQ ID NO: 31 - DNA, 22 bp, Oryza sativa
ggtttgccggagttggaggaga

SEQ ID NO: 32 - DNA, 23 bp, Oryza sativa
agggattttggaaggaggtgaca

SEQ ID NO: 33 - DNA, 23 bp, Oryza sativa
ggtggaggtggagctgtgccaaa

SEQ ID NO: 34 - DNA, 19 bp, Oryza sativa
catcggtgttggaggtggc

SEQ ID NO: 35 - DNA, 21 bp, Oryza sativa
aaaccgtgcaaaggaggtccc

SEQ ID NO: 36 - DNA, 21 bp, Oryza sativa
acgcggaggaggtggtgttct

SEQ ID NO: 37 - DNA, 22 bp, Physcomitrella patens
gtagcttagcgaggtgttggta

SEQ ID NO: 38 - DNA, 21 bp, Picea sitchensis
cttggattgaagggagctcca

SEQ ID NO: 39 - DNA, 20 bp, Pinus taeda
cagaagatagagagcacatc

SEQ ID NO: 40 - DNA, 20 bp, Pinus taeda
cagaagatagagagcacaac

SEQ ID NO: 41 - DNA, 20 bp, Populus trichocarpa
tggtgcacctggtggtggag

SEQ ID NO: 42 - DNA, 23 bp, Populus trichocarpa
tcctttggggagatggagagctt

SEQ ID NO: 43 - DNA, 21 bp, Populus trichocarpa
ttggattgaagggagctctaa

SEQ ID NO: 44 - DNA, 20 bp, Populus trichocarpa
tttggaaagcaagtgaggtg

SEQ ID NO: 45 - DNA, 20 bp, Populus trichocarpa
ttggggagctggactctgga

SEQ ID NO: 46 - DNA, 21 bp, Populus trichocarpa
gttgggcttgctgctggagga

SEQ ID NO: 47 - DNA, 20 bp, Populus trichocarpa
cagaagatagagagcactga

SEQ ID NO: 48 - DNA, 23 bp, Populus trichocarpa
cttggtgaatggttgggaggaat

SEQ ID NO: 49 - DNA, 22 bp, Populus trichocarpa
cccaacttggaggtgggtgtgg

SEQ ID NO: 50 - DNA, 21 bp, Populus trichocarpa
gaaagtgtggagaaggttgcc

SEQ ID NO: 51 - DNA, 21 bp, Populus trichocarpa
ggcagagcatggatggagcta

SEQ ID NO: 52 - DNA, 21 bp, Sorghum bicolor
tttggattgaagggagctctg

SEQ ID NO: 53 - DNA, 24 bp, Selaginella moellendorffii
tggaaaaaggaggtgcattcttgt

SEQ ID NO: 54 - DNA, 21 bp, Selaginella moellendorffii
ctgacagaagatagagagcac

SEQ ID NO: 55 - DNA, 22 bp, Triticum aestivum
cggttgggctgtatgatggcga

SEQ ID NO: 56 - DNA, 19 bp, Zea mays
tgggagatgaaggagcctt

SEQ ID NO: 57 - DNA, 21 bp, Arabidopsis lyrata
gttcaataaagctgtgggaag

SEQ ID NO: 58 - DNA, 21 bp, Arabidopsis lyrata
gctcaagaaagctgtgggaaa

SEQ ID NO: 59 - DNA, 22 bp, Brachypodium distachyon
attgagtgcagcgttgatgaac

SEQ ID NO: 60 - DNA, 21 bp, Citrus trifoliata
ttgagccgcgtcaatatctcc

SEQ ID NO: 61 - DNA, 22 bp, Glycine max
tctcattccatacatcgtctga

SEQ ID NO: 62 - DNA, 21 bp, Glycine max
agctgcttagctatggatccc

SEQ ID NO: 63 - DNA, 24 bp, Glycine max
aagaaagctgtgggagaatatggc

SEQ ID NO: 64 - DNA, 24 bp, Glycine max
aagtgatgacgtggtagacggagt

SEQ ID NO: 65 - DNA, 22 bp, Glycine max
tacgcaggagagatgacgctgt

SEQ ID NO: 66 - DNA, 20 bp, Glycine max
acgggtcgctctcacctagg

SEQ ID NO: 67 - DNA, 24 bp, Glycine max
tcttcccaattccgcccattccta

SEQ ID NO: 68 - DNA, 22 bp, Glycine max
tatggggggattgggaaggaat

SEQ ID NO: 69 - DNA, 20 bp, Glycine soja
tcggcaagttggccttggct

SEQ ID NO: 70 - DNA, 21 bp, Glycine soja
tcttccctacacctcccatac

SEQ ID NO: 71 - DNA, 22 bp, Oryza sativa
gtcttataacctgaaacggggg

SEQ ID NO: 72 - DNA, 21 bp, Physcomitrella patens
tcggaccaggcatcattcctt

SEQ ID NO: 73 - DNA, 21 bp, Pinus taeda
ccggaccaggcttcatcccag

SEQ ID NO: 74 - DNA, 21 bp, Populus trichocarpa
tcggaccaggctccattcctt

SEQ ID NO: 75 - DNA, 24 bp, Populus trichocarpa
aagatggagaagcagggcacgtgc

SEQ ID NO: 76 - DNA, 22 bp, Populus trichocarpa
caaggctctgataccatgtcaa

SEQ ID NO: 77 - DNA, 20 bp, Populus trichocarpa
caaggctctgataccatgtt

SEQ ID NO: 78 - DNA, 20 bp, Vitis vinifera
ttggcattctgtccacctcc

SEQ ID NO: 79 - DNA, 21 bp, Zea mays
gttcaataaagctgtgggaaa

SEQ ID NO: 80 - DNA, 22 bp, Physcomitrella patens
gtagcttagcgaggtgttggta

SEQ ID NO: 81 - DNA, 20 bp, Populus trichocarpa
tttggaaagcaagtgaggtg

SEQ ID NO: 82 - DNA, 21 bp, Oryza sativa
cctgtgacgttggtgaaggtg

SEQ ID NO: 83 - DNA, 24 bp, Selaginella moellendorffii
tggaaaaaggaggtgcattcttgt

SEQ ID NO: 84 - DNA, 21 bp, Oryza sativa
aaaccgtgcaaaggaggtccc

SEQ ID NO: 85 - DNA, 24 bp, Oryza sativa
tatggatggaggtgtaacccgatg

SEQ ID NO: 86 - DNA, 21 bp, Populus trichocarpa
gttgggcttgctgctggagga

SEQ ID NO: 87 - DNA, 21 bp, Oryza sativa
gctggaggatgcgacggtgct

SEQ ID NO: 88 - DNA, 22 bp, Arachis hypogaea
aggattctgtattaacggtgga

SEQ ID NO: 89 - DNA, 21 bp, Medicago truncatula
tcaaagggaggtgtggagtag

SEQ ID NO: 90 - DNA, 23 bp, Oryza sativa
ggtggaggtggagctgtgccaaa

SEQ ID NO: 91 - DNA, 19 bp, Oryza sativa
catcggtgttggaggtggc

SEQ ID NO: 92 - DNA, 22 bp, Populus trichocarpa
cccaacttggaggtgggtgtgg

SEQ ID NO: 93 - DNA, 21 bp, Populus trichocarpa
gaaagtgtggagaaggttgcc

SEQ ID NO: 94 - DNA, 22 bp, Arabidopsis thaliana
tttcttgtggaggaagcaagat

SEQ ID NO: 95 - DNA, 20 bp, Arabidopsis thaliana
gtgggaggactccaagtgtg

SEQ ID NO: 96 - DNA, 22 bp, Arabidopsis thaliana
tgcagttcctggaggtggagga

SEQ ID NO: 97 - DNA, 24 bp, Oryza sativa
tgagaacaataggcatgggaggta

SEQ ID NO: 98 - DNA, 20 bp, Populus trichocarpa
tggtgcacctggtggtggag

SEQ ID NO: 99 - DNA, 24 bp, Oryza sativa
gtgtttggtttagggatgaggtgg

SEQ ID NO: 100 - DNA, 20 bp, Arabidopsis thaliana
ggtggtggaaagatcaagat

SEQ ID NO: 101 - DNA, 22 bp, Oryza sativa
ggtttgccggagttggaggaga

SEQ ID NO: 102 - DNA, 23 bp, Arabidopsis thaliana
atggtggtactcggccaggtggt

SEQ ID NO: 103 - DNA, 21 bp, Arabidopsis thaliana
tgaggcgtatcaggaggtagt

SEQ ID NO: 104 - DNA, 21 bp, Physcomitrella patens
ttccggtggtgaggaagatag

SEQ ID NO: 105 - DNA, 23 bp, Oryza sativa
cgcgccgacgatgacggtggagt

SEQ ID NO: 106 - DNA, 23 bp, Oryza sativa
agggattttggaaggaggtgaca

SEQ ID NO: 107 - DNA, 21 bp, Oryza sativa
tttccttgggaaggtggtttc

SEQ ID NO: 108 - DNA, 20 bp, Arabidopsis thaliana
atcgaaggagatggaggacg

SEQ ID NO: 109 - DNA, 20 bp, Arabidopsis thaliana
caccggtggaggagtgagag

SEQ ID NO: 110 - DNA, 21 bp, Gossypium hirsutum
tggtgtgcagggggtggaata

SEQ ID NO: 111 - DNA, 20 bp, Arabidopsis thaliana
acttgggtggtgctgattat

SEQ ID NO: 112 - DNA, 20 bp, Arabidopsis thaliana
ggtggtgaagaagcatggtt

SEQ ID NO: 113 - DNA, 21 bp, Populus trichocarpa
catctaggtggtggtccagtg

SEQ ID NO: 114 - DNA, 21 bp, Oryza sativa
acgcggaggaggtggtgttct

SEQ ID NO: 115 - DNA, 19 bp, Zea mays
tgggagatgaaggagcctt

SEQ ID NO: 116 - DNA, 21 bp, Oryza sativa
tggaaagttgggagattgggg

SEQ ID NO: 117 - DNA, 24 bp, Oryza sativa
aatgttattgtagcgtggtggtgt

SEQ ID NO: 118 - DNA, 23 bp, Populus trichocarpa
tcctttggggagatggagagctt

SEQ ID NO: 119 - DNA, 23 bp, Populus trichocarpa
cttggtgaatggttgggaggaat

SEQ ID NO: 120 - DNA, 21 bp, Arabidopsis thaliana
gaggtttgcgatgagaaagag

SEQ ID NO: 121 - DNA, 24 bp, Arabidopsis thaliana
tggcggtggatacttcttgatcgg

SEQ ID NO: 122 - DNA, 23 bp, Populus trichocarpa
ttggcggtgattgaacggagggt

SEQ ID NO: 123 - DNA, 20 bp, Populus trichocarpa
caacttagagttgggggtgg

SEQ ID NO: 124 - DNA, 23 bp, Arabidopsis lyrata
agaagaggtacaaggagatgaga

SEQ ID NO: 125 - DNA, 24 bp, Citrus sinensis
tggagtgggagtgggagtagggtg

SEQ ID NO: 126 - DNA, 21 bp, Arabidopsis lyrata
gcgtacaaggagccaagcatg

SEQ ID NO: 127 - DNA, 21 bp, Arabidopsis lyrata
gttcaataaagctgtgggaag

SEQ ID NO: 128 - DNA, 21 bp, Arabidopsis lyrata
gctcaagaaagctgtgggaaa

SEQ ID NO: 129 - DNA, 24 bp, Arabidopsis thaliana
cactcgaccaagggggtcgagtga

SEQ ID NO: 130 - DNA, 20 bp, Arabidopsis thaliana
cgccttgcatcaactgaatc

SEQ ID NO: 131 - DNA, 23 bp, Arabidopsis thaliana
actcagcctgggggtcgagtgat

SEQ ID NO: 132 - DNA, 21 bp, Brassica napus
taatctgcatcctgaggttta

SEQ ID NO: 133 - DNA, 21 bp, Brassica rapa
gcgtatgaggagccatgcata

SEQ ID NO: 134 - DNA, 22 bp, Citrus sinensis
tggaggcagcggttcatcgatc

SEQ ID NO: 135 - DNA, 21 bp, Glycine max
cgagtccgaggaaggaactcc

SEQ ID NO: 136 - DNA, 21 bp, Glycine max
agctgcttagctatggatccc

SEQ ID NO: 137 - DNA, 21 bp, Glycine max
tcaaagggagttgtaggggaa

SEQ ID NO: 138 - DNA, 24 bp, Glycine max
aagaaagctgtgggagaatatggc

SEQ ID NO: 139 - DNA, 21 bp, Glycine max
agtggcgtagatccccacaac

SEQ ID NO: 140 - DNA, 20 bp, Glycine max
acgggtcgctctcacctagg

SEQ ID NO: 141 - DNA, 22 bp, Glycine max
tatggggggattgggaaggaat

SEQ ID NO: 142 - DNA, 21 bp, Oryza sativa
tcgataaacctctgcatccag

SEQ ID NO: 143 - DNA, 20 bp, Oryza sativa
caacgaggaggccgggacca

SEQ ID NO: 144 - DNA, 22 bp, Oryza sativa
gcggcgaggggatgcgagcgtg

SEQ ID NO: 145 - DNA, 22 bp, Oryza sativa
tggactgtttgggggagcttct

SEQ ID NO: 146 - DNA, 21 bp, Oryza sativa
gagagcaggatgcagccaagg

SEQ ID NO: 147 - DNA, 22 bp, Oryza sativa
gtcttataacctgaaacggggg

SEQ ID NO: 148 - DNA, 21 bp, Physcomitrella patens
gagctgtccaggctgtgaggg

SEQ ID NO: 149 - DNA, 21 bp, Populus trichocarpa
cattgacagggaaactcacca

SEQ ID NO: 150 - DNA, 20 bp, Populus trichocarpa
tgggaacgtggctgtggcta

SEQ ID NO: 151 - DNA, 20 bp, Populus trichocarpa
ctgcaaacctaagggagcgg

SEQ ID NO: 152 - DNA, 24 bp, Populus trichocarpa
aagatggagaagcagggcacgtgc

SEQ ID NO: 153 - DNA, 23 bp, Populus trichocarpa
cttgtcgcaggagagatggcgct

SEQ ID NO: 154 - DNA, 22 bp, Populus trichocarpa
caaggctctgataccatgtcaa

SEQ ID NO: 155 - DNA, 20 bp, Populus trichocarpa
gtaatctgcatcctgaggtt

SEQ ID NO: 156 - DNA, 21 bp, Populus trichocarpa
ggaggggctgcaagacccaag

SEQ ID NO: 157 - DNA, 23 bp, Populus trichocarpa
gtcgacctggcgagtcaaccggg

SEQ ID NO: 158 - DNA, 21 bp, Vitis vinifera
taatctgcatcctgaggtcta

SEQ ID NO: 159 - DNA, 20 bp, Zea mays
tgaagctgccacatgatctg

SEQ ID NO: 160 - DNA, 21 bp, Zea mays
gttcaataaagctgtgggaaa

SEQ ID NO: 161 - DNA, 21 bp, Zea mays
ggggcgaactgagaacacatg

SEQ ID NO: 162 - DNA, 23 bp, Arabidopsis lyrata
agaagaggtacaaggagatgaga

SEQ ID NO: 163 - DNA, 21 bp, Arabidopsis thaliana
ttagctgaagaagcagaggag

SEQ ID NO: 164 - DNA, 21 bp, Arabidopsis thaliana
gaggtttgcgatgagaaagag

SEQ ID NO: 165 - DNA, 24 bp, Festuca arundinacea
cgacaacaacaacaagaagaagag

SEQ ID NO: 166 - DNA, 22 bp, Oryza sativa
ttggcctcgtcgaagaaggaga

SEQ ID NO: 167 - DNA, 20 bp, Picea abies
tggcgctagaaggagggcct

SEQ ID NO: 168 - DNA, 19 bp, Zea mays
tgggagatgaaggagcctt

SEQ ID NO: 169 - DNA, 23 bp, Arabidopsis thaliana
actcagcctgggggtcgagtgat

SEQ ID NO: 170 - DNA, 22 bp, Citrus sinensis
tggaggcagcggttcatcgatc

SEQ ID NO: 171 - DNA, 21 bp, Glycine max
agtggcgtagatccccacaac

SEQ ID NO: 172 - DNA, 21 bp, Oryza sativa
tggctatattttgggacggag

SEQ ID NO: 173 - DNA, 21 bp, Populus trichocarpa
ggaggggctgcaagacccaag

SEQ ID NO: 174 - DNA, 192 bp, Arachis hypogaea
acaatagaaggattctgtattaacggtggacatgatttatctcgtttttaaagatatctttgcatttcatatgagatttaaagtttttattggtaatataaatctcacatgaaatttaaatttatattttaaagttaagataaagtcatgtcaccgttaatacagaatccttcaattatatttagtcagggg

SEQ ID NO: 175 - DNA, 185 bp, Arabidopsis lyrata
aagtgctacaagaatgtatagtcttagagtctcaagaagaggtacaaggagatgagaagtgaatcactgaaacaagtggttctggtttgtggatcagtatggtttacccaaaacacgtgtttggtgcttcacttctaaactcctcgtactcttcttgggattctatgacttacacttgttgattt

SEQ ID NO: 176 - DNA, 71 bp, Aquilegia coerulea
ggagtctttccagcccaaaacagcttcttgatcttcttgaaaacttctgtttggactgaagggagctctaa

SEQ ID NO: 177 - DNA, 98 bp, Arabidopsis thaliana
gtgttgacagaagatagagagcacagatgatgagatacaattcggagcatgttctttgcatcttactcctttgtgctctctagccttctgtcatcacc

SEQ ID NO: 178 - DNA, 196 bp, Arabidopsis thaliana
ggaagagctccttgaagttcaatggagggtttagcagggtgaagtaaagctgctaagctatggatcccataagccttatcaaattcaatataattgatgataaggttttttttatggatgccatatctcaggagctttcacttacccctttaatggcttcactcttctttggattgaagggagctcttcatctctc

SEQ ID NO: 179 - DNA, 225 bp, Arabidopsis thaliana
gtgtaacagaaggagctcccttcctccaaaacgaagaggacaagatttgaggaactaaaatgcagaatctaagagttcatgtcttcctcatagagagtgcgcggtgttaaaagcttgaagaaagcacactttaaggggattgcacgacctcttagattctccctctttctctacatatcattctcttctcttcgtttggattgaagggagctccttttcttcttc

SEQ ID NO: 180 - DNA, 152 bp, Citrus sinensis
ataaagatgatgatgacaatgaattttgtagagaaagagaagagagcacaaactttttgctgaaagtagctttgattcgatgtgtatcggttcatagataatgagttttcaagtctattttaatagaatactaaaagttagctctaaaaatc

SEQ ID NO: 181 - DNA, 118 bp, Glycine max
tgaacaatatcttgaacagtttgttgacagaagatagagagcacaggtgatcatacccaaaaaagcttttgtgtgtgagcagttttgtgctctctatcttctgtcaatgtacttctca

SEQ ID NO: 182 - DNA, 84 bp, Glycine max
tgacagaagactagagagcacaaaggagtgagatgccattccctttcatgcatttcatcatcagtgctctctatcttctgtcaa

SEQ ID NO: 183 - DNA, 214 bp, Glycine max
aattaaaggggattatgaagtggagctccttgaagtccaattgaggatcttactgggtgaattgagctgcttagctatggatcccacagttctacccatcaataagtgcttttgtggtagtcttgtggcttccatatttggggagcttcatttgcctttatagtattaaccttctttggattgaagggagctctacacccttctcttcttttct

SEQ ID NO: 184 - DNA, 283 bp, Ipomoea batatas
ttgacagaagatagagagcatgctagaaattacattgataagctatgtggttcagagaccaatcttcttatgagttccaataaggagttggtttgtccccccactggtattatgtcttcaggttgacccttcaccatgagaatcatatgtaattctccggcggcgctcattgtgacctgccaatcgcctccggcaactcctcttagcttcatcaaactgggctaattcatgaaacctgctgcattgctgacagaagcgctgttgaactccatttataagtact

SEQ ID NO: 185 - DNA, 152 bp, Malus domestica
gagaagagggaaagggagattggagctgctggaagttttaggaatgggctgtttgggaacaaggaaattaccacaataattgtcttgtggggtttcttcccaagcccgcccattcctatgatttccagctgttcctccctttcccttgtctc

SEQ ID NO: 186 - DNA, 129 bp, Medicago truncatula
tttattttttttacactaagatactccctactttcctttgattggaaataaagagagacaaaaaggtaaatttaatttctcttcttatgtcaatcaaagggaggtgtggagtagggtgtaaaaagtaaa

SEQ ID NO: 187 - DNA, 191 bp, Oryza sativa
gatgaagaagaagagctccctttcgatccaattcaggagaggaagtggtaggatgcagctgccggttcatggatacctctggagtgcagggcaaatagtcctaccctttcatgggtttgcatgactcgggagatgaacccgccattgtcttcctctattgattggattgaagggagctcctctagctacat

SEQ ID NO: 188 - DNA, 188 bp, Oryza sativa
gaagaagaagacgagctcccttcgatccaatccaggagaggaagtggtaggatgcagctgccggttcatggatacctctgcagtgcatgtcgtaggcttgcacttgcatgggtttgcatgacccgggagatgaacccaccattgtcttcctcttatgcttggattgaagggagctctacacctctctc

SEQ ID NO: 189 - DNA, 200 bp, Oryza sativa
tcccgtcatcgctgccggcaaagggagggggggtgccgcaacaaggagaggaggacggagtggggcgagtggagcgtcaaaggggatgtcatcgccgccgaatctgctcgtgggacatccccttcgatgctccactcgccccaatccgtcctcctctccttgttgcggcaccccccttcgctggcagcgacgacggcctc

SEQ ID NO: 190 - DNA, 151 bp, Oryza sativa
ccataatcatctattagtacagtggtgaagacatagggctactacaccatccataagggttcgaatcttcgatgtgcctagatagggtacagttggatcccatatggatggaggtgtaacccgatgccttttacaaatagatggttatttt

SEQ ID NO: 191 - DNA, 150 bp, Oryza sativa
tccaacccatcccacctcgtccccaaaccaaacacatgcacgcaaatggcttgttgaggaataaacatcttgctcccttgcattctaaactatgatattcttcaagcatatgtgtttggtttagggatgaggtgggatgggttaggtcca

SEQ ID NO: 192 - DNA, 222 bp, Physcomitrella patens
gattcatgtaattattgttaacctctttgtgttccgagcttttatgattggtagcttagcgaggtgttggtatgataccaatccctggtttgcttgttcctaattgagttatgcttgcactcaaatctaggggagcggtattttggctcactcgcaatgctttcatgtacccttcccgcattatgagtgccacttggctccatggtgtgatatataagtttc

SEQ ID NO: 193 - DNA, 193 bp, Picea sitchensis
tggagctcccttcagtccaaccaaagcttgtgcggcggtggttcagctgctgattcatgcattcgactgccctgtccgtgactttccagcagcctgaatcaatcaatctatctccatgacaggatagtggtgtgcatgacgcaggagatgtattgtcactggacacgcattccttggattgaagggagctcca

SEQ ID NO: 194 - DNA, 83 bp, Pinus taeda
gatgacagaagatagagagcacatccgctcacatgccgggactctgcgtttgaggtgtatgtggtctccatgattctgtcatc

SEQ ID NO: 195 - DNA, 83 bp, Pinus taeda
gatgacagaagatagagagcacaaccgctcagatgccggcactctgcgtttgaggtgtatgtgctctcgttgattttgtcatc

SEQ ID NO: 196 - DNA, 226 bp, Sorghum bicolor
agcgaagctcctatcattccaatgaagggcccttttcatgggtggttccgctgctcgttcatggttcccactatcctatctcatcatgtatgtgtgtatgtactctagagggcccgagaagagattcatgtggtcgtcagtctttgagataggcttgtggtttgcatgaccgaggagctgcaccgtccccttgctggccgctctttggattgaagggagctctgca

SEQ ID NO: 197 - DNA, 198 bp, Selaginella moellendorffii
gcccatgaacaagagtgcaccccctttccaatcggttaaaggtcttaggatagttggagtttaagcgtccttgggtttgaatagtactgggctgggtgacctcccgggaagtccaaattcaggagcttacattaaccccaagtattccaaaacgcttaatcgattggaaaaaggaggtgcattcttgttcataggccc

SEQ ID NO: 198 - DNA, 112 bp, Selaginella moellendorffii
tggactgctgctgacagaagatagagagcacagacgtttggctgcaagagcggaatccatatccagcagctctgcgttcgtgctctctattcttctgtcatcaatctttcga

SEQ ID NO: 199 - DNA, 96 bp, Triticum aestivum
cattcggattcgccatcatacgtccaaccgtgcatttgatatgcatatatatgcatcacgagcaacggttgggctgtatgatggcgataccgattg

SEQ ID NO: 200 - DNA, 122 bp, Zea mays
agtgggagatgaaggagccttgcatcgatgtcaccgccggaggagcgctcgccttcttcgcgcaccgccgcaatagccgccctcggacccctcgcctcgctcttccttgttcctcccatttt

SEQ ID NO: 201 - DNA, 151 bp, Oryza sativa
atccaacccatcccacctcgtccccaaaccaaacacatgcacgcaaatggcttgttgaggaataaacatcttgctcccttgcattctaaactatgatattcttcaagcatatgtgtttggtttagggatgaggtgggatgggttaggtcca

SEQ ID NO: 202 - DNA, 172 bp, Arabidopsis lyrata
tctacgtgaccctctctgtattcttccacagctttcttgaactgcaaaacttcttcagatttgttttttttatatatatgtcttacgcataaaatagtgtttttgttcacatctctgctcgattgatttgcggttcaataaagctgtgggaagatacggacagagtcaaaga

SEQ ID NO: 203 - DNA, 188 bp, Arabidopsis lyrata
gaagaagaagaagaagatcctggtcatatttttccacagctttcttgaactttctttttcatttccattgtttttttttttctaaaccaaaaaaaaagatctctaaaatttagcattttggaaacaaagaagaagctcaagaaagctgtgggaaaacatgacaattcagggttttactccattgattc

SEQ ID NO: 204 - DNA, 99 bp, Brachypodium distachyon
gcaaaggcatcattgagtgcagcgttgatgaacaggggccaggcgaccggcggccggtccggttcggttcaccggcgctgcacacagtgacgcccttgc

SEQ ID NO: 205 - DNA, 371 bp, Citrus trifoliata
atcgacggttgaaggggagagttgtaaaatgaaatcatcaaggtattggcgcgcctcaatttaaagacgtggttaaatgggcatgattagccatgtattttcattgagccgcgtcaatatctccttaattattttgtaactctctcctctatatcctcgccttcggtatgcagctgctcctcgatacatatgaggattcagaaacagacaaaggcggtagaagtaatcttcatcaatattattgaagcaggaaacataacggcaagttttaagacccgtttggggcatgtggggtctcattttgatgttaatgaagtgaaaacttgtattttccctcaaacattcactcactccaggccggcaggaacaac

SEQ ID NO: 206 - DNA, 107 bp, Glycine max
cagtgtttggcagaggtgtatggagtgagagaagggaaagggtattttccgattctgtcgttactctcttccctctctcattccatacatcgtctgacgaacgtatc

SEQ ID NO: 207 - DNA, 103 bp, Glycine max
gggtgaattgagctgcttagctatggatcccacagttctacccatcaataagtgcttttgtggtagtcttgtggcttccatatctggggagcttcatttgcct

SEQ ID NO: 208 - DNA, 108 bp, Glycine max
ggtcatgcttttccacagctttcttgaacttcttatgcatcttatatctctccacttccagcattttaagccctagaagctcaagaaagctgtgggagaatatggcaa

SEQ ID NO: 209 - DNA, 183 bp, Glycine max
ttgttagttgcctttcgttaagtgatgacgtggtagacggagtgccgtgtcattatgccttgtcacagacacctcattgctacatcatcaccgctaatgatatggcactgacgtgttagtgattggtgtgatgacgtgacactctatctgccacatcatcacctaacggaagacaactaacga

SEQ ID NO: 210 - DNA, 110 bp, Glycine max
aaggtttgctacgcaggagagatgacgctgtcccttgcacccatcctagcttcccttgagtaggtaagagcaaggccagccagcatcatatctcctgcatagtaaacctt

SEQ ID NO: 211 - DNA, 130 bp, Glycine max
ctttgatctgggtgagagaaacgcgtatcgatggattgggttcagttctggtctcacacggtttgttctaacaatttgtactgactgtgttttgatcgatacgggtcgctctcacctaggccagagttgc

SEQ ID NO: 212 - DNA, 95 bp, Glycine max
tcagaatttgtgggaatgggctgattgggaagcaatgtgtgctggtgcaatgcatttaatttcttcccaattccgcccattcctatgatttctga

SEQ ID NO: 213 - DNA, 69 bp, Glycine max
ggtatggggggattgggaaggaatatccataagcaaaatatgctatttcttccctacacctcccatacc

SEQ ID NO: 214 - DNA, 93 bp, Glycine soja
ggggaaggcatgggtatggggggattgggaaggaatatccataagcaaaatatgctatttcttccctacacctcccataccactgtttttcct

SEQ ID NO: 215 - DNA, 130 bp, Physcomitrella patens
gccgagaacagagattgtgtagctcagctgtaaggaatgtggcatggctcgatgctgtttgagcatgtcaagttcagcctcggaccaggcatcattcctttcatctcagttacacatttgacatccagga

SEQ ID NO: 216 - DNA, 164 bp, Pinus taeda
accaatcgaatccggaccaggcttcatcccaggcatctggacccaatcgacagcagctcctttagcctttgaaaggaactctgtcaaggtctcctctgctatagacaggagtccagcggggctagcatctcttgggggatgctgaggtgttggattatgttggt

SEQ ID NO: 217 - DNA, 146 bp, Populus trichocarpa
taaggttgagaggaacgctgtctgggtcgaggtcatggaggccatgattatacataaatggcattatctgatgacagcccagataatcgatgcacctgtcttgaacctaaatgattctcggaccaggctccattccttccaaccat

SEQ ID NO: 218 - DNA, 93 bp, Vitis vinifera
acagagtttattggcattctgtccacctcccatctcttgaaaatctctcttttctctctgtggaggtgggcatactgccaaccaagctctgtt

SEQ ID NO: 219 - DNA, 136 bp, Zea mays
agatggccttctttgtgatcttccacagctttcttgaactgcatctctcagaggagcggcagcttcaactcctccacccgcatcagcaggtgcatgcagttcaataaagctgtgggaaactgcagagagaggccag

SEQ ID NO: 220 - DNA, 222 bp, Physcomitrella patens; identical to SEQ ID NO: 192

SEQ ID NO: 221 - DNA, 198 bp, Selaginella moellendorffii; identical to SEQ ID NO: 197

SEQ ID NO: 222 - DNA, 151 bp, Oryza sativa; identical to SEQ ID NO: 190

SEQ ID NO: 223 - DNA, 192 bp, Arachis hypogaea; identical to SEQ ID NO: 174

SEQ ID NO: 224 - DNA, 129 bp, Medicago truncatula; identical to SEQ ID NO: 186

SEQ ID NO: 225 - DNA, 138 bp, Oryza sativa
aaggaacacctgagaacaataggcatgggaggtattgggaaaacacaggaacatattgtgacccctaattttaaagggaaataatggttgaggctttcctccatgttcccatgcctaatgctcttaggtgctcttttt

SEQ ID NO: 226 - DNA, 150 bp, Oryza sativa; identical to SEQ ID NO: 191

SEQ ID NO: 227 - DNA, 205 bp, Physcomitrella patens
acttcttgcactcctctatctccctcggcacctgcacagtgattttctcaatatcttcacgttggtggccacgttcgaacatatcccatgcgggcaactccggcgtaggtgtacacggccagcgttgcttaccatctggaggatacccttgctcaaacctacgactctgttccggtggtgaggaagatagaggagttcaagaagt

SEQ ID NO: 228 - DNA, 100 bp, Oryza sativa
agaagatggaggcaccagcccaaggaaacacagacattgacacgcaattcaaggagaagattgcgtcctactttttccttgggaaggtggtttctcttct

SEQ ID NO: 229 - DNA, 108 bp, Gossypium hirsutum
catgggtttatgttatattccatctcttgcacactggactagccagctttttgttggcttcagcttcaggttggtgtgcagggggtggaatacatcattgatatcatg

SEQ ID NO: 230 - DNA, 122 bp, Zea mays; identical to SEQ ID NO: 200

SEQ ID NO: 231 - DNA, 133 bp, Oryza sativa
atgtgatggagatgcgatggaaagttgggagattgggggaagttgtgtgtgaactaaacgtggattggggccctgtttagttcacatcaatcttcctccaaattcccaacttttcatcacatcacaatcacat

SEQ ID NO: 232 - DNA, 338 bp, Oryza sativa
aaccaagttaaaatgctcataggtatgaacaagcatcaatgttattgtagcgtggtggtgtgacctctgtgcacgtaagcttgaggcagcaagttcgactccttcaaaaggaagatttgtaccgctggggaagtgccagaagaaaagaacaaggaagacttgctagcaggacaaaaggacggtaaacttggaaaaaaaaaggtccagaagaaaagaacaaagaagaactgcttgaaggagtcgaacttgctacctcaagcttgcgtgcacataggtcacaccactacgctacaataacgttgatgcttgttcagacctgtgagcattttaacttggtt

SEQ ID NO: 233 - DNA, 185 bp, Arabidopsis lyrata; identical to SEQ ID NO: 175

SEQ ID NO: 234 - DNA, 153 bp, Citrus sinensis
aggagtgtggagtgggagtgggagtagggtgtttacttagactaaatgaaagtatggattatcaatcagaatcctaattatttgtttactttgtcttggattgggagtaaattattttaaattataattttatccttatgtacaaaattataa

SEQ ID NO: 235 - DNA, 151 bp, Oryza sativa; identical to SEQ ID NO: 201

SEQ ID NO: 236 - DNA, 119 bp, Arabidopsis lyrata
catataatagtttgtcgtcgttatgcctggctccctgtatgccacgagtggataccgattttgttataaaatcggctgccggtggcgtacaaggagccaagcatgaccataagcatatg

SEQ ID NO: 237 - DNA, 172 bp, Arabidopsis lyrata; identical to SEQ ID NO: 202

SEQ ID NO: 238 - DNA, 188 bp, Arabidopsis lyrata; identical to SEQ ID NO: 203

SEQ ID NO: 239 - DNA, 119 bp, Brassica napus
gcacttgatgaggaactggtaatctgcatcctgaggtttaaaaatacataggcacatgcaaatgtgtgtattatagtttttaatcctcgggatacagattacctcttccttttactgaa

SEQ ID NO: 240 - DNA, 127 bp, Brassica rapa
tatgtgtagttgtataagatgtgtatgcctggctccctgtatgccatcctctaagctcatcgaccattgatgacctccgtgaatggcgtatgaggagccatgcatattttcatatacatttacatac

SEQ ID NO: 241 - DNA, 201 bp, Citrus sinensis
aaactgtttacactgatctgtgctgctgataaatcttaatttttttttttgaatttttatttaacagaaaatagagagagtgaagtcactggaggcagcggttcatcgatcactttgtgcaaattttgttgtgaaaaataacacaaaatacatgaatcgatcgataaacctctgcatccagcgctcactccaactctattc

SEQ ID NO: 242 - DNA, 336 bp, Glycine max
gcgacttattggagttcattcttcgcactctctcggaaaccacttgtttccaatcatctaatcagacgatagcagactcaagaaagacgtttccttcccagatccttctagaccatttgcaaaccgtctccttccccgaatccattctccaaaccctcgatccttgaggagctccaccaccgtgacggcgctccggtctccgccgtcaattgtgccgtcgcggtggagcatgagcgtcttcatgagtctgaaagggaattataggaactactttcctgattaggttattggaaacaagtggtttccgagtccgaggaaggaactccaacgcccaac

SEQ ID NO: 243 - DNA, 103 bp, Glycine max; identical to SEQ ID NO: 207

SEQ ID NO: 244 - DNA, 135 bp, Glycine max
atacttcattttttatactttaatttcctctatacctcacttttattggagaaaaaagagaatagaaaatagtggatttctcttctttttttcaatcaaagggagttgtaggggaaagtttagaaaatggcgtgt

SEQ ID NO: 245 - DNA, 108 bp, Glycine max; identical to SEQ ID NO: 208

SEQ ID NO: 246 - DNA, 88 bp, Glycine max
aactgttgcgggtatctttgcctctgaaggaaagttgtgcctattattatggcttattgctttagtggcgtagatccccacaacagtt

SEQ ID NO: 247 - DNA, 130 bp, Glycine max; identical to SEQ ID NO: 211

SEQ ID NO: 248 - DNA, 69 bp, Glycine max; identical to SEQ ID NO: 213

SEQ ID NO: 249 - DNA, 171 bp, Oryza sativa
ggtgatgcctgggcgcagtggtttatcgatcccttccctgccttgtggcgctgatccaggagcggcgaatttctttgagagggtgttctttttttttcttccttttggtccttgttgcagccaacgacaacgcgggaatcgatcgataaacctctgcatccagttctcgcc

SEQ ID NO: 250 - DNA, 69 bp, Oryza sativa
cgcatccgccaacgaggaggccgggaccaccggatccggtgactccggcctcctcgccggcagatccgg

SEQ ID NO: 251 - DNA, 105 bp, Oryza sativa
acgggcgctcacggtggcttcgaccctcgtctcggccgcgtgcggtagtgcgggaggcatgccgtgtgtaccggcggcgaggggatgcgagcgtgagtgcctcgg

SEQ ID NO: 252 - DNA, 125 bp, Physcomitrella patens
ggaggaccgatatggagagctgtccaggctgtgaggggagcactcgtattcttttgacctttgctagaagagggaatacagcgctctccctcacagtctgtacagctctctgtatctcttcctct

SEQ ID NO: 253 - DNA, 108 bp, Vitis vinifera
gcaatattgggtcaggatcgggtaatctgcatcctgaggtctagataagtatatctccgttgcagctagtcctctggttgcagattacttcttcctcactgccaatgc

SEQ ID NO: 254 - DNA, 262 bp, Zea mays
tgaagctgccacatgatctgatgacgcagagtcatgcatatgcattgcatccagcaagctccatgcgtgcgtgcatggccgaatggccgaagagactagctagtccatctctccaaggccatccacgtgtgagaattcaattcctcgtggatcagatcaggctgttgttgacaactgcatgccgcacctgcactacagcaacccaaggcataggtagctagctaggtttcggtggtcagatcagatcaggctggcagcttca

SEQ ID NO: 255 - DNA, 136 bp, Zea mays; identical to SEQ ID NO: 219

SEQ ID NO: 256 - DNA, 185 bp, Arabidopsis lyrata; identical to SEQ ID NO: 175

SEQ ID NO: 257 - DNA, 240 bp, Festuca arundinacea
acggcaatcccagcttcaacgggccggtgccaggcgtgcctcccggcgatgcccatcggtcgccgacgcctcctagcacgccagctggctcacaaggtgtctctcccggcggcgacaacaacaacaagaagaagagatcaggtctggtgctggctactaccatcccggtctcagtcagtgtggtggcgctcatctcgctgggtgccgtgctgctcttccgcaagaaaaacaacgggtccg

SEQ ID NO: 258 - DNA, 133 bp, Picea abies
aaatggcgctagaaggagggcctgaaaattattaatggcacgaggcagtcgtaagactcctccaccacccaaccactcacctatagtgaaaagaagtcattaaaatgataacatcacccctcaaatagaacca

SEQ ID NO: 259 - DNA, 122 bp, Zea mays; identical to SEQ ID NO: 200

SEQ ID NO: 260 - DNA, 201 bp, Citrus sinensis; identical to SEQ ID NO: 241

SEQ ID NO: 261 - DNA, 88 bp, Glycine max; identical to SEQ ID NO: 246

SEQ ID NO: 262 - DNA, 24 bp, Triticum aestivum
caacaacaacaagaagaagaagat

SEQ ID NO: 263 - DNA, 21 bp, Glycine max
tcaaagggagttgtaggggaa

SEQ ID NO: 264 - DNA, 21 bp, Phaseolus vulgaris
tcaaagggagttgtaggggaa

SEQ ID NO: 265 - DNA, 21 bp, Physcomitrella patens
ttccggtggtgaggaagatag

SEQ ID NO: 266 - DNA, 21 bp, Arabidopsis cebennensis
ttggactgaagggagctccct

SEQ ID NO: 267 - DNA, 21 bp, Arabidopsis halleri
ttggactgaagggagctccct

SEQ ID NO: 268 - DNA, 21 bp, Arabis hirsuta
ttggactgaagggagctccct

SEQ ID NO: 269 - DNA, 21 bp, Arachis hypogaea
tttggattgaagggagctcta

SEQ ID NO: 270 - DNA, 21 bp, Arabidopsis lyrata
tttggattgaagggagctcta

SEQ ID NO: 271 - DNA, 21 bp, Arabidopsis lyrata
tttggattgaagggagctctt

SEQ ID NO: 272 - DNA, 21 bp, Arabidopsis lyrata
tttggattgaagggagctcct

SEQ ID NO: 273 - DNA, 21 bp, Alliaria petiolata
ttggactgaagggagctccct

SEQ ID NO: 274 - DNA, 21 bp, Arabidopsis thaliana
tttggattgaagggagctcta

SEQ ID NO: 275 - DNA, 21 bp, Arabidopsis thaliana
tttggattgaagggagctctt

SEQ ID NO: 276 - DNA, 21 bp, Arabidopsis thaliana
tttggattgaagggagctcct

SEQ ID NO: 277 - DNA, 20 bp, Brachypodium distachyon
cttggattgaagggagctct

SEQ ID NO: 278 - DNA, 21 bp, Brassica napus
tttggattgaagggagctcta

SEQ ID NO: 279 - DNA, 21 bp, Brassica rapa
tttggattgaagggagctcta

SEQ ID NO: 280 - DNA, 21 bp, Barbarea vulgaris
ttggactgaagggagctccct

SEQ ID NO: 281 - DNA, 21 bp, Camelina microcarpa
ttggactgaagggagctccct

SEQ ID NO: 282 - DNA, 21 bp, Conringia orientalis
ttggactgaagggagctccct

SEQ ID NO: 283 - DNA, 21 bp, Capsella rubella
ttggactgaagggagctccct

SEQ ID NO: 284 - DNA, 21 bp, Citrus sinensis
tttggattgaagggagctcta

SEQ ID NO: 285 - DNA, 21 bp, Descurainia sophia
ttggactgaagggagctccct

SEQ ID NO: 286 - DNA, 21 bp, Erysimum cheiri
ttggactgaagggagctccct

SEQ ID NO: 287 - DNA, 21 bp, Fourraea alpina
ttggactgaagggagctccct

SEQ ID NO: 288 - DNA, 21 bp, Festuca arundinacea
tttggattgaagggagctctg

SEQ ID NO: 289 - DNA, 21 bp, Glycine max
tttggattgaagggagctcta

SEQ ID NO: 290 - DNA, 21 bp, Glycine max
attggagtgaagggagctcca

SEQ ID NO: 291 - DNA, 21 bp, Glycine max
attggagtgaagggagctccg

SEQ ID NO: 292 - DNA, 21 bp, Hordeum vulgare
tttggattgaagggagctctg

SEQ ID NO: 293 - DNA, 21 bp, Hordeum vulgare
tttggattgaagggagctctg

SEQ ID NO: 294 - DNA, 21 bp, Hordeum vulgare subsp. Vulgare
tttggattgaagggagctctg

SEQ ID NO: 295 - DNA, 21 bp, Hordeum vulgare subsp. Vulgare
tttggattgaagggagctctg

SEQ ID NO: 296 - DNA, 21 bp, Liriodendron tulipifera
tttggattgaagggagctcta

SEQ ID NO: 297 - DNA, 21 bp, Malcolmia maritima
ttggactgaagggagctccct

SEQ ID NO: 298 - DNA, 21 bp, Medicago truncatula
tttggattgaagggagctcta

SEQ ID NO: 299 - DNA, 21 bp, Medicago truncatula
attgaattgaagggagcaact

SEQ ID NO: 300 - DNA, 21 bp, Medicago truncatula
tttggattgaagggagctcta

SEQ ID NO: 301 - DNA, 21 bp, Nasturtium officinale
ttggactgaagggagctccct

SEQ ID NO: 302 - DNA, 21 bp, Oryza rufipogon
tttggattgaagggagctctg

SEQ ID NO: 303 - DNA, 21 bp, Oryza sativa
tttggattgaagggagctctg

SEQ ID NO: 304 - DNA, 21 bp, Oryza sativa
tttggattgaagggagctctg

SEQ ID NO: 305 - DNA, 21 bp, Oryza sativa
tttggattgaagggagctctg

SEQ ID NO: 306 - DNA, 21 bp, Oryza sativa
attggattgaagggagctcca

SEQ ID NO: 307 - DNA, 21 bp, Oryza sativa
attggattgaagggagctccg

SEQ ID NO: 308 - DNA, 21 bp, Oryza sativa
attggattgaagggagctcct

SEQ ID NO: 309 - DNA, 21 bp, Oryza sativa
cttggattgaagggagctcta

SEQ ID NO: 310 - DNA, 21 bp, Oryza sativa
tttggattgaagggagctctg

SEQ ID NO: 311 - DNA, 21 bp, Pennisetum glaucum
tttggattgaagggagctctg

SEQ ID NO: 312 - DNA, 21 bp, Picea sitchensis
cttggattgaagggagctcca

SEQ ID NO: 313 - DNA, 20 bp, Pinus taeda
ttggattgaagggagctcca

SEQ ID NO: 314 - DNA, 20 bp, Pinus taeda
ttggattgaagagagctccc

SEQ ID NO: 315 - DNA, 21 bp, Pinus taeda
cttggattgaagggagctccc

SEQ ID NO: 316 - DNA, 21 bp, Populus trichocarpa
tttggattgaagggagctcta

SEQ ID NO: 317 - DNA, 21 bp, Populus trichocarpa
tttggattgaagggagctcta

SEQ ID NO: 318 - DNA, 21 bp, Populus trichocarpa
tttggattgaagggagctcta

SEQ ID NO: 319 - DNA, 21 bp, Populus trichocarpa
cttggattgaagggagctcct

SEQ ID NO: 320 - DNA, 21 bp, Populus trichocarpa
cttggggtgaagggagctcct

SEQ ID NO: 321 - DNA, 21 bp, Populus trichocarpa
attggagtgaagggagctcga

SEQ ID NO: 322 - DNA, 21 bp, Phaseolus vulgaris
tttggattgaagggagctcta

SEQ ID NO: 323 - DNA, 21 bp, Phaseolus vulgaris
tttggattgaagggagctcta

SEQ ID NO: 324 - DNA, 21 bp, Ricinus communis
tttggattgaagggagctcta

SEQ ID NO: 325 - DNA, 21 bp, Rorippa indica
ttggactgaagggagctccct

SEQ ID NO: 326 - DNA, 21 bp, Schedonorus arundinaceus
tttggattgaagggagctctg

SEQ ID NO: 327 - DNA, 21 bp, Sorghum bicolor
tttggattgaagggagctctg

SEQ ID NO: 328 - DNA, 21 bp, Sorghum bicolor
cttggattgaagggagctcct

SEQ ID NO: 329 - DNA, 21 bp, Solanum lycopersicum
tttggattgaagggagctcta

SEQ ID NO: 330 - DNA, 21 bp, Selaginella moellendorffii
cttggattgaagggagctccc

SEQ ID NO: 331 - DNA, 21 bp, Saccharum officinarum
tttggattgaagggagctctg

SEQ ID NO: 332 - DNA, 21 bp, Saccharum officinarum
tttggattgaagggagctctg

SEQ ID NO: 333 - DNA, 21 bp, Saccharum officinarum
cttggattgaagggagctcct

SEQ ID NO: 334 - DNA, 21 bp, Saccharum officinarum
tttggattgaagggagctctg

SEQ ID NO: 335 - DNA, 21 bp, Saccharum officinarum
tttggattgaaaggagctctt

SEQ ID NO: 336 - DNA, 21 bp, Sorghum Propinquum
tttggattgaagggagctctg

SEQ ID NO: 337 - DNA, 21 bp, Saccharum spp
tttggattgaagggagctctg

SEQ ID NO: 338 - DNA, 21 bp, Sibara virginica
ttggactgaagggagctccct

SEQ ID NO: 339 - DNA, 21 bp, Triticum aestivum
tttggattgaagggagctctg

SEQ ID NO: 340 - DNA, 21 bp, Triticum aestivum
tttggattgaagggagctctg

SEQ ID NO: 341 - DNA, 21 bp, Thlaspi arvense
ttggactgaagggagctccct

SEQ ID NO: 342 - DNA, 21 bp, Vitis vinifera
cttggagtgaagggagctctc

SEQ ID NO: 343 - DNA, 21 bp, Vitis vinifera
cttggagtgaagggagctctc

SEQ ID NO: 344 - DNA, 21 bp, Vitis vinifera
tttggattgaagggagctcta

SEQ ID NO: 345 - DNA, 21 bp, Zea mays
tttggattgaagggagctctg

SEQ ID NO: 346 - DNA, 21 bp, Zea mays
tttggattgaagggagctctg

SEQ ID NO: 347 - DNA, 21 bp, Zea mays
cttggattgaagggagctcct

SEQ ID NO: 348 - DNA, 21 bp, Zea mays
cttggattgaagggagctcct

SEQ ID NO: 349 - DNA, 21 bp, Zea mays
attggtttgaagggagctcca

SEQ ID NO: 350 - DNA, 21 bp, Zea mays
tttggattgaagggagctctg

SEQ ID NO: 351 - DNA, 21 bp, Zea mays
tttggagtgaagggagttctg

SEQ ID NO: 352 - DNA, 21 bp, Zea mays
tttggagtgaagggagctctg

SEQ ID NO: 353 - DNA, 21 bp, Zea mays
tttggagtgaagggagctctg

SEQ ID NO: 354 - DNA, 21 bp, Zea mays
tttggattgaagggagctctg

SEQ ID NO: 355 - DNA, 21 bp, Zea mays
tttggattgaagggagctctg

SEQ ID NO: 356 - DNA, 21 bp, Zea mays
tttggattgaagggagctctg

SEQ ID NO: 357 - DNA, 21 bp, Arabidopsis cebennensis
ttggactgaagggagctccct

SEQ ID NO: 358 - DNA, 21 bp, Arabidopsis halleri
ttggactgaagggagctccct

SEQ ID NO: 359 - DNA, 21 bp, Arabis hirsuta
ttggactgaagggagctccct

SEQ ID NO: 360 - DNA, 21 bp, Arachis hypogaea
tttggattgaagggagctcta

SEQ ID NO: 361 - DNA, 21 bp, Arabidopsis lyrata
tttggattgaagggagctcta

SEQ ID NO: 362 - DNA, 21 bp, Arabidopsis lyrata
tttggattgaagggagctctt

SEQ ID NO: 363 - DNA, 21 bp, Arabidopsis lyrata
tttggattgaagggagctcct

SEQ ID NO: 364 - DNA, 21 bp, Alliaria petiolata
ttggactgaagggagctccct

SEQ ID NO: 365 - DNA, 21 bp, Aquilegia coerulea
tttggactgaagggagctcta

SEQ ID NO: 366 - DNA, 21 bp, Arabidopsis thaliana
tttggattgaagggagctcta

SEQ ID NO: 367 - DNA, 21 bp, Arabidopsis thaliana
tttggattgaagggagctcct

SEQ ID NO: 368 - DNA, 20 bp, Brachypodium distachyon
cttggattgaagggagctct

SEQ ID NO: 369 - DNA, 21 bp, Brassica napus
tttggattgaagggagctcta

SEQ ID NO: 370 - DNA, 21 bp, Brassica rapa
tttggattgaagggagctcta

SEQ ID NO: 371 - DNA, 21 bp, Barbarea vulgaris
ttggactgaagggagctccct

SEQ ID NO: 372 - DNA, 21 bp, Camelina microcarpa
ttggactgaagggagctccct

SEQ ID NO: 373 - DNA, 21 bp, Conringia orientalis
ttggactgaagggagctccct

SEQ ID NO: 374 - DNA, 21 bp, Capsella rubella
ttggactgaagggagctccct

SEQ ID NO: 375 - DNA, 21 bp, Citrus sinensis
tttggattgaagggagctcta

SEQ ID NO: 376 - DNA, 21 bp, Descurainia sophia
ttggactgaagggagctccct

SEQ ID NO: 377 - DNA, 21 bp, Erysimum cheiri
ttggactgaagggagctccct

SEQ ID NO: 378 - DNA, 21 bp, Fourraea alpina
ttggactgaagggagctccct

SEQ ID NO: 379 - DNA, 21 bp, Festuca arundinacea
tttggattgaagggagctctg

SEQ ID NO: 380 - DNA, 21 bp, Glycine max
tttggattgaagggagctcta

SEQ ID NO: 381 - DNA, 21 bp, Glycine max
attggagtgaagggagctcca

SEQ ID NO: 382 - DNA, 21 bp, Glycine max
attggagtgaagggagctccg

SEQ ID NO: 383 - DNA, 21 bp, Hordeum vulgare
tttggattgaagggagctctg

SEQ ID NO: 384 - DNA, 21 bp, Hordeum vulgare
tttggattgaagggagctctg

SEQ ID NO: 385 - DNA, 21 bp, Hordeum vulgare subsp. Vulgare
tttggattgaagggagctctg

SEQ ID NO: 386 - DNA, 21 bp, Hordeum vulgare subsp. Vulgare
tttggattgaagggagctctg

SEQ ID NO: 387 - DNA, 21 bp, Liriodendron tulipifera
tttggattgaagggagctcta

SEQ ID NO: 388 - DNA, 21 bp, Malcolmia maritima
ttggactgaagggagctccct

SEQ ID NO: 389 - DNA, 21 bp, Medicago truncatula
tttggattgaagggagctcta

SEQ ID NO: 390 - DNA, 21 bp, Medicago truncatula
attgaattgaagggagcaact

SEQ ID NO: 391 - DNA, 21 bp, Medicago truncatula
tttggattgaagggagctcta

SEQ ID NO: 392 - DNA, 21 bp, Nasturtium officinale
ttggactgaagggagctccct

SEQ ID NO: 393 - DNA, 21 bp, Oryza rufipogon
tttggattgaagggagctctg

SEQ ID NO: 394 - DNA, 21 bp, Oryza sativa
tttggattgaagggagctctg

SEQ ID NO: 395 - DNA, 21 bp, Oryza sativa
tttggattgaagggagctctg

SEQ ID NO: 396 - DNA, 21 bp, Oryza sativa
tttggattgaagggagctctg

SEQ ID NO: 397 - DNA, 21 bp, Oryza sativa
attggattgaagggagctcca

SEQ ID NO: 398 - DNA, 21 bp, Oryza sativa
attggattgaagggagctccg

SEQ ID NO: 399 - DNA, 21 bp, Oryza sativa
attggattgaagggagctcct

SEQ ID NO: 400 - DNA, 21 bp, Oryza sativa
cttggattgaagggagctcta

SEQ ID NO: 401 - DNA, 21 bp, Oryza sativa
tttggattgaagggagctctg

SEQ ID NO: 402 - DNA, 21 bp, Pennisetum glaucum
tttggattgaagggagctctg

SEQ ID NO: 403 - DNA, 21 bp, Picea sitchensis
cttggattgaagggagctcca

SEQ ID NO: 404 - DNA, 20 bp, Pinus taeda
ttggattgaagggagctcca

SEQ ID NO: 405 - DNA, 20 bp, Pinus taeda
ttggattgaagagagctccc

SEQ ID NO: 406 - DNA, 21 bp, Pinus taeda
cttggattgaagggagctccc

SEQ ID NO: 407 - DNA, 21 bp, Populus trichocarpa
tttggattgaagggagctcta

SEQ ID NO: 408 - DNA, 21 bp, Populus trichocarpa
tttggattgaagggagctcta

SEQ ID NO: 409 - DNA, 21 bp, Populus trichocarpa
tttggattgaagggagctcta

SEQ ID NO: 410 - DNA, 21 bp, Populus trichocarpa
cttggattgaagggagctcct

SEQ ID NO: 411 - DNA, 21 bp, Populus trichocarpa
cttggggtgaagggagctcct

SEQ ID NO: 412 - DNA, 21 bp, Populus trichocarpa
attggagtgaagggagctcga

SEQ ID NO: 413 - DNA, 21 bp, Phaseolus vulgaris
tttggattgaagggagctcta

SEQ ID NO: 414 - DNA, 21 bp, Phaseolus vulgaris
tttggattgaagggagctcta

SEQ ID NO: 415 - DNA, 21 bp, Ricinus communis
tttggattgaagggagctcta

SEQ ID NO: 416 - DNA, 21 bp, Rorippa indica
ttggactgaagggagctccct

SEQ ID NO: 417 - DNA, 21 bp, Schedonorus arundinaceus
tttggattgaagggagctctg

SEQ ID NO: 418 - DNA, 21 bp, Sorghum bicolor
tttggattgaagggagctctg

SEQ ID NO: 419 - DNA, 21 bp, Sorghum bicolor
cttggattgaagggagctcct

SEQ ID NO: 420 - DNA, 21 bp, Solanum lycopersicum
tttggattgaagggagctcta

SEQ ID NO: 421 - DNA, 21 bp, Selaginella moellendorffii
cttggattgaagggagctccc

SEQ ID NO: 422 - DNA, 21 bp, Saccharum officinarum
tttggattgaagggagctctg

SEQ ID NO: 423 - DNA, 21 bp, Saccharum officinarum
tttggattgaagggagctctg

SEQ ID NO: 424 - DNA, 21 bp, Saccharum officinarum
cttggattgaagggagctcct

SEQ ID NO: 425 - DNA, 21 bp, Saccharum officinarum
tttggattgaagggagctctg

SEQ ID NO: 426 - DNA, 21 bp, Saccharum officinarum
tttggattgaaaggagctctt

SEQ ID NO: 427 - DNA, 21 bp, Sorghum Propinquum
tttggattgaagggagctctg

SEQ ID NO: 428 - DNA, 21 bp, Saccharum spp
tttggattgaagggagctctg

SEQ ID NO: 429 - DNA, 21 bp, Sibara virginica
ttggactgaagggagctccct

SEQ ID NO: 430 - DNA, 21 bp, Triticum aestivum
tttggattgaagggagctctg

SEQ ID NO: 431 - DNA, 21 bp, Triticum aestivum
tttggattgaagggagctctg

SEQ ID NO: 432 - DNA, 21 bp, Thlaspi arvense
ttggactgaagggagctccct

SEQ ID NO: 433 - DNA, 21 bp, Vitis vinifera
cttggagtgaagggagctctc

SEQ ID NO: 434 - DNA, 21 bp, Vitis vinifera
cttggagtgaagggagctctc

SEQ ID NO: 435 - DNA, 21 bp, Vitis vinifera
tttggattgaagggagctcta

SEQ ID NO: 436 - DNA, 21 bp, Zea mays
tttggattgaagggagctctg

SEQ ID NO: 437 - DNA, 21 bp, Zea mays
tttggattgaagggagctctg

SEQ ID NO: 438 - DNA, 21 bp, Zea mays
cttggattgaagggagctcct

SEQ ID NO: 439 - DNA, 21 bp, Zea mays
cttggattgaagggagctcct

SEQ ID NO: 440 - DNA, 21 bp, Zea mays
attggtttgaagggagctcca

SEQ ID NO: 441 - DNA, 21 bp, Zea mays
tttggattgaagggagctctg

SEQ ID NO: 442 - DNA, 21 bp, Zea mays
tttggagtgaagggagttctg

SEQ ID NO: 443 - DNA, 21 bp, Zea mays
tttggagtgaagggagctctg

SEQ ID NO: 444 - DNA, 21 bp, Zea mays
tttggagtgaagggagctctg

SEQ ID NO: 445 - DNA, 21 bp, Zea mays
tttggattgaagggagctctg

SEQ ID NO: 446 - DNA, 21 bp, Zea mays
tttggattgaagggagctctg

SEQ ID NO: 447 - DNA, 21 bp, Zea mays
tttggattgaagggagctctg

SEQ ID NO: 448 - DNA, 21 bp, Arabidopsis cebennensis
ttggactgaagggagctccct

SEQ ID NO: 449 - DNA, 21 bp, Arabidopsis halleri
ttggactgaagggagctccct

SEQ ID NO: 450 - DNA, 21 bp, Arabis hirsuta
ttggactgaagggagctccct

SEQ ID NO: 451 - DNA, 21 bp, Arachis hypogaea
tttggattgaagggagctcta

SEQ ID NO: 452 - DNA, 21 bp, Arabidopsis lyrata
tttggattgaagggagctcta

SEQ ID NO: 453 - DNA, 21 bp, Arabidopsis lyrata
tttggattgaagggagctctt

SEQ ID NO: 454 - DNA, 21 bp, Arabidopsis lyrata
tttggattgaagggagctcct

SEQ ID NO: 455 - DNA, 21 bp, Alliaria petiolata
ttggactgaagggagctccct

SEQ ID NO: 456 - DNA, 21 bp, Aquilegia coerulea
tttggactgaagggagctcta

SEQ ID NO: 457 - DNA, 21 bp, Arabidopsis thaliana
tttggattgaagggagctcta

SEQ ID NO: 458 - DNA, 21 bp, Arabidopsis thaliana
tttggattgaagggagctctt

SEQ ID NO: 459 - DNA, 20 bp, Brachypodium distachyon
cttggattgaagggagctct

SEQ ID NO: 460 - DNA, 21 bp, Brassica napus
tttggattgaagggagctcta

SEQ ID NO: 461 - DNA, 21 bp, Brassica rapa
tttggattgaagggagctcta

SEQ ID NO: 462 - DNA, 21 bp, Barbarea vulgaris
ttggactgaagggagctccct

SEQ ID NO: 463 - DNA, 21 bp, Camelina microcarpa
ttggactgaagggagctccct

SEQ ID NO: 464 - DNA, 21 bp, Conringia orientalis
ttggactgaagggagctccct

SEQ ID NO: 465 - DNA, 21 bp, Capsella rubella
ttggactgaagggagctccct

SEQ ID NO: 466 - DNA, 21 bp, Citrus sinensis
tttggattgaagggagctcta

SEQ ID NO: 467 - DNA, 21 bp, Descurainia sophia
ttggactgaagggagctccct

SEQ ID NO: 468 - DNA, 21 bp, Erysimum cheiri
ttggactgaagggagctccct

SEQ ID NO: 469 - DNA, 21 bp, Fourraea alpina
ttggactgaagggagctccct

SEQ ID NO: 470 - DNA, 21 bp, Festuca arundinacea
tttggattgaagggagctctg

SEQ ID NO: 471 - DNA, 21 bp, Glycine max
tttggattgaagggagctcta

SEQ ID NO: 472 - DNA, 21 bp, Glycine max
attggagtgaagggagctcca

SEQ ID NO: 473 - DNA, 21 bp, Glycine max
attggagtgaagggagctccg

SEQ ID NO: 474 - DNA, 21 bp, Hordeum vulgare
tttggattgaagggagctctg

SEQ ID NO: 475 - DNA, 21 bp, Hordeum vulgare
tttggattgaagggagctctg

SEQ ID NO: 476 - DNA, 21 bp, Hordeum vulgare subsp. Vulgare
tttggattgaagggagctctg

SEQ ID NO: 477 - DNA, 21 bp, Hordeum vulgare subsp. Vulgare
tttggattgaagggagctctg

SEQ ID NO: 478 - DNA, 21 bp, Liriodendron tulipifera
tttggattgaagggagctcta

SEQ ID NO: 479 - DNA, 21 bp, Malcolmia maritima
ttggactgaagggagctccct

SEQ ID NO: 480 - DNA, 21 bp, Medicago truncatula
tttggattgaagggagctcta

SEQ ID NO: 481 - DNA, 21 bp, Medicago truncatula
attgaattgaagggagcaact

SEQ ID NO: 482 - DNA, 21 bp, Medicago truncatula
tttggattgaagggagctcta

SEQ ID NO: 483 - DNA, 21 bp, Nasturtium officinale
ttggactgaagggagctccct

SEQ ID NO: 484 - DNA, 21 bp, Oryza rufipogon
tttggattgaagggagctctg

SEQ ID NO: 485 - DNA, 21 bp, Oryza sativa
tttggattgaagggagctctg

SEQ ID NO: 486 - DNA, 21 bp, Oryza sativa
tttggattgaagggagctctg

SEQ ID NO: 487 - DNA, 21 bp, Oryza sativa
tttggattgaagggagctctg

SEQ ID NO: 488 - DNA, 21 bp, Oryza sativa
attggattgaagggagctcca

SEQ ID NO: 489 - DNA, 21 bp, Oryza sativa
attggattgaagggagctccg

SEQ ID NO: 490 - DNA, 21 bp, Oryza sativa
attggattgaagggagctcct

SEQ ID NO: 491 - DNA, 21 bp, Oryza sativa
cttggattgaagggagctcta

SEQ ID NO: 492 - DNA, 21 bp, Oryza sativa
tttggattgaagggagctctg

SEQ ID NO: 493 - DNA, 21 bp, Pennisetum glaucum
tttggattgaagggagctctg

SEQ ID NO: 494 - DNA, 21 bp, Picea sitchensis
cttggattgaagggagctcca

SEQ ID NO: 495 - DNA, 20 bp, Pinus taeda
ttggattgaagggagctcca

SEQ ID NO: 496 - DNA, 20 bp, Pinus taeda
ttggattgaagagagctccc

SEQ ID NO: 497 - DNA, 21 bp, Pinus taeda
cttggattgaagggagctccc

SEQ ID NO: 498 - DNA, 21 bp, Populus trichocarpa
tttggattgaagggagctcta

SEQ ID NO: 499 - DNA, 21 bp, Populus trichocarpa
tttggattgaagggagctcta

SEQ ID NO: 500 - DNA, 21 bp, Populus trichocarpa
tttggattgaagggagctcta

SEQ ID NO: 501 - DNA, 21 bp, Populus trichocarpa
cttggattgaagggagctcct

SEQ ID NO: 502 - DNA, 21 bp, Populus trichocarpa
cttggggtgaagggagctcct

SEQ ID NO: 503 - DNA, 21 bp, Populus trichocarpa
attggagtgaagggagctcga

SEQ ID NO: 504 - DNA, 21 bp, Phaseolus vulgaris
tttggattgaagggagctcta

SEQ ID NO: 505 - DNA, 21 bp, Phaseolus vulgaris
tttggattgaagggagctcta

SEQ ID NO: 506 - DNA, 21 bp, Ricinus communis
tttggattgaagggagctcta

SEQ ID NO: 507 - DNA, 21 bp, Rorippa indica
ttggactgaagggagctccct

SEQ ID NO: 508 - DNA, 21 bp, Schedonorus arundinaceus
tttggattgaagggagctctg

SEQ ID NO: 509 - DNA, 21 bp, Sorghum bicolor
tttggattgaagggagctctg

SEQ ID NO: 510 - DNA, 21 bp, Sorghum bicolor
cttggattgaagggagctcct

SEQ ID NO: 511 - DNA, 21 bp, Solanum lycopersicum
tttggattgaagggagctcta

SEQ ID NO: 512 - DNA, 21 bp, Selaginella moellendorffii
cttggattgaagggagctccc

SEQ ID NO: 513 - DNA, 21 bp, Saccharum officinarum
tttggattgaagggagctctg

SEQ ID NO: 514 - DNA, 21 bp, Saccharum officinarum
tttggattgaagggagctctg

SEQ ID NO: 515 - DNA, 21 bp, Saccharum officinarum
cttggattgaagggagctcct

SEQ ID NO: 516 - DNA, 21 bp, Saccharum officinarum
tttggattgaagggagctctg

SEQ ID NO: 517 - DNA, 21 bp, Saccharum officinarum
tttggattgaaaggagctctt

SEQ ID NO: 518 - DNA, 21 bp, Sorghum Propinquum
tttggattgaagggagctctg

SEQ ID NO: 519 - DNA, 21 bp, Saccharum spp
tttggattgaagggagctctg

SEQ ID NO: 520 - DNA, 21 bp, Sibara virginica
ttggactgaagggagctccct

SEQ ID NO: 521 - DNA, 21 bp, Triticum aestivum
tttggattgaagggagctctg

SEQ ID NO: 522 - DNA, 21 bp, Triticum aestivum
tttggattgaagggagctctg

SEQ ID NO: 523 - DNA, 21 bp, Thlaspi arvense
ttggactgaagggagctccct

SEQ ID NO: 524 - DNA, 21 bp, Vitis vinifera
cttggagtgaagggagctctc

SEQ ID NO: 525 - DNA, 21 bp, Vitis vinifera
cttggagtgaagggagctctc

SEQ ID NO: 526 - DNA, 21 bp, Vitis vinifera
tttggattgaagggagctcta

SEQ ID NO: 527 - DNA, 21 bp, Zea mays
tttggattgaagggagctctg

SEQ ID NO: 528 - DNA, 21 bp, Zea mays
tttggattgaagggagctctg

SEQ ID NO: 529 - DNA, 21 bp, Zea mays
cttggattgaagggagctcct

SEQ ID NO: 530 - DNA, 21 bp, Zea mays
cttggattgaagggagctcct

SEQ ID NO: 531 - DNA, 21 bp, Zea mays
attggtttgaagggagctcca

SEQ ID NO: 532 - DNA, 21 bp, Zea mays
tttggattgaagggagctctg

SEQ ID NO: 533 - DNA, 21 bp, Zea mays
tttggagtgaagggagttctg

SEQ ID NO: 534 - DNA, 21 bp, Zea mays
tttggagtgaagggagctctg

SEQ ID NO: 535 - DNA, 21 bp, Zea mays
tttggagtgaagggagctctg

SEQ ID NO: 536 - DNA, 21 bp, Zea mays
tttggattgaagggagctctg

SEQ ID NO: 537 - DNA, 21 bp, Zea mays
tttggattgaagggagctctg

SEQ ID NO: 538 - DNA, 21 bp, Zea mays
tttggattgaagggagctctg

SEQ ID NO: 539 - DNA, 21 bp, Vitis vinifera
tggtgtgcacgggatggaata

SEQ ID NO: 540 - DNA, 20 bp, Arachis hypogaea
tgacagaagagagagagcac

SEQ ID NO: 541 - DNA, 21 bp, Arachis hypogaea
ttgacagaagatagagagcac

SEQ ID NO: 542 - DNA, 21 bp, Arachis hypogaea
ttgacagaagagagagagcac

SEQ ID NO: 543 - DNA, 20 bp, Arabidopsis lyrata
tgacagaagagagtgagcac

SEQ ID NO: 544 - DNA, 20 bp, Arabidopsis lyrata
tgacagaagagagtgagcac

SEQ ID NO: 545 - DNA, 20 bp, Arabidopsis lyrata
tgacagaagagagtgagcac

SEQ ID NO: 546 - DNA, 20 bp, Arabidopsis lyrata
tgacagaagagagtgagcac

SEQ ID NO: 547 - DNA, 20 bp, Arabidopsis lyrata
tgacagaagagagtgagcac

SEQ ID NO: 548 - DNA, 20 bp, Arabidopsis lyrata
tgacagaagagagtgagcac

SEQ ID NO: 549 - DNA, 20 bp, Arabidopsis lyrata
cgacagaagagagtgagcac

SEQ ID NO: 550 - DNA, 20 bp, Arabidopsis lyrata
tgacagaagaaagagagcac

SEQ ID NO: 551 - DNA, 20 bp, Aquilegia coerulea
tgacagaagatagagagcac

SEQ ID NO: 552 - DNA, 20 bp, Aquilegia coerulea
tgacagaagatagagagcac

SEQ ID NO: 553 - DNA, 20 bp, Arabidopsis thaliana
tgacagaagagagtgagcac

SEQ ID NO: 554 - DNA, 20 bp, Arabidopsis thaliana
tgacagaagagagtgagcac

SEQ ID NO: 555 - DNA, 20 bp, Arabidopsis thaliana
tgacagaagagagtgagcac

SEQ ID NO: 556 - DNA, 20 bp, Arabidopsis thaliana
tgacagaagagagtgagcac

SEQ ID NO: 557 - DNA, 20 bp, Arabidopsis thaliana
tgacagaagagagtgagcac

SEQ ID NO: 558 - DNA, 20 bp, Arabidopsis thaliana
tgacagaagagagtgagcac

SEQ ID NO: 559 - DNA, 20 bp, Arabidopsis thaliana
cgacagaagagagtgagcac

SEQ ID NO: 560 - DNA, 20 bp, Arabidopsis thaliana
tgacagaagaaagagagcac

SEQ ID NO: 561 - DNA, 21 bp, Brachypodium distachyon
tgacagaagagagagagcaca

SEQ ID NO: 562 - DNA, 20 bp, Brachypodium distachyon
tgacagaagagagtgagcac

SEQ ID NO: 563 - DNA, 20 bp, Brachypodium distachyon
tgacagaagagagtgagcac

SEQ ID NO: 564 - DNA, 20 bp, Brachypodium distachyon
tgacagaagagagtgagcac

SEQ ID NO: 565 - DNA, 21 bp, Brassica napus
tgacagaagagagtgagcaca

SEQ ID NO: 566 - DNA, 21 bp, Brassica napus
ttgacagaagatagagagcac

SEQ ID NO: 567 - DNA, 21 bp, Brassica napus
ttgacagaagatagagagcac

SEQ ID NO: 568 - DNA, 20 bp, Citrus sinensis
tgacagaagagagtgagcac

SEQ ID NO: 569 - DNA, 20 bp, Citrus trifoliata
tgacagaagagagtgagcac

SEQ ID NO: 570 - DNA, 21 bp, Festuca arundinacea
tgacagaagagagagagcaca

SEQ ID NO: 571 - DNA, 21 bp, Festuca arundinacea
ttgacagaagagagagagcac

SEQ ID NO: 572 - DNA, 20 bp, Gossypium hirsutum
tgacagaagagagtgagcac

SEQ ID NO: 573 - DNA, 20 bp, Gossypium hirsutum
tgacagaagagagtgagcac

SEQ ID NO: 574 - DNA, 20 bp, Gossypium hirsutum
tgtcagaagagagtgagcac

SEQ ID NO: 575 - DNA, 20 bp, Gossypium hirsutum
tgacagaagagagtgagcac

SEQ ID NO: 576 - DNA, 20 bp, Glycine max
tgacagaagagagtgagcac

SEQ ID NO: 577 - DNA, 21 bp, Glycine max
tgacagaagagagagagcaca

SEQ ID NO: 578 - DNA, 21 bp, Glycine max
ttgacagaagatagagagcac

SEQ ID NO: 579 - DNA, 21 bp, Glycine max
ttgacagaagatagagagcac

SEQ ID NO: 580 - DNA, 21 bp, Glycine max
ttgacagaagatagagagcac

SEQ ID NO: 581 - DNA, 22 bp, Glycine max
ttgacagaagagagagagcaca

SEQ ID NO: 582 - DNA, 21 bp, Hordeum vulgare
tgacagaagagagtgagcaca

SEQ ID NO: 583 - DNA, 21 bp, Medicago truncatula
tgacagaagagagagagcaca

SEQ ID NO: 584 - DNA, 20 bp, Medicago truncatula
tgacagaagagagtgagcac

SEQ ID NO: 585 - DNA, 20 bp, Medicago truncatula
tgacagaagagagtgagcac

SEQ ID NO: 586 - DNA, 20 bp, Medicago truncatula
tgacagaagagagtgagcac

SEQ ID NO: 587 - DNA, 21 bp, Medicago truncatula
ttgacagaagatagagagcac

SEQ ID NO: 588 - DNA, 21 bp, Medicago truncatula
ttgacagaagatagagagcac

SEQ ID NO: 589 - DNA, 21 bp, Medicago truncatula
ttgacagaagatagagggcac

SEQ ID NO: 590 - DNA, 21 bp, Medicago truncatula
ttgacagaagatagagagcac

SEQ ID NO: 591 - DNA, 20 bp, Medicago truncatula
tgacagaagagagtgagcac

SEQ ID NO: 592 - DNA, 20 bp, Oryza sativa
tgacagaagagagtgagcac

SEQ ID NO: 593 - DNA, 20 bp, Oryza sativa
tgacagaagagagtgagcac

SEQ ID NO: 594 - DNA, 20 bp, Oryza sativa
tgacagaagagagtgagcac

SEQ ID NO: 595 - DNA, 20 bp, Oryza sativa
tgacagaagagagtgagcac

SEQ ID NO: 596 - DNA, 20 bp, Oryza sativa
tgacagaagagagtgagcac

SEQ ID NO: 597 - DNA, 20 bp, Oryza sativa
tgacagaagagagtgagcac

SEQ ID NO: 598 - DNA, 20 bp, Oryza sativa
tgacagaagagagtgagcac

SEQ ID NO: 599 - DNA, 20 bp, Oryza sativa
tgacagaagagagtgagcac

SEQ ID NO: 600 - DNA, 20 bp, Oryza sativa
tgacagaagagagtgagcac

SEQ ID NO: 601 - DNA, 20 bp, Oryza sativa
tgacagaagagagtgagcac

SEQ ID NO: 602 - DNA, 21 bp, Oryza sativa
tgacagaagagagagagcaca

SEQ ID NO: 603 - DNA, 21 bp, Oryza sativa
cgacagaagagagtgagcata

SEQ ID NO: 604 - DNA, 20 bp, Physcomitrella patens
tgacagaagagagtgagcac

SEQ ID NO: 605 - DNA, 20 bp, Physcomitrella patens
tgacagaagagagtgagcac

SEQ ID NO: 606 - DNA, 20 bp, Physcomitrella patens
tgacagaagagagtgagcac

SEQ ID NO: 607 - DNA, 20 bp, Pinus taeda
cagaagatagagagcacatc

SEQ ID NO: 608 - DNA, 20 bp, Pinus taeda
cagaagatagagagcacaac

SEQ ID NO: 609 - DNA, 20 bp, Populus trichocarpa
tgacagaagagagtgagcac

SEQ ID NO: 610 - DNA, 20 bp, Populus trichocarpa
tgacagaagagagtgagcac

SEQ ID NO: 611 - DNA, 20 bp, Populus trichocarpa
tgacagaagagagtgagcac

SEQ ID NO: 612 - DNA, 20 bp, Populus trichocarpa
tgacagaagagagtgagcac

SEQ ID NO: 613 - DNA, 20 bp, Populus trichocarpa
tgacagaagagagtgagcac

SEQ ID NO: 614 - DNA, 20 bp, Populus trichocarpa
tgacagaagagagtgagcac

SEQ ID NO: 615 - DNA, 21 bp, Populus trichocarpa
ttgacagaagatagagagcac

SEQ ID NO: 616 - DNA, 21 bp, Populus trichocarpa
ttgacagaagatagagagcac

SEQ ID NO: 617 - DNA, 21 bp, Populus trichocarpa
ttgacagaagatagagagcac

SEQ ID NO: 618 - DNA, 21 bp, Populus trichocarpa
ttgacagaagatagagagcac

SEQ ID NO: 619 - DNA, 20 bp, Populus trichocarpa
tgacagaagagagggagcac

SEQ ID NO: 620 - DNA, 21 bp, Ricinus communis
tgacagaagagagtgagcaca

SEQ ID NO: 621 - DNA, 21 bp, Ricinus communis
tgacagaagagagtgagcaca

SEQ ID NO: 622 - DNA, 21 bp, Ricinus communis
tgacagaagagagtgagcaca

SEQ ID NO: 623 - DNA, 21 bp, Ricinus communis
tgacagaagagagtgagcaca

SEQ ID NO: 624 - DNA, 21 bp, Ricinus communis
tgacagaagagagagagcaca

SEQ ID NO: 625 - DNA, 21 bp, Ricinus communis
ttgacagaagatagagagcac

SEQ ID NO: 626 - DNA, 21 bp, Ricinus communis
ttgacagaagatagagagcac

SEQ ID NO: 627 - DNA, 21 bp, Ricinus communis
ttgacagaagatagagagcac

SEQ ID NO: 628 - DNA, 20 bp, Sorghum bicolor
tgacagaagagagtgagcac

SEQ ID NO: 629 - DNA, 20 bp, Sorghum bicolor
tgacagaagagagtgagcac

SEQ ID NO: 630 - DNA, 20 bp, Sorghum bicolor
tgacagaagagagtgagcac

SEQ ID NO: 631 - DNA, 21 bp, Sorghum bicolor
tgacagaagagagagagcaca

SEQ ID NO: 632 - DNA, 20 bp, Sorghum bicolor
tgacagaagagagcgagcac

SEQ ID NO: 633 - DNA, 20 bp, Sorghum bicolor
tgacagaagagagtgagcac

SEQ ID NO: 634 - DNA, 20 bp, Sorghum bicolor
tgacagaagagagtgagcac

SEQ ID NO: 635 - DNA, 20 bp, Sorghum bicolor
tgacagaagagagtgagcac

SEQ ID NO: 636 - DNA, 20 bp, Sorghum bicolor
tgacagaagagagtgagcac

SEQ ID NO: 637 - DNA, 21 bp, Solanum lycopersicum
ttgacagaagatagagagcac

SEQ ID NO: 638 - DNA, 21 bp, Solanum lycopersicum
ttgacagaagatagagagcac

SEQ ID NO: 639 - DNA, 21 bp, Solanum lycopersicum
ttgacagaagatagagagcac

SEQ ID NO: 640 - DNA, 20 bp, Selaginella moellendorffii
cgacagaagagagtgagcac

SEQ ID NO: 641 - DNA, 21 bp, Selaginella moellendorffii
ctgacagaagatagagagcac

SEQ ID NO: 642 - DNA, 21 bp, Selaginella moellendorffii
ttgacagaagaaagagagcac

SEQ ID NO: 643 - DNA, 21 bp, Selaginella moellendorffii
ttgacagaagacagggagcac

SEQ ID NO: 644 - DNA, 20 bp, Saccharum officinarum
tgacagaagagagtgagcac

SEQ ID NO: 645 - DNA, 21 bp, Saccharum spp
tgacagaagagagtgagcaca

SEQ ID NO: 646 - DNA, 21 bp, Triticum aestivum
tgacagaagagagtgagcaca

SEQ ID NO: 647 - DNA, 21 bp, Theobroma cacao
tgacagaagagagagagcaca

SEQ ID NO: 648 - DNA, 20 bp, Theobroma cacao
tgacagaagagagtgagcac

SEQ ID NO: 649 - DNA, 20 bp, Theobroma cacao
tgacagaagagagtgagcac

SEQ ID NO: 650 - DNA, 20 bp, Theobroma cacao
tgacagaagagagtgagcac

SEQ ID NO: 651 - DNA, 21 bp, Theobroma cacao
ttgacagaagatagagagcac

SEQ ID NO: 652 - DNA, 21 bp, Theobroma cacao
ttgacagaagatagagagcac

SEQ ID NO: 653 - DNA, 20 bp, Theobroma cacao
tgacagaagagagtgagcac

SEQ ID NO: 654 - DNA, 20 bp, Vitis vinifera
tgacagaagagagggagcac

SEQ ID NO: 655 - DNA, 20 bp, Vitis vinifera
tgacagaagagagtgagcac

SEQ ID NO: 656 - DNA, 20 bp, Vitis vinifera
tgacagaagagagtgagcac

SEQ ID NO: 657 - DNA, 20 bp, Vitis vinifera
tgacagaagagagtgagcac

SEQ ID NO: 658 - DNA, 20 bp, Vitis vinifera
tgacagaggagagtgagcac

SEQ ID NO: 659 - DNA, 21 bp, Vitis vinifera
ttgacagaagatagagagcac

SEQ ID NO: 660 - DNA, 21 bp, Vitis vinifera
ttgacagaagatagagagcac

SEQ ID NO: 661 - DNA, 20 bp, Vitis vinifera
tgacagaagagagagagcat

SEQ ID NO: 662 - DNA, 21 bp, Vitis vinifera
ttgacagaagatagagagcac

SEQ ID NO: 663 - DNA, 20 bp, Zea mays
tgacagaagagagtgagcac

SEQ ID NO: 664 - DNA, 20 bp, Zea mays
tgacagaagagagtgagcac

SEQ ID NO: 665 - DNA, 20 bp, Zea mays
tgacagaagagagtgagcac

SEQ ID NO: 666 - DNA, 20 bp, Zea mays
tgacagaagagagtgagcac

SEQ ID NO: 667 - DNA, 20 bp, Zea mays
tgacagaagagagtgagcac

SEQ ID NO: 668 - DNA, 20 bp, Zea mays
tgacagaagagagtgagcac

SEQ ID NO: 669 - DNA, 20 bp, Zea mays
tgacagaagagagtgagcac

SEQ ID NO: 670 - DNA, 20 bp, Zea mays
tgacagaagagagtgagcac

SEQ ID NO: 671 - DNA, 20 bp, Zea mays
tgacagaagagagtgagcac

SEQ ID NO: 672 - DNA, 21 bp, Zea mays
tgacagaagagagagagcaca

SEQ ID NO: 673 - DNA, 20 bp, Zea mays
tgacagaagagagcgagcac

SEQ ID NO: 674 - DNA, 20 bp, Zea mays
tgacagaagagagtgagcac

SEQ ID NO: 675 - DNA, 21 bp, Arachis hypogaea
ttgacagaagatagagagcac

SEQ ID NO: 676 - DNA, 21 bp, Arachis hypogaea
ttgacagaagagagagagcac

SEQ ID NO: 677 - DNA, 21 bp, Arabidopsis lyrata
ttgacagaagatagagagcac

SEQ ID NO: 678 - DNA, 21 bp, Arabidopsis lyrata
ttgacagaagatagagagcac

SEQ ID NO: 679 - DNA, 21 bp, Arabidopsis lyrata
ttgacagaagatagagagcac

SEQ ID NO: 680 - DNA, 20 bp, Arabidopsis lyrata
tgacagaagatagagagcac

SEQ ID NO: 681 - DNA, 21 bp, Arabidopsis thaliana
ttgacagaagatagagagcac

SEQ ID NO: 682 - DNA, 21 bp, Arabidopsis thaliana
ttgacagaagatagagagcac

SEQ ID NO: 683 - DNA, 21 bp, Arabidopsis thaliana
ttgacagaagatagagagcac

SEQ ID NO: 684 - DNA, 20 bp, Arabidopsis thaliana
tgacagaagatagagagcac

SEQ ID NO: 685 - DNA, 21 bp, Arabidopsis thaliana
ttgacagaagagagagagcac

SEQ ID NO: 686 - DNA, 21 bp, Brassica oleracea
ttgacagaagatagagagcac

SEQ ID NO: 687 - DNA, 21 bp, Brassica rapa
ttgacagaagatagagagcac

SEQ ID NO: 688 - DNA, 21 bp, Capsicum annuum
ttgacagaagagagagagcac

SEQ ID NO: 689 - DNA, 21 bp, Gossypium hirsutum
atgacagaagagagagagcac

SEQ ID NO: 690 - DNA, 21 bp, Glycine max
ttgacagaagagagagagcac

SEQ ID NO: 691 - DNA, 21 bp, Gossypium raimondii
ttgacagaagatagagagcac

SEQ ID NO: 692 - DNA, 21 bp, Gossypium raimondii
ttgacagaagatagagagcac

SEQ ID NO: 693 - DNA, 21 bp, Gossypium raimondii
ttgacagaagagagagagcac

SEQ ID NO: 694 - DNA, 21 bp, Gossypium raimondii
ttgacagaagagagagagcac

SEQ ID NO: 695 - DNA, 21 bp, Helianthus annuus
ttgacagaagatagagagcac

SEQ ID NO: 696 - DNA, 21 bp, Helianthus annuus
ttgacagaagagagagagcac

SEQ ID NO: 697 - DNA, 21 bp, Ipomoea batatas
ttgacagaagatagagagcat

SEQ ID NO: 698 - DNA, 21 bp, Ipomoea nil
ttgacagaagatagagagcat

SEQ ID NO: 699 - DNA, 21 bp, Ipomoea nil
ttgacagaagatagagagcat

SEQ ID NO: 700 - DNA, 21 bp, Lotus japonicus
ttgacagaagatagagagcac

SEQ ID NO: 701 - DNA, 21 bp, Lotus japonicus
ttgacagaagagagagagcac

SEQ ID NO: 702 - DNA, 21 bp, Lotus japonicus
ttgacagaagatagagagcat

SEQ ID NO: 703 - DNA, 21 bp, Lactuca sativa
ttgacagaagagagagagcac

SEQ ID NO: 704 - DNA, 21 bp, Medicago truncatula
ttgacagaagatagagggcac

SEQ ID NO: 705 - DNA, 21 bp, Nuphar advena
ttgacagaagacagagagcac

SEQ ID NO: 706 - DNA, 21 bp, Nuphar advena
ttgacagaagacagagagcac

SEQ ID NO: 707 - DNA, 21 bp, Nuphar advena
ttgacagaagacagagagcac

SEQ ID NO: 708 - DNA, 21 bp, Nicotiana benthamiana
ttgacagaagagagagagcac

SEQ ID NO: 709 - DNA, 21 bp, Nicotiana benthamiana
ttgacagaagagagagagcac

SEQ ID NO: 710 - DNA, 21 bp, Nicotiana tabacum
ttgacagaagatagagagcac

SEQ ID NO: 711 - DNA, 21 bp, Persea americana
ttgacagaagagagagagcac

SEQ ID NO: 712 - DNA, 21 bp, Prunus armeniaca
ttgacagaagagagagagcac

SEQ ID NO: 713 - DNA, 21 bp, Phaseolus coccineus
ttgacagaagatagagagcat

SEQ ID NO: 714 - DNA, 21 bp, Populus tremuloides
ttgacagaagagagagagcac

SEQ ID NO: 715 - DNA, 21 bp, Sorghum bicolor
ttgacagaagagagtgagcac

SEQ ID NO: 716 - DNA, 21 bp, Sesamum indicum
ttgacagaagagagagagcac

SEQ ID NO: 717 - DNA, 21 bp, Solanum lycopersicum
ttgacagaagatagagagcat

SEQ ID NO: 718 - DNA, 21 bp, Solanum lycopersicum
ttgacagaagatagagagcat

SEQ ID NO: 719 - DNA, 21 bp, Solanum lycopersicum
ttgacagaagatagagagcat

SEQ ID NO: 720 - DNA, 21 bp, Solanum tuberosum
ttgacagaagatagagagcac

SEQ ID NO: 721 - DNA, 21 bp, Solanum tuberosum
ttgacagaagagagagagcac

SEQ ID NO: 722 - DNA, 21 bp, Solanum tuberosum
ttgacagaagagagagagcac

SEQ ID NO: 723 - DNA, 21 bp, Zinnia elegans
ttgacagaagagagagagcac

SEQ ID NO: 724 - DNA, 21 bp, Zea mays
ttgacagaagagagagagcac

SEQ ID NO: 725 - DNA, 21 bp, Arachis hypogaea
ttgacagaagatagagagcac

SEQ ID NO: 726 - DNA, 21 bp, Arachis hypogaea
ttgacagaagagagagagcac

SEQ ID NO: 727 - DNA, 21 bp, Arabidopsis lyrata
ttgacagaagatagagagcac

SEQ ID NO: 728 - DNA, 21 bp, Arabidopsis lyrata
ttgacagaagatagagagcac

SEQ ID NO: 729 - DNA, 21 bp, Arabidopsis lyrata
ttgacagaagatagagagcac

SEQ ID NO: 730 - DNA, 20 bp, Arabidopsis lyrata
tgacagaagatagagagcac

SEQ ID NO: 731 - DNA, 21 bp, Arabidopsis thaliana
ttgacagaagatagagagcac

SEQ ID NO: 732 - DNA, 21 bp, Arabidopsis thaliana
ttgacagaagatagagagcac

SEQ ID NO: 733 - DNA, 21 bp, Arabidopsis thaliana
ttgacagaagatagagagcac

SEQ ID NO: 734 - DNA, 20 bp, Arabidopsis thaliana
tgacagaagatagagagcac

SEQ ID NO: 735 - DNA, 21 bp, Arabidopsis thaliana
ttgacagaagagagagagcac

SEQ ID NO: 736 - DNA, 21 bp, Brassica oleracea
ttgacagaagatagagagcac

SEQ ID NO: 737 - DNA, 21 bp, Brassica rapa
ttgacagaagatagagagcac

SEQ ID NO: 738 - DNA, 21 bp, Capsicum annuum
ttgacagaagagagagagcac

SEQ ID NO: 739 - DNA, 21 bp, Gossypium hirsutum
atgacagaagagagagagcac

SEQ ID NO: 740 - DNA, 21 bp, Glycine max
tgacagaagactagagagcac

SEQ ID NO: 741 - DNA, 21 bp, Glycine max
ttgacagaagagagagagcac

SEQ ID NO: 742 - DNA, 21 bp, Gossypium raimondii
ttgacagaagatagagagcac

SEQ ID NO: 743 - DNA, 21 bp, Gossypium raimondii
ttgacagaagatagagagcac

SEQ ID NO: 744 - DNA, 21 bp, Gossypium raimondii
ttgacagaagagagagagcac

SEQ ID NO: 745 - DNA, 21 bp, Gossypium raimondii
ttgacagaagagagagagcac

SEQ ID NO: 746 - DNA, 21 bp, Helianthus annuus
ttgacagaagatagagagcac

SEQ ID NO: 747 - DNA, 21 bp, Helianthus annuus
ttgacagaagagagagagcac

SEQ ID NO: 748 - DNA, 21 bp, Ipomoea nil
ttgacagaagatagagagcat

SEQ ID NO: 749 - DNA, 21 bp, Ipomoea nil
ttgacagaagatagagagcat

SEQ ID NO: 750 - DNA, 21 bp, Lotus japonicus
ttgacagaagatagagagcac

SEQ ID NO: 751 - DNA, 21 bp, Lotus japonicus
ttgacagaagagagagagcac

SEQ ID NO: 752 - DNA, 21 bp, Lotus japonicus
ttgacagaagatagagagcat

SEQ ID NO: 753 - DNA, 21 bp, Lactuca sativa
ttgacagaagagagagagcac

SEQ ID NO: 754 - DNA, 21 bp, Medicago truncatula
ttgacagaagatagagggcac

SEQ ID NO: 755 - DNA, 21 bp, Nuphar advena
ttgacagaagacagagagcac

SEQ ID NO: 756 - DNA, 21 bp, Nuphar advena
ttgacagaagacagagagcac

SEQ ID NO: 757 - DNA, 21 bp, Nuphar advena
ttgacagaagacagagagcac

SEQ ID NO: 758 - DNA, 21 bp, Nicotiana benthamiana
ttgacagaagagagagagcac

SEQ ID NO: 759 - DNA, 21 bp, Nicotiana benthamiana
ttgacagaagagagagagcac

SEQ ID NO: 760 - DNA, 21 bp, Nicotiana tabacum
ttgacagaagatagagagcac

SEQ ID NO: 761 - DNA, 21 bp, Persea americana
ttgacagaagagagagagcac

SEQ ID NO: 762 - DNA, 21 bp, Prunus armeniaca
ttgacagaagagagagagcac

SEQ ID NO: 763 - DNA, 21 bp, Phaseolus coccineus
ttgacagaagatagagagcat

SEQ ID NO: 764 - DNA, 21 bp, Populus tremuloides
ttgacagaagagagagagcac

SEQ ID NO: 765 - DNA, 21 bp, Sorghum bicolor
ttgacagaagagagtgagcac

SEQ ID NO: 766 - DNA, 21 bp, Sesamum indicum
ttgacagaagagagagagcac

SEQ ID NO: 767 - DNA, 21 bp, Solanum lycopersicum
ttgacagaagatagagagcat

SEQ ID NO: 768 - DNA, 21 bp, Solanum lycopersicum
ttgacagaagatagagagcat

SEQ ID NO: 769 - DNA, 21 bp, Solanum lycopersicum
ttgacagaagatagagagcat

SEQ ID NO: 770 - DNA, 21 bp, Solanum tuberosum
ttgacagaagatagagagcac

SEQ ID NO: 771 - DNA, 21 bp, Solanum tuberosum
ttgacagaagagagagagcac

SEQ ID NO: 772 - DNA, 21 bp, Solanum tuberosum
ttgacagaagagagagagcac

SEQ ID NO: 773 - DNA, 21 bp, Zinnia elegans
ttgacagaagagagagagcac

SEQ ID NO: 774 - DNA, 21 bp, Zea mays
ttgacagaagagagagagcac

SEQ ID NO: 775 - DNA, 22 bp, Glycine max
tatggggggattgggaaggaat

SEQ ID NO: 776 - DNA, 21 bp, Malus x domestica
ggaatgggctgtttgggaaca

SEQ ID NO: 777 - DNA, 22 bp, Phaseolus vulgaris
ggaatgggctgattgggaagca

SEQ ID NO: 778 - DNA, 21 bp, Arabidopsis cebennensis
ttggactgaagggagctccct

SEQ ID NO: 779 - DNA, 21 bp, Arabidopsis halleri
ttggactgaagggagctccct

SEQ ID NO: 780 - DNA, 21 bp, Arabis hirsuta
ttggactgaagggagctccct

SEQ ID NO: 781 - DNA, 21 bp, Arachis hypogaea
tttggattgaagggagctcta

SEQ ID NO: 782 - DNA, 21 bp, Arabidopsis lyrata
tttggattgaagggagctcta

SEQ ID NO: 783 - DNA, 21 bp, Arabidopsis lyrata
tttggattgaagggagctctt

SEQ ID NO: 784 - DNA, 21 bp, Arabidopsis lyrata
tttggattgaagggagctcct

SEQ ID NO: 785 - DNA, 21 bp, Alliaria petiolata
ttggactgaagggagctccct

SEQ ID NO: 786 - DNA, 21 bp, Aquilegia coerulea
tttggactgaagggagctcta

SEQ ID NO: 787 - DNA, 21 bp, Arabidopsis thaliana
tttggattgaagggagctcta

SEQ ID NO: 788 - DNA, 21 bp, Arabidopsis thaliana
tttggattgaagggagctctt

SEQ ID NO: 789 - DNA, 21 bp, Arabidopsis thaliana
tttggattgaagggagctcct

SEQ ID NO: 790 - DNA, 20 bp, Brachypodium distachyon
cttggattgaagggagctct

SEQ ID NO: 791 - DNA, 21 bp, Brassica napus
tttggattgaagggagctcta

SEQ ID NO: 792 - DNA, 21 bp, Brassica rapa
tttggattgaagggagctcta

SEQ ID NO: 793 - DNA, 21 bp, Barbarea vulgaris
ttggactgaagggagctccct

SEQ ID NO: 794 - DNA, 21 bp, Camelina microcarpa
ttggactgaagggagctccct

SEQ ID NO: 795 - DNA, 21 bp, Conringia orientalis
ttggactgaagggagctccct

SEQ ID NO: 796 - DNA, 21 bp, Capsella rubella
ttggactgaagggagctccct

SEQ ID NO: 797 - DNA, 21 bp, Citrus sinensis
tttggattgaagggagctcta

SEQ ID NO: 798 - DNA, 21 bp, Descurainia sophia
ttggactgaagggagctccct

SEQ ID NO: 799 - DNA, 21 bp, Erysimum cheiri
ttggactgaagggagctccct

SEQ ID NO: 800 - DNA, 21 bp, Fourraea alpina
ttggactgaagggagctccct

SEQ ID NO: 801 - DNA, 21 bp, Festuca arundinacea
tttggattgaagggagctctg

SEQ ID NO: 802 - DNA, 21 bp, Glycine max
tttggattgaagggagctcta

SEQ ID NO: 803 - DNA, 21 bp, Glycine max
attggagtgaagggagctcca

SEQ ID NO: 804 - DNA, 21 bp, Glycine max
attggagtgaagggagctccg

SEQ ID NO: 805 - DNA, 21 bp, Hordeum vulgare
tttggattgaagggagctctg

SEQ ID NO: 806 - DNA, 21 bp, Hordeum vulgare
tttggattgaagggagctctg

SEQ ID NO: 807 - DNA, 21 bp, Hordeum vulgare subsp. Vulgare
tttggattgaagggagctctg

SEQ ID NO: 808 - DNA, 21 bp, Hordeum vulgare subsp. Vulgare
tttggattgaagggagctctg

SEQ ID NO: 809 - DNA, 21 bp, Liriodendron tulipifera
tttggattgaagggagctcta

SEQ ID NO: 810 - DNA, 21 bp, Malcolmia maritima
ttggactgaagggagctccct

SEQ ID NO: 811 - DNA, 21 bp, Medicago truncatula
tttggattgaagggagctcta

SEQ ID NO: 812 - DNA, 21 bp, Medicago truncatula
attgaattgaagggagcaact

SEQ ID NO: 813 - DNA, 21 bp, Medicago truncatula
tttggattgaagggagctcta

SEQ ID NO: 814 - DNA, 21 bp, Nasturtium officinale
ttggactgaagggagctccct

SEQ ID NO: 815 - DNA, 21 bp, Oryza rufipogon
tttggattgaagggagctctg

SEQ ID NO: 816 - DNA, 21 bp, Oryza sativa
tttggattgaagggagctctg

SEQ ID NO: 817 - DNA, 21 bp, Oryza sativa
tttggattgaagggagctctg

SEQ ID NO: 818 - DNA, 21 bp, Oryza sativa
tttggattgaagggagctctg

SEQ ID NO: 819 - DNA, 21 bp, Oryza sativa
attggattgaagggagctcca

SEQ ID NO: 820 - DNA, 21 bp, Oryza sativa
attggattgaagggagctccg

SEQ ID NO: 821 - DNA, 21 bp, Oryza sativa
cttggattgaagggagctcta

SEQ ID NO: 822 - DNA, 21 bp, Oryza sativa
tttggattgaagggagctctg

SEQ ID NO: 823 - DNA, 21 bp, Pennisetum glaucum
tttggattgaagggagctctg

SEQ ID NO: 824 - DNA, 21 bp, Picea sitchensis
cttggattgaagggagctcca

SEQ ID NO: 825 - DNA, 20 bp, Pinus taeda
ttggattgaagggagctcca

SEQ ID NO: 826 - DNA, 20 bp, Pinus taeda
ttggattgaagagagctccc

SEQ ID NO: 827 - DNA, 21 bp, Pinus taeda
cttggattgaagggagctccc

SEQ ID NO: 828 - DNA, 21 bp, Populus trichocarpa
tttggattgaagggagctcta

SEQ ID NO: 829 - DNA, 21 bp, Populus trichocarpa
tttggattgaagggagctcta

SEQ ID NO: 830 - DNA, 21 bp, Populus trichocarpa
tttggattgaagggagctcta

SEQ ID NO: 831 - DNA, 21 bp, Populus trichocarpa
cttggattgaagggagctcct

SEQ ID NO: 832 - DNA, 21 bp, Populus trichocarpa
cttggggtgaagggagctcct

SEQ ID NO: 833 - DNA, 21 bp, Populus trichocarpa
attggagtgaagggagctcga

SEQ ID NO: 834 - DNA, 21 bp, Phaseolus vulgaris
tttggattgaagggagctcta

SEQ ID NO: 835 - DNA, 21 bp, Phaseolus vulgaris
cttccatatctggggagcttc

SEQ ID NO: 836 - DNA, 21 bp, Phaseolus vulgaris
tttggattgaagggagctcta

SEQ ID NO: 837 - DNA, 21 bp, Phaseolus vulgaris
cttccatatctggggagcttc

SEQ ID NO: 838 - DNA, 21 bp, Ricinus communis
tttggattgaagggagctcta

SEQ ID NO: 839 - DNA, 21 bp, Rorippa indica
ttggactgaagggagctccct

SEQ ID NO: 840 - DNA, 21 bp, Schedonorus arundinaceus
tttggattgaagggagctctg

SEQ ID NO: 841 - DNA, 21 bp, Sorghum bicolor
tttggattgaagggagctctg

SEQ ID NO: 842 - DNA, 21 bp, Sorghum bicolor
cttggattgaagggagctcct

SEQ ID NO: 843 - DNA, 21 bp, Solanum lycopersicum
tttggattgaagggagctcta

SEQ ID NO: 844 - DNA, 21 bp, Selaginella moellendorffii
cttggattgaagggagctccc

SEQ ID NO: 845 - DNA, 21 bp, Saccharum officinarum
tttggattgaagggagctctg

SEQ ID NO: 846 - DNA, 21 bp, Saccharum officinarum
tttggattgaagggagctctg

SEQ ID NO: 847 - DNA, 21 bp, Saccharum officinarum
cttggattgaagggagctcct

SEQ ID NO: 848 - DNA, 21 bp, Saccharum officinarum
tttggattgaagggagctctg

SEQ ID NO: 849 - DNA, 21 bp, Saccharum officinarum
tttggattgaaaggagctctt

SEQ ID NO: 850 - DNA, 21 bp, Sorghum Propinquum
tttggattgaagggagctctg

SEQ ID NO: 851 - DNA, 21 bp, Saccharum spp
tttggattgaagggagctctg

SEQ ID NO: 852 - DNA, 21 bp, Sibara virginica
ttggactgaagggagctccct

SEQ ID NO: 853 - DNA, 21 bp, Triticum aestivum
tttggattgaagggagctctg

SEQ ID NO: 854 - DNA, 21 bp, Triticum aestivum
tttggattgaagggagctctg

SEQ ID NO: 855 - DNA, 21 bp, Thlaspi arvense
ttggactgaagggagctccct

SEQ ID NO: 856 - DNA, 21 bp, Vitis vinifera
cttggagtgaagggagctctc

SEQ ID NO: 857 - DNA, 21 bp, Vitis vinifera
cttggagtgaagggagctctc

SEQ ID NO: 858 - DNA, 21 bp, Vitis vinifera
tttggattgaagggagctcta

SEQ ID NO: 859 - DNA, 21 bp, Zea mays
tttggattgaagggagctctg

SEQ ID NO: 860 - DNA, 21 bp, Zea mays
tttggattgaagggagctctg

SEQ ID NO: 861 - DNA, 21 bp, Zea mays
cttggattgaagggagctcct

SEQ ID NO: 862 - DNA, 21 bp, Zea mays
cttggattgaagggagctcct

SEQ ID NO: 863 - DNA, 21 bp, Zea mays
attggtttgaagggagctcca

SEQ ID NO: 864 - DNA, 21 bp, Zea mays
tttggattgaagggagctctg

SEQ ID NO: 865 - DNA, 21 bp, Zea mays
tttggagtgaagggagttctg

SEQ ID NO: 866 - DNA, 21 bp, Zea mays
tttggagtgaagggagctctg

SEQ ID NO: 867 - DNA, 21 bp, Zea mays
tttggagtgaagggagctctg

SEQ ID NO: 868 - DNA, 21 bp, Zea mays
tttggattgaagggagctctg

SEQ ID NO: 869 - DNA, 21 bp, Zea mays
tttggattgaagggagctctg

SEQ ID NO: 870 - DNA, 21 bp, Zea mays
tttggattgaagggagctctg

SEQ ID NO: 871 - DNA, 21 bp, Arabidopsis cebennensis
ttggactgaagggagctccct

SEQ ID NO: 872 - DNA, 21 bp, Arabidopsis halleri
ttggactgaagggagctccct

SEQ ID NO: 873 - DNA, 21 bp, Arabis hirsuta
ttggactgaagggagctccct

SEQ ID NO: 874 - DNA, 21 bp, Arachis hypogaea
tttggattgaagggagctcta

SEQ ID NO: 875 - DNA, 21 bp, Arabidopsis lyrata
tttggattgaagggagctcta

SEQ ID NO: 876 - DNA, 21 bp, Arabidopsis lyrata
tttggattgaagggagctctt

SEQ ID NO: 877 - DNA, 21 bp, Arabidopsis lyrata
tttggattgaagggagctcct

SEQ ID NO: 878 - DNA, 21 bp, Alliaria petiolata
ttggactgaagggagctccct

SEQ ID NO: 879 - DNA, 21 bp, Aquilegia coerulea
tttggactgaagggagctcta

SEQ ID NO: 880 - DNA, 21 bp, Arabidopsis thaliana
tttggattgaagggagctcta

SEQ ID NO: 881 - DNA, 21 bp, Arabidopsis thaliana
tttggattgaagggagctctt

SEQ ID NO: 882 - DNA, 21 bp, Arabidopsis thaliana
tttggattgaagggagctcct

SEQ ID NO: 883 - DNA, 20 bp, Brachypodium distachyon
cttggattgaagggagctct

SEQ ID NO: 884 - DNA, 21 bp, Brassica napus
tttggattgaagggagctcta

SEQ ID NO: 885 - DNA, 21 bp, Brassica rapa
tttggattgaagggagctcta

SEQ ID NO: 886 - DNA, 21 bp, Barbarea vulgaris
ttggactgaagggagctccct

SEQ ID NO: 887 - DNA, 21 bp, Camelina microcarpa
ttggactgaagggagctccct

SEQ ID NO: 888 - DNA, 21 bp, Conringia orientalis
ttggactgaagggagctccct

SEQ ID NO: 889 - DNA, 21 bp, Capsella rubella
ttggactgaagggagctccct

SEQ ID NO: 890 - DNA, 21 bp, Citrus sinensis
tttggattgaagggagctcta

SEQ ID NO: 891 - DNA, 21 bp, Descurainia sophia
ttggactgaagggagctccct

SEQ ID NO: 892 - DNA, 21 bp, Erysimum cheiri
ttggactgaagggagctccct

SEQ ID NO: 893 - DNA, 21 bp, Fourraea alpina
ttggactgaagggagctccct

SEQ ID NO: 894 - DNA, 21 bp, Festuca arundinacea
tttggattgaagggagctctg

SEQ ID NO: 895 - DNA, 21 bp, Glycine max
tttggattgaagggagctcta

SEQ ID NO: 896 - DNA, 21 bp, Glycine max
attggagtgaagggagctcca

SEQ ID NO: 897 - DNA, 21 bp, Glycine max
attggagtgaagggagctccg

SEQ ID NO: 898 - DNA, 21 bp, Hordeum vulgare
tttggattgaagggagctctg

SEQ ID NO: 899 - DNA, 21 bp, Hordeum vulgare
tttggattgaagggagctctg

SEQ ID NO: 900 - DNA, 21 bp, Hordeum vulgare subsp. Vulgare
tttggattgaagggagctctg

SEQ ID NO: 901 - DNA, 21 bp, Hordeum vulgare subsp. Vulgare
tttggattgaagggagctctg

SEQ ID NO: 902 - DNA, 21 bp, Liriodendron tulipifera
tttggattgaagggagctcta

SEQ ID NO: 903 - DNA, 21 bp, Malcolmia maritima
ttggactgaagggagctccct

SEQ ID NO: 904 - DNA, 21 bp, Medicago truncatula
tttggattgaagggagctcta

SEQ ID NO: 905 - DNA, 21 bp, Medicago truncatula
attgaattgaagggagcaact

SEQ ID NO: 906 - DNA, 21 bp, Medicago truncatula
tttggattgaagggagctcta

SEQ ID NO: 907 - DNA, 21 bp, Nasturtium officinale
ttggactgaagggagctccct

SEQ ID NO: 908 - DNA, 21 bp, Oryza rufipogon
tttggattgaagggagctctg

SEQ ID NO: 909 - DNA, 21 bp, Oryza sativa
tttggattgaagggagctctg

SEQ ID NO: 910 - DNA, 21 bp, Oryza sativa
tttggattgaagggagctctg

SEQ ID NO: 911 - DNA, 21 bp, Oryza sativa
tttggattgaagggagctctg

SEQ ID NO: 912 - DNA, 21 bp, Oryza sativa
attggattgaagggagctcca

SEQ ID NO: 913 - DNA, 21 bp, Oryza sativa
attggattgaagggagctccg

SEQ ID NO: 914 - DNA, 21 bp, Oryza sativa
attggattgaagggagctcct

SEQ ID NO: 915 - DNA, 21 bp, Oryza sativa
tttggattgaagggagctctg

SEQ ID NO: 916 - DNA, 21 bp, Pennisetum glaucum
tttggattgaagggagctctg

SEQ ID NO: 917 - DNA, 21 bp, Picea sitchensis
cttggattgaagggagctcca

SEQ ID NO: 918 - DNA, 20 bp, Pinus taeda
ttggattgaagggagctcca

SEQ ID NO: 919 - DNA, 20 bp, Pinus taeda
ttggattgaagagagctccc

SEQ ID NO: 920 - DNA, 21 bp, Pinus taeda
cttggattgaagggagctccc

SEQ ID NO: 921 - DNA, 21 bp, Populus trichocarpa
tttggattgaagggagctcta

SEQ ID NO: 922 - DNA, 21 bp, Populus trichocarpa
tttggattgaagggagctcta

SEQ ID NO: 923 - DNA, 21 bp, Populus trichocarpa
tttggattgaagggagctcta

SEQ ID NO: 924 - DNA, 21 bp, Populus trichocarpa
cttggattgaagggagctcct

SEQ ID NO: 925 - DNA, 21 bp, Populus trichocarpa
cttggggtgaagggagctcct

SEQ ID NO: 926 - DNA, 21 bp, Populus trichocarpa
attggagtgaagggagctcga

SEQ ID NO: 927 - DNA, 21 bp, Phaseolus vulgaris
tttggattgaagggagctcta

SEQ ID NO: 928 - DNA, 21 bp, Phaseolus vulgaris
cttccatatctggggagcttc

SEQ ID NO: 929 - DNA, 21 bp, Phaseolus vulgaris
tttggattgaagggagctcta

SEQ ID NO: 930 - DNA, 21 bp, Phaseolus vulgaris
cttccatatctggggagcttc

SEQ ID NO: 931 - DNA, 21 bp, Ricinus communis
tttggattgaagggagctcta

SEQ ID NO: 932 - DNA, 21 bp, Rorippa indica
ttggactgaagggagctccct

SEQ ID NO: 933 - DNA, 21 bp, Schedonorus arundinaceus
tttggattgaagggagctctg

SEQ ID NO: 934 - DNA, 21 bp, Sorghum bicolor
tttggattgaagggagctctg

SEQ ID NO: 935 - DNA, 21 bp, Sorghum bicolor
cttggattgaagggagctcct

SEQ ID NO: 936 - DNA, 21 bp, Solanum lycopersicum
tttggattgaagggagctcta

SEQ ID NO: 937 - DNA, 21 bp, Selaginella moellendorffii
cttggattgaagggagctccc

SEQ ID NO: 938 - DNA, 21 bp, Saccharum officinarum
tttggattgaagggagctctg

SEQ ID NO: 939 - DNA, 21 bp, Saccharum officinarum
tttggattgaagggagctctg

SEQ ID NO: 940 - DNA, 21 bp, Saccharum officinarum
cttggattgaagggagctcct

SEQ ID NO: 941 - DNA, 21 bp, Saccharum officinarum
tttggattgaagggagctctg

SEQ ID NO: 942 - DNA, 21 bp, Saccharum officinarum
tttggattgaaaggagctctt

SEQ ID NO: 943 - DNA, 21 bp, Sorghum Propinquum
tttggattgaagggagctctg

SEQ ID NO: 944 - DNA, 21 bp, Saccharum spp
tttggattgaagggagctctg

SEQ ID NO: 945 - DNA, 21 bp, Sibara virginica
ttggactgaagggagctccct

SEQ ID NO: 946 - DNA, 21 bp, Triticum aestivum
tttggattgaagggagctctg

SEQ ID NO: 947 - DNA, 21 bp, Triticum aestivum
tttggattgaagggagctctg

SEQ ID NO: 948 - DNA, 21 bp, Thlaspi arvense
ttggactgaagggagctccct

SEQ ID NO: 949 - DNA, 21 bp, Vitis vinifera
cttggagtgaagggagctctc

SEQ ID NO: 950 - DNA, 21 bp, Vitis vinifera
cttggagtgaagggagctctc

SEQ ID NO: 951 - DNA, 21 bp, Vitis vinifera
tttggattgaagggagctcta

SEQ ID NO: 952 - DNA, 21 bp, Zea mays
tttggattgaagggagctctg

SEQ ID NO: 953 - DNA, 21 bp, Zea mays
tttggattgaagggagctctg

SEQ ID NO: 954 - DNA, 21 bp, Zea mays
cttggattgaagggagctcct

SEQ ID NO: 955 - DNA, 21 bp, Zea mays
cttggattgaagggagctcct

SEQ ID NO: 956 - DNA, 21 bp, Zea mays
attggtttgaagggagctcca

SEQ ID NO: 957 - DNA, 21 bp, Zea mays
tttggattgaagggagctctg

SEQ ID NO: 958 - DNA, 21 bp, Zea mays
tttggagtgaagggagttctg

SEQ ID NO: 959 - DNA, 21 bp, Zea mays
tttggagtgaagggagctctg

SEQ ID NO: 960 - DNA, 21 bp, Zea mays
tttggagtgaagggagctctg

SEQ ID NO: 961 - DNA, 21 bp, Zea mays
tttggattgaagggagctctg

SEQ ID NO: 962 - DNA, 21 bp, Zea mays
tttggattgaagggagctctg

SEQ ID NO: 963 - DNA, 21 bp, Zea mays
tttggattgaagggagctctg

SEQ ID NO: 964 - DNA, 21 bp, Oryza sativa
gagaggaggacggagtggggc

SEQ ID NO: 965 - DNA, 21 bp, Arabidopsis cebennensis
ttggactgaagggagctccct

SEQ ID NO: 966 - DNA, 21 bp, Arabidopsis halleri
ttggactgaagggagctccct

SEQ ID NO: 967 - DNA, 21 bp, Arabis hirsuta
ttggactgaagggagctccct

SEQ ID NO: 968 - DNA, 21 bp, Arachis hypogaea
tttggattgaagggagctcta

SEQ ID NO: 969 - DNA, 21 bp, Arabidopsis lyrata
tttggattgaagggagctcta

SEQ ID NO: 970 - DNA, 21 bp, Arabidopsis lyrata
tttggattgaagggagctctt

SEQ ID NO: 971 - DNA, 21 bp, Arabidopsis lyrata
tttggattgaagggagctcct

SEQ ID NO: 972 - DNA, 21 bp, Alliaria petiolata
ttggactgaagggagctccct

SEQ ID NO: 973 - DNA, 21 bp, Aquilegia coerulea
tttggactgaagggagctcta

SEQ ID NO: 974 - DNA, 21 bp, Arabidopsis thaliana
tttggattgaagggagctcta

SEQ ID NO: 975 - DNA, 21 bp, Arabidopsis thaliana
tttggattgaagggagctctt

SEQ ID NO: 976 - DNA, 21 bp, Arabidopsis thaliana
tttggattgaagggagctcct

SEQ ID NO: 977 - DNA, 20 bp, Brachypodium distachyon
cttggattgaagggagctct

SEQ ID NO: 978 - DNA, 21 bp, Brassica napus
tttggattgaagggagctcta

SEQ ID NO: 979 - DNA, 21 bp, Brassica rapa
tttggattgaagggagctcta

SEQ ID NO: 980 - DNA, 21 bp, Barbarea vulgaris
ttggactgaagggagctccct

SEQ ID NO: 981 - DNA, 21 bp, Camelina microcarpa
ttggactgaagggagctccct

SEQ ID NO: 982 - DNA, 21 bp, Conringia orientalis
ttggactgaagggagctccct

SEQ ID NO: 983 - DNA, 21 bp, Capsella rubella
ttggactgaagggagctccct

SEQ ID NO: 984 - DNA, 21 bp, Citrus sinensis
tttggattgaagggagctcta

SEQ ID NO: 985 - DNA, 21 bp, Descurainia sophia
ttggactgaagggagctccct

SEQ ID NO: 986 - DNA, 21 bp, Erysimum cheiri
ttggactgaagggagctccct

SEQ ID NO: 987 - DNA, 21 bp, Fourraea alpina
ttggactgaagggagctccct

SEQ ID NO: 988 - DNA, 21 bp, Festuca arundinacea
tttggattgaagggagctctg

SEQ ID NO: 989 - DNA, 21 bp, Glycine max
tttggattgaagggagctcta

SEQ ID NO: 990 - DNA, 21 bp, Glycine max
attggagtgaagggagctcca

SEQ ID NO: 991 - DNA, 21 bp, Glycine max
attggagtgaagggagctccg

SEQ ID NO: 992 - DNA, 21 bp, Hordeum vulgare
tttggattgaagggagctctg

SEQ ID NO: 993 - DNA, 21 bp, Hordeum vulgare
tttggattgaagggagctctg

SEQ ID NO: 994 - DNA, 21 bp, Hordeum vulgare subsp. Vulgare
tttggattgaagggagctctg

SEQ ID NO: 995 - DNA, 21 bp, Hordeum vulgare subsp. Vulgare
tttggattgaagggagctctg

SEQ ID NO: 996 - DNA, 21 bp, Liriodendron tulipifera
tttggattgaagggagctcta

SEQ ID NO: 997 - DNA, 21 bp, Malcolmia maritima
ttggactgaagggagctccct

SEQ ID NO: 998 - DNA, 21 bp, Medicago truncatula
tttggattgaagggagctcta

SEQ ID NO: 999 - DNA, 21 bp, Medicago truncatula
attgaattgaagggagcaact

SEQ ID NO: 1000 - DNA, 21 bp, Medicago truncatula
tttggattgaagggagctcta

SEQ ID NO: 1001 - DNA, 21 bp, Nasturtium officinale
ttggactgaagggagctccct

SEQ ID NO: 1002 - DNA, 21 bp, Oryza rufipogon
tttggattgaagggagctctg

SEQ ID NO: 1003 - DNA, 21 bp, Oryza sativa
tttggattgaagggagctctg

SEQ ID NO: 1004 - DNA, 21 bp, Oryza sativa
tttggattgaagggagctctg

SEQ ID NO: 1005 - DNA, 21 bp, Oryza sativa
ttgcatgccccaggagctgca

SEQ ID NO: 1006 - DNA, 21 bp, Oryza sativa
tttggattgaagggagctctg

SEQ ID NO: 1007 - DNA, 21 bp, Oryza sativa
attggattgaagggagctcca

SEQ ID NO: 1008 - DNA, 21 bp, Oryza sativa
attggattgaagggagctccg

SEQ ID NO: 1009 - DNA, 21 bp, Oryza sativa
attggattgaagggagctcct

SEQ ID NO: 1010 - DNA, 21 bp, Oryza sativa
cttggattgaagggagctcta

SEQ ID NO: 1011 - DNA, 21 bp, Oryza sativa
tttggattgaagggagctctg

SEQ ID NO: 1012 - DNA, 21 bp, Pennisetum glaucum
tttggattgaagggagctctg

SEQ ID NO: 1013 - DNA, 20 bp, Pinus taeda
ttggattgaagggagctcca

SEQ ID NO: 1014 - DNA, 20 bp, Pinus taeda
ttggattgaagagagctccc

SEQ ID NO: 1015 - DNA, 21 bp, Pinus taeda
cttggattgaagggagctccc

SEQ ID NO: 1016 - DNA, 21 bp, Populus trichocarpa
tttggattgaagggagctcta

SEQ ID NO: 1017 - DNA, 21 bp, Populus trichocarpa
tttggattgaagggagctcta

SEQ ID NO: 1018 - DNA, 21 bp, Populus trichocarpa
tttggattgaagggagctcta

SEQ ID NO: 1019 - DNA, 21 bp, Populus trichocarpa
cttggattgaagggagctcct

SEQ ID NO: 1020 - DNA, 21 bp, Populus trichocarpa
cttggggtgaagggagctcct

SEQ ID NO: 1021 - DNA, 21 bp, Populus trichocarpa
attggagtgaagggagctcga

SEQ ID NO: 1022 - DNA, 21 bp, Phaseolus vulgaris
tttggattgaagggagctcta

SEQ ID NO: 1023 - DNA, 21 bp, Phaseolus vulgaris
cttccatatctggggagcttc

SEQ ID NO: 1024 - DNA, 21 bp, Phaseolus vulgaris
tttggattgaagggagctcta

SEQ ID NO: 1025 - DNA, 21 bp, Phaseolus vulgaris
cttccatatctggggagcttc

SEQ ID NO: 1026 - DNA, 21 bp, Ricinus communis
tttggattgaagggagctcta

SEQ ID NO: 1027 - DNA, 21 bp, Rorippa indica
ttggactgaagggagctccct

SEQ ID NO: 1028 - DNA, 21 bp, Schedonorus arundinaceus
tttggattgaagggagctctg

SEQ ID NO: 1029 - DNA, 21 bp, Sorghum bicolor
tttggattgaagggagctctg

SEQ ID NO: 1030 - DNA, 21 bp, Sorghum bicolor
cttggattgaagggagctcct

SEQ ID NO: 1031 - DNA, 21 bp, Solanum lycopersicum
tttggattgaagggagctcta

SEQ ID NO: 1032 - DNA, 21 bp, Selaginella moellendorffii
cttggattgaagggagctccc

SEQ ID NO: 1033 - DNA, 21 bp, Saccharum officinarum
tttggattgaagggagctctg

SEQ ID NO: 1034 - DNA, 21 bp, Saccharum officinarum
tttggattgaagggagctctg

SEQ ID NO: 1035 - DNA, 21 bp, Saccharum officinarum
cttggattgaagggagctcct

SEQ ID NO: 1036 - DNA, 21 bp, Saccharum officinarum
tttggattgaagggagctctg

SEQ ID NO: 1037 - DNA, 21 bp, Saccharum officinarum
tttggattgaaaggagctctt

SEQ ID NO: 1038 - DNA, 21 bp, Sorghum Propinquum
tttggattgaagggagctctg

SEQ ID NO: 1039 - DNA, 21 bp, Saccharum spp
tttggattgaagggagctctg

SEQ ID NO: 1040 - DNA, 21 bp, Sibara virginica
ttggactgaagggagctccct

SEQ ID NO: 1041 - DNA, 21 bp, Triticum aestivum
tttggattgaagggagctctg

SEQ ID NO: 1042 - DNA, 21 bp, Triticum aestivum
tttggattgaagggagctctg

SEQ ID NO: 1043 - DNA, 21 bp, Thlaspi arvense
ttggactgaagggagctccct

SEQ ID NO: 1044 - DNA, 21 bp, Vitis vinifera
cttggagtgaagggagctctc

SEQ ID NO: 1045 - DNA, 21 bp, Vitis vinifera
cttggagtgaagggagctctc

SEQ ID NO: 1046 - DNA, 21 bp, Vitis vinifera
tttggattgaagggagctcta

SEQ ID NO: 1047 - DNA, 21 bp, Zea mays
tttggattgaagggagctctg

SEQ ID NO: 1048 - DNA, 21 bp, Zea mays
tttggattgaagggagctctg

SEQ ID NO: 1049 - DNA, 21 bp, Zea mays
cttggattgaagggagctcct

SEQ ID NO: 1050 - DNA, 21 bp, Zea mays
cttggattgaagggagctcct

SEQ ID NO: 1051 - DNA, 21 bp, Zea mays
attggtttgaagggagctcca

SEQ ID NO: 1052 - DNA, 21 bp, Zea mays
tttggattgaagggagctctg

SEQ ID NO: 1053 - DNA, 21 bp, Zea mays
tttggagtgaagggagttctg

SEQ ID NO: 1054 - DNA, 21 bp, Zea mays
tttggagtgaagggagctctg

SEQ ID NO: 1055 - DNA, 21 bp, Zea mays
tttggagtgaagggagctctg

SEQ ID NO: 1056 - DNA, 21 bp, Zea mays
tttggattgaagggagctctg

SEQ ID NO: 1057 - DNA, 21 bp, Zea mays
tttggattgaagggagctctg

SEQ ID NO: 1058 - DNA, 21 bp, Zea mays
tttggattgaagggagctctg

SEQ ID NO: 1059 - DNA, 20 bp, Arachis hypogaea
tgacagaagagagagagcac

SEQ ID NO: 1060 - DNA, 21 bp, Arachis hypogaea
ttgacagaagatagagagcac

SEQ ID NO: 1061 - DNA, 21 bp, Arachis hypogaea
ttgacagaagagagagagcac

SEQ ID NO: 1062 - DNA, 20 bp, Arabidopsis lyrata
tgacagaagagagtgagcac

SEQ ID NO: 1063 - DNA, 20 bp, Arabidopsis lyrata
tgacagaagagagtgagcac

SEQ ID NO: 1064 - DNA, 20 bp, Arabidopsis lyrata
tgacagaagagagtgagcac

SEQ ID NO: 1065 - DNA, 20 bp, Arabidopsis lyrata
tgacagaagagagtgagcac

SEQ ID NO: 1066 - DNA, 20 bp, Arabidopsis lyrata
tgacagaagagagtgagcac

SEQ ID NO: 1067 - DNA, 20 bp, Arabidopsis lyrata
tgacagaagagagtgagcac

SEQ ID NO: 1068 - DNA, 20 bp, Arabidopsis lyrata
cgacagaagagagtgagcac

SEQ ID NO: 1069 - DNA, 20 bp, Arabidopsis lyrata
tgacagaagaaagagagcac

SEQ ID NO: 1070 - DNA, 20 bp, Aquilegia coerulea
tgacagaagatagagagcac

SEQ ID NO: 1071 - DNA, 20 bp, Aquilegia coerulea
tgacagaagatagagagcac

SEQ ID NO: 1072 - DNA, 20 bp, Arabidopsis thaliana
tgacagaagagagtgagcac

SEQ ID NO: 1073 - DNA, 20 bp, Arabidopsis thaliana
tgacagaagagagtgagcac

SEQ ID NO: 1074 - DNA, 20 bp, Arabidopsis thaliana
tgacagaagagagtgagcac

SEQ ID NO: 1075 - DNA, 20 bp, Arabidopsis thaliana
tgacagaagagagtgagcac

SEQ ID NO: 1076 - DNA, 20 bp, Arabidopsis thaliana
tgacagaagagagtgagcac

SEQ ID NO: 1077 - DNA, 20 bp, Arabidopsis thaliana
tgacagaagagagtgagcac

SEQ ID NO: 1078 - DNA, 20 bp, Arabidopsis thaliana
cgacagaagagagtgagcac

SEQ ID NO: 1079 - DNA, 20 bp, Arabidopsis thaliana
tgacagaagaaagagagcac

SEQ ID NO: 1080 - DNA, 20 bp, Arabidopsis thaliana
tgacagaagagagagagcac

SEQ ID NO: 1081 - DNA, 20 bp, Arabidopsis thaliana
tgacagaagagagagagcac

SEQ ID NO: 1082 - DNA, 20 bp, Arabidopsis thaliana
tgacagaagagagagagcac

SEQ ID NO: 1083 - DNA, 20 bp, Arabidopsis thaliana
tgacagaagagagagagcac

SEQ ID NO: 1084 - DNA, 20 bp, Arabidopsis thaliana
tgacagaagagagagagcac

SEQ ID NO: 1085 - DNA, 20 bp, Arabidopsis thaliana
tgacagaagagagagagcac

SEQ ID NO: 1086 - DNA, 21 bp, Brachypodium distachyon
tgacagaagagagagagcaca

SEQ ID NO: 1087 - DNA, 20 bp, Brachypodium distachyon
tgacagaagagagtgagcac

SEQ ID NO: 1088 - DNA, 20 bp, Brachypodium distachyon
tgacagaagagagtgagcac

SEQ ID NO: 1089 - DNA, 20 bp, Brachypodium distachyon
tgacagaagagagtgagcac

SEQ ID NO: 1090 - DNA, 21 bp, Brassica napus
tgacagaagagagtgagcaca

SEQ ID NO: 1091 - DNA, 21 bp, Brassica napus
ttgacagaagatagagagcac

SEQ ID NO: 1092 - DNA, 21 bp, Brassica napus
ttgacagaagatagagagcac

SEQ ID NO: 1093 - DNA, 20 bp, Capsicum annuum
tgacagaagagagagagcac

SEQ ID NO: 1094 - DNA, 20 bp, Capsicum annuum
tgacagaagagagggagcac

SEQ ID NO: 1095 - DNA, 20 bp, Citrus x paradisi x Poncirus trifoliata
tgacagaagagagtgagcac

SEQ ID NO: 1096 - DNA, 20 bp, Citrus x paradisi x Poncirus trifoliata
tgacagaagagagagagcac

SEQ ID NO: 1097 - DNA, 20 bp, Cycas rumphii
tgacagaagagagagagcac

SEQ ID NO: 1098 - DNA, 20 bp, Citrus sinensis
tgacagaagagagtgagcac

SEQ ID NO: 1099 - DNA, 20 bp, Citrus sinensis
tgacagaagagagagagcac

SEQ ID NO: 1100 - DNA, 20 bp, Citrus sinensis
tgacagaagagagagagcac

SEQ ID NO: 1101 - DNA, 20 bp, Citrus trifoliata
tgacagaagagagtgagcac

SEQ ID NO: 1102 - DNA, 20 bp, Eschscholzia californica
tgacagaagagagagagcac

SEQ ID NO: 1103 - DNA, 21 bp, Festuca arundinacea
tgacagaagagagagagcaca

SEQ ID NO: 1104 - DNA, 21 bp, Festuca arundinacea
ttgacagaagagagagagcac

SEQ ID NO: 1105 - DNA, 20 bp, Gossypium hirsutum
tgacagaagagagtgagcac

SEQ ID NO: 1106 - DNA, 20 bp, Gossypium hirsutum
tgacagaagagagtgagcac

SEQ ID NO: 1107 - DNA, 20 bp, Gossypium hirsutum
tgtcagaagagagtgagcac

SEQ ID NO: 1108 - DNA, 20 bp, Gossypium hirsutum
tgacagaagagagtgagcac

SEQ ID NO: 1109 - DNA, 20 bp, Glycine max
tgacagaagagagtgagcac

SEQ ID NO: 1110 - DNA, 21 bp, Glycine max
tgacagaagagagagagcaca

SEQ ID NO: 1111 - DNA, 21 bp, Glycine max
ttgacagaagatagagagcac

SEQ ID NO: 1112 - DNA, 21 bp, Glycine max
ttgacagaagatagagagcac

SEQ ID NO: 1113 - DNA, 21 bp, Glycine max
ttgacagaagatagagagcac

SEQ ID NO: 1114 - DNA, 22 bp, Glycine max
ttgacagaagagagagagcaca

SEQ ID NO: 1115 - DNA, 20 bp, Glycine max
acagaagatagagagcacag

SEQ ID NO: 1116 - DNA, 20 bp, Glycine max
tgacagaagagagagagcac

SEQ ID NO: 1117 - DNA, 20 bp, Glycine max
tgacagaagagagagagcac

SEQ ID NO: 1118 - DNA, 20 bp, Helianthus annuus
tgacagaagagagagagcac

SEQ ID NO: 1119 - DNA, 20 bp, Hordeum vulgare subsp. Spontaneum
tgacagaagagagagagcac

SEQ ID NO: 1120 - DNA, 21 bp, Hordeum vulgare
tgacagaagagagtgagcaca

SEQ ID NO: 1121 - DNA, 20 bp, Hordeum vulgare subsp. Vulgare
tgacagaagagagtgagcac

SEQ ID NO: 1122 - DNA, 20 bp, Hordeum vulgare subsp. Vulgare
tgacagaagagagagagcac

SEQ ID NO: 1123 - DNA, 20 bp, Hordeum vulgare subsp. Vulgare
tgacagaagagagagagcac

SEQ ID NO: 1124 - DNA, 20 bp, Hordeum vulgare subsp. Vulgare
tgacagaagagagagagcac

SEQ ID NO: 1125 - DNA, 20 bp, Lotus japonicus
tgacagaagagagagagcac

SEQ ID NO: 1126 - DNA, 20 bp, Lactuca sativa
tgacagaagagagagagcac

SEQ ID NO: 1127 - DNA, 20 bp, Malus x domestica
tgacagaagagagagagcac

SEQ ID NO: 1128 - DNA, 20 bp, Malus x domestica
tgacagaagagagagagcac

SEQ ID NO: 1129 - DNA, 21 bp, Medicago truncatula
tgacagaagagagagagcaca

SEQ ID NO: 1130 - DNA, 20 bp, Medicago truncatula
tgacagaagagagtgagcac

SEQ ID NO: 1131 - DNA, 20 bp, Medicago truncatula
tgacagaagagagtgagcac

SEQ ID NO: 1132 - DNA, 20 bp, Medicago truncatula
tgacagaagagagtgagcac

SEQ ID NO: 1133 - DNA, 21 bp, Medicago truncatula
ttgacagaagatagagagcac

SEQ ID NO: 1134 - DNA, 21 bp, Medicago truncatula
ttgacagaagatagagagcac

SEQ ID NO: 1135 - DNA, 21 bp, Medicago truncatula
ttgacagaagatagagggcac

SEQ ID NO: 1136 - DNA, 21 bp, Medicago truncatula
ttgacagaagatagagagcac

SEQ ID NO: 1137 - DNA, 20 bp, Medicago truncatula
tgacagaagagagtgagcac

SEQ ID NO: 1138 - DNA, 20 bp, Nicotiana benthamiana
tgacagaagagagagagcac

SEQ ID NO: 1139 - DNA, 20 bp, Nicotiana benthamiana
tgacagaagagagagagcac

SEQ ID NO: 1140 - DNA, 20 bp, Oryza rufipogon
tgacagaagagagtgagcac

SEQ ID NO: 1141 - DNA, 20 bp, Oryza sativa
tgacagaagagagtgagcac

SEQ ID NO: 1142 - DNA, 20 bp, Oryza sativa
tgacagaagagagtgagcac

SEQ ID NO: 1143 - DNA, 20 bp, Oryza sativa
tgacagaagagagtgagcac

SEQ ID NO: 1144 - DNA, 20 bp, Oryza sativa
tgacagaagagagtgagcac

SEQ ID NO: 1145 - DNA, 20 bp, Oryza sativa
tgacagaagagagtgagcac

SEQ ID NO: 1146 - DNA, 20 bp, Oryza sativa
tgacagaagagagtgagcac

SEQ ID NO: 1147 - DNA, 20 bp, Oryza sativa
tgacagaagagagtgagcac

SEQ ID NO: 1148 - DNA, 20 bp, Oryza sativa
tgacagaagagagtgagcac

SEQ ID NO: 1149 - DNA, 20 bp, Oryza sativa
tgacagaagagagtgagcac

SEQ ID NO: 1150 - DNA, 20 bp, Oryza sativa
tgacagaagagagtgagcac

SEQ ID NO: 1151 - DNA, 21 bp, Oryza sativa
tgacagaagagagagagcaca

SEQ ID NO: 1152 - DNA, 21 bp, Oryza sativa
cgacagaagagagtgagcata

SEQ ID NO: 1153 - DNA, 20 bp, Oryza sativa
tgacagaagagagtgagcac

SEQ ID NO: 1154 - DNA, 20 bp, Oryza sativa
tgacagaagagagtgagcac

SEQ ID NO: 1155 - DNA, 20 bp, Oryza sativa
tgacagaagagagtgagcat

SEQ ID NO: 1156 - DNA, 20 bp, Oryza sativa
tgacagaagagagtgagctc

SEQ ID NO: 1157 - DNA, 20 bp, Oryza sativa
tgacagaacagagtgagcac

SEQ ID NO: 1158 - DNA, 20 bp, Oryza sativa
tgacagaagagagagagcac

SEQ ID NO: 1159 - DNA, 20 bp, Prunus armeniaca
tgacagaagagagagagcac

SEQ ID NO: 1160 - DNA, 20 bp, Populus trichocarpa x Populus deltoides
tgacagaagagagagagcac

SEQ ID NO: 1161 - DNA, 20 bp, Phleum pratense
tgacagaagagagtgagcac

SEQ ID NO: 1162 - DNA, 20 bp, Physcomitrella patens
tgacagaagagagtgagcac

SEQ ID NO: 1163 - DNA, 20 bp, Physcomitrella patens
tgacagaagagagtgagcac

SEQ ID NO: 1164 - DNA, 20 bp, Physcomitrella patens
tgacagaagagagtgagcac

SEQ ID NO: 1165 - DNA, 20 bp, Pinus taeda
cagaagatagagagcacaac

SEQ ID NO: 1166 - DNA, 20 bp, Populus trichocarpa
tgacagaagagagtgagcac

SEQ ID NO: 1167 - DNA, 20 bp, Populus trichocarpa
tgacagaagagagtgagcac

SEQ ID NO: 1168 - DNA, 20 bp, Populus trichocarpa
tgacagaagagagtgagcac

SEQ ID NO: 1169 - DNA, 20 bp, Populus trichocarpa
tgacagaagagagtgagcac

SEQ ID NO: 1170 - DNA, 20 bp, Populus trichocarpa
tgacagaagagagtgagcac

SEQ ID NO: 1171 - DNA, 20 bp, Populus trichocarpa
tgacagaagagagtgagcac

SEQ ID NO: 1172 - DNA, 21 bp, Populus trichocarpa
ttgacagaagatagagagcac

SEQ ID NO: 1173 - DNA, 21 bp, Populus trichocarpa
ttgacagaagatagagagcac

SEQ ID NO: 1174 - DNA, 21 bp, Populus trichocarpa
ttgacagaagatagagagcac

SEQ ID NO: 1175 - DNA, 21 bp, Populus trichocarpa
ttgacagaagatagagagcac

SEQ ID NO: 1176 - DNA, 20 bp, Populus trichocarpa
tgacagaagagagggagcac

SEQ ID NO: 1177 - DNA, 20 bp, Populus tremula
tgacagaagagagagagcac

SEQ ID NO: 1178 - DNA, 20 bp, Populus tremuloides
tgacagaagagagtgagcgc

SEQ ID NO: 1179 - DNA, 20 bp, Populus tremuloides
tgacagaagagagagagcac

SEQ ID NO: 1180 - DNA, 20 bp, Populus tremuloides
tgacagaagagagagagcac

SEQ ID NO: 1181 - DNA, 21 bp, Ricinus communis
tgacagaagagagtgagcaca

SEQ ID NO: 1182 - DNA, 21 bp, Ricinus communis
tgacagaagagagtgagcaca

SEQ ID NO: 1183 - DNA, 21 bp, Ricinus communis
tgacagaagagagtgagcaca

SEQ ID NO: 1184 - DNA, 21 bp, Ricinus communis
tgacagaagagagtgagcaca

SEQ ID NO: 1185 - DNA, 21 bp, Ricinus communis
tgacagaagagagagagcaca

SEQ ID NO: 1186 - DNA, 21 bp, Ricinus communis
ttgacagaagatagagagcac

SEQ ID NO: 1187 - DNA, 21 bp, Ricinus communis
ttgacagaagatagagagcac

SEQ ID NO: 1188 - DNA, 21 bp, Ricinus communis
ttgacagaagatagagagcac

SEQ ID NO: 1189 - DNA, 20 bp, Sorghum bicolor
tgacagaagagagtgagcac

SEQ ID NO: 1190 - DNA, 20 bp, Sorghum bicolor
tgacagaagagagtgagcac

SEQ ID NO: 1191 - DNA, 20 bp, Sorghum bicolor
tgacagaagagagtgagcac

SEQ ID NO: 1192 - DNA, 21 bp, Sorghum bicolor
tgacagaagagagagagcaca

SEQ ID NO: 1193 - DNA, 20 bp, Sorghum bicolor
tgacagaagagagcgagcac

SEQ ID NO: 1194 - DNA, 20 bp, Sorghum bicolor
tgacagaagagagtgagcac

SEQ ID NO: 1195 - DNA, 20 bp, Sorghum bicolor
tgacagaagagagtgagcac

SEQ ID NO: 1196 - DNA, 20 bp, Sorghum bicolor
tgacagaagagagtgagcac

SEQ ID NO: 1197 - DNA, 20 bp, Sorghum bicolor
tgacagaagagagtgagcac

SEQ ID NO: 1198 - DNA, 20 bp, Sesamum indicum
tgacagaagagagagagcac

SEQ ID NO: 1199 - DNA, 21 bp, Solanum lycopersicum
ttgacagaagatagagagcac

SEQ ID NO: 1200 - DNA, 21 bp, Solanum lycopersicum
ttgacagaagatagagagcac

SEQ ID NO: 1201 - DNA, 21 bp, Solanum lycopersicum
ttgacagaagatagagagcac

SEQ ID NO: 1202 - DNA, 20 bp, Selaginella moellendorffii
cgacagaagagagtgagcac

SEQ ID NO: 1203 - DNA, 21 bp, Selaginella moellendorffii
ctgacagaagatagagagcac

SEQ ID NO: 1204 - DNA, 21 bp, Selaginella moellendorffii
ttgacagaagaaagagagcac

SEQ ID NO: 1205 - DNA, 21 bp, Selaginella moellendorffii
ttgacagaagacagggagcac

SEQ ID NO: 1206 - DNA, 20 bp, Saccharum officinarum
tgacagaagagagtgagcac

SEQ ID NO: 1207 - DNA, 20 bp, Saccharum officinarum
tgacagaagagagagagcac

SEQ ID NO: 1208 - DNA, 20 bp, Saccharum officinarum
tgacagaagagagagagcac

SEQ ID NO: 1209 - DNA, 20 bp, Saccharum officinarum
tgacagaagagagagagcac

SEQ ID NO: 1210 - DNA, 20 bp, Saccharum officinarum
tgacagaagagagagagcac

SEQ ID NO: 1211 - DNA, 20 bp, Saccharum officinarum
tgacagaagagagagagcac

SEQ ID NO: 1212 - DNA, 20 bp, Saccharum officinarum
tgacagaagagagagagcac

SEQ ID NO: 1213 - DNA, 20 bp, Saccharum officinarum
tgacagaagagagagagcac

SEQ ID NO: 1214 - DNA, 20 bp, Sorghum Propinquum
tgacagaagagagagagcac

SEQ ID NO: 1215 - DNA, 21 bp, Saccharum spp
tgacagaagagagtgagcaca

SEQ ID NO: 1216 - DNA, 20 bp, Solanum tuberosum
tgacagaagagagtgagcac

SEQ ID NO: 1217 - DNA, 20 bp, Solanum tuberosum
tgacagaagagagagagcac

SEQ ID NO: 1218 - DNA, 20 bp, Solanum tuberosum
tgacagaagagagagagcac

SEQ ID NO: 1219 - DNA, 20 bp, Solanum tuberosum
tgacagaagagagagagcac

SEQ ID NO: 1220 - DNA, 20 bp, Solanum tuberosum
tgacagaagagagagagcac

SEQ ID NO: 1221 - DNA, 21 bp, Triticum aestivum
tgacagaagagagtgagcaca

SEQ ID NO: 1222 - DNA, 20 bp, Triticum aestivum
tgacagaagagagagagcac

SEQ ID NO: 1223 - DNA, 20 bp, Triticum aestivum
tgacagaagagagagagcac

SEQ ID NO: 1224 - DNA, 21 bp, Theobroma cacao
tgacagaagagagagagcaca

SEQ ID NO: 1225 - DNA, 20 bp, Theobroma cacao
tgacagaagagagtgagcac

SEQ ID NO: 1226 - DNA, 20 bp, Theobroma cacao
tgacagaagagagtgagcac

SEQ ID NO: 1227 - DNA, 20 bp, Theobroma cacao
tgacagaagagagtgagcac

SEQ ID NO: 1228 - DNA, 21 bp, Theobroma cacao
ttgacagaagatagagagcac

SEQ ID NO: 1229 - DNA, 21 bp, Theobroma cacao
ttgacagaagatagagagcac

SEQ ID NO: 1230 - DNA, 20 bp, Theobroma cacao
tgacagaagagagtgagcac

SEQ ID NO: 1231 - DNA, 20 bp, Trifolium repens
tgacagaagagagtgagcac

SEQ ID NO: 1232 - DNA, 20 bp, Vitis vinifera
tgacagaagagagggagcac

SEQ ID NO: 1233 - DNA, 20 bp, Vitis vinifera
tgacagaagagagtgagcac

SEQ ID NO: 1234 - DNA, 20 bp, Vitis vinifera
tgacagaagagagtgagcac

SEQ ID NO: 1235 - DNA, 20 bp, Vitis vinifera
tgacagaagagagtgagcac

SEQ ID NO: 1236 - DNA, 20 bp, Vitis vinifera
tgacagaggagagtgagcac

SEQ ID NO: 1237 - DNA, 21 bp, Vitis vinifera
ttgacagaagatagagagcac

SEQ ID NO: 1238 - DNA, 21 bp, Vitis vinifera
ttgacagaagatagagagcac

SEQ ID NO: 1239 - DNA, 20 bp, Vitis vinifera
tgacagaagagagagagcat

SEQ ID NO: 1240 - DNA, 21 bp, Vitis vinifera
ttgacagaagatagagagcac

SEQ ID NO: 1241 - DNA, 20 bp, Zinnia elegans
tgacagaagagagagagcac

SEQ ID NO: 1242 - DNA, 20 bp, Zea mays
tgacagaagagagtgagcac

SEQ ID NO: 1243 - DNA, 20 bp, Zea mays
tgacagaagagagtgagcac

SEQ ID NO: 1244 - DNA, 20 bp, Zea mays
tgacagaagagagtgagcac

SEQ ID NO: 1245 - DNA, 20 bp, Zea mays
tgacagaagagagtgagcac

SEQ ID NO: 1246 - DNA, 20 bp, Zea mays
tgacagaagagagtgagcac

SEQ ID NO: 1247 - DNA, 20 bp, Zea mays
tgacagaagagagtgagcac

SEQ ID NO: 1248 - DNA, 20 bp, Zea mays
tgacagaagagagtgagcac

SEQ ID NO: 1249 - DNA, 20 bp, Zea mays
tgacagaagagagtgagcac

SEQ ID NO: 1250 - DNA, 20 bp, Zea mays
tgacagaagagagtgagcac

SEQ ID NO: 1251 - DNA, 21 bp, Zea mays
tgacagaagagagagagcaca

SEQ ID NO: 1252 - DNA, 20 bp, Zea mays
tgacagaagagagcgagcac

SEQ ID NO: 1253 - DNA, 20 bp, Zea mays
tgacagaagagagtgagcac

SEQ ID NO: 1254 - DNA, 20 bp, Zea mays
tgacagaagagagtgagcac

SEQ ID NO: 1255 - DNA, 20 bp, Zea mays
tgacagaagagagtgagcac

SEQ ID NO: 1256 - DNA, 20 bp, Zea mays
tgacagaagagagtgagcac

SEQ ID NO: 1257 - DNA, 20 bp, Zea mays
tgacagaagagagagagcac

SEQ ID NO: 1258 - DNA, 20 bp, Zea mays
tgacagaagagagagagcac

SEQ ID NO: 1259 - DNA, 20 bp, Zea mays
tgacagaagagagtgggcac

SEQ ID NO: 1260 - DNA, 20 bp, Arachis hypogaea
tgacagaagagagagagcac

SEQ ID NO: 1261 - DNA, 21 bp, Arachis hypogaea
ttgacagaagatagagagcac

SEQ ID NO: 1262 - DNA, 21 bp, Arachis hypogaea
ttgacagaagagagagagcac

SEQ ID NO: 1263 - DNA, 20 bp, Arabidopsis lyrata
tgacagaagagagtgagcac

SEQ ID NO: 1264 - DNA, 20 bp, Arabidopsis lyrata
tgacagaagagagtgagcac

SEQ ID NO: 1265 - DNA, 20 bp, Arabidopsis lyrata
tgacagaagagagtgagcac

SEQ ID NO: 1266 - DNA, 20 bp, Arabidopsis lyrata
tgacagaagagagtgagcac

SEQ ID NO: 1267 - DNA, 20 bp, Arabidopsis lyrata
tgacagaagagagtgagcac

SEQ ID NO: 1268 - DNA, 20 bp, Arabidopsis lyrata
tgacagaagagagtgagcac

SEQ ID NO: 1269 - DNA, 20 bp, Arabidopsis lyrata
cgacagaagagagtgagcac

SEQ ID NO: 1270 - DNA, 20 bp, Arabidopsis lyrata
tgacagaagaaagagagcac

SEQ ID NO: 1271 - DNA, 20 bp, Aquilegia coerulea
tgacagaagatagagagcac

SEQ ID NO: 1272 - DNA, 20 bp, Aquilegia coerulea
tgacagaagatagagagcac

SEQ ID NO: 1273 - DNA, 20 bp, Arabidopsis thaliana
tgacagaagagagtgagcac

SEQ ID NO: 1274 - DNA, 20 bp, Arabidopsis thaliana
tgacagaagagagtgagcac

SEQ ID NO: 1275 - DNA, 20 bp, Arabidopsis thaliana
tgacagaagagagtgagcac

SEQ ID NO: 1276 - DNA, 20 bp, Arabidopsis thaliana
tgacagaagagagtgagcac

SEQ ID NO: 1277 - DNA, 20 bp, Arabidopsis thaliana
tgacagaagagagtgagcac

SEQ ID NO: 1278 - DNA, 20 bp, Arabidopsis thaliana
tgacagaagagagtgagcac

SEQ ID NO: 1279 - DNA, 20 bp, Arabidopsis thaliana
cgacagaagagagtgagcac

SEQ ID NO: 1280 - DNA, 20 bp, Arabidopsis thaliana
tgacagaagaaagagagcac

SEQ ID NO: 1281 - DNA, 20 bp, Arabidopsis thaliana
tgacagaagagagagagcac

SEQ ID NO: 1282 - DNA, 20 bp, Arabidopsis thaliana
tgacagaagagagagagcac

SEQ ID NO: 1283 - DNA, 20 bp, Arabidopsis thaliana
tgacagaagagagagagcac

SEQ ID NO: 1284 - DNA, 20 bp, Arabidopsis thaliana
tgacagaagagagagagcac

SEQ ID NO: 1285 - DNA, 20 bp, Arabidopsis thaliana
tgacagaagagagagagcac

SEQ ID NO: 1286 - DNA, 20 bp, Arabidopsis thaliana
tgacagaagagagagagcac

SEQ ID NO: 1287 - DNA, 21 bp, Brachypodium distachyon
tgacagaagagagagagcaca

SEQ ID NO: 1288 - DNA, 20 bp, Brachypodium distachyon
tgacagaagagagtgagcac

SEQ ID NO: 1289 - DNA, 20 bp, Brachypodium distachyon
tgacagaagagagtgagcac

SEQ ID NO: 1290 - DNA, 20 bp, Brachypodium distachyon
tgacagaagagagtgagcac

SEQ ID NO: 1291 - DNA, 21 bp, Brassica napus
tgacagaagagagtgagcaca

SEQ ID NO: 1292 - DNA, 21 bp, Brassica napus
ttgacagaagatagagagcac

SEQ ID NO: 1293 - DNA, 21 bp, Brassica napus
ttgacagaagatagagagcac

SEQ ID NO: 1294 - DNA, 20 bp, Capsicum annuum
tgacagaagagagagagcac

SEQ ID NO: 1295 - DNA, 20 bp, Capsicum annuum
tgacagaagagagggagcac

SEQ ID NO: 1296 - DNA, 20 bp, Citrus x paradisi x Poncirus trifoliata
tgacagaagagagtgagcac

SEQ ID NO: 1297 - DNA, 20 bp, Citrus x paradisi x Poncirus trifoliata
tgacagaagagagagagcac

SEQ ID NO: 1298 - DNA, 20 bp, Cycas rumphii
tgacagaagagagagagcac

SEQ ID NO: 1299 - DNA, 20 bp, Citrus sinensis
tgacagaagagagtgagcac

SEQ ID NO: 1300 - DNA, 20 bp, Citrus sinensis
tgacagaagagagagagcac

SEQ ID NO: 1301 - DNA, 20 bp, Citrus sinensis
tgacagaagagagagagcac

SEQ ID NO: 1302 - DNA, 20 bp, Citrus trifoliata
tgacagaagagagtgagcac

SEQ ID NO: 1303 - DNA, 20 bp, Eschscholzia californica
tgacagaagagagagagcac

SEQ ID NO: 1304 - DNA, 21 bp, Festuca arundinacea
tgacagaagagagagagcaca

SEQ ID NO: 1305 - DNA, 21 bp, Festuca arundinacea
ttgacagaagagagagagcac

SEQ ID NO: 1306 - DNA, 20 bp, Gossypium hirsutum
tgacagaagagagtgagcac

SEQ ID NO: 1307 - DNA, 20 bp, Gossypium hirsutum
tgacagaagagagtgagcac

SEQ ID NO: 1308 - DNA, 20 bp, Gossypium hirsutum
tgtcagaagagagtgagcac

SEQ ID NO: 1309 - DNA, 20 bp, Gossypium hirsutum
tgacagaagagagtgagcac

SEQ ID NO: 1310 - DNA, 20 bp, Glycine max
tgacagaagagagtgagcac

SEQ ID NO: 1311 - DNA, 21 bp, Glycine max
tgacagaagagagagagcaca

SEQ ID NO: 1312 - DNA, 21 bp, Glycine max
ttgacagaagatagagagcac

SEQ ID NO: 1313 - DNA, 21 bp, Glycine max
ttgacagaagatagagagcac

SEQ ID NO: 1314 - DNA, 21 bp, Glycine max
ttgacagaagatagagagcac

SEQ ID NO: 1315 - DNA, 22 bp, Glycine max
ttgacagaagagagagagcaca

SEQ ID NO: 1316 - DNA, 20 bp, Glycine max
acagaagatagagagcacag

SEQ ID NO: 1317 - DNA, 20 bp, Glycine max
tgacagaagagagagagcac

SEQ ID NO: 1318 - DNA, 20 bp, Glycine max
tgacagaagagagagagcac

SEQ ID NO: 1319 - DNA, 20 bp, Helianthus annuus
tgacagaagagagagagcac

SEQ ID NO: 1320 - DNA, 20 bp, Hordeum vulgare subsp. Spontaneum
tgacagaagagagagagcac

SEQ ID NO: 1321 - DNA, 21 bp, Hordeum vulgare
tgacagaagagagtgagcaca

SEQ ID NO: 1322 - DNA, 20 bp, Hordeum vulgare subsp. Vulgare
tgacagaagagagtgagcac

SEQ ID NO: 1323 - DNA, 20 bp, Hordeum vulgare subsp. Vulgare
tgacagaagagagagagcac

SEQ ID NO: 1324 - DNA, 20 bp, Hordeum vulgare subsp. Vulgare
tgacagaagagagagagcac

SEQ ID NO: 1325 - DNA, 20 bp, Hordeum vulgare subsp. Vulgare
tgacagaagagagagagcac

SEQ ID NO: 1326 - DNA, 20 bp, Lotus japonicus
tgacagaagagagagagcac

SEQ ID NO: 1327 - DNA, 20 bp, Lactuca sativa
tgacagaagagagagagcac

SEQ ID NO: 1328 - DNA, 20 bp, Malus x domestica
tgacagaagagagagagcac

SEQ ID NO: 1329 - DNA, 20 bp, Malus x domestica
tgacagaagagagagagcac

SEQ ID NO: 1330 - DNA, 21 bp, Medicago truncatula
tgacagaagagagagagcaca

SEQ ID NO: 1331 - DNA, 20 bp, Medicago truncatula
tgacagaagagagtgagcac

SEQ ID NO: 1332 - DNA, 20 bp, Medicago truncatula
tgacagaagagagtgagcac

SEQ ID NO: 1333 - DNA, 20 bp, Medicago truncatula
tgacagaagagagtgagcac

SEQ ID NO: 1334 - DNA, 21 bp, Medicago truncatula
ttgacagaagatagagagcac

SEQ ID NO: 1335 - DNA, 21 bp, Medicago truncatula
ttgacagaagatagagagcac

SEQ ID NO: 1336 - DNA, 21 bp, Medicago truncatula
ttgacagaagatagagggcac

SEQ ID NO: 1337 - DNA, 21 bp, Medicago truncatula
ttgacagaagatagagagcac

SEQ ID NO: 1338 - DNA, 20 bp, Medicago truncatula
tgacagaagagagtgagcac

SEQ ID NO: 1339 - DNA, 20 bp, Nicotiana benthamiana
tgacagaagagagagagcac

SEQ ID NO: 1340 - DNA, 20 bp, Nicotiana benthamiana
tgacagaagagagagagcac

SEQ ID NO: 1341 - DNA, 20 bp, Oryza rufipogon
tgacagaagagagtgagcac

SEQ ID NO: 1342 - DNA, 20 bp, Oryza sativa
tgacagaagagagtgagcac

SEQ ID NO: 1343 - DNA, 20 bp, Oryza sativa
tgacagaagagagtgagcac

SEQ ID NO: 1344 - DNA, 20 bp, Oryza sativa
tgacagaagagagtgagcac

SEQ ID NO: 1345 - DNA, 20 bp, Oryza sativa
tgacagaagagagtgagcac

SEQ ID NO: 1346 - DNA, 20 bp, Oryza sativa
tgacagaagagagtgagcac

SEQ ID NO: 1347 - DNA, 20 bp, Oryza sativa
tgacagaagagagtgagcac

SEQ ID NO: 1348 - DNA, 20 bp, Oryza sativa
tgacagaagagagtgagcac

SEQ ID NO: 1349 - DNA, 20 bp, Oryza sativa
tgacagaagagagtgagcac

SEQ ID NO: 1350 - DNA, 20 bp, Oryza sativa
tgacagaagagagtgagcac

SEQ ID NO: 1351 - DNA, 20 bp, Oryza sativa
tgacagaagagagtgagcac

SEQ ID NO: 1352 - DNA, 21 bp, Oryza sativa
tgacagaagagagagagcaca

SEQ ID NO: 1353 - DNA, 21 bp, Oryza sativa
cgacagaagagagtgagcata

SEQ ID NO: 1354 - DNA, 20 bp, Oryza sativa
tgacagaagagagtgagcac

SEQ ID NO: 1355 - DNA, 20 bp, Oryza sativa
tgacagaagagagtgagcac

SEQ ID NO: 1356 - DNA, 20 bp, Oryza sativa
tgacagaagagagtgagcat

SEQ ID NO: 1357 - DNA, 20 bp, Oryza sativa
tgacagaagagagtgagctc

SEQ ID NO: 1358 - DNA, 20 bp, Oryza sativa
tgacagaacagagtgagcac

SEQ ID NO: 1359 - DNA, 20 bp, Oryza sativa
tgacagaagagagagagcac

SEQ ID NO: 1360 - DNA, 20 bp, Prunus armeniaca
tgacagaagagagagagcac

SEQ ID NO: 1361 - DNA, 20 bp, Populus trichocarpa x Populus deltoides
tgacagaagagagagagcac

SEQ ID NO: 1362 - DNA, 20 bp, Phleum pratense
tgacagaagagagtgagcac

SEQ ID NO: 1363 - DNA, 20 bp, Physcomitrella patens
tgacagaagagagtgagcac

SEQ ID NO: 1364 - DNA, 20 bp, Physcomitrella patens
tgacagaagagagtgagcac

SEQ ID NO: 1365 - DNA, 20 bp, Physcomitrella patens
tgacagaagagagtgagcac

SEQ ID NO: 1366 - DNA, 20 bp, Pinus taeda
cagaagatagagagcacatc

SEQ ID NO: 1367 - DNA, 20 bp, Populus trichocarpa
tgacagaagagagtgagcac

SEQ ID NO: 1368 - DNA, 20 bp, Populus trichocarpa
tgacagaagagagtgagcac

SEQ ID NO: 1369 - DNA, 20 bp, Populus trichocarpa
tgacagaagagagtgagcac

SEQ ID NO: 1370 - DNA, 20 bp, Populus trichocarpa
tgacagaagagagtgagcac

SEQ ID NO: 1371 - DNA, 20 bp, Populus trichocarpa
tgacagaagagagtgagcac

SEQ ID NO: 1372 - DNA, 20 bp, Populus trichocarpa
tgacagaagagagtgagcac

SEQ ID NO: 1373 - DNA, 21 bp, Populus trichocarpa
ttgacagaagatagagagcac

SEQ ID NO: 1374 - DNA, 21 bp, Populus trichocarpa
ttgacagaagatagagagcac

SEQ ID NO: 1375 - DNA, 21 bp, Populus trichocarpa
ttgacagaagatagagagcac

SEQ ID NO: 1376 - DNA, 21 bp, Populus trichocarpa
ttgacagaagatagagagcac

SEQ ID NO: 1377 - DNA, 20 bp, Populus trichocarpa
tgacagaagagagggagcac

SEQ ID NO: 1378 - DNA, 20 bp, Populus tremula
tgacagaagagagagagcac

SEQ ID NO: 1379 - DNA, 20 bp, Populus tremuloides
tgacagaagagagtgagcgc

SEQ ID NO: 1380 - DNA, 20 bp, Populus tremuloides
tgacagaagagagagagcac

SEQ ID NO: 1381 - DNA, 20 bp, Populus tremuloides
tgacagaagagagagagcac

SEQ ID NO: 1382 - DNA, 21 bp, Ricinus communis
tgacagaagagagtgagcaca

SEQ ID NO: 1383 - DNA, 21 bp, Ricinus communis
tgacagaagagagtgagcaca

SEQ ID NO: 1384 - DNA, 21 bp, Ricinus communis
tgacagaagagagtgagcaca

SEQ ID NO: 1385 - DNA, 21 bp, Ricinus communis
tgacagaagagagtgagcaca

SEQ ID NO: 1386 - DNA, 21 bp, Ricinus communis
tgacagaagagagagagcaca

SEQ ID NO: 1387 - DNA, 21 bp, Ricinus communis
ttgacagaagatagagagcac

SEQ ID NO: 1388 - DNA, 21 bp, Ricinus communis
ttgacagaagatagagagcac

SEQ ID NO: 1389 - DNA, 21 bp, Ricinus communis
ttgacagaagatagagagcac

SEQ ID NO: 1390 - DNA, 20 bp, Sorghum bicolor
tgacagaagagagtgagcac

SEQ ID NO: 1391 - DNA, 20 bp, Sorghum bicolor
tgacagaagagagtgagcac

SEQ ID NO: 1392 - DNA, 20 bp, Sorghum bicolor
tgacagaagagagtgagcac

SEQ ID NO: 1393 - DNA, 21 bp, Sorghum bicolor
tgacagaagagagagagcaca

SEQ ID NO: 1394 - DNA, 20 bp, Sorghum bicolor
tgacagaagagagcgagcac

SEQ ID NO: 1395 - DNA, 20 bp, Sorghum bicolor
tgacagaagagagtgagcac

SEQ ID NO: 1396 - DNA, 20 bp, Sorghum bicolor
tgacagaagagagtgagcac

SEQ ID NO: 1397 - DNA, 20 bp, Sorghum bicolor
tgacagaagagagtgagcac

SEQ ID NO: 1398 - DNA, 20 bp, Sorghum bicolor
tgacagaagagagtgagcac

SEQ ID NO: 1399 - DNA, 20 bp, Sesamum indicum
tgacagaagagagagagcac

SEQ ID NO: 1400 - DNA, 21 bp, Solanum lycopersicum
ttgacagaagatagagagcac

SEQ ID NO: 1401 - DNA, 21 bp, Solanum lycopersicum
ttgacagaagatagagagcac

SEQ ID NO: 1402 - DNA, 21 bp, Solanum lycopersicum
ttgacagaagatagagagcac

SEQ ID NO: 1403 - DNA, 20 bp, Selaginella moellendorffii
cgacagaagagagtgagcac

SEQ ID NO: 1404 - DNA, 21 bp, Selaginella moellendorffii
ctgacagaagatagagagcac

SEQ ID NO: 1405 - DNA, 21 bp, Selaginella moellendorffii
ttgacagaagaaagagagcac

SEQ ID NO: 1406 - DNA, 21 bp, Selaginella moellendorffii
ttgacagaagacagggagcac

SEQ ID NO: 1407 - DNA, 20 bp, Saccharum officinarum
tgacagaagagagtgagcac

SEQ ID NO: 1408 - DNA, 20 bp, Saccharum officinarum
tgacagaagagagagagcac

SEQ ID NO: 1409 - DNA, 20 bp, Saccharum officinarum
tgacagaagagagagagcac

SEQ ID NO: 1410 - DNA, 20 bp, Saccharum officinarum
tgacagaagagagagagcac

SEQ ID NO: 1411 - DNA, 20 bp, Saccharum officinarum
tgacagaagagagagagcac

SEQ ID NO: 1412 - DNA, 20 bp, Saccharum officinarum
tgacagaagagagagagcac

SEQ ID NO: 1413 - DNA, 20 bp, Saccharum officinarum
tgacagaagagagagagcac

SEQ ID NO: 1414 - DNA, 20 bp, Saccharum officinarum
tgacagaagagagagagcac

SEQ ID NO: 1415 - DNA, 20 bp, Sorghum Propinquum
tgacagaagagagagagcac

SEQ ID NO: 1416 - DNA, 21 bp, Saccharum spp
tgacagaagagagtgagcaca

SEQ ID NO: 1417 - DNA, 20 bp, Solanum tuberosum
tgacagaagagagtgagcac

SEQ ID NO: 1418 - DNA, 20 bp, Solanum tuberosum
tgacagaagagagagagcac

SEQ ID NO: 1419 - DNA, 20 bp, Solanum tuberosum
tgacagaagagagagagcac

SEQ ID NO: 1420 - DNA, 20 bp, Solanum tuberosum
tgacagaagagagagagcac

SEQ ID NO: 1421 - DNA, 20 bp, Solanum tuberosum
tgacagaagagagagagcac

SEQ ID NO: 1422 - DNA, 21 bp, Triticum aestivum
tgacagaagagagtgagcaca

SEQ ID NO: 1423 - DNA, 20 bp, Triticum aestivum
tgacagaagagagagagcac

SEQ ID NO: 1424 - DNA, 20 bp, Triticum aestivum
tgacagaagagagagagcac

SEQ ID NO: 1425 - DNA, 21 bp, Theobroma cacao
tgacagaagagagagagcaca

SEQ ID NO: 1426 - DNA, 20 bp, Theobroma cacao
tgacagaagagagtgagcac

SEQ ID NO: 1427 - DNA, 20 bp, Theobroma cacao
tgacagaagagagtgagcac

SEQ ID NO: 1428 - DNA, 20 bp, Theobroma cacao
tgacagaagagagtgagcac

SEQ ID NO: 1429 - DNA, 21 bp, Theobroma cacao
ttgacagaagatagagagcac

SEQ ID NO: 1430 - DNA, 21 bp, Theobroma cacao
ttgacagaagatagagagcac

SEQ ID NO: 1431 - DNA, 20 bp, Theobroma cacao
tgacagaagagagtgagcac

SEQ ID NO: 1432 - DNA, 20 bp, Trifolium repens
tgacagaagagagtgagcac

SEQ ID NO: 1433 - DNA, 20 bp, Vitis vinifera
tgacagaagagagggagcac

SEQ ID NO: 1434 - DNA, 20 bp, Vitis vinifera
tgacagaagagagtgagcac

SEQ ID NO: 1435 - DNA, 20 bp, Vitis vinifera
tgacagaagagagtgagcac

SEQ ID NO: 1436 - DNA, 20 bp, Vitis vinifera
tgacagaagagagtgagcac

SEQ ID NO: 1437 - DNA, 20 bp, Vitis vinifera
tgacagaggagagtgagcac

SEQ ID NO: 1438 - DNA, 21 bp, Vitis vinifera
ttgacagaagatagagagcac

SEQ ID NO: 1439 - DNA, 21 bp, Vitis vinifera
ttgacagaagatagagagcac

SEQ ID NO: 1440 - DNA, 20 bp, Vitis vinifera
tgacagaagagagagagcat

SEQ ID NO: 1441 - DNA, 21 bp, Vitis vinifera
ttgacagaagatagagagcac

SEQ ID NO: 1442 - DNA, 20 bp, Zinnia elegans
tgacagaagagagagagcac

SEQ ID NO: 1443 - DNA, 20 bp, Zea mays
tgacagaagagagtgagcac

SEQ ID NO: 1444 - DNA, 20 bp, Zea mays
tgacagaagagagtgagcac

SEQ ID NO: 1445 - DNA, 20 bp, Zea mays
tgacagaagagagtgagcac

SEQ ID NO: 1446 - DNA, 20 bp, Zea mays
tgacagaagagagtgagcac

SEQ ID NO: 1447 - DNA, 20 bp, Zea mays
tgacagaagagagtgagcac

SEQ ID NO: 1448 - DNA, 20 bp, Zea mays
tgacagaagagagtgagcac

SEQ ID NO: 1449 - DNA, 20 bp, Zea mays
tgacagaagagagtgagcac

SEQ ID NO: 1450 - DNA, 20 bp, Zea mays
tgacagaagagagtgagcac

SEQ ID NO: 1451 - DNA, 20 bp, Zea mays
tgacagaagagagtgagcac

SEQ ID NO: 1452 - DNA, 21 bp, Zea mays
tgacagaagagagagagcaca

SEQ ID NO: 1453 - DNA, 20 bp, Zea mays
tgacagaagagagcgagcac

SEQ ID NO: 1454 - DNA, 20 bp, Zea mays
tgacagaagagagtgagcac

SEQ ID NO: 1455 - DNA, 20 bp, Zea mays
tgacagaagagagtgagcac

SEQ ID NO: 1456 - DNA, 20 bp, Zea mays
tgacagaagagagtgagcac

SEQ ID NO: 1457 - DNA, 20 bp, Zea mays
tgacagaagagagtgagcac

SEQ ID NO: 1458 - DNA, 20 bp, Zea mays
tgacagaagagagagagcac

SEQ ID NO: 1459 - DNA, 20 bp, Zea mays
tgacagaagagagagagcac

SEQ ID NO: 1460 - DNA, 20 bp, Zea mays
tgacagaagagagtgggcac

SEQ ID NO: 1461 - DNA, 21 bp, Arachis hypogaea
tttggattgaagggagctcta

SEQ ID NO: 1462 - DNA, 21 bp, Arabidopsis lyrata
tttggattgaagggagctcta

SEQ ID NO: 1463 - DNA, 21 bp, Arabidopsis lyrata
tttggattgaagggagctctt

SEQ ID NO: 1464 - DNA, 21 bp, Aquilegia coerulea
tttggactgaagggagctcta

SEQ ID NO: 1465 - DNA, 21 bp, Arabidopsis thaliana
tttggattgaagggagctcta

SEQ ID NO: 1466 - DNA, 21 bp, Arabidopsis thaliana
tttggattgaagggagctctt

SEQ ID NO: 1467 - DNA, 20 bp, Brachypodium distachyon
cttggattgaagggagctct

SEQ ID NO: 1468 - DNA, 21 bp, Brassica napus
tttggattgaagggagctcta

SEQ ID NO: 1469 - DNA, 21 bp, Brassica rapa
tttggattgaagggagctcta

SEQ ID NO: 1470 - DNA, 21 bp, Citrus sinensis
tttggattgaagggagctcta

SEQ ID NO: 1471 - DNA, 21 bp, Festuca arundinacea
tttggattgaagggagctctg

SEQ ID NO: 1472 - DNA, 21 bp, Glycine max
tttggattgaagggagctcta

SEQ ID NO: 1473 - DNA, 21 bp, Hordeum vulgare
tttggattgaagggagctctg

SEQ ID NO: 1474 - DNA, 21 bp, Hordeum vulgare
tttggattgaagggagctctg

SEQ ID NO: 1475 - DNA, 21 bp, Medicago truncatula
tttggattgaagggagctcta

SEQ ID NO: 1476 - DNA, 21 bp, Oryza sativa
tttggattgaagggagctctg

SEQ ID NO: 1477 - DNA, 21 bp, Oryza sativa
tttggattgaagggagctctg

SEQ ID NO: 1478 - DNA, 21 bp, Oryza sativa
attggattgaagggagctcca

SEQ ID NO: 1479 - DNA, 21 bp, Oryza sativa
cttggattgaagggagctcta

SEQ ID NO: 1480 - DNA, 20 bp, Pinus taeda
ttggattgaagggagctcca

SEQ ID NO: 1481 - DNA, 21 bp, Populus trichocarpa
tttggattgaagggagctcta

SEQ ID NO: 1482 - DNA, 21 bp, Populus trichocarpa
tttggattgaagggagctcta

SEQ ID NO: 1483 - DNA, 21 bp, Populus trichocarpa
tttggattgaagggagctcta

SEQ ID NO: 1484 - DNA, 21 bp, Phaseolus vulgaris
tttggattgaagggagctcta

SEQ ID NO: 1485 - DNA, 21 bp, Ricinus communis
tttggattgaagggagctcta

SEQ ID NO: 1486 - DNA, 21 bp, Sorghum bicolor
tttggattgaagggagctctg

SEQ ID NO: 1487 - DNA, 21 bp, Solanum lycopersicum
tttggattgaagggagctcta

SEQ ID NO: 1488 - DNA, 21 bp, Saccharum officinarum
tttggattgaagggagctctg

SEQ ID NO: 1489 - DNA, 21 bp, Saccharum officinarum
tttggattgaagggagctctg

SEQ ID NO: 1490 - DNA, 21 bp, Saccharum officinarum
tttggattgaagggagctctg

SEQ ID NO: 1491 - DNA, 21 bp, Saccharum spp
tttggattgaagggagctctg

SEQ ID NO: 1492 - DNA, 21 bp, Triticum aestivum
tttggattgaagggagctctg

SEQ ID NO: 1493 - DNA, 21 bp, Triticum aestivum
tttggattgaagggagctctg

SEQ ID NO: 1494 - DNA, 21 bp, Vitis vinifera
tttggattgaagggagctcta

SEQ ID NO: 1495 - DNA, 21 bp, Zea mays
tttggattgaagggagctctg

SEQ ID NO: 1496 - DNA, 21 bp, Zea mays
tttggattgaagggagctctg

SEQ ID NO: 1497 - DNA, 21 bp, Zea mays
tttggattgaagggagctctg

SEQ ID NO: 1498 - DNA, 21 bp, Zea mays
tttggattgaagggagctctg

SEQ ID NO: 1499 - DNA, 21 bp, Zea mays
tttggattgaagggagctctg

SEQ ID NO: 1500 - DNA, 20 bp, Glycine max
acagaagatagagagcacag

SEQ ID NO: 1501 - DNA, 20 bp, Arachis hypogaea
tgacagaagagagagagcac

SEQ ID NO: 1502 - DNA, 21 bp, Arachis hypogaea
ttgacagaagatagagagcac

SEQ ID NO: 1503 - DNA, 21 bp, Arachis hypogaea
ttgacagaagagagagagcac

SEQ ID NO: 1504 - DNA, 20 bp, Arabidopsis lyrata
tgacagaagagagtgagcac

SEQ ID NO: 1505 - DNA, 20 bp, Arabidopsis lyrata
tgacagaagagagtgagcac

SEQ ID NO: 1506 - DNA, 20 bp, Arabidopsis lyrata
tgacagaagagagtgagcac

SEQ ID NO: 1507 - DNA, 20 bp, Arabidopsis lyrata
tgacagaagagagtgagcac

SEQ ID NO: 1508 - DNA, 20 bp, Arabidopsis lyrata
tgacagaagagagtgagcac

SEQ ID NO: 1509 - DNA, 20 bp, Arabidopsis lyrata
tgacagaagagagtgagcac

SEQ ID NO: 1510 - DNA, 20 bp, Arabidopsis lyrata
cgacagaagagagtgagcac

SEQ ID NO: 1511 - DNA, 20 bp, Arabidopsis lyrata
tgacagaagaaagagagcac

SEQ ID NO: 1512 - DNA, 20 bp, Aquilegia coerulea
tgacagaagatagagagcac

SEQ ID NO: 1513 - DNA, 20 bp, Aquilegia coerulea
tgacagaagatagagagcac

SEQ ID NO: 1514 - DNA, 20 bp, Arabidopsis thaliana
tgacagaagagagtgagcac

SEQ ID NO: 1515 - DNA, 20 bp, Arabidopsis thaliana
tgacagaagagagtgagcac

SEQ ID NO: 1516 - DNA, 20 bp, Arabidopsis thaliana
tgacagaagagagtgagcac

SEQ ID NO: 1517 - DNA, 20 bp, Arabidopsis thaliana
tgacagaagagagtgagcac

SEQ ID NO: 1518 - DNA, 20 bp, Arabidopsis thaliana
tgacagaagagagtgagcac

SEQ ID NO: 1519 - DNA, 20 bp, Arabidopsis thaliana
tgacagaagagagtgagcac

SEQ ID NO: 1520 - DNA, 20 bp, Arabidopsis thaliana
cgacagaagagagtgagcac

SEQ ID NO: 1521 - DNA, 20 bp, Arabidopsis thaliana
tgacagaagaaagagagcac

SEQ ID NO: 1522 - DNA, 20 bp, Arabidopsis thaliana
tgacagaagagagagagcac

SEQ ID NO: 1523 - DNA, 20 bp, Arabidopsis thaliana
tgacagaagagagagagcac

SEQ ID NO: 1524 - DNA, 20 bp, Arabidopsis thaliana
tgacagaagagagagagcac

SEQ ID NO: 1525 - DNA, 20 bp, Arabidopsis thaliana
tgacagaagagagagagcac

SEQ ID NO: 1526 - DNA, 20 bp, Arabidopsis thaliana
tgacagaagagagagagcac

SEQ ID NO: 1527 - DNA, 20 bp, Arabidopsis thaliana
tgacagaagagagagagcac

SEQ ID NO: 1528 - DNA, 21 bp, Brachypodium distachyon
tgacagaagagagagagcaca

SEQ ID NO: 1529 - DNA, 20 bp, Brachypodium distachyon
tgacagaagagagtgagcac

SEQ ID NO: 1530 - DNA, 20 bp, Brachypodium distachyon
tgacagaagagagtgagcac

SEQ ID NO: 1531 - DNA, 20 bp, Brachypodium distachyon
tgacagaagagagtgagcac

SEQ ID NO: 1532 - DNA, 21 bp, Brassica napus
tgacagaagagagtgagcaca

SEQ ID NO: 1533 - DNA, 21 bp, Brassica napus
ttgacagaagatagagagcac

SEQ ID NO: 1534 - DNA, 21 bp, Brassica napus
ttgacagaagatagagagcac

SEQ ID NO: 1535 - DNA, 20 bp, Capsicum annuum
tgacagaagagagagagcac

SEQ ID NO: 1536 - DNA, 20 bp, Capsicum annuum
tgacagaagagagggagcac

SEQ ID NO: 1537 - DNA, 20 bp, Citrus x paradisi x Poncirus trifoliata
tgacagaagagagtgagcac

SEQ ID NO: 1538 - DNA, 20 bp, Citrus x paradisi x Poncirus trifoliata
tgacagaagagagagagcac

SEQ ID NO: 1539 - DNA, 20 bp, Cycas rumphii
tgacagaagagagagagcac

SEQ ID NO: 1540 - DNA, 20 bp, Citrus sinensis
tgacagaagagagtgagcac

SEQ ID NO: 1541 - DNA, 20 bp, Citrus sinensis
tgacagaagagagagagcac

SEQ ID NO: 1542 - DNA, 20 bp, Citrus sinensis
tgacagaagagagagagcac

SEQ ID NO: 1543 - DNA, 20 bp, Citrus trifoliata
tgacagaagagagtgagcac

SEQ ID NO: 1544 - DNA, 20 bp, Eschscholzia californica
tgacagaagagagagagcac

SEQ ID NO: 1545 - DNA, 21 bp, Festuca arundinacea
tgacagaagagagagagcaca

SEQ ID NO: 1546 - DNA, 21 bp, Festuca arundinacea
ttgacagaagagagagagcac

SEQ ID NO: 1547 - DNA, 20 bp, Gossypium hirsutum
tgacagaagagagtgagcac

SEQ ID NO: 1548 - DNA, 20 bp, Gossypium hirsutum
tgacagaagagagtgagcac

SEQ ID NO: 1549 - DNA, 20 bp, Gossypium hirsutum
tgtcagaagagagtgagcac

SEQ ID NO: 1550 - DNA, 20 bp, Gossypium hirsutum
tgacagaagagagtgagcac

SEQ ID NO: 1551 - DNA, 20 bp, Glycine max
tgacagaagagagtgagcac

SEQ ID NO: 1552 - DNA, 21 bp, Glycine max
tgacagaagagagagagcaca

SEQ ID NO: 1553 - DNA, 21 bp, Glycine max
ttgacagaagatagagagcac

SEQ ID NO: 1554 - DNA, 21 bp, Glycine max
ttgacagaagatagagagcac

SEQ ID NO: 1555 - DNA, 21 bp, Glycine max
ttgacagaagatagagagcac

SEQ ID NO: 1556 - DNA, 22 bp, Glycine max
ttgacagaagagagagagcaca

SEQ ID NO: 1557 - DNA, 20 bp, Glycine max
acagaagatagagagcacag

SEQ ID NO: 1558 - DNA, 20 bp, Glycine max
tgacagaagagagagagcac

SEQ ID NO: 1559 - DNA, 20 bp, Glycine max
tgacagaagagagagagcac

SEQ ID NO: 1560 - DNA, 20 bp, Helianthus annuus
tgacagaagagagagagcac

SEQ ID NO: 1561 - DNA, 20 bp, Hordeum vulgare subsp. Spontaneum
tgacagaagagagagagcac

SEQ ID NO: 1562 - DNA, 21 bp, Hordeum vulgare
tgacagaagagagtgagcaca

SEQ ID NO: 1563 - DNA, 20 bp, Hordeum vulgare subsp. Vulgare
tgacagaagagagtgagcac

SEQ ID NO: 1564 - DNA, 20 bp, Hordeum vulgare subsp. Vulgare
tgacagaagagagagagcac

SEQ ID NO: 1565 - DNA, 20 bp, Hordeum vulgare subsp. Vulgare
tgacagaagagagagagcac

SEQ ID NO: 1566 - DNA, 20 bp, Hordeum vulgare subsp. Vulgare
tgacagaagagagagagcac

SEQ ID NO: 1567 - DNA, 20 bp, Lotus japonicus
tgacagaagagagagagcac

SEQ ID NO: 1568 - DNA, 20 bp, Lactuca sativa
tgacagaagagagagagcac

SEQ ID NO: 1569 - DNA, 20 bp, Malus x domestica
tgacagaagagagagagcac

SEQ ID NO: 1570 - DNA, 20 bp, Malus x domestica
tgacagaagagagagagcac

SEQ ID NO: 1571 - DNA, 21 bp, Medicago truncatula
tgacagaagagagagagcaca

SEQ ID NO: 1572 - DNA, 20 bp, Medicago truncatula
tgacagaagagagtgagcac

SEQ ID NO: 1573 - DNA, 20 bp, Medicago truncatula
tgacagaagagagtgagcac

SEQ ID NO: 1574 - DNA, 20 bp, Medicago truncatula
tgacagaagagagtgagcac

SEQ ID NO: 1575 - DNA, 21 bp, Medicago truncatula
ttgacagaagatagagagcac

SEQ ID NO: 1576 - DNA, 21 bp, Medicago truncatula
ttgacagaagatagagagcac

SEQ ID NO: 1577 - DNA, 21 bp, Medicago truncatula
ttgacagaagatagagggcac

SEQ ID NO: 1578 - DNA, 21 bp, Medicago truncatula
ttgacagaagatagagagcac

SEQ ID NO: 1579 - DNA, 20 bp, Medicago truncatula
tgacagaagagagtgagcac

SEQ ID NO: 1580 - DNA, 20 bp, Nicotiana benthamiana
tgacagaagagagagagcac

SEQ ID NO: 1581 - DNA, 20 bp, Nicotiana benthamiana
tgacagaagagagagagcac

SEQ ID NO: 1582 - DNA, 20 bp, Oryza rufipogon
tgacagaagagagtgagcac

SEQ ID NO: 1583 - DNA, 20 bp, Oryza sativa
tgacagaagagagtgagcac

SEQ ID NO: 1584 - DNA, 20 bp, Oryza sativa
tgacagaagagagtgagcac

SEQ ID NO: 1585 - DNA, 20 bp, Oryza sativa
tgacagaagagagtgagcac

SEQ ID NO: 1586 - DNA, 20 bp, Oryza sativa
tgacagaagagagtgagcac

SEQ ID NO: 1587 - DNA, 20 bp, Oryza sativa
tgacagaagagagtgagcac

SEQ ID NO: 1588 - DNA, 20 bp, Oryza sativa
tgacagaagagagtgagcac

SEQ ID NO: 1589 - DNA, 20 bp, Oryza sativa
tgacagaagagagtgagcac

SEQ ID NO: 1590 - DNA, 20 bp, Oryza sativa
tgacagaagagagtgagcac

SEQ ID NO: 1591 - DNA, 20 bp, Oryza sativa
tgacagaagagagtgagcac

SEQ ID NO: 1592 - DNA, 20 bp, Oryza sativa
tgacagaagagagtgagcac

SEQ ID NO: 1593 - DNA, 21 bp, Oryza sativa
tgacagaagagagagagcaca

SEQ ID NO: 1594 - DNA, 21 bp, Oryza sativa
cgacagaagagagtgagcata

SEQ ID NO: 1595 - DNA, 20 bp, Oryza sativa
tgacagaagagagtgagcac

SEQ ID NO: 1596 - DNA, 20 bp, Oryza sativa
tgacagaagagagtgagcac

SEQ ID NO: 1597 - DNA, 20 bp, Oryza sativa
tgacagaagagagtgagcat

SEQ ID NO: 1598 - DNA, 20 bp, Oryza sativa
tgacagaagagagtgagctc

SEQ ID NO: 1599 - DNA, 20 bp, Oryza sativa
tgacagaacagagtgagcac

SEQ ID NO: 1600 - DNA, 20 bp, Oryza sativa
tgacagaagagagagagcac

SEQ ID NO: 1601 - DNA, 20 bp, Prunus armeniaca
tgacagaagagagagagcac

SEQ ID NO: 1602 - DNA, 20 bp, Picea glauca
gatcctagagcccttgagcc

SEQ ID NO: 1603 - DNA, 20 bp, Populus trichocarpa x Populus deltoides
tgacagaagagagagagcac

SEQ ID NO: 1604 - DNA, 20 bp, Phleum pratense
tgacagaagagagtgagcac

SEQ ID NO: 1605 - DNA, 20 bp, Physcomitrella patens
tgacagaagagagtgagcac

SEQ ID NO: 1606 - DNA, 20 bp, Physcomitrella patens
tgacagaagagagtgagcac

SEQ ID NO: 1607 - DNA, 20 bp, Physcomitrella patens
tgacagaagagagtgagcac

SEQ ID NO: 1608 - DNA, 20 bp, Pinus taeda
cagaagatagagagcacatc

SEQ ID NO: 1609 - DNA, 20 bp, Pinus taeda
cagaagatagagagcacaac

SEQ ID NO: 1610 - DNA, 20 bp, Populus trichocarpa
tgacagaagagagtgagcac

SEQ ID NO: 1611 - DNA, 20 bp, Populus trichocarpa
tgacagaagagagtgagcac

SEQ ID NO: 1612 - DNA, 20 bp, Populus trichocarpa
tgacagaagagagtgagcac

SEQ ID NO: 1613 - DNA, 20 bp, Populus trichocarpa
tgacagaagagagtgagcac

SEQ ID NO: 1614 - DNA, 20 bp, Populus trichocarpa
tgacagaagagagtgagcac

SEQ ID NO: 1615 - DNA, 20 bp, Populus trichocarpa
tgacagaagagagtgagcac

SEQ ID NO: 1616 - DNA, 21 bp, Populus trichocarpa
ttgacagaagatagagagcac

SEQ ID NO: 1617 - DNA, 21 bp, Populus trichocarpa
ttgacagaagatagagagcac

SEQ ID NO: 1618 - DNA, 21 bp, Populus trichocarpa
ttgacagaagatagagagcac

SEQ ID NO: 1619 - DNA, 21 bp, Populus trichocarpa
ttgacagaagatagagagcac

SEQ ID NO: 1620 - DNA, 20 bp, Populus trichocarpa
tgacagaagagagggagcac

SEQ ID NO: 1621 - DNA, 20 bp, Populus tremula
tgacagaagagagagagcac

SEQ ID NO: 1622 - DNA, 20 bp, Populus tremuloides
tgacagaagagagtgagcgc

SEQ ID NO: 1623 - DNA, 20 bp, Populus tremuloides
tgacagaagagagagagcac

SEQ ID NO: 1624 - DNA, 20 bp, Populus tremuloides
tgacagaagagagagagcac

SEQ ID NO: 1625 - DNA, 21 bp, Ricinus communis
tgacagaagagagtgagcaca

SEQ ID NO: 1626 - DNA, 21 bp, Ricinus communis
tgacagaagagagtgagcaca

SEQ ID NO: 1627 - DNA, 21 bp, Ricinus communis
tgacagaagagagtgagcaca

SEQ ID NO: 1628 - DNA, 21 bp, Ricinus communis
tgacagaagagagtgagcaca

SEQ ID NO: 1629 - DNA, 21 bp, Ricinus communis
tgacagaagagagagagcaca

SEQ ID NO: 1630 - DNA, 21 bp, Ricinus communis
ttgacagaagatagagagcac

SEQ ID NO: 1631 - DNA, 21 bp, Ricinus communis
ttgacagaagatagagagcac

SEQ ID NO: 1632 - DNA, 21 bp, Ricinus communis
ttgacagaagatagagagcac

SEQ ID NO: 1633 - DNA, 20 bp, Sorghum bicolor
tgacagaagagagtgagcac

SEQ ID NO: 1634 - DNA, 20 bp, Sorghum bicolor
tgacagaagagagtgagcac

SEQ ID NO: 1635 - DNA, 20 bp, Sorghum bicolor
tgacagaagagagtgagcac

SEQ ID NO: 1636 - DNA, 21 bp, Sorghum bicolor
tgacagaagagagagagcaca

SEQ ID NO: 1637 - DNA, 20 bp, Sorghum bicolor
tgacagaagagagcgagcac

SEQ ID NO: 1638 - DNA, 20 bp, Sorghum bicolor
tgacagaagagagtgagcac

SEQ ID NO: 1639 - DNA, 20 bp, Sorghum bicolor
tgacagaagagagtgagcac

SEQ ID NO: 1640 - DNA, 20 bp, Sorghum bicolor
tgacagaagagagtgagcac

SEQ ID NO: 1641 - DNA, 20 bp, Sorghum bicolor
tgacagaagagagtgagcac

SEQ ID NO: 1642 - DNA, 20 bp, Sesamum indicum
tgacagaagagagagagcac

SEQ ID NO: 1643 - DNA, 21 bp, Solanum lycopersicum
ttgacagaagatagagagcac

SEQ ID NO: 1644 - DNA, 21 bp, Solanum lycopersicum
ttgacagaagatagagagcac

SEQ ID NO: 1645 - DNA, 21 bp, Solanum lycopersicum
ttgacagaagatagagagcac

SEQ ID NO: 1646 - DNA, 20 bp, Selaginella moellendorffii
cgacagaagagagtgagcac

SEQ ID NO: 1647 - DNA, 21 bp, Selaginella moellendorffii
ctgacagaagatagagagcac

SEQ ID NO: 1648 - DNA, 21 bp, Selaginella moellendorffii
ttgacagaagaaagagagcac

SEQ ID NO: 1649 - DNA, 21 bp, Selaginella moellendorffii
ttgacagaagacagggagcac

SEQ ID NO: 1650 - DNA, 20 bp, Saccharum officinarum
tgacagaagagagtgagcac

SEQ ID NO: 1651 - DNA, 20 bp, Saccharum officinarum
tgacagaagagagagagcac

SEQ ID NO: 1652 - DNA, 20 bp, Saccharum officinarum
tgacagaagagagagagcac

SEQ ID NO: 1653 - DNA, 20 bp, Saccharum officinarum
tgacagaagagagagagcac

SEQ ID NO: 1654 - DNA, 20 bp, Saccharum officinarum
tgacagaagagagagagcac

SEQ ID NO: 1655 - DNA, 20 bp, Saccharum officinarum
tgacagaagagagagagcac

SEQ ID NO: 1656 - DNA, 20 bp, Saccharum officinarum
tgacagaagagagagagcac

SEQ ID NO: 1657 - DNA, 20 bp, Saccharum officinarum
tgacagaagagagagagcac

SEQ ID NO: 1658 - DNA, 20 bp, Sorghum Propinquum
tgacagaagagagagagcac

SEQ ID NO: 1659 - DNA, 21 bp, Saccharum spp
tgacagaagagagtgagcaca

SEQ ID NO: 1660 - DNA, 20 bp, Solanum tuberosum
tgacagaagagagtgagcac

SEQ ID NO: 1661 - DNA, 20 bp, Solanum tuberosum
tgacagaagagagagagcac

SEQ ID NO: 1662 - DNA, 20 bp, Solanum tuberosum
tgacagaagagagagagcac

SEQ ID NO: 1663 - DNA, 20 bp, Solanum tuberosum
tgacagaagagagagagcac

SEQ ID NO: 1664 - DNA, 20 bp, Solanum tuberosum
tgacagaagagagagagcac

SEQ ID NO: 1665 - DNA, 21 bp, Triticum aestivum
tgacagaagagagtgagcaca

SEQ ID NO: 1666 - DNA, 20 bp, Triticum aestivum
tgacagaagagagagagcac

SEQ ID NO: 1667 - DNA, 20 bp, Triticum aestivum
tgacagaagagagagagcac

SEQ ID NO: 1668 - DNA, 21 bp, Theobroma cacao
tgacagaagagagagagcaca

SEQ ID NO: 1669 - DNA, 20 bp, Theobroma cacao
tgacagaagagagtgagcac

SEQ ID NO: 1670 - DNA, 20 bp, Theobroma cacao
tgacagaagagagtgagcac

SEQ ID NO: 1671 - DNA, 20 bp, Theobroma cacao
tgacagaagagagtgagcac

SEQ ID NO: 1672 - DNA, 21 bp, Theobroma cacao
ttgacagaagatagagagcac

SEQ ID NO: 1673 - DNA, 21 bp, Theobroma cacao
ttgacagaagatagagagcac

SEQ ID NO: 1674 - DNA, 20 bp, Theobroma cacao
tgacagaagagagtgagcac

SEQ ID NO: 1675 - DNA, 20 bp, Trifolium repens
tgacagaagagagtgagcac

SEQ ID NO: 1676 - DNA, 20 bp, Vitis vinifera
tgacagaagagagggagcac

SEQ ID NO: 1677 - DNA, 20 bp, Vitis vinifera
tgacagaagagagtgagcac

SEQ ID NO: 1678 - DNA, 20 bp, Vitis vinifera
tgacagaagagagtgagcac

SEQ ID NO: 1679 - DNA, 20 bp, Vitis vinifera
tgacagaagagagtgagcac

SEQ ID NO: 1680 - DNA, 20 bp, Vitis vinifera
tgacagaggagagtgagcac

SEQ ID NO: 1681 - DNA, 21 bp, Vitis vinifera
ttgacagaagatagagagcac

SEQ ID NO: 1682 - DNA, 21 bp, Vitis vinifera
ttgacagaagatagagagcac

SEQ ID NO: 1683 - DNA, 20 bp, Vitis vinifera
tgacagaagagagagagcat

SEQ ID NO: 1684 - DNA, 21 bp, Vitis vinifera
ttgacagaagatagagagcac

SEQ ID NO: 1685 - DNA, 20 bp, Zinnia elegans
tgacagaagagagagagcac

SEQ ID NO: 1686 - DNA, 20 bp, Zea mays
tgacagaagagagtgagcac

SEQ ID NO: 1687 - DNA, 20 bp, Zea mays
tgacagaagagagtgagcac

SEQ ID NO: 1688 - DNA, 20 bp, Zea mays
tgacagaagagagtgagcac

SEQ ID NO: 1689 - DNA, 20 bp, Zea mays
tgacagaagagagtgagcac

SEQ ID NO: 1690 - DNA, 20 bp, Zea mays
tgacagaagagagtgagcac

SEQ ID NO: 1691 - DNA, 20 bp, Zea mays
tgacagaagagagtgagcac

SEQ ID NO: 1692 - DNA, 20 bp, Zea mays
tgacagaagagagtgagcac

SEQ ID NO: 1693 - DNA, 20 bp, Zea mays
tgacagaagagagtgagcac

SEQ ID NO: 1694 - DNA, 20 bp, Zea mays
tgacagaagagagtgagcac

SEQ ID NO: 1695 - DNA, 21 bp, Zea mays
tgacagaagagagagagcaca

SEQ ID NO: 1696 - DNA, 20 bp, Zea mays
tgacagaagagagcgagcac

SEQ ID NO: 1697 - DNA, 20 bp, Zea mays
tgacagaagagagtgagcac

SEQ ID NO: 1698 - DNA, 20 bp, Zea mays
tgacagaagagagtgagcac

SEQ ID NO: 1699 - DNA, 20 bp, Zea mays
tgacagaagagagtgagcac

SEQ ID NO: 1700 - DNA, 20 bp, Zea mays
tgacagaagagagtgagcac

SEQ ID NO: 1701 - DNA, 20 bp, Zea mays
tgacagaagagagagagcac

SEQ ID NO: 1702 - DNA, 20 bp, Zea mays
tgacagaagagagagagcac

SEQ ID NO: 1703 - DNA, 20 bp, Zea mays
tgacagaagagagtgggcac

SEQ ID NO: 1704 - DNA, 20 bp, Arachis hypogaea
tgacagaagagagagagcac

SEQ ID NO: 1705 - DNA, 21 bp, Arachis hypogaea
ttgacagaagatagagagcac

SEQ ID NO: 1706 - DNA, 21 bp, Arachis hypogaea
ttgacagaagagagagagcac

SEQ ID NO: 1707 - DNA, 20 bp, Arabidopsis lyrata
tgacagaagagagtgagcac

SEQ ID NO: 1708 - DNA, 20 bp, Arabidopsis lyrata
tgacagaagagagtgagcac

SEQ ID NO: 1709 - DNA, 20 bp, Arabidopsis lyrata
tgacagaagagagtgagcac

SEQ ID NO: 1710 - DNA, 20 bp, Arabidopsis lyrata
tgacagaagagagtgagcac

SEQ ID NO: 1711 - DNA, 20 bp, Arabidopsis lyrata
tgacagaagagagtgagcac

SEQ ID NO: 1712 - DNA, 20 bp, Arabidopsis lyrata
tgacagaagagagtgagcac

SEQ ID NO: 1713 - DNA, 20 bp, Arabidopsis lyrata
cgacagaagagagtgagcac

SEQ ID NO: 1714 - DNA, 20 bp, Arabidopsis lyrata
tgacagaagaaagagagcac

SEQ ID NO: 1715 - DNA, 20 bp, Aquilegia coerulea
tgacagaagatagagagcac

SEQ ID NO: 1716 - DNA, 20 bp, Aquilegia coerulea
tgacagaagatagagagcac

SEQ ID NO: 1717 - DNA, 20 bp, Arabidopsis thaliana
tgacagaagagagtgagcac

SEQ ID NO: 1718 - DNA, 20 bp, Arabidopsis thaliana
tgacagaagagagtgagcac

SEQ ID NO: 1719 - DNA, 20 bp, Arabidopsis thaliana
tgacagaagagagtgagcac

SEQ ID NO: 1720 - DNA, 20 bp, Arabidopsis thaliana
tgacagaagagagtgagcac

SEQ ID NO: 1721 - DNA, 20 bp, Arabidopsis thaliana
tgacagaagagagtgagcac

SEQ ID NO: 1722 - DNA, 20 bp, Arabidopsis thaliana
tgacagaagagagtgagcac

SEQ ID NO: 1723 - DNA, 20 bp, Arabidopsis thaliana
cgacagaagagagtgagcac

SEQ ID NO: 1724 - DNA, 20 bp, Arabidopsis thaliana
tgacagaagaaagagagcac

SEQ ID NO: 1725 - DNA, 20 bp, Arabidopsis thaliana
tgacagaagagagagagcac

SEQ ID NO: 1726 - DNA, 20 bp, Arabidopsis thaliana
tgacagaagagagagagcac

SEQ ID NO: 1727 - DNA, 20 bp, Arabidopsis thaliana
tgacagaagagagagagcac

SEQ ID NO: 1728 - DNA, 20 bp, Arabidopsis thaliana
tgacagaagagagagagcac

SEQ ID NO: 1729 - DNA, 20 bp, Arabidopsis thaliana
tgacagaagagagagagcac

SEQ ID NO: 1730 - DNA, 20 bp, Arabidopsis thaliana
tgacagaagagagagagcac

SEQ ID NO: 1731 - DNA, 21 bp, Brachypodium distachyon
tgacagaagagagagagcaca

SEQ ID NO: 1732 - DNA, 20 bp, Brachypodium distachyon
tgacagaagagagtgagcac

SEQ ID NO: 1733 - DNA, 20 bp, Brachypodium distachyon
tgacagaagagagtgagcac

SEQ ID NO: 1734 - DNA, 20 bp, Brachypodium distachyon
tgacagaagagagtgagcac

SEQ ID NO: 1735 - DNA, 21 bp, Brassica napus
tgacagaagagagtgagcaca

SEQ ID NO: 1736 - DNA, 21 bp, Brassica napus
ttgacagaagatagagagcac

SEQ ID NO: 1737 - DNA, 21 bp, Brassica napus
ttgacagaagatagagagcac

SEQ ID NO: 1738 - DNA, 20 bp, Capsicum annuum
tgacagaagagagagagcac

SEQ ID NO: 1739 - DNA, 20 bp, Capsicum annuum
tgacagaagagagggagcac

SEQ ID NO: 1740 - DNA, 20 bp, Citrus x paradisi x Poncirus trifoliata
tgacagaagagagtgagcac

SEQ ID NO: 1741 - DNA, 20 bp, Citrus x paradisi x Poncirus trifoliata
tgacagaagagagagagcac

SEQ ID NO: 1742 - DNA, 20 bp, Cycas rumphii
tgacagaagagagagagcac

SEQ ID NO: 1743 - DNA, 20 bp, Citrus sinensis
tgacagaagagagtgagcac

SEQ ID NO: 1744 - DNA, 20 bp, Citrus sinensis
tgacagaagagagagagcac

SEQ ID NO: 1745 - DNA, 20 bp, Citrus sinensis
tgacagaagagagagagcac

SEQ ID NO: 1746 - DNA, 20 bp, Citrus trifoliata
tgacagaagagagtgagcac

SEQ ID NO: 1747 - DNA, 20 bp, Eschscholzia californica
tgacagaagagagagagcac

SEQ ID NO: 1748 - DNA, 21 bp, Festuca arundinacea
tgacagaagagagagagcaca

SEQ ID NO: 1749 - DNA, 21 bp, Festuca arundinacea
ttgacagaagagagagagcac

SEQ ID NO: 1750 - DNA, 20 bp, Gossypium hirsutum
tgacagaagagagtgagcac

SEQ ID NO: 1751 - DNA, 20 bp, Gossypium hirsutum
tgacagaagagagtgagcac

SEQ ID NO: 1752 - DNA, 20 bp, Gossypium hirsutum
tgtcagaagagagtgagcac

SEQ ID NO: 1753 - DNA, 20 bp, Gossypium hirsutum
tgacagaagagagtgagcac

SEQ ID NO: 1754 - DNA, 20 bp, Glycine max
tgacagaagagagtgagcac

SEQ ID NO: 1755 - DNA, 21 bp, Glycine max
tgacagaagagagagagcaca

SEQ ID NO: 1756 - DNA, 21 bp, Glycine max
ttgacagaagatagagagcac

SEQ ID NO: 1757 - DNA, 21 bp, Glycine max
ttgacagaagatagagagcac

SEQ ID NO: 1758 - DNA, 21 bp, Glycine max
ttgacagaagatagagagcac

SEQ ID NO: 1759 - DNA, 22 bp, Glycine max
ttgacagaagagagagagcaca

SEQ ID NO: 1760 - DNA, 20 bp, Glycine max
acagaagatagagagcacag

SEQ ID NO: 1761 - DNA, 20 bp, Glycine max
tgacagaagagagagagcac

SEQ ID NO: 1762 - DNA, 20 bp, Glycine max
tgacagaagagagagagcac

SEQ ID NO: 1763 - DNA, 20 bp, Helianthus annuus
tgacagaagagagagagcac

SEQ ID NO: 1764 - DNA, 20 bp, Hordeum vulgare subsp. Spontaneum
tgacagaagagagagagcac

SEQ ID NO: 1765 - DNA, 21 bp, Hordeum vulgare
tgacagaagagagtgagcaca

SEQ ID NO: 1766 - DNA, 20 bp, Hordeum vulgare subsp. Vulgare
tgacagaagagagtgagcac

SEQ ID NO: 1767 - DNA, 20 bp, Hordeum vulgare subsp. Vulgare
tgacagaagagagagagcac

SEQ ID NO: 1768 - DNA, 20 bp, Hordeum vulgare subsp. Vulgare
tgacagaagagagagagcac

SEQ ID NO: 1769 - DNA, 20 bp, Hordeum vulgare subsp. Vulgare
tgacagaagagagagagcac

SEQ ID NO: 1770 - DNA, 20 bp, Lotus japonicus
tgacagaagagagagagcac

SEQ ID NO: 1771 - DNA, 20 bp, Lactuca sativa
tgacagaagagagagagcac

SEQ ID NO: 1772 - DNA, 20 bp, Malus x domestica
tgacagaagagagagagcac

SEQ ID NO: 1773 - DNA, 20 bp, Malus x domestica
tgacagaagagagagagcac

SEQ ID NO: 1774 - DNA, 21 bp, Medicago truncatula
tgacagaagagagagagcaca

SEQ ID NO: 1775 - DNA, 20 bp, Medicago truncatula
tgacagaagagagtgagcac

SEQ ID NO: 1776 - DNA, 20 bp, Medicago truncatula
tgacagaagagagtgagcac

SEQ ID NO: 1777 - DNA, 20 bp, Medicago truncatula
tgacagaagagagtgagcac

SEQ ID NO: 1778 - DNA, 21 bp, Medicago truncatula
ttgacagaagatagagagcac

SEQ ID NO: 1779 - DNA, 21 bp, Medicago truncatula
ttgacagaagatagagagcac

SEQ ID NO: 1780 - DNA, 21 bp, Medicago truncatula
ttgacagaagatagagggcac

SEQ ID NO: 1781 - DNA, 21 bp, Medicago truncatula
ttgacagaagatagagagcac

SEQ ID NO: 1782 - DNA, 20 bp, Medicago truncatula
tgacagaagagagtgagcac

SEQ ID NO: 1783 - DNA, 20 bp, Nicotiana benthamiana
tgacagaagagagagagcac

SEQ ID NO: 1784 - DNA, 20 bp, Nicotiana benthamiana
tgacagaagagagagagcac

SEQ ID NO: 1785 - DNA, 20 bp, Oryza rufipogon
tgacagaagagagtgagcac

SEQ ID NO: 1786 - DNA, 20 bp, Oryza sativa
tgacagaagagagtgagcac

SEQ ID NO: 1787 - DNA, 20 bp, Oryza sativa
tgacagaagagagtgagcac

SEQ ID NO: 1788 - DNA, 20 bp, Oryza sativa
tgacagaagagagtgagcac

SEQ ID NO: 1789 - DNA, 20 bp, Oryza sativa
tgacagaagagagtgagcac

SEQ ID NO: 1790 - DNA, 20 bp, Oryza sativa
tgacagaagagagtgagcac

SEQ ID NO: 1791 - DNA, 20 bp, Oryza sativa
tgacagaagagagtgagcac

SEQ ID NO: 1792 - DNA, 20 bp, Oryza sativa
tgacagaagagagtgagcac

SEQ ID NO: 1793 - DNA, 20 bp, Oryza sativa
tgacagaagagagtgagcac

SEQ ID NO: 1794 - DNA, 20 bp, Oryza sativa
tgacagaagagagtgagcac

SEQ ID NO: 1795 - DNA, 20 bp, Oryza sativa
tgacagaagagagtgagcac

SEQ ID NO: 1796 - DNA, 21 bp, Oryza sativa
tgacagaagagagagagcaca

SEQ ID NO: 1797 - DNA, 21 bp, Oryza sativa
cgacagaagagagtgagcata

SEQ ID NO: 1798 - DNA, 20 bp, Oryza sativa
tgacagaagagagtgagcac

SEQ ID NO: 1799 - DNA, 20 bp, Oryza sativa
tgacagaagagagtgagcac

SEQ ID NO: 1800 - DNA, 20 bp, Oryza sativa
tgacagaagagagtgagcat

SEQ ID NO: 1801 - DNA, 20 bp, Oryza sativa
tgacagaagagagtgagctc

SEQ ID NO: 1802 - DNA, 20 bp, Oryza sativa
tgacagaacagagtgagcac

SEQ ID NO: 1803 - DNA, 20 bp, Oryza sativa
tgacagaagagagagagcac

SEQ ID NO: 1804 - DNA, 20 bp, Prunus armeniaca
tgacagaagagagagagcac

SEQ ID NO: 1805 - DNA, 20 bp, Populus trichocarpa x Populus deltoides
tgacagaagagagagagcac

SEQ ID NO: 1806 - DNA, 20 bp, Phleum pratense
tgacagaagagagtgagcac

SEQ ID NO: 1807 - DNA, 20 bp, Physcomitrella patens
tgacagaagagagtgagcac

SEQ ID NO: 1808 - DNA, 20 bp, Physcomitrella patens
tgacagaagagagtgagcac

SEQ ID NO: 1809 - DNA, 20 bp, Physcomitrella patens
tgacagaagagagtgagcac

SEQ ID NO: 1810 - DNA, 20 bp, Pinus taeda
cagaagatagagagcacatc

SEQ ID NO: 1811 - DNA, 20 bp, Pinus taeda
cagaagatagagagcacaac

SEQ ID NO: 1812 - DNA, 20 bp, Populus trichocarpa
tgacagaagagagtgagcac

SEQ ID NO: 1813 - DNA, 20 bp, Populus trichocarpa
tgacagaagagagtgagcac

SEQ ID NO: 1814 - DNA, 20 bp, Populus trichocarpa
tgacagaagagagtgagcac

SEQ ID NO: 1815 - DNA, 20 bp, Populus trichocarpa
tgacagaagagagtgagcac

SEQ ID NO: 1816 - DNA, 20 bp, Populus trichocarpa
tgacagaagagagtgagcac

SEQ ID NO: 1817 - DNA, 20 bp, Populus trichocarpa
tgacagaagagagtgagcac

SEQ ID NO: 1818 - DNA, 21 bp, Populus trichocarpa
ttgacagaagatagagagcac

SEQ ID NO: 1819 - DNA, 21 bp, Populus trichocarpa
ttgacagaagatagagagcac

SEQ ID NO: 1820 - DNA, 21 bp, Populus trichocarpa
ttgacagaagatagagagcac

SEQ ID NO: 1821 - DNA, 21 bp, Populus trichocarpa
ttgacagaagatagagagcac

SEQ ID NO: 1822 - DNA, 20 bp, Populus trichocarpa
tgacagaagagagggagcac

SEQ ID NO: 1823 - DNA, 20 bp, Populus tremula
tgacagaagagagagagcac

SEQ ID NO: 1824 - DNA, 20 bp, Populus tremuloides
tgacagaagagagtgagcgc

SEQ ID NO: 1825 - DNA, 20 bp, Populus tremuloides
tgacagaagagagagagcac

SEQ ID NO: 1826 - DNA, 20 bp, Populus tremuloides
tgacagaagagagagagcac

SEQ ID NO: 1827 - DNA, 21 bp, Ricinus communis
tgacagaagagagtgagcaca

SEQ ID NO: 1828 - DNA, 21 bp, Ricinus communis
tgacagaagagagtgagcaca

SEQ ID NO: 1829 - DNA, 21 bp, Ricinus communis
tgacagaagagagtgagcaca

SEQ ID NO: 1830 - DNA, 21 bp, Ricinus communis
tgacagaagagagtgagcaca

SEQ ID NO: 1831 - DNA, 21 bp, Ricinus communis
tgacagaagagagagagcaca

SEQ ID NO: 1832 - DNA, 21 bp, Ricinus communis
ttgacagaagatagagagcac

SEQ ID NO: 1833 - DNA, 21 bp, Ricinus communis
ttgacagaagatagagagcac

SEQ ID NO: 1834 - DNA, 21 bp, Ricinus communis
ttgacagaagatagagagcac

SEQ ID NO: 1835 - DNA, 20 bp, Sorghum bicolor
tgacagaagagagtgagcac

SEQ ID NO: 1836 - DNA, 20 bp, Sorghum bicolor
tgacagaagagagtgagcac

SEQ ID NO: 1837 - DNA, 20 bp, Sorghum bicolor
tgacagaagagagtgagcac

SEQ ID NO: 1838 - DNA, 21 bp, Sorghum bicolor
tgacagaagagagagagcaca

SEQ ID NO: 1839 - DNA, 20 bp, Sorghum bicolor
tgacagaagagagcgagcac

SEQ ID NO: 1840 - DNA, 20 bp, Sorghum bicolor
tgacagaagagagtgagcac

SEQ ID NO: 1841 - DNA, 20 bp, Sorghum bicolor
tgacagaagagagtgagcac

SEQ ID NO: 1842 - DNA, 20 bp, Sorghum bicolor
tgacagaagagagtgagcac

SEQ ID NO: 1843 - DNA, 20 bp, Sorghum bicolor
tgacagaagagagtgagcac

SEQ ID NO: 1844 - DNA, 20 bp, Sesamum indicum
tgacagaagagagagagcac

SEQ ID NO: 1845 - DNA, 21 bp, Solanum lycopersicum
ttgacagaagatagagagcac

SEQ ID NO: 1846 - DNA, 21 bp, Solanum lycopersicum
ttgacagaagatagagagcac

SEQ ID NO: 1847 - DNA, 21 bp, Solanum lycopersicum
ttgacagaagatagagagcac

SEQ ID NO: 1848 - DNA, 20 bp, Selaginella moellendorffii
cgacagaagagagtgagcac

SEQ ID NO: 1849 - DNA, 21 bp, Selaginella moellendorffii
ttgacagaagaaagagagcac

SEQ ID NO: 1850 - DNA, 21 bp, Selaginella moellendorffii
ttgacagaagacagggagcac

SEQ ID NO: 1851 - DNA, 20 bp, Saccharum officinarum
tgacagaagagagtgagcac

SEQ ID NO: 1852 - DNA, 20 bp, Saccharum officinarum
tgacagaagagagagagcac

SEQ ID NO: 1853 - DNA, 20 bp, Saccharum officinarum
tgacagaagagagagagcac

SEQ ID NO: 1854 - DNA, 20 bp, Saccharum officinarum
tgacagaagagagagagcac

SEQ ID NO: 1855 - DNA, 20 bp, Saccharum officinarum
tgacagaagagagagagcac

SEQ ID NO: 1856 - DNA, 20 bp, Saccharum officinarum
tgacagaagagagagagcac

SEQ ID NO: 1857 - DNA, 20 bp, Saccharum officinarum
tgacagaagagagagagcac

SEQ ID NO: 1858 - DNA, 20 bp, Saccharum officinarum
tgacagaagagagagagcac

SEQ ID NO: 1859 - DNA, 20 bp, Sorghum Propinquum
tgacagaagagagagagcac

SEQ ID NO: 1860 - DNA, 21 bp, Saccharum spp
tgacagaagagagtgagcaca

SEQ ID NO: 1861 - DNA, 20 bp, Solanum tuberosum
tgacagaagagagtgagcac

SEQ ID NO: 1862 - DNA, 20 bp, Solanum tuberosum
tgacagaagagagagagcac

SEQ ID NO: 1863 - DNA, 20 bp, Solanum tuberosum
tgacagaagagagagagcac

SEQ ID NO: 1864 - DNA, 20 bp, Solanum tuberosum
tgacagaagagagagagcac

SEQ ID NO: 1865 - DNA, 20 bp, Solanum tuberosum
tgacagaagagagagagcac

SEQ ID NO: 1866 - DNA, 21 bp, Triticum aestivum
tgacagaagagagtgagcaca

SEQ ID NO: 1867 - DNA, 20 bp, Triticum aestivum
tgacagaagagagagagcac

SEQ ID NO: 1868 - DNA, 20 bp, Triticum aestivum
tgacagaagagagagagcac

SEQ ID NO: 1869 - DNA, 21 bp, Theobroma cacao
tgacagaagagagagagcaca

SEQ ID NO: 1870 - DNA, 20 bp, Theobroma cacao
tgacagaagagagtgagcac

SEQ ID NO: 1871 - DNA, 20 bp, Theobroma cacao
tgacagaagagagtgagcac

SEQ ID NO: 1872 - DNA, 20 bp, Theobroma cacao
tgacagaagagagtgagcac

SEQ ID NO: 1873 - DNA, 21 bp, Theobroma cacao
ttgacagaagatagagagcac

SEQ ID NO: 1874 - DNA, 21 bp, Theobroma cacao
ttgacagaagatagagagcac

SEQ ID NO: 1875 - DNA, 20 bp, Theobroma cacao
tgacagaagagagtgagcac

SEQ ID NO: 1876 - DNA, 20 bp, Trifolium repens
tgacagaagagagtgagcac

SEQ ID NO: 1877 - DNA, 20 bp, Vitis vinifera
tgacagaagagagggagcac

SEQ ID NO: 1878 - DNA, 20 bp, Vitis vinifera
tgacagaagagagtgagcac

SEQ ID NO: 1879 - DNA, 20 bp, Vitis vinifera
tgacagaagagagtgagcac

SEQ ID NO: 1880 - DNA, 20 bp, Vitis vinifera
tgacagaagagagtgagcac

SEQ ID NO: 1881 - DNA, 20 bp, Vitis vinifera
tgacagaggagagtgagcac

SEQ ID NO: 1882 - DNA, 21 bp, Vitis vinifera
ttgacagaagatagagagcac

SEQ ID NO: 1883 - DNA, 21 bp, Vitis vinifera
ttgacagaagatagagagcac

SEQ ID NO: 1884 - DNA, 20 bp, Vitis vinifera
tgacagaagagagagagcat

SEQ ID NO: 1885 - DNA, 21 bp, Vitis vinifera
ttgacagaagatagagagcac

SEQ ID NO: 1886 - DNA, 20 bp, Zinnia elegans
tgacagaagagagagagcac

SEQ ID NO: 1887 - DNA, 20 bp, Zea mays
tgacagaagagagtgagcac

SEQ ID NO: 1888 - DNA, 20 bp, Zea mays
tgacagaagagagtgagcac

SEQ ID NO: 1889 - DNA, 20 bp, Zea mays
tgacagaagagagtgagcac

SEQ ID NO: 1890 - DNA, 20 bp, Zea mays
tgacagaagagagtgagcac

SEQ ID NO: 1891 - DNA, 20 bp, Zea mays
tgacagaagagagtgagcac

SEQ ID NO: 1892 - DNA, 20 bp, Zea mays
tgacagaagagagtgagcac

SEQ ID NO: 1893 - DNA, 20 bp, Zea mays
tgacagaagagagtgagcac

SEQ ID NO: 1894 - DNA, 20 bp, Zea mays
tgacagaagagagtgagcac

SEQ ID NO: 1895 - DNA, 20 bp, Zea mays
tgacagaagagagtgagcac

SEQ ID NO: 1896 - DNA, 21 bp, Zea mays
tgacagaagagagagagcaca

SEQ ID NO: 1897 - DNA, 20 bp, Zea mays
tgacagaagagagcgagcac

SEQ ID NO: 1898 - DNA, 20 bp, Zea mays
tgacagaagagagtgagcac

SEQ ID NO: 1899 - DNA, 20 bp, Zea mays
tgacagaagagagtgagcac

SEQ ID NO: 1900 - DNA, 20 bp, Zea mays
tgacagaagagagtgagcac

SEQ ID NO: 1901 - DNA, 20 bp, Zea mays
tgacagaagagagtgagcac

SEQ ID NO: 1902 - DNA, 20 bp, Zea mays
tgacagaagagagagagcac

SEQ ID NO: 1903 - DNA, 20 bp, Zea mays
tgacagaagagagagagcac

SEQ ID NO: 1904 - DNA, 20 bp, Zea mays
tgacagaagagagtgggcac

SEQ ID NO: 1905 - DNA, 21 bp, Arabidopsis cebennensis
ttggactgaagggagctccct

SEQ ID NO: 1906 - DNA, 21 bp, Arabidopsis halleri
ttggactgaagggagctccct

SEQ ID NO: 1907 - DNA, 21 bp, Arabis hirsuta
ttggactgaagggagctccct

SEQ ID NO: 1908 - DNA, 21 bp, Arachis hypogaea
tttggattgaagggagctcta

SEQ ID NO: 1909 - DNA, 21 bp, Arabidopsis lyrata
tttggattgaagggagctcta

SEQ ID NO: 1910 - DNA, 21 bp, Arabidopsis lyrata
tttggattgaagggagctctt

SEQ ID NO: 1911 - DNA, 21 bp, Arabidopsis lyrata
tttggattgaagggagctcct

SEQ ID NO: 1912 - DNA, 21 bp, Alliaria petiolata
ttggactgaagggagctccct

SEQ ID NO: 1913 - DNA, 21 bp, Aquilegia coerulea
tttggactgaagggagctcta

SEQ ID NO: 1914 - DNA, 21 bp, Arabidopsis thaliana
tttggattgaagggagctcta

SEQ ID NO: 1915 - DNA, 21 bp, Arabidopsis thaliana
tttggattgaagggagctctt

SEQ ID NO: 1916 - DNA, 21 bp, Arabidopsis thaliana
tttggattgaagggagctcct

SEQ ID NO: 1917 - DNA, 20 bp, Brachypodium distachyon
cttggattgaagggagctct

SEQ ID NO: 1918 - DNA, 21 bp, Brassica napus
tttggattgaagggagctcta

SEQ ID NO: 1919 - DNA, 21 bp, Brassica rapa
tttggattgaagggagctcta

SEQ ID NO: 1920 - DNA, 21 bp, Barbarea vulgaris
ttggactgaagggagctccct

SEQ ID NO: 1921 - DNA, 21 bp, Camelina microcarpa
ttggactgaagggagctccct

SEQ ID NO: 1922 - DNA, 21 bp, Conringia orientalis
ttggactgaagggagctccct

SEQ ID NO: 1923 - DNA, 21 bp, Capsella rubella
ttggactgaagggagctccct

SEQ ID NO: 1924 - DNA, 21 bp, Citrus sinensis
tttggattgaagggagctcta

SEQ ID NO: 1925 - DNA, 21 bp, Descurainia sophia
ttggactgaagggagctccct

SEQ ID NO: 1926 - DNA, 21 bp, Erysimum cheiri
ttggactgaagggagctccct

SEQ ID NO: 1927 - DNA, 21 bp, Fourraea alpina
ttggactgaagggagctccct

SEQ ID NO: 1928 - DNA, 21 bp, Festuca arundinacea
tttggattgaagggagctctg

SEQ ID NO: 1929 - DNA, 21 bp, Glycine max
attggagtgaagggagctcca

SEQ ID NO: 1930 - DNA, 21 bp, Glycine max
attggagtgaagggagctccg

SEQ ID NO: 1931 - DNA, 21 bp, Hordeum vulgare
tttggattgaagggagctctg

SEQ ID NO: 1932 - DNA, 21 bp, Hordeum vulgare
tttggattgaagggagctctg

SEQ ID NO: 1933 - DNA, 21 bp, Hordeum vulgare subsp. Vulgare
tttggattgaagggagctctg

SEQ ID NO: 1934 - DNA, 21 bp, Hordeum vulgare subsp. Vulgare
tttggattgaagggagctctg

SEQ ID NO: 1935 - DNA, 21 bp, Liriodendron tulipifera
tttggattgaagggagctcta

SEQ ID NO: 1936 - DNA, 21 bp, Malcolmia maritima
ttggactgaagggagctccct

SEQ ID NO: 1937 - DNA, 21 bp, Medicago truncatula
tttggattgaagggagctcta

SEQ ID NO: 1938 - DNA, 21 bp, Medicago truncatula
attgaattgaagggagcaact

SEQ ID NO: 1939 - DNA, 21 bp, Medicago truncatula
tttggattgaagggagctcta

SEQ ID NO: 1940 - DNA, 21 bp, Nasturtium officinale
ttggactgaagggagctccct

SEQ ID NO: 1941 - DNA, 21 bp, Oryza rufipogon
tttggattgaagggagctctg

SEQ ID NO: 1942 - DNA, 21 bp, Oryza sativa
tttggattgaagggagctctg

SEQ ID NO: 1943 - DNA, 21 bp, Oryza sativa
tttggattgaagggagctctg

SEQ ID NO: 1944 - DNA, 21 bp, Oryza sativa
tttggattgaagggagctctg

SEQ ID NO: 1945 - DNA, 21 bp, Oryza sativa
attggattgaagggagctcca

SEQ ID NO: 1946 - DNA, 21 bp, Oryza sativa
attggattgaagggagctccg

SEQ ID NO: 1947 - DNA, 21 bp, Oryza sativa
attggattgaagggagctcct

SEQ ID NO: 1948 - DNA, 21 bp, Oryza sativa
cttggattgaagggagctcta

SEQ ID NO: 1949 - DNA, 21 bp, Oryza sativa
tttggattgaagggagctctg

SEQ ID NO: 1950 - DNA, 21 bp, Pennisetum glaucum
tttggattgaagggagctctg

SEQ ID NO: 1951 - DNA, 21 bp, Picea sitchensis
cttggattgaagggagctcca

SEQ ID NO: 1952 - DNA, 20 bp, Pinus taeda
ttggattgaagggagctcca

SEQ ID NO: 1953 - DNA, 20 bp, Pinus taeda
ttggattgaagagagctccc

SEQ ID NO: 1954 - DNA, 21 bp, Pinus taeda
cttggattgaagggagctccc

SEQ ID NO: 1955 - DNA, 21 bp, Populus trichocarpa
tttggattgaagggagctcta

SEQ ID NO: 1956 - DNA, 21 bp, Populus trichocarpa
tttggattgaagggagctcta

SEQ ID NO: 1957 - DNA, 21 bp, Populus trichocarpa
tttggattgaagggagctcta

SEQ ID NO: 1958 - DNA, 21 bp, Populus trichocarpa
cttggattgaagggagctcct

SEQ ID NO: 1959 - DNA, 21 bp, Populus trichocarpa
cttggggtgaagggagctcct

SEQ ID NO: 1960 - DNA, 21 bp, Populus trichocarpa
attggagtgaagggagctcga

SEQ ID NO: 1961 - DNA, 21 bp, Phaseolus vulgaris
tttggattgaagggagctcta

SEQ ID NO: 1962 - DNA, 21 bp, Phaseolus vulgaris
tttggattgaagggagctcta

SEQ ID NO: 1963 - DNA, 21 bp, Ricinus communis
tttggattgaagggagctcta

SEQ ID NO: 1964 - DNA, 21 bp, Rorippa indica
ttggactgaagggagctccct

SEQ ID NO: 1965 - DNA, 21 bp, Schedonorus arundinaceus
tttggattgaagggagctctg

SEQ ID NO: 1966 - DNA, 21 bp, Sorghum bicolor
tttggattgaagggagctctg

SEQ ID NO: 1967 - DNA, 21 bp, Sorghum bicolor
cttggattgaagggagctcct

SEQ ID NO: 1968 - DNA, 21 bp, Solanum lycopersicum
tttggattgaagggagctcta

SEQ ID NO: 1969 - DNA, 21 bp, Selaginella moellendorffii
cttggattgaagggagctccc

SEQ ID NO: 1970 - DNA, 21 bp, Saccharum officinarum
tttggattgaagggagctctg

SEQ ID NO: 1971 - DNA, 21 bp, Saccharum officinarum
tttggattgaagggagctctg

SEQ ID NO: 1972 - DNA, 21 bp, Saccharum officinarum
cttggattgaagggagctcct

SEQ ID NO: 1973 - DNA, 21 bp, Saccharum officinarum
tttggattgaagggagctctg

SEQ ID NO: 1974 - DNA, 21 bp, Saccharum officinarum
tttggattgaaaggagctctt

SEQ ID NO: 1975 - DNA, 21 bp, Sorghum Propinquum
tttggattgaagggagctctg

SEQ ID NO: 1976 - DNA, 21 bp, Saccharum spp
tttggattgaagggagctctg

SEQ ID NO: 1977 - DNA, 21 bp, Sibara virginica
ttggactgaagggagctccct

SEQ ID NO: 1978 - DNA, 21 bp, Triticum aestivum
tttggattgaagggagctctg

SEQ ID NO: 1979 - DNA, 21 bp, Triticum aestivum
tttggattgaagggagctctg

SEQ ID NO: 1980 - DNA, 21 bp, Thlaspi arvense
ttggactgaagggagctccct

SEQ ID NO: 1981 - DNA, 21 bp, Vitis vinifera
cttggagtgaagggagctctc

SEQ ID NO: 1982 - DNA, 21 bp, Vitis vinifera
cttggagtgaagggagctctc

SEQ ID NO: 1983 - DNA, 21 bp, Vitis vinifera
tttggattgaagggagctcta

SEQ ID NO: 1984 - DNA, 21 bp, Zea mays
tttggattgaagggagctctg

SEQ ID NO: 1985 - DNA, 21 bp, Zea mays
tttggattgaagggagctctg

SEQ ID NO: 1986 - DNA, 21 bp, Zea mays
cttggattgaagggagctcct

SEQ ID NO: 1987 - DNA, 21 bp, Zea mays
cttggattgaagggagctcct

SEQ ID NO: 1988 - DNA, 21 bp, Zea mays
attggtttgaagggagctcca

SEQ ID NO: 1989 - DNA, 21 bp, Zea mays
tttggattgaagggagctctg

SEQ ID NO: 1990 - DNA, 21 bp, Zea mays
tttggagtgaagggagttctg

SEQ ID NO: 1991 - DNA, 21 bp, Zea mays
tttggagtgaagggagctctg

SEQ ID NO: 1992 - DNA, 21 bp, Zea mays
tttggagtgaagggagctctg

SEQ ID NO: 1993 - DNA, 21 bp, Zea mays
tttggattgaagggagctctg

SEQ ID NO: 1994 - DNA, 21 bp, Zea mays
tttggattgaagggagctctg

SEQ ID NO: 1995 - DNA, 21 bp, Zea mays
tttggattgaagggagctctg

SEQ ID NO: 1996 - DNA, 21 bp, Arabidopsis cebennensis
ttggactgaagggagctccct

SEQ ID NO: 1997 - DNA, 21 bp, Arabidopsis halleri
ttggactgaagggagctccct

SEQ ID NO: 1998 - DNA, 21 bp, Arabis hirsuta
ttggactgaagggagctccct

SEQ ID NO: 1999 - DNA, 21 bp, Arachis hypogaea
tttggattgaagggagctcta

SEQ ID NO: 2000 - DNA, 21 bp, Arabidopsis lyrata
tttggattgaagggagctcta

SEQ ID NO: 2001 - DNA, 21 bp, Arabidopsis lyrata
tttggattgaagggagctctt

SEQ ID NO: 2002 - DNA, 21 bp, Arabidopsis lyrata
tttggattgaagggagctcct

SEQ ID NO: 2003 - DNA, 21 bp, Alliaria petiolata
ttggactgaagggagctccct

SEQ ID NO: 2004 - DNA, 21 bp, Aquilegia coerulea
tttggactgaagggagctcta

SEQ ID NO: 2005 - DNA, 21 bp, Arabidopsis thaliana
tttggattgaagggagctcta

SEQ ID NO: 2006 - DNA, 21 bp, Arabidopsis thaliana
tttggattgaagggagctctt

SEQ ID NO: 2007 - DNA, 21 bp, Arabidopsis thaliana
tttggattgaagggagctcct

SEQ ID NO: 2008 - DNA, 20 bp, Brachypodium distachyon
cttggattgaagggagctct

SEQ ID NO: 2009 - DNA, 21 bp, Brassica napus
tttggattgaagggagctcta

SEQ ID NO: 2010 - DNA, 21 bp, Brassica rapa
tttggattgaagggagctcta

SEQ ID NO: 2011 - DNA, 21 bp, Barbarea vulgaris
ttggactgaagggagctccct

SEQ ID NO: 2012 - DNA, 21 bp, Camelina microcarpa
ttggactgaagggagctccct

SEQ ID NO: 2013 - DNA, 21 bp, Conringia orientalis
ttggactgaagggagctccct

SEQ ID NO: 2014 - DNA, 21 bp, Capsella rubella
ttggactgaagggagctccct

SEQ ID NO: 2015 - DNA, 21 bp, Citrus sinensis
tttggattgaagggagctcta

SEQ ID NO: 2016 - DNA, 21 bp, Descurainia sophia
ttggactgaagggagctccct

SEQ ID NO: 2017 - DNA, 21 bp, Erysimum cheiri
ttggactgaagggagctccct

SEQ ID NO: 2018 - DNA, 21 bp, Fourraea alpina
ttggactgaagggagctccct

SEQ ID NO: 2019 - DNA, 21 bp, Festuca arundinacea
tttggattgaagggagctctg

SEQ ID NO: 2020 - DNA, 21 bp, Glycine max
tttggattgaagggagctcta

SEQ ID NO: 2021 - DNA, 21 bp, Glycine max
attggagtgaagggagctcca

SEQ ID NO: 2022 - DNA, 21 bp, Glycine max
attggagtgaagggagctccg

SEQ ID NO: 2023 - DNA, 21 bp, Hordeum vulgare
tttggattgaagggagctctg

SEQ ID NO: 2024 - DNA, 21 bp, Hordeum vulgare
tttggattgaagggagctctg

SEQ ID NO: 2025 - DNA, 21 bp, Hordeum vulgare subsp. Vulgare
tttggattgaagggagctctg

SEQ ID NO: 2026 - DNA, 21 bp, Hordeum vulgare subsp. Vulgare
tttggattgaagggagctctg

SEQ ID NO: 2027 - DNA, 21 bp, Liriodendron tulipifera
tttggattgaagggagctcta

SEQ ID NO: 2028 - DNA, 21 bp, Malcolmia maritima
ttggactgaagggagctccct

SEQ ID NO: 2029 - DNA, 21 bp, Medicago truncatula
tttggattgaagggagctcta

SEQ ID NO: 2030 - DNA, 21 bp, Medicago truncatula
attgaattgaagggagcaact

SEQ ID NO: 2031 - DNA, 21 bp, Medicago truncatula
tttggattgaagggagctcta

SEQ ID NO: 2032 - DNA, 21 bp, Nasturtium officinale
ttggactgaagggagctccct

SEQ ID NO: 2033 - DNA, 21 bp, Oryza rufipogon
tttggattgaagggagctctg

SEQ ID NO: 2034 - DNA, 21 bp, Oryza sativa
tttggattgaagggagctctg

SEQ ID NO: 2035 - DNA, 21 bp, Oryza sativa
tttggattgaagggagctctg

SEQ ID NO: 2036 - DNA, 21 bp, Oryza sativa
tttggattgaagggagctctg

SEQ ID NO: 2037 - DNA, 21 bp, Oryza sativa
attggattgaagggagctcca

SEQ ID NO: 2038 - DNA, 21 bp, Oryza sativa
attggattgaagggagctccg

SEQ ID NO: 2039 - DNA, 21 bp, Oryza sativa
attggattgaagggagctcct

SEQ ID NO: 2040 - DNA, 21 bp, Oryza sativa
cttggattgaagggagctcta

SEQ ID NO: 2041 - DNA, 21 bp, Oryza sativa
tttggattgaagggagctctg

SEQ ID NO: 2042 - DNA, 21 bp, Pennisetum glaucum
tttggattgaagggagctctg

SEQ ID NO: 2043 - DNA, 21 bp, Picea sitchensis
cttggattgaagggagctcca

SEQ ID NO: 2044 - DNA, 20 bp, Pinus taeda
ttggattgaagggagctcca

SEQ ID NO: 2045 - DNA, 20 bp, Pinus taeda
ttggattgaagagagctccc

SEQ ID NO: 2046 - DNA, 21 bp, Pinus taeda
cttggattgaagggagctccc

SEQ ID NO: 2047 - DNA, 21 bp, Populus trichocarpa
tttggattgaagggagctcta

SEQ ID NO: 2048 - DNA, 21 bp, Populus trichocarpa
tttggattgaagggagctcta

SEQ ID NO: 2049 - DNA, 21 bp, Populus trichocarpa
tttggattgaagggagctcta

SEQ ID NO: 2050 - DNA, 21 bp, Populus trichocarpa
cttggattgaagggagctcct

SEQ ID NO: 2051 - DNA, 21 bp, Populus trichocarpa
cttggggtgaagggagctcct

SEQ ID NO: 2052 - DNA, 21 bp, Populus trichocarpa
attggagtgaagggagctcga

SEQ ID NO: 2053 - DNA, 21 bp, Phaseolus vulgaris
tttggattgaagggagctcta

SEQ ID NO: 2054 - DNA, 21 bp, Phaseolus vulgaris
tttggattgaagggagctcta

SEQ ID NO: 2055 - DNA, 21 bp, Ricinus communis
tttggattgaagggagctcta

SEQ ID NO: 2056 - DNA, 21 bp, Rorippa indica
ttggactgaagggagctccct

SEQ ID NO: 2057 - DNA, 21 bp, Schedonorus arundinaceus
tttggattgaagggagctctg

SEQ ID NO: 2058 - DNA, 21 bp, Sorghum bicolor
cttggattgaagggagctcct

SEQ ID NO: 2059 - DNA, 21 bp, Solanum lycopersicum
tttggattgaagggagctcta

SEQ ID NO: 2060 - DNA, 21 bp, Selaginella moellendorffii
cttggattgaagggagctccc

SEQ ID NO: 2061 - DNA, 21 bp, Saccharum officinarum
tttggattgaagggagctctg

SEQ ID NO: 2062 - DNA, 21 bp, Saccharum officinarum
tttggattgaagggagctctg

SEQ ID NO: 2063 - DNA, 21 bp, Saccharum officinarum
cttggattgaagggagctcct

SEQ ID NO: 2064 - DNA, 21 bp, Saccharum officinarum
tttggattgaagggagctctg

SEQ ID NO: 2065 - DNA, 21 bp, Saccharum officinarum
tttggattgaaaggagctctt

SEQ ID NO: 2066 - DNA, 21 bp, Sorghum Propinquum
tttggattgaagggagctctg

SEQ ID NO: 2067 - DNA, 21 bp, Saccharum spp
tttggattgaagggagctctg

SEQ ID NO: 2068 - DNA, 21 bp, Sibara virginica
ttggactgaagggagctccct

SEQ ID NO: 2069 - DNA, 21 bp, Triticum aestivum
tttggattgaagggagctctg

SEQ ID NO: 2070 - DNA, 21 bp, Triticum aestivum
tttggattgaagggagctctg

SEQ ID NO: 2071 - DNA, 21 bp, Thlaspi arvense
ttggactgaagggagctccct

SEQ ID NO: 2072 - DNA, 21 bp, Vitis vinifera
cttggagtgaagggagctctc

SEQ ID NO: 2073 - DNA, 21 bp, Vitis vinifera
cttggagtgaagggagctctc

SEQ ID NO: 2074 - DNA, 21 bp, Vitis vinifera
tttggattgaagggagctcta

SEQ ID NO: 2075 - DNA, 21 bp, Zea mays
tttggattgaagggagctctg

SEQ ID NO: 2076 - DNA, 21 bp, Zea mays
tttggattgaagggagctctg

SEQ ID NO: 2077 - DNA, 21 bp, Zea mays
cttggattgaagggagctcct

SEQ ID NO: 2078 - DNA, 21 bp, Zea mays
cttggattgaagggagctcct

SEQ ID NO: 2079 - DNA, 21 bp, Zea mays
attggtttgaagggagctcca

SEQ ID NO: 2080 - DNA, 21 bp, Zea mays
tttggattgaagggagctctg

SEQ ID NO: 2081 - DNA, 21 bp, Zea mays
tttggagtgaagggagttctg

SEQ ID NO: 2082 - DNA, 21 bp, Zea mays
tttggagtgaagggagctctg

SEQ ID NO: 2083 - DNA, 21 bp, Zea mays
tttggagtgaagggagctctg

SEQ ID NO: 2084 - DNA, 21 bp, Zea mays
tttggattgaagggagctctg

SEQ ID NO: 2085 - DNA, 21 bp, Zea mays
tttggattgaagggagctctg

SEQ ID NO: 2086 - DNA, 21 bp, Zea mays
tttggattgaagggagctctg

SEQ ID NO: 2087 - DNA, 180 bp, Triticum aestivum
ccacgcgtccggcattcttcttcttcttgttgttgttgttgtaatggatttggaggaggaggaggaggaggagctgctgttgatgctcctagtacaacaaataaggaggcggcggaggaggagcaacaacaacaagaagaagaagatttgggcttgaagctgcagctgcaacaacatgta

SEQ ID NO: 2088 - DNA, 135 bp, Glycine max; identical to SEQ ID NO: 244

SEQ ID NO: 2089 - DNA, 148 bp, Phaseolus vulgaris
agcaatggtgttatttttatactttattttctatgcttttcctctacaactctcttttattttggataaatgaagtggatttctactctttgattggagaaaaaaagtggatttctatttttttcaatcaaagggagttgtaggggaa

SEQ ID NO: 2090 - DNA, 205 bp, Physcomitrella patens
acttctcggactcctctatctccctcggcacctgcacagtcattttatcaatatcttcacgttggtggccacgttcgaacatatcccatgcgggcaactccggcgtaggtgtacaaggccagcgttgcttaccatctggaggatacccctgctcaaacctacgactctgttccggtggtgaggaagatagaggagttcaagaagt

SEQ ID NO: 2091 - DNA, 191 bp, Arabidopsis cebennensis
taaatgtagagagagcttccttgagtccattcacaggtcggatatgatccaattagcttccgactcattcatccaaataccgagtcgccaaaattcaaattagactcgttaaatgaatgaatgatgcggtagacaaattggatcattgattctctttgattggactgaagggagctccctctctcttctgt

SEQ ID NO: 2092 - DNA, 192 bp, Arabidopsis halleri
tatatgtagagagagcttccttgagtccattcacaggtcgtgatatgatccaattagcttccgactcattcatccaaataccgagtcgccaaaattcgaactagactcgttaaatgaatgaatgatgcggtagacaaattggatcattgattctctttgattggactgaagggagctccctctctcttctgt

SEQ ID NO: 2093 - DNA, 192 bp, Arabis hirsuta
taaatgtagagagagcttccttgagtccattcacaggtcgtgatatgatccaattagcttccgactcattcatccaaataccgagtcgccaaaattcaaattagactcgttaaatgaatgaatgatgcggtagacaaattggatcattgattctctttgattggactgaagggagctccctctctcttctgt

SEQ ID NO: 2094 - DNA, 197 bp, Arachis hypogaea
agtggagctccttgaagtccaacagagggtcttggtgggtagattgagctgctaagctatggatcccacagtactacccatatataccccattatgcagtggtagttctgcggattccatatcctgggagcttcattacctttccacagatccttatttggattgaagggagctctacatagcatcctctttctaat

SEQ ID NO: 2095 - DNA, 222 bp, Arabidopsis lyrata
gagaaaaaaaaagatggaagtagagctccttgaagttcaaacgagagttgagcagggtaaagaaaagctgctaagctatggatcccataagccctaatccttataaagaaaaaaaaggatttggttatatggcttgcatatctcaggagctttaacttgccctttaatggcttttactcttctttggattgaagggagctctacatcttctttcaccttctc

SEQ ID NO: 2096 - DNA, 202 bp, Arabidopsis lyrata
ggaagaagaagaggaagagctccttgaagttcaatggagggtttagcagggtaaagtaaagctgctaagctatggatcccataaaccttatcaaattcaaaataaggattttttatggattccatatctcaggagctttcacttacccctttaatggcttcactcttctttggattgaagggagctcttcatctctacctcc

SEQ ID NO: 2097 - DNA, 220 bp, Arabidopsis lyrata
agaaggagctcccttcctccaaaacgaggaggacaagatttgaggaactaaaaagcaaaatctaagagttcatggattcctcatagagagtgcgtaggttaacatcttgaagaaagcacactttaaggggactgcatgacctcttagattatctctctctctctctctctctctatacatccttctcttctcttcgtttggattgaagggagctcctttt

SEQ ID NO: 2098 - DNA, 192 bp, Alliaria petiolata
tatatcaagggagagcttccttgagtccattcacaggtcgtgatatgatccaattagcttccgactcattcatccaaataccgagtcagggaaatttgatctatactcgttaaatgaatgaatgatgcggtagacaaattggatcattgattctctctgattggactgaagggagctccctctcattaggta

SEQ ID NO: 2099 - DNA, 184 bp, Arabidopsis thaliana
gtagagctccttaaagttcaaacatgagttgagcagggtaaagaaaagctgctaagctatggatcccataagccctaatccttgtaaagtaaaaaaggatttggttatatggattgcatatctcaggagctttaacttgccctttaatggcttttactcttctttggattgaagggagctctac

SEQ ID NO: 2100 - DNA, 196 bp, Arabidopsis thaliana; identical to SEQ ID NO: 178

SEQ ID NO: 2101 - DNA, 225 bp, Arabidopsis thaliana; identical to SEQ ID NO: 179

SEQ ID NO: 2102 - DNA, 234 bp, Brachypodium distachyon
gggcaagcgaaagatatagacaagaagaagagctcccttcgatccaatccaggaggggaagtggtcggatgcagctgccggttcatggatacctgtctggtgcatgcagtgtggtaatagcctgcgcacctgcatcggtttgcatgacccgggagatgaacctgccagcgtctttccctcgtgcttggattgaagggagctctctctcccccctctctctctctccctctctct

SEQ ID NO: 2103 - DNA, 183 bp, Brassica napus
gtagggctccttatagttcaaacgagagtttagcagggtaaagaaaagctgctaagctatgaatcccataagccctaatccttatatataaaaaggatttggttatatggcttacatatctcaggagctttaacttgccctttaattgcttttactcttctttggattgaagggagctctaca

SEQ ID NO: 2104 - DNA, 185 bp, Brassica rapa
aagtagggctccttatagttcaaacgagagtttagcagggtaaagaaaagctgctaagctatgaatcccataagccctaatccttatatataaaaaggatttggttatatggcttacatatctcaggagctttaacttgccctttaattgcttttactcttctttggattgaagggagctctaca

SEQ ID NO: 2105 - DNA, 192 bp, Barbarea vulgaris; identical to SEQ ID NO: 2098

SEQ ID NO: 2106 - DNA, 193 bp, Camelina microcarpa
tatatagatagagagtttccttgagtccattcacaggtcgtgatatgatccaattagcttccgactcattcatccaaataccgagtcatcaaaatttcaatctaaactcgttaaatgaatgaatgatgcggtagacaaattggatcattgattctctttgattggactgaagggagctccctctctttttggt

SEQ ID NO: 2107 - DNA, 193 bp, Conringia orientalis; identical to SEQ ID NO: 2106

SEQ ID NO: 2108 - DNA, 194 bp, Capsella rubella
tatgtacggagagagcttccttgagtccattcacaggtcgtgatatgatccaattagcttccgactcattcatccaaataccgagtctcaccaaaattggaacaagacttgttaaatgaatgaatgatgcggtagacaaattggatcattgattctctttgattggactgaagggagctccctttcttcttggt

SEQ ID NO: 2109 - DNA, 216 bp, Citrus sinensis
gggttaaggagtggagctccttgaagtccaaaagaggttctagcaagggtaaattgagctgctgagctatggatcccacagtcctatgtatcagattttagggtttgtttctgatgatggtgatgataggcttgtggcttgcatatttctggaccttcattaccccttaagtttttacccctttttttggattgaagggagctctacctctctacc

SEQ ID NO: 2110 - DNA, 192 bp, Descurainia sophia
aatatatagagagagcttccttgagtccattcacaggtcgtgatatgatccaattagcttccgactcattcatccacataccgagtcacccaaattcaaactagactcgttaaatgactgaatgatgcggtagacaaattggatcattgattctctttgattggactgaagggagctccctctctttctggt

SEQ ID NO: 2111 - DNA, 192 bp, Erysimum cheiri
tatatcgagagagagcttccttgagtccattcacaggtcgtgatatgatccaattagcttccgactcattcatccaaataccgagtcaccaaaattcgaactagactcgttaaatgaatgaatgatgcgctagacaaattggatcattgattctctttgattggactgaagggagctcccttcctttttggt

SEQ ID NO: 2112 - DNA, 192 bp, Fourraea alpina
tatatgtagagagagcttccttgagtccattcacaggtcgtgatatgatccaattagcttccgactcattcatccaaataccgagtcgctaaaattcgaactagactcgttaaatgaatgaatgatgcggtagacaaattggatcattgattctctttgattggactgaagggagctccctctctcttctgt

SEQ ID NO: 2113 - DNA, 200 bp, Festuca arundinacea
gtttggttttgaggtggagctcctatcattccaatgaaaggtcttgctaggaggggtggtacagctgctcgttcatggttcccactatcctacctccgtttgaaaccagggagataggcctgtggctagcatgaccgaggagccgcatcgtcccctcgctggccgctctttggattgaagggagctctgcatcttggcct

SEQ ID NO: 2114 - DNA, 214 bp, Glycine max; identical to SEQ ID NO: 183

SEQ ID NO: 2115 - DNA, 186 bp, Glycine max
aaacccaacttggagttccctgcactccaagtctgaaaggatatgatggtaaacctctactgctagttcatggatacctctgacttcttaacaacatgcgttcgaagtcaagggtttgcatgccctgggagatgagtttaccttgatcttttggtattggagtgaagggagctccagagggtattc

SEQ ID NO: 2116 - DNA, 185 bp, Glycine max
acccaagttggagctctctacactccaagtctgaaggaagtgacggtagacccttgctgctaattcatggttacctttggattcagataaggaagcatgtgaaagtcatgggtctgcatgaatttgaagacggggctaccttgatcttttagtattggagtgaagggagctccgaattaggcctt

SEQ ID NO: 2117 - DNA, 178 bp, Hordeum vulgare
ggtggagctcctatcattccaatgaagggtctaccggaagggtttgtgcagctgcttgttcatggttcccactatcctatctccattagaacacgaggagataggcttgtggtttgcatgatcgaggagccgcttcgatccctcgctgaccgctgtttggattgaagggagctctgca

SEQ ID NO: 2118 - DNA, 122 bp, Hordeum vulgare
ctgaccgctgtttggattgaagggagctctgcatcttgatctattactaattagtttcctcttccttctgctgcatgcaagcctggaaatcatttgtggggccctcttagatctagccatgg

SEQ ID NO: 2119 - DNA, 303 bp, Hordeum vulgare subsp. Vulgare
tttggattgaagggagctctgcatcttgatctattactaattagtttcctcttccttctgctgcatgcaagcctggaaatgttttgcagatttttctcctccacggtccagatctgggtgcaagctctttcttgcgtttagatctctccttgagcttgaacttttcaagctgtgattttatgaccacggtgttttgttttcccctcaaggtaatgaatgaaagattcaggttatgctttgtactttgcatggacctttattcccttgcctttgagctgtggtgtcattgttccttcgtcttta

SEQ ID NO: 2120 - DNA, 174 bp, Hordeum vulgare subsp. Vulgare
tggagctcctatcattccaatgaagggtctaccggaagggtttgtgcagctgcttgttcatggttcccactatcctatctccattagaacacgaggagataggcttgtggtttgcatgatcgaggagccgcttcgatccctcgctgaccgctgtttggattgaagggagctctg

SEQ ID NO: 2121 - DNA, 345 bp, Liriodendron tulipifera
tttggattgaagggagctctacaccatgctcttttactccttggtgtttggcctactggtttggtgggccactgttgatctgctgtagaccagatcaacggctaggattcctgcaaatcagcatcctctttttattggaaataaaactgatgttgtcatgaaattctttgtaagcatgctccacccttgttcttcagttgtattcagtgtgtggcccatccaccatgaggcctgctcgatgaactgcttcgattcgcagatgttcttttggaagattttactgttctttactttaattttaatgagcgttaacgggtggatctccccttgcaggaaattgatatc

SEQ ID NO: 2122 - DNA, 192 bp, Malcolmia maritima
tagttagaaagagagcttccttgagtccattcacaggtcgtgatatgatccaattagcttccgactcattcatccaaataccgagtcaccaaaattcaaactagactcgttaaatgaatgaatgatgcggtagacaaattgggtcattgattctctttgattggactgaagggagctccctccctctttggt

SEQ ID NO: 2123 - DNA, 183 bp, Medicago truncatula
ggggtggagcttcctttagtccaaatatggatcttgctatgttgatagagctgcttagctatgggtccctcaactctacccatcttgttctttgtggtagttttgtggcttccatatctagggagccttatcacctttagtttaatctttctttggattgaagggagctctacatcttgctct

SEQ ID NO: 2124 - DNA, 62 bp, Medicago truncatula
attgaattgaagggagcaactgaacagtcttaattaggactcctcaaatgtttcaattcaat

SEQ ID NO: 2125 - DNA, 44 bp, Medicago truncatula
tttggattgaagggagctctacatcttgctctctttactttaat

SEQ ID NO: 2126 - DNA, 192 bp, Nasturtium officinale
tatattaatggagagcttccttgagtccattcacaggtcgtgatatgatccaattagcttccgactcattcatacaaataccgagtcacagaaatcttaactggactcggtaaatgaatgaatgatgctgtagacaaattggatcattgattctctctgattggactgaagggagctccctctctttaggta

SEQ ID NO: 2127 - DNA, 274 bp, Oryza rufipogon
gttgtggacgttgagctcctttcggtccaaaaaggggtgttgctgtgggtcgattgagctgctgggtcatggatcccgttagcctactccatgttcatcattcagctcgagatctgaaagaaactactccaatttatactaatagtatgtgtgtagataggaaaatgatggagtactcgttgttgggataggcttatggcttgcatgccccaggagctgcatcaaccctacatggaccctctttggattgaagggagctctgcatcttttgtca

SEQ ID NO: 2128 - DNA, 272 bp, Oryza sativa
gttgtggacgttgagctcctttcggtccaaaaaggggtgttgctgtgggtcgattgagctgctgggtcatggatcccgttagcctactccatgttcatcattcagctcgagatctgaaagaaactactccaatttatactaatagtatgtgtgtagataggaaaatgatggagtactcgttgttgggataggcttatggcttgcatgccccaggagctgcatcaaccctacatggaccctctttggattgaagggagctctgcatcttttgt

SEQ ID NO: 2129 - DNA, 272 bp, Oryza sativa; identical to SEQ ID NO: 2128

SEQ ID NO: 2130 - DNA, 188 bp, Oryza sativa
ggttatgaagtggagctcctttcgttccaatgaaaggtttatctgaagggtgatacagctgcttgttcatggttcccactattctatctcataggaaaagagataggcttgtggtttgcatgaccaaggagccgaatcaactccttgctgaccactctttggattgaagggagctctgcatcttgatc

SEQ ID NO: 2131 - DNA, 197 bp, Oryza sativa
gaggaggaagaggagctcctttcgatccaattcaggagaggaagtggtaggatgcagctgccgattcatggatacctctggagtgcatggcagcaatgctgtaggcctgcacttgcatgggtttgcatgacccgggagatgaacccaccattgtcttcctctattgattggattgaagggagctccacatctctctc

SEQ ID NO: 2132 - DNA, 189 bp, Oryza sativa
tgatgtgaggaggagctcctttcgatccaattcaggagaggaagtggtgggatgcagctgccggttcatggatacctctgcagttcatgccggtaggcctgcacttgcatgggtttgcatgacctgggagatgaacctgccattgtgttcctctattgattggattgaagggagctccggctacaccta

SEQ ID NO: 2133 - DNA, 191 bp, Oryza sativa; identical to SEQ ID NO: 187

SEQ ID NO: 2134 - DNA, 188 bp, Oryza sativa; identical to SEQ ID NO: 188

SEQ ID NO: 2135 - DNA, 249 bp, Oryza sativa
ttgagctcctttcggtccaaaaaggggtgttgctgtgggtcgattgagctgctgggtcatggatcccgttagactactccatgttcatcattcagctcgagatctgaaagaaactactccaatttatactaatagtatgtgtgtagataggaaaatgatggagtactcgttgggataggcttatggcttgcatgccccaggagctgcatcaaccctacatggaccctctttggattgaagggagctctg

SEQ ID NO: 2136 - DNA, 226 bp, Pennisetum glaucum
cggagctcctatcattccaatgaaaggttgtttttgtgggttggtacagctgctcgttcatggttcccactatcctatctcatggctggaggtttatctgagagagagagagagagatgagatgagtggtcggtctggtgttggcttgagataggcttgtggcttgcatgaccgaggagctgcaccgtccccttgctggccgctctttggattgaagggagctctg

SEQ ID NO: 2137 - DNA, 193 bp, Picea sitchensis; identical to SEQ ID NO: 193

SEQ ID NO: 2138 - DNA, 210 bp, Pinus taeda
gatgtgttggagctcccttcagtccaaccaaagcttgtgcagcggtggttcagctgctgattcatgcattctacttccctgtccgtgactctccagcagcctgaacaaatcaatcaatcgacctgcatgacaggatagtggtgtgcatgacgcaggagatgtactgtcactaaacacgcatttcttggattgaagggagctccacttatc

SEQ ID NO: 2139 - DNA, 184 bp, Pinus taeda
ttacggggagctttcttcagtccaacgaaaggccgtatagggatgattcaactgctggttcatggactctactatcttgtaatcctcgaggttcagtattggcggcaagataatggtgtgcatgacacgggagtcgtattgccactacgctgtttttacttggattgaagagagctcccagaaa

SEQ ID NO: 2140 - DNA, 85 bp, Pinus taeda
gatgtgtgaatgatgcgggagctgattttgtccaggaaatgtcttttccttggattgaagggagctcccttatgtagcatacatt

SEQ ID NO: 2141 - DNA, 183 bp, Populus trichocarpa
gattagggagtggagctccttgaagtccaatagaggttcttgctgggtagattaagctgctaagctatggatccacagtcctatctatcaactgaaggataggtttgcggcttgcatatctcaggagctttattgcctaatgttagatccctttttggattgaagggagctctaaacccataa

SEQ ID NO: 2142 - DNA, 187 bp, Populus trichocarpa
gattatggagtggagctccttgaagtccaatagaagctcctgctgggtagatcgagctgctgagctatgaatcccacagccctatcaccatcagtcattttgatgggcctgcggcttgcatatctcaggagctttattacctaatgttagatctttttttggattgaagggagctctaaacctttga

SEQ ID NO: 2143 - DNA, 183 bp, Populus trichocarpa
gattagggagtggagctccttgaagtccaatagaggttcttgctgggtagattaagctgctaagctatggatccacagtcctatctatcaaccgaaggataggtttgcggcttgcatatctcaggagctttattgcctaatgttagatccctttttggattgaagggagctctaaacccataa

SEQ ID NO: 2144 - DNA, 194 bp, Populus trichocarpa
ttgtaaatttgggagctttctttggttcaaaatgaggaaagaaagtgggtatactcgtctgcttgttcatggatacctctgggttgcgcaggatatattagttagggctacagcttaagggtttgcatggccaaggagacgttgcctgccttctcctttcgtttcttggattgaagggagctcctacatgtatc

SEQ ID NO: 2145 - DNA, 192 bp, Populus trichocarpa
accattaaataggagcttgctcactccagatctgaaaggaggtgataggaaaccacttctgctacttcatgaatacccgtgggtgtgcgcgtagccatggtgagctgcgcaggctaagggtctgcatgtgctaggagatgtggttgccttgatctttttggtcttggggtgaagggagctcctatagtccca

SEQ ID NO: 2146 - DNA, 201 bp, Populus trichocarpa
gaggctcaatggagctctccccactccatgcctgaaaggagttcgatggtagaccatggctgctagttcatgaatacccttgggtgcgcagaattagcaacggtgcaggcgaagttgcgcaggctaagggtctgcatgacctaggagacgtggttaccctgaccctttttgtattggagtgaagggagctcgatggtcttt

SEQ ID NO: 2147 - DNA, 174 bp, Phaseolus vulgaris
gtggagctccttgaagtccaattgaggatcttactgggtggattgagctgcttagctatggatcccacagttctacccatcagcatgttttgtggtagtcttgtggcttccatatctggggagcttcatctgcctctatagtatcatccttctttggattgaagggagctctac

SEQ ID NO: 2148 - DNA, 174 bp, Phaseolus vulgaris; identical to SEQ ID NO: 2147

SEQ ID NO: 2149 - DNA, 180 bp, Ricinus communis
gagtggagctccttgaagtccaatagaggatcttgatgggtagattgagctgctgagctatggatcccacagccctataagcagagattataattttggataggcttgtggcttgcatatctcaggagcttcattaccttgtattagatccttgtttggattgaagggagctctacatct

SEQ ID NO: 2150 - DNA, 192 bp, Rorippa indica
tatattaagggagagcttccttgagtccattcacaggtcgtgatatgattcaattagcttccgactcattcatccaaatatcgagtcaccaaaatttgaactagactcgttaaatgaatgaatgatgcggtagacaaattggatcattgattctctctgattggactgaagggagctccctctctttaggta

SEQ ID NO: 2151 - DNA, 175 bp, Schedonorus arundinaceus
tggagctcctatcattccaatgaaaggtcttgctagaaggggtggtacagctgctcgttcatggttcccactatcctacctccgtttgaaaccagggagataggcctgtggcttgcatgaccgaggagccgcatcgtcccctcgctggccgctctttggattgaagggagctctg

SEQ ID NO: 2152 - DNA, 226 bp, Sorghum bicolor; identical to SEQ ID NO: 196

SEQ ID NO: 2153 - DNA, 253 bp, Sorghum bicolor
tgaatgaagatatgaagaagaagacgacgacgatgaagaaggcgaagaaaagcgaacaaagagctcccttcgatccaatccaggaggggaagtggtcggttgcagctgccggttcatggatgcctctctggtgcagcaatgactgatgctcacctgcacttgcatgggtgtgcatgacccgggagatgaacccaccatcatctttccctcgtgcttggattgaagggagctcctctctctttctctctttctc

SEQ ID NO: 2154 - DNA, 177 bp, Solanum lycopersicum
tggagctccttgaagtccaacaaaaaatctaacaggttaaattgagctgctgacctatggattcctcagccctatctatttatgatttcaaacatatagataggttttgggtttgcatatgtcaggagctttattttaccctttgtttgatcattttttggattgaagggagctcta

SEQ ID NO: 2155 - DNA, 279 bp, Selaginella moellendorffii
ttgcagggggagctcccttcaattcaactgaggtcggtgcgtcgctgttactcgctgctgactcatgcattcgcctgacatgcccgcaaccatcatcagatcgtgatcaggacacgccgaaaacatgcccgtgatcacctccgcaactctctgatctcggcgaggttgatcacagaatcccccgagtttgaggcatggcagccgtgtgcatgatgcaggagcaggtgcggcttcggctctgaacttcccttggattgaagggagctcccttccagattc

SEQ ID NO: 2156 - DNA, 265 bp, Saccharum officinarum
cctgatgcttggatttgaagcggagctcctatcattccaatgaagggccgttctgaagggttgttccgctgctcgttcatggttcccactatcctatctcatcatgtatgtgtgtatgtattttcgagagggaggagaggagctagactctcatggtggtcgtctttgagataggcttgtggtttgcatgaccgaggagctgcaccgtccccttgctggccgctctttggattgaagggagctctgcatcctgatccatccatcc

SEQ ID NO: 2157 - DNA, 266 bp, Saccharum officinarum
cctgatgcttggatttgaagcggagctcctatcattccaatgaagggccgttctgaagggtggttccgctgctcgttcatggttcccactatcctatctcatcatgtatgtgtgtatgtattttcggagagggaggagaggagctagactctcacggtggtcgtctttgagataggcttgtggtttgcatgaccgaggagctgcaccgtccccttgctggccgctctttggattgaagggagctctgcatcctgaaccatccatcc

SEQ ID NO: 2158 - DNA, 238 bp, Saccharum officinarum
tgaagacgacgacgaagaagaagatggcgaagaaaagtgatcgaagagctcccttcgatccaatccaggaggggaagtggtcggttgcagctgccggttcatggatgcctctctggtgcagcaatgactaatgctcacctgcacttgcatgggtgtgcatgacccgggagatgaacccaccatcatctttccctcgtgcttggattgaagggagctcctctctctttcctctctctct

SEQ ID NO: 2159 - DNA, 265 bp, Saccharum officinarum
cctgatgcttggatttgaagcggagctcctatcattccaatgaagggccgttctgaagggttgttccgctgctcgttcatggttcccactatcctatctcatcatgtatgtgtgtatgtattttcgagagggaggagaggagctagactctcatgggggtcgtctatgagatacgcttgtggtttgcatgaccgatgagctgcaccgtccccttgctggccgctctttggattgaagggagctctgcatcctgatccatccatcc

SEQ ID NO: 2160 - DNA, 264 bp, Saccharum officinarum
ctgatgcttggatttgaagcggagctcctatcattccaatgaagggccgttctgaagggtggttccgctgctcgttcatggttcccactatcctatctcatcatgtatgtgtgtatgtattttcgagagggaggagaggagctagactctcacggtggtcgtctttgagataggcttgtggtttgcatgaccgaagagctgcaccgtccccttgctggccgctctttggattgaaaggagctcttgcatctgatccatccatcc

SEQ ID NO: 2161 - DNA, 392 bp, Sorghum Propinquum
tttggattgaagggagctctgcatcctgatccatccattccatccccccatgcttgctttgtttattggctgttcctgagtgagatctgaggctcatggctctatgtagccatggattttttttccctttctcctaactgctgctgctgtttctccaagattcaataggctgttctgccgtgcttatccgtgctggagctggatgaagcaagctgctttgctgctgccctcatcctcatgccctggatgatggtggtgtggtgtggtatcggtaccccgtacttgcgtcgctttattcctatctttgctggtgaggtgttatgtcagtacagtagtttatgtcaccctcgtttatcttgttctatatgcttcggtttcctattcgtaccctg

SEQ ID NO: 2162 - DNA, 261 bp, Saccharum spp
gatgcttggatttgaagcggagctcctatcattccaatgaagggccgttctgaagggttgttccgctgctcgttcatggttcccactatcctatctcatcatgtatgtgtgtatgtattttcgagagggaggagaggagctagactctcatggtggtcgtctttgagataggcttgtggtttgcatgaccgaggagctgcaccgtccccttgctggccgctctttggattgaagggagctctgcatcctgatccatccatc

SEQ ID NO: 2163 - DNA, 191 bp, Sibara virginica
tatattaagggagagcttccttgagtccattcacaggtcgtgatatgatccaattagcttccgactcattcatccaaataccgagtcacgaaaatttgaactagactcgttaaatgaatgaatgatgcggtagacaaattgggtcattgattctctctgattggactgaagggagctccctctctttaggt

SEQ ID NO: 2164 - DNA, 177 bp, Triticum aestivum
gtggagctcctatcattccaatgaagggtctaccggaagggtttgtgcagctgctcgttcatggttcccactatcctatctccatagaaaacgaggagagaggcctgtggtttgcatgaccgaggagccgcttcgatccctcgctgaccgctgtttggattgaagggagctctgcat

SEQ ID NO: 2165 - DNA, 255 bp, Triticum aestivum
gagctcctttcggtccaaaaaggggtgttgctgtgggtcgattgagctgctgggtcatggatcccgttagcctactccatgttcatcattcagctcgagatctgaaagaaactactccaatttatactaatagtatgtgtgtagataggaaaatgatggagtactcgttgttgggataggcttatggcttgcatgccccaggagctgcatcaaccctacatggaccctctttggattgaagggagctctgcatct

SEQ ID NO: 2166 - DNA, 192 bp, Thlaspi arvense
gataaagagagagagcttccttgagtccattcacaggtcgtgatatgatccaattagcttccgactcattcatccaaataccgagtcaccaaaattcgagcaagactcgttaaatgaatgaatgaagcggtagacaaattgggtcattgattctctatgattggactgaagggagctccctctatatttggt

SEQ ID NO: 2167 - DNA, 194 bp, Vitis vinifera
gggtttatgggagctcctttacgctccagttctgaaaggagatgatggtatccacagctgctggttcatgagtacctatggctgcacaatatatatagcaatgttgtgtgcaaactatgggtgtgcatgacctcggagaagtggttgccttgatctttctggccttggagtgaagggagctctcataacccttc

SEQ ID NO: 2168 - DNA, 185 bp, Vitis vinifera
gggcttgtgggagcttctttacactccagaactgaaaggagatactactgctggttcatgaaaacctatggctgcattctctatactgaaattttgtatacaaactatgggtttgcatgaacttggagaagtgtttgcttttatcttttctggccttggagtgaagggagctctcataaccgatc

SEQ ID NO: 2169 - DNA, 190 bp, Vitis vinifera
ttttggagtggagctccttgaagtccaatagagggtcttactgggtagattgagctgctgacttatggatcccacagccctatcccgtcaatggggggcattggataggcttgtggcttgcatatctcaggagctgcattatccaagtttagatccttgtttggattgaagggagctctacacctctctc

SEQ ID NO: 2170 - DNA, 246 bp, Zea mays
tcgatgctttgggtttgaagcggagctcctatcattccaatgaagggtcgttccgaagggctggttccgctgctcgttcatggttcccactatcctatctcatcatgtgtatatatgtaatccatgggggagggtttctctcgtctttgagataggcttgtggtttgcatgaccgaggagctgcaccgcccccttgctggccgctctttggattgaagggagctctgcatcctgatccacccctcc

SEQ ID NO: 2171 - DNA, 221 bp, Zea mays
tagacggtctggtcttaaggcggtgctcccttcaaaccaataaacggtcgatctgatgggtggtacagctgctcgttcatggttcccactgtcccatctcatcagagagagagagagatgcttgagatgggcttgtggtttgcatgaccgaggagctgcacgtccccttcgttgaccgctgtttggattgaagggagctctgcatcttggtcccaagactt

SEQ ID NO: 2172 - DNA, 217 bp, Zea mays
atgattaagaaaggcgatcgaagagctcccttcgatccaatccaggaggggaagtggtcggttgcagctgccggttcatggatacctctctggtgcagcaatggccgctgctcacctctgcacttgcatgggtgtgcatgacccgggagatgagcccgccatcatctttccctcgtgcttggattgaagggagctcctctctgtctgtctgtctgtc

SEQ ID NO: 2173 - DNA, 217 bp, Zea mays
aagaagatgccgatcgatcgaagagctcccttcgatccaatccaggagggaaagtggtcggctgcagctgccggttcatggatacctctctggtgcagcaatggccgagatgctcacctgcacttgcatgggtgtgcatgacccgggagacgaaccgaccatcatctttccctcgtgcttggattgaagggagctcctctctctctctctctcttat

SEQ ID NO: 2174 - DNA, 127 bp, Zea mays
gcagctcctgcagcatctgttcgaggctcgccgcgttctgatgatccggcagcgcaagtccggcggcgacggcggcggccgaggtcggcggcgccggctggccgtattggtttgaagggagctccac

SEQ ID NO: 2175 - DNA, 215 bp, Zea mays
ggagctcctctcattccaatgaagggtccttccgaagggtggttccgctgctcgttcatggttcccactatcctatctcatccatgtttgcgtgtcttcgagaggaagcggaagagattcctgtggtcgccttttgagataggcttgtggtttgcatgaccgaggagctgcaccgaccccgtgctggccgctctttggattgaagggagctctgc

SEQ ID NO: 2176 - DNA, 252 bp, Zea mays
agtttgattcactagacctgatcccctagactagacggtctggtcttaaggcggtgctcccttcacaccaataaacggtcgatctgatgggtggtacagctgctcgttcatggttcccactgtcccatctcatcagagagagagaagatcatgagagagcgagagatgcttgagatgggcttgtggtttgcatgaccgaggagctgcctcgtccccttcgttgaccgctgtttggagtgaagggagttctgc

SEQ ID NO: 2177 - DNA, 200 bp, Zea mays
ggtgctcccttcacaccaataaacggtcgatctgatgggtggtacagctgctcgttcatggttcccactgtcccatctcatcagagagagagaagatcgtgagagagcgagagatgcttgagatgggcttgtggtttgcatgaccgaggagctgcctcgtccccttcgttgaccgctgtttggagtgaagggagctctgc

SEQ ID NO: 2178 - DNA, 252 bp, Zea mays
agtttgattcactagacctgatcccctagactagacggtctggtcttaaggcggtgctcccttcacaccaataaacggtcgatctgatgggtggtacagctgctcgttcatggttcccactgtcccatctcatcagagagagagaagatcatgagagagcgagagatgcttgagatgggcttgtggtttgcatgaccgaggagctgcctcgtccccttcgttgaccgctgtttggagtgaagggagctctgc

SEQ ID NO: 2179 - DNA, 252 bp, Zea mays
agtttgattcactagacctgatcccctagactagacggtctggtcttaaggcggtgctcccttcaaaccaataaacggtcgatctgatgggtggtacagctgctcgttcatggttcccactgtcccatctcatcagagagagagaagatcgtgagagagcgagagatgcttgagatgggcttgtggtttgcatgaccgaggagctgcctcgtccccttcgttgaccgctgtttggattgaagggagctctgc

SEQ ID NO: 2180 - DNA, 200 bp, Zea mays
ggtgctcccttcaaaccaataaacggtcgatctgatgggtggtacaactgctcgttcatggttcccactgtcccatctcatcagagagagagaagatcgtgagagagcgagagatgcttgagatgggcttgtggtttgcatgaccgaggagctgcatcgtccccttcgttgaccgctgtttggattgaagggagctctgc

SEQ ID NO: 2181 - DNA, 457 bp, Zea mays
tttggattgaagggagctctgcatcctgatccacccctccatttttttttgcttgttgcgtccttcctgggacctgagatccgaggctcgtggggctcactgtagcctcgctacactgttttcttctcctctcctgtgctatttgctgtttctcctaagattctttaggccgtgcttatccgtgctggagtttaacgaagcagcacgttgctgctgctggtgctgccctcatgccctggtggtcgactggtatcggtacccgtacttgcgtcgctttattataccctatcttcgccggtgaggtttccggccgttcggtacaggtagtctatgtcaaacactcgttttatttcttgtcatactatattcttctgcttcctgttcgtaccggcggcgtgtgcctttgcggtggcgctcctggatctgggtgcagcgagcgcccgtcagcttctccctc

SEQ ID NO: 2182 - DNA, 191 bp, Arabidopsis cebennensis; identical to SEQ ID NO: 2091

SEQ ID NO: 2183 - DNA, 192 bp, Arabidopsis halleri; identical to SEQ ID NO: 2092

SEQ ID NO: 2184 - DNA, 192 bp, Arabis hirsuta; identical to SEQ ID NO: 2093

SEQ ID NO: 2185 - DNA, 197 bp, Arachis hypogaea; identical to SEQ ID NO: 2094

SEQ ID NO: 2186 - DNA, 222 bp, Arabidopsis lyrata; identical to SEQ ID NO: 2095

SEQ ID NO: 2187 - DNA, 202 bp, Arabidopsis lyrata; identical to SEQ ID NO: 2096

SEQ ID NO: 2188 - DNA, 220 bp, Arabidopsis lyrata; identical to SEQ ID NO: 2097

SEQ ID NO: 2189 - DNA, 192 bp, Alliaria petiolata; identical to SEQ ID NO: 2098

SEQ ID NO: 2190 - DNA, 71 bp, Aquilegia coerulea; identical to SEQ ID NO: 176

SEQ ID NO: 2191 - DNA, 184 bp, Arabidopsis thaliana; identical to SEQ ID NO: 2099

SEQ ID NO: 2192 - DNA, 225 bp, Arabidopsis thaliana; identical to SEQ ID NO: 179

SEQ ID NO: 2193 - DNA, 234 bp, Brachypodium distachyon; identical to SEQ ID NO: 2102

SEQ ID NO: 2194 - DNA, 183 bp, Brassica napus; identical to SEQ ID NO: 2103

SEQ ID NO: 2195 - DNA, 185 bp, Brassica rapa; identical to SEQ ID NO: 2104

SEQ ID NO: 2196 - DNA, 192 bp, Barbarea vulgaris; identical to SEQ ID NO: 2098

SEQ ID NO: 2197 - DNA, 193 bp, Camelina microcarpa; identical to SEQ ID NO: 2106

SEQ ID NO: 2198 - DNA, 193 bp, Conringia orientalis; identical to SEQ ID NO: 2106

SEQ ID NO: 2199 - DNA, 194 bp, Capsella rubella; identical to SEQ ID NO: 2108

SEQ ID NO: 2200 - DNA, 216 bp, Citrus sinensis; identical to SEQ ID NO: 2109

SEQ ID NO: 2201 - DNA, 192 bp, Descurainia sophia; identical to SEQ ID NO: 2110

SEQ ID NO: 2202 - DNA, 192 bp, Erysimum cheiri; identical to SEQ ID NO: 2111

SEQ ID NO: 2203 - DNA, 192 bp, Fourraea alpina; identical to SEQ ID NO: 2112

SEQ ID NO: 2204 - DNA, 200 bp, Festuca arundinacea; identical to SEQ ID NO: 2113

SEQ ID NO: 2205 - DNA, 214 bp, Glycine max; identical to SEQ ID NO: 183

SEQ ID NO: 2206 - DNA, 186 bp, Glycine max; identical to SEQ ID NO: 2115

SEQ ID NO: 2207 - DNA, 185 bp, Glycine max; identical to SEQ ID NO: 2116

SEQ ID NO: 2208 - DNA, 178 bp, Hordeum vulgare; identical to SEQ ID NO: 2117

SEQ ID NO: 2209 - DNA, 122 bp, Hordeum vulgare; identical to SEQ ID NO: 2118

SEQ ID NO: 2210 - DNA, 303 bp, Hordeum vulgare subsp. Vulgare; identical to SEQ ID NO: 2119

SEQ ID NO: 2211 - DNA, 174 bp, Hordeum vulgare subsp. Vulgare; identical to SEQ ID NO: 2120

SEQ ID NO: 2212 - DNA, 345 bp, Liriodendron tulipifera; identical to SEQ ID NO: 2121

SEQ ID NO: 2213 - DNA, 192 bp, Malcolmia maritima; identical to SEQ ID NO: 2122

SEQ ID NO: 2214 - DNA, 183 bp, Medicago truncatula; identical to SEQ ID NO: 2123

SEQ ID NO: 2215 - DNA, 62 bp, Medicago truncatula; identical to SEQ ID NO: 2124

SEQ ID NO: 2216 - DNA, 44 bp, Medicago truncatula; identical to SEQ ID NO: 2125

SEQ ID NO: 2217 - DNA, 192 bp, Nasturtium officinale; identical to SEQ ID NO: 2126

SEQ ID NO: 2218 - DNA, 274 bp, Oryza rufipogon; identical to SEQ ID NO: 2127

SEQ ID NO: 2219 - DNA, 272 bp, Oryza sativa; identical to SEQ ID NO: 2128

SEQ ID NO: 2220 - DNA, 272 bp, Oryza sativa; identical to SEQ ID NO: 2128

SEQ ID NO: 2221 - DNA, 188 bp, Oryza sativa; identical to SEQ ID NO: 2130

SEQ ID NO: 2222 - DNA, 197 bp, Oryza sativa; identical to SEQ ID NO: 2131

SEQ ID NO: 2223 - DNA, 189 bp, Oryza sativa; identical to SEQ ID NO: 2132

SEQ ID NO: 2224 - DNA, 191 bp, Oryza sativa; identical to SEQ ID NO: 187

SEQ ID NO: 2225 - DNA, 188 bp, Oryza sativa; identical to SEQ ID NO: 188

SEQ ID NO: 2226 - DNA, 249 bp, Oryza sativa; identical to SEQ ID NO: 2135

SEQ ID NO: 2227 - DNA, 226 bp, Pennisetum glaucum; identical to SEQ ID NO: 2136

SEQ ID NO: 2228 - DNA, 193 bp, Picea sitchensis; identical to SEQ ID NO: 193

SEQ ID NO: 2229 - DNA, 210 bp, Pinus taeda; identical to SEQ ID NO: 2138

SEQ ID NO: 2230 - DNA, 184 bp, Pinus taeda; identical to SEQ ID NO: 2139

SEQ ID NO: 2231 - DNA, 85 bp, Pinus taeda; identical to SEQ ID NO: 2140

SEQ ID NO: 2232 - DNA, 183 bp, Populus trichocarpa; identical to SEQ ID NO: 2141

SEQ ID NO: 2233 - DNA, 187 bp, Populus trichocarpa; identical to SEQ ID NO: 2142

SEQ ID NO: 2234 - DNA, 183 bp, Populus trichocarpa; identical to SEQ ID NO: 2143

SEQ ID NO: 2235 - DNA, 194 bp, Populus trichocarpa; identical to SEQ ID NO: 2144

SEQ ID NO: 2236 - DNA, 192 bp, Populus trichocarpa; identical to SEQ ID NO: 2145

SEQ ID NO: 2237 - DNA, 201 bp, Populus trichocarpa; identical to SEQ ID NO: 2146

SEQ ID NO: 2238 - DNA, 174 bp, Phaseolus vulgaris; identical to SEQ ID NO: 2147

SEQ ID NO: 2239 - DNA, 174 bp, Phaseolus vulgaris; identical to SEQ ID NO: 2147

SEQ ID NO: 2240 - DNA, 180 bp, Ricinus communis; identical to SEQ ID NO: 2149

SEQ ID NO: 2241 - DNA, 192 bp, Rorippa indica; identical to SEQ ID NO: 2150

SEQ ID NO: 2242 - DNA, 175 bp, Schedonorus arundinaceus; identical to SEQ ID NO: 2151

SEQ ID NO: 2243 - DNA, 226 bp, Sorghum bicolor; identical to SEQ ID NO: 196

SEQ ID NO: 2244 - DNA, 253 bp, Sorghum bicolor; identical to SEQ ID NO: 2153

SEQ ID NO: 2245 - DNA, 177 bp, Solanum lycopersicum; identical to SEQ ID NO: 2154

SEQ ID NO: 2246 - DNA, 279 bp, Selaginella moellendorffii; identical to SEQ ID NO: 2155

SEQ ID NO: 2247 - DNA, 265 bp, Saccharum officinarum; identical to SEQ ID NO: 2156

SEQ ID NO: 2248 - DNA, 266 bp, Saccharum officinarum; identical to SEQ ID NO: 2157

SEQ ID NO: 2249 - DNA, 238 bp, Saccharum officinarum; identical to SEQ ID NO: 2158

SEQ ID NO: 2250 - DNA, 265 bp, Saccharum officinarum; identical to SEQ ID NO: 2159

SEQ ID NO: 2251 - DNA, 264 bp, Saccharum officinarum; identical to SEQ ID NO: 2160

SEQ ID NO: 2252 - DNA, 392 bp, Sorghum Propinquum; identical to SEQ ID NO: 2161

SEQ ID NO: 2253 - DNA, 261 bp, Saccharum spp; identical to SEQ ID NO: 2162

SEQ ID NO: 2254 - DNA, 191 bp, Sibara virginica; identical to SEQ ID NO: 2163

SEQ ID NO: 2255 - DNA, 177 bp, Triticum aestivum; identical to SEQ ID NO: 2164

SEQ ID NO: 2256 - DNA, 255 bp, Triticum aestivum; identical to SEQ ID NO: 2165

SEQ ID NO: 2257 - DNA, 192 bp, Thlaspi arvense; identical to SEQ ID NO: 2166

SEQ ID NO: 2258 - DNA, 194 bp, Vitis vinifera; identical to SEQ ID NO: 2167

SEQ ID NO: 2259 - DNA, 185 bp, Vitis vinifera; identical to SEQ ID NO: 2168

SEQ ID NO: 2260 - DNA, 190 bp, Vitis vinifera; identical to SEQ ID NO: 2169

SEQ ID NO: 2261 - DNA, 246 bp, Zea mays; identical to SEQ ID NO: 2170

SEQ ID NO: 2262 - DNA, 221 bp, Zea mays; identical to SEQ ID NO: 2171

SEQ ID NO: 2263 - DNA, 217 bp, Zea mays; identical to SEQ ID NO: 2172

SEQ ID NO: 2264 - DNA, 217 bp, Zea mays; identical to SEQ ID NO: 2173

SEQ ID NO: 2265 - DNA, 127 bp, Zea mays; identical to SEQ ID NO: 2174

SEQ ID NO: 2266 - DNA, 215 bp, Zea mays; identical to SEQ ID NO: 2175

SEQ ID NO: 2267 - DNA, 252 bp, Zea mays; identical to SEQ ID NO: 2176

SEQ ID NO: 2268 - DNA, 200 bp, Zea mays; identical to SEQ ID NO: 2177

SEQ ID NO: 2269 - DNA, 252 bp, Zea mays; identical to SEQ ID NO: 2178

SEQ ID NO: 2270 - DNA, 252 bp, Zea mays; identical to SEQ ID NO: 2179

SEQ ID NO: 2271 - DNA, 200 bp, Zea mays; identical to SEQ ID NO: 2180

SEQ ID NO: 2272 - DNA, 457 bp, Zea mays; identical to SEQ ID NO: 2181

SEQ ID NO: 2273 - DNA, 191 bp, Arabidopsis cebennensis; identical to SEQ ID NO: 2091

SEQ ID NO: 2274 - DNA, 192 bp, Arabidopsis halleri; identical to SEQ ID NO: 2092

SEQ ID NO: 2275 - DNA, 192 bp, Arabis hirsuta; identical to SEQ ID NO: 2093

SEQ ID NO: 2276 - DNA, 197 bp, Arachis hypogaea; identical to SEQ ID NO: 2094

SEQ ID NO: 2277 - DNA, 222 bp, Arabidopsis lyrata; identical to SEQ ID NO: 2095

SEQ ID NO: 2278 - DNA, 202 bp, Arabidopsis lyrata; identical to SEQ ID NO: 2096

SEQ ID NO: 2279 - DNA, 220 bp, Arabidopsis lyrata; identical to SEQ ID NO: 2097

SEQ ID NO: 2280 - DNA, 192 bp, Alliaria petiolata; identical to SEQ ID NO: 2098

SEQ ID NO: 2281 - DNA, 71 bp, Aquilegia coerulea; identical to SEQ ID NO: 176

SEQ ID NO: 2282 - DNA, 184 bp, Arabidopsis thaliana; identical to SEQ ID NO: 2099

SEQ ID NO: 2283 - DNA, 196 bp, Arabidopsis thaliana; identical to SEQ ID NO: 178

SEQ ID NO: 2284 - DNA, 234 bp, Brachypodium distachyon; identical to SEQ ID NO: 2102

SEQ ID NO: 2285 - DNA, 183 bp, Brassica napus; identical to SEQ ID NO: 2103

SEQ ID NO: 2286 - DNA, 185 bp, Brassica rapa; identical to SEQ ID NO: 2104

SEQ ID NO: 2287 - DNA, 192 bp, Barbarea vulgaris; identical to SEQ ID NO: 2098

SEQ ID NO: 2288 - DNA, 193 bp, Camelina microcarpa; identical to SEQ ID NO: 2106

SEQ ID NO: 2289 - DNA, 193 bp, Conringia orientalis; identical to SEQ ID NO: 2106

SEQ ID NO: 2290 - DNA, 194 bp, Capsella rubella; identical to SEQ ID NO: 2108

SEQ ID NO: 2291 - DNA, 216 bp, Citrus sinensis; identical to SEQ ID NO: 2109

SEQ ID NO: 2292 - DNA, 192 bp, Descurainia sophia; identical to SEQ ID NO: 2110

SEQ ID NO: 2293 - DNA, 192 bp, Erysimum cheiri; identical to SEQ ID NO: 2111

SEQ ID NO: 2294 - DNA, 192 bp, Fourraea alpina; identical to SEQ ID NO: 2112

SEQ ID NO: 2295 - DNA, 200 bp, Festuca arundinacea; identical to SEQ ID NO: 2113

SEQ ID NO: 2296 - DNA, 214 bp, Glycine max; identical to SEQ ID NO: 183

SEQ ID NO: 2297 - DNA, 186 bp, Glycine max; identical to SEQ ID NO: 2115

SEQ ID NO: 2298 - DNA, 185 bp, Glycine max; identical to SEQ ID NO: 2116

SEQ ID NO: 2299 - DNA, 178 bp, Hordeum vulgare; identical to SEQ ID NO: 2117

SEQ ID NO: 2300 - DNA, 122 bp, Hordeum vulgare; identical to SEQ ID NO: 2118

SEQ ID NO: 2301 - DNA, 303 bp, Hordeum vulgare subsp. Vulgare; identical to SEQ ID NO: 2119

SEQ ID NO: 2302 - DNA, 174 bp, Hordeum vulgare subsp. Vulgare; identical to SEQ ID NO: 2120

SEQ ID NO: 2303 - DNA, 345 bp, Liriodendron tulipifera; identical to SEQ ID NO: 2121

SEQ ID NO: 2304 - DNA, 192 bp, Malcolmia maritima; identical to SEQ ID NO: 2122

SEQ ID NO: 2305 - DNA, 183 bp, Medicago truncatula; identical to SEQ ID NO: 2123

SEQ ID NO: 2306 - DNA, 62 bp, Medicago truncatula; identical to SEQ ID NO: 2124

SEQ ID NO: 2307 - DNA, 44 bp, Medicago truncatula; identical to SEQ ID NO: 2125

SEQ ID NO: 2308 - DNA, 192 bp, Nasturtium officinale; identical to SEQ ID NO: 2126

SEQ ID NO: 2309 - DNA, 274 bp, Oryza rufipogon; identical to SEQ ID NO: 2127

SEQ ID NO: 2310 - DNA, 272 bp, Oryza sativa; identical to SEQ ID NO: 2128

SEQ ID NO: 2311 - DNA, 272 bp, Oryza sativa; identical to SEQ ID NO: 2128

SEQ ID NO: 2312 - DNA, 188 bp, Oryza sativa; identical to SEQ ID NO: 2130

SEQ ID NO: 2313 - DNA, 197 bp, Oryza sativa; identical to SEQ ID NO: 2131

SEQ ID NO: 2314 - DNA, 189 bp, Oryza sativa; identical to SEQ ID NO: 2132

SEQ ID NO: 2315 - DNA, 191 bp, Oryza sativa; identical to SEQ ID NO: 187

SEQ ID NO: 2316 - DNA, 188 bp, Oryza sativa; identical to SEQ ID NO: 188

SEQ ID NO: 2317 - DNA, 249 bp, Oryza sativa; identical to SEQ ID NO: 2135

SEQ ID NO: 2318 - DNA, 226 bp, Pennisetum glaucum; identical to SEQ ID NO: 2136

SEQ ID NO: 2319 - DNA, 193 bp, Picea sitchensis; identical to SEQ ID NO: 193

SEQ ID NO: 2320 - DNA, 210 bp, Pinus taeda; identical to SEQ ID NO: 2138

SEQ ID NO: 2321 - DNA, 184 bp, Pinus taeda; identical to SEQ ID NO: 2139

SEQ ID NO: 2322 - DNA, 85 bp, Pinus taeda; identical to SEQ ID NO: 2140

SEQ ID NO: 2323 - DNA, 183 bp, Populus trichocarpa; identical to SEQ ID NO: 2141

SEQ ID NO: 2324 - DNA, 187 bp, Populus trichocarpa; identical to SEQ ID NO: 2142

SEQ ID NO: 2325 - DNA, 183 bp, Populus trichocarpa; identical to SEQ ID NO: 2143

SEQ ID NO: 2326 - DNA, 194 bp, Populus trichocarpa; identical to SEQ ID NO: 2144

SEQ ID NO: 2327 - DNA, 192 bp, Populus trichocarpa; identical to SEQ ID NO: 2145

SEQ ID NO: 2328 - DNA, 201 bp, Populus trichocarpa; identical to SEQ ID NO: 2146

SEQ ID NO: 2329 - DNA, 174 bp, Phaseolus vulgaris; identical to SEQ ID NO: 2147

SEQ ID NO: 2330 - DNA, 174 bp, Phaseolus vulgaris; identical to SEQ ID NO: 2147

SEQ ID NO: 2331 - DNA, 180 bp, Ricinus communis; identical to SEQ ID NO: 2149

SEQ ID NO: 2332 - DNA, 192 bp, Rorippa indica; identical to SEQ ID NO: 2150

SEQ ID NO: 2333 - DNA, 175 bp, Schedonorus arundinaceus; identical to SEQ ID NO: 2151

SEQ ID NO: 2334 - DNA, 226 bp, Sorghum bicolor; identical to SEQ ID NO: 196

SEQ ID NO: 2335 - DNA, 253 bp, Sorghum bicolor; identical to SEQ ID NO: 2153

SEQ ID NO: 2336 - DNA, 177 bp, Solanum lycopersicum; identical to SEQ ID NO: 2154

SEQ ID NO: 2337 - DNA, 279 bp, Selaginella moellendorffii; identical to SEQ ID NO: 2155

SEQ ID NO: 2338 - DNA, 265 bp, Saccharum officinarum; identical to SEQ ID NO: 2156

SEQ ID NO: 2339 - DNA, 266 bp, Saccharum officinarum; identical to SEQ ID NO: 2157

SEQ ID NO: 2340 - DNA, 238 bp, Saccharum officinarum; identical to SEQ ID NO: 2158

SEQ ID NO: 2341 - DNA, 265 bp, Saccharum officinarum; identical to SEQ ID NO: 2159

SEQ ID NO: 2342 - DNA, 264 bp, Saccharum officinarum; identical to SEQ ID NO: 2160

SEQ ID NO: 2343 - DNA, 392 bp, Sorghum Propinquum; identical to SEQ ID NO: 2161

SEQ ID NO: 2344 - DNA, 261 bp, Saccharum spp; identical to SEQ ID NO: 2162

SEQ ID NO: 2345 - DNA, 191 bp, Sibara virginica; identical to SEQ ID NO: 2163

SEQ ID NO: 2346 - DNA, 177 bp, Triticum aestivum; identical to SEQ ID NO: 2164

SEQ ID NO: 2347 - DNA, 255 bp, Triticum aestivum; identical to SEQ ID NO: 2165

SEQ ID NO: 2348 - DNA, 192 bp, Thlaspi arvense; identical to SEQ ID NO: 2166

SEQ ID NO: 2349 - DNA, 194 bp, Vitis vinifera; identical to SEQ ID NO: 2167

SEQ ID NO: 2350 - DNA, 185 bp, Vitis vinifera; identical to SEQ ID NO: 2168

SEQ ID NO: 2351 - DNA, 190 bp, Vitis vinifera; identical to SEQ ID NO: 2169

SEQ ID NO: 2352 - DNA, 246 bp, Zea mays; identical to SEQ ID NO: 2170

SEQ ID NO: 2353 - DNA, 221 bp, Zea mays; identical to SEQ ID NO: 2171

SEQ ID NO: 2354 - DNA, 217 bp, Zea mays; identical to SEQ ID NO: 2172

SEQ ID NO: 2355 - DNA, 217 bp, Zea mays; identical to SEQ ID NO: 2173

SEQ ID NO: 2356 - DNA, 127 bp, Zea mays; identical to SEQ ID NO: 2174

SEQ ID NO: 2357 - DNA, 215 bp, Zea mays; identical to SEQ ID NO: 2175

SEQ ID NO: 2358 - DNA, 252 bp, Zea mays; identical to SEQ ID NO: 2176

SEQ ID NO: 2359 - DNA, 200 bp, Zea mays; identical to SEQ ID NO: 2177

SEQ ID NO: 2360 - DNA, 252 bp, Zea mays; identical to SEQ ID NO: 2178

SEQ ID NO: 2361 - DNA, 252 bp, Zea mays; identical to SEQ ID NO: 2179

SEQ ID NO: 2362 - DNA, 200 bp, Zea mays; identical to SEQ ID NO: 2180

SEQ ID NO: 2363 - DNA, 457 bp, Zea mays; identical to SEQ ID NO: 2181

SEQ ID NO: 2364 - DNA, 107 bp, Vitis vinifera
tggcttacatgggcttgtgatgtattccatctcttgcacactggaccagcgctccagctgcagtttggtgtgcacgggatggaatacatcatggattcatgatgtgg

SEQ ID NO: 2365 - DNA, 116 bp, Arachis hypogaea
gaagagattataaatgttgacagaagagagagagcacaacccgagaaatggtcaaagaatcttttacctttgttgggagtgtgctctctactcttctgtcatcatctttatcttta

SEQ ID NO: 2366 - DNA, 135 bp, Arachis hypogaea
ggaggcactattggtagagttgttgacagaagatagagagcacaaaagatgatatgcatatagatatatatagtctgcattttattcctttgtgctctctaagcttctgtcatcactcttcagcctctatttcta

SEQ ID NO: 2367 - DNA, 139 bp, Arachis hypogaea
cctcgaagagattataaatgttgacagaagagagagagcacaacccgagaaatggtcaaagaatcttttacctttgttgggagtgtgctctctactcttctgtcatcatctttatctttatttgtatggtatagatctt

SEQ ID NO: 2368 - DNA, 184 bp, Arabidopsis lyrata
gggttggttgtgagtgaaagagttgggacaagagaaacgcaaagaaactgacagaagagagtgagcacacaaaggcaatttgcatatcattgcatttgcttctcttgcgtgctcactgctctttctgtcagattccggtgctgatctctttggcctgtcctcgatctctttgtctcaatctctc

SEQ ID NO: 2369 - DNA, 109 bp, Arabidopsis lyrata
aacagagaaaactgacagaagagagtgagcacatgcaggctctgttatgtgtctataactttgcgtgtgcgtgctcacctctctttctgtcagttgcttatctcttgtt

SEQ ID NO: 2370 - DNA, 102 bp, Arabidopsis lyrata
gcatagaaactgacagaagagagtgagcacacaaaggcactttgcatgttcgatgcatttgcttctcttgcgtgctcactgctctatctgtcagatttcggc

SEQ ID NO: 2371 - DNA, 118 bp, Arabidopsis lyrata
atgggggaaaagaagttgacagaagagagtgagcacacaaaggggaagttgtatagaatttttgtatatggttgcttttgcgtgctcactctctttctgtcataacttctcctttcat

SEQ ID NO: 2372 - DNA, 150 bp, Arabidopsis lyrata
gtagagtgtgaaaggtaagaggaggtgacagaagagagtgagcacacatggtggtttcttgcatgcttttttttaattagggcttcatgcttgaagctatgtgtgcttactctctctctgtcaccccttctctctctcttttcaaattac

SEQ ID NO: 2373 - DNA, 228 bp, Arabidopsis lyrata
gtatgtgatattaagaggtatatatgaatcataaatatggatggtttgattgatgagtaattgatggtgacagaagagagtgagcacacatggtggctttcttgcatatttgatggtttcatgcttgaagctatgtgtgctcactctctatctgtcacccccttctctctctctatatacaccatttaaatttattttatagagttatatacaatttgattttgatac

SEQ ID NO: 2374 - DNA, 138 bp, Arabidopsis lyrata
ggaggtaagtgatgaataacaataaggaaggcgacagaagagagtgagcacacatggctcctttttctagcatgctcatgctcgaaagctctgcgtgcttactctcttcttgtctcctcctgctttctctctttctct

SEQ ID NO: 2375 - DNA, 99 bp, Arabidopsis lyrata
gaaatgttgacagaagaaagagagcacaacctgggattagcaaaaagatagttttgcccttgtcgggagtgtgctctctttccttctgccaccatcatc

SEQ ID NO: 2376 - DNA, 81 bp, Aquilegia coerulea
tgacagaagatagagagcacagatgacgaattgcatggagtttgcatctcgatactttgtgctctctatgcttctgtcacc

SEQ ID NO: 2377 - DNA, 83 bp, Aquilegia coerulea
tgacagaagatagagagcacagatgatgatatgcatggagagtctgcatctcactcctttgtgctctctatgcttctgtcatc

SEQ ID NO: 2378 - DNA, 123 bp, Arabidopsis thaliana
caagagaaacgcaaagaaactgacagaagagagtgagcacacaaaggcaatttgcatatcattgcacttgcttctcttgcgtgctcactgctctttctgtcagattccggtgctgatctcttt

SEQ ID NO: 2379 - DNA, 183 bp, Arabidopsis thaliana
gctagaagagggagagatggtgattgaggaatgcaacagagaaaactgacagaagagagtgagcacatgcaggcactgttatgtgtctataactttgcgtgtgcgtgctcacctctctttctgtcagttgcctatctctgcctgcttgacctctctctctctctctctctctcaaatttggct

SEQ ID NO: 2380 - DNA, 104 bp, Arabidopsis thaliana
cgcatagaaactgacagaagagagtgagcacacaaaggcactttgcatgttcgatgcatttgcttctcttgcgtgctcactgctctatctgtcagattccggct

SEQ ID NO: 2381 - DNA, 118 bp, Arabidopsis thaliana
gatgggggaaaagaagttgacagaagagagtgagcacacaaaggggaagttgtataaaagttttgtatatggttgcttttgcgtgctcactctctttttgtcataacttctccttcat

SEQ ID NO: 2382 - DNA, 107 bp, Arabidopsis thaliana
aggaggtgacagaagagagtgagcacacatggtggtttcttgcatgcttttttgattagggtttcatgcttgaagctatgtgtgcttactctctctctgtcacccct

SEQ ID NO: 2383 - DNA, 132 bp, Arabidopsis thaliana
gagtggtgaggaattgatggtgacagaagagagtgagcacacatggtggctttcttgcatatttgaaggttccatgcttgaagctatgtgtgctcactctctatccgtcacccccttctctccctctccctc

SEQ ID NO: 2384 - DNA, 103 bp, Arabidopsis thaliana
ataacgaaggcgacagaagagagtgagcacacatggctctttttctagcatgctcatgctcgaaagctctgcgtgcttactctcttcttgtctcctgctctct

SEQ ID NO: 2385 - DNA, 106 bp, Arabidopsis thaliana
atgaaaaatgttgacagaagaaagagagcacaacctgggattagcaaaaagatagttttgcccttgtcgggagtgtgctctctttccttctgccaccatcattgcg

SEQ ID NO: 2386 - DNA, 147 bp, Brachypodium distachyon
cggatggcgccaccgggctgacctggaaggcgctggccgtcgacattgccgggggccggttgtggctggcgctgtgggcactatgatcccatggctgagttgacagaagagagagagcacagctggagtcggcggccgtgactcctg

SEQ ID NO: 2387 - DNA, 205 bp, Brachypodium distachyon
gtgttgtggcaggtgtggcaaggctatgggtgacagaagagagtgagcacacagcggccagactgcatctattccttcggcggcggacacggccgggcatggccggccatggcatggcatacacgaaaacgaatgatgctgctgctgctgcgtgctcacttctctctctgtcacctctcgcacacacggctagcccgccagcctc

SEQ ID NO: 2388 - DNA, 146 bp, Brachypodium distachyon
agctcctggtgttgagagggcctcgagagattgacagaagagagtgagcacacggcgtgatgtccggcatatgtatgccgtcgtcgccgcgtgctcactcctctttctgtcagcctctttctctccggagtttatcttgcatccag

SEQ ID NO: 2389 - DNA, 151 bp, Brachypodium distachyon
gccggccggcagggtcatgtgtgcgcgcggtgacagaagagagtgagcacacggccgggcgggacggcacccggcggattggtgccgtcgcggccgcgtgctcactgctctgtctgtcacctttgcccagaaggccgcctcttcacggaca

SEQ ID NO: 2390 - DNA, 82 bp, Brassica napus
tgacagaagagagtgagcacacaaaagtaatctgcatatactgcatttgcttctcttgcgtgctcactgctctttctgtcag

SEQ ID NO: 2391 - DNA, 208 bp, Brassica napus
taggtttgagagtgatgctggttgttgacagaagatagagagcactaaggatgacatgcaagtacatatgtatgtatcatcacaccgcctgtggatgattacaaaaataaaaccaattcaaaagagagagagagagagcctgcatgtctactctttcgtgctctctatacttctgtcaccaccattatttcttcttctttcttaccta

SEQ ID NO: 2392 - DNA, 155 bp, Brassica napus
gggagtgatgcaggttgttgacagaagatagagagcactaaggatgacatgcaagtacaaggatataaggaaattcaagaaagagaggaaaaaagagcctgcatctttactcttttgtgctctctatacttctgtcaataccattatttattcct

SEQ ID NO: 2393 - DNA, 103 bp, Citrus sinensis
cgagagagctactgacagaagagagtgagcacacgcaggtaattgtattagaaaatatctttgcaggtgcgtgctcgctcctcttctgtcagcgtcatttttg

SEQ ID NO: 2394 - DNA, 190 bp, Citrus trifoliata
tgaagaggaagaggaaacataacgagagagctactgacagaagagagtgagcacacgcaggtaattgtattagaaaatatctttgcaggtgcgtgctcgctcctcttctgtcagcgtcatttttgcaagtgcttcctcacaaccccagcacgtcgtaacccccagccctcttttgctcttccttctatca

SEQ ID NO: 2395 - DNA, 180 bp, Festuca arundinacea
gcagaccgatggtcgtggctggcaccgtgggtggtggtatcccatggctgagttgacagaagagagagagcacagctggagtcggtggcgacccctgtgagacacccgcctggagggagctctggaccggggaagccgtggctgccatatgcatgtgggccataacccgtgtgaggacgc

SEQ ID NO: 2396 - DNA, 180 bp, Festuca arundinacea; identical to SEQ ID NO: 2395

SEQ ID NO: 2397 - DNA, 104 bp, Gossypium hirsutum
aagggaggtgacagaagagagtgagcacacagggtactttcttgcatgcttgagcctttcatgcttgaagctctgcgtgctcaccctctatctgtcatccactt

SEQ ID NO: 2398 - DNA, 113 bp, Gossypium hirsutum
ggtgacagaagagagtgagcacacagggtactttcttgcatgcttgagcctttcatgcttgaagctctgcgtgctcaccctctatctgtcatccacttttctctctctctctc

SEQ ID NO: 2399 - DNA, 97 bp, Gossypium hirsutum
ggtgtcagaagagagtgagcacacagggttctttgtagcatgcttgagcctttcatgctagaagctatgtgtgctcaccctctatctgtcatccact

SEQ ID NO: 2400 - DNA, 96 bp, Gossypium hirsutum
gagaggtttgacagaagagagtgagcacacgcaggcagattgtatgaaaggccatacctttgcccgccgtgtgctcacttctcttctgtcagctta

SEQ ID NO: 2401 - DNA, 122 bp, Glycine max
cacaccagattgagagaggctgacagaagagagtgagcacatgctagtggtatttgtatgagggcatacaattgcgggtgcgtgctcacttctctatctgtcagcttcccattcttttttac

SEQ ID NO: 2402 - DNA, 120 bp, Glycine max
tgatgtgagatatctcatgttgacagaagagagagagcacaacccgggaatggctaaaggagtctttgcctttgttgggagtgtgccctctcttcctctgtcatcatcacattcacatgc

SEQ ID NO: 2403 - DNA, 185 bp, Glycine max
acttgaccactaggcttatctctttccgtttctgagcatgcatactcattcacagcatcaaaatgcacagatcctgatggagattgcacagggcaggtgatgctagattgcaccatactcaactctggactttgtgattgaagtgttgacagaagatagagagcacaacctgagtcaaaggatcc

SEQ ID NO: 2404 - DNA, 151 bp, Glycine max
ctacttggtaattaaggttgttgacagaagatagagagcacagatgatgatatgcatattatataatatatagcagggaactcatgatgaattgtgcatcttactcctttgtgctctctatacttctgtcatcaccttcagcctccatttc

SEQ ID NO: 2405 - DNA, 124 bp, Glycine max
aggaggtgttggtgatgctgttgacagaagatagagagcactgatgatgaaatgcatgaaagggaatggcatctcactcctttgtgctctctagtcttctgtcatcatccttctccctcccctc

SEQ ID NO: 2406 - DNA, 106 bp, Glycine max
atatctcatgttgacagaagagagagagcacaacccgggaatggttaaaggagtctttgcctttgttgggagtgtgctctctcttcctctgtcatcatcacattca

SEQ ID NO: 2407 - DNA, 135 bp, Hordeum vulgare
tgacagaagagagtgagcacacagcggcaggctacgtctgataagagcatggttaatagtatagccaactgctggctatactatgagcacgtgcttagacgcagctgctgttgcgtgctcaccctctctctgtct

SEQ ID NO: 2408 - DNA, 460 bp, Medicago truncatula
agccatgaatcagtccgagatgacagaagagagagagcacacccacctgattacaagtaacaaaaaactaccaactatcaacattttgtctactatgaagaaaatcacatgtctagactatagttacgaatggaagatacattcaatgatgtttatgaaaatttgagacggtcgaggactatagttactctatcgcatacatttaatgacaaaaaaaattgtgtactcttatttattttcaatacatcttcattcaatttctatgcaagaatcaaaatgcagtataaaaaattgcattcaatatcatggtaaaaaaattgttcaaaaaaagtaaatatcatggtaaaaaaatcattagattttgcaataagtaagagtcaagttttaccttgtgaggaattcctcccaacagaatcatgggagctctttcttcttctctcattgtgccctgccagtctcc

SEQ ID NO: 2409 - DNA, 95 bp, Medicago truncatula
ggaggtgacagaagagagtgagcacacatggtactttcgtgtatgatgtttcattctcgaagctatgtgtgctcactctctatctgtcaccccat

SEQ ID NO: 2410 - DNA, 98 bp, Medicago truncatula
ggtggtgacagaagagagtgagcacacatggtgttttcttgcacgattatgtttcctgcttgaagctatatgtgcttactctctatctgtcaccccac

SEQ ID NO: 2411 - DNA, 90 bp, Medicago truncatula
gaaattgacagaagagagtgagcacatagacactcggtatagatgtatatcgttgcctttgcgtgctcactcatctttctgtcaaattcc

SEQ ID NO: 2412 - DNA, 172 bp, Medicago truncatula
ggttgttgacagaagatagagagcacagatgatgatatgcatttatatatatatatatatatatatatatatatatatatatatatatatatatatatgaggagctggagctgcatggagatgaattttgtgcatatcactcctttgtgctctctatgcttctgtcatcacc

SEQ ID NO: 2413 - DNA, 94 bp, Medicago truncatula
gtttgttgacagaagatagagagcacatctgaacaaacacaaaagacattgtgtttgaacagttgtgtgctctctgctcttctgccaacatact

SEQ ID NO: 2414 - DNA, 120 bp, Medicago truncatula
ggttgttgacagaagatagagggcactaaggatgatatgcatacacatatatatacaacatggaggaggagcttaattgcatttcatttcctttgtgctctctagacttctgtcatcacc

SEQ ID NO: 2415 - DNA, 94 bp, Medicago truncatula
tgctgttgacagaagatagagagcacagatgatgaaatgcatggaaggcaatggcatctcattcctttgtgctctttattcttctgtcatcacc

SEQ ID NO: 2416 - DNA, 93 bp, Medicago truncatula
gatattgacagaagagagtgagcacatgctgcagtgattgtatgatagcatacaattcttggtgcgtgctcacttctctttctgtcatcttat

SEQ ID NO: 2417 - DNA, 100 bp, Oryza sativa
ggagggtgacagaagagagtgagcacacgtggttgtttccttgcataaatgatgcctatgcttggagctacgcgtgctcacttctctctctgtcacctcc

SEQ ID NO: 2418 - DNA, 176 bp, Oryza sativa
ttgtcttgagaggggaagagatctctatgggttttggaggtctgacagaagagagtgagcacacacggtgctttcttagcatgcaagagccatgctgggagctgtgcgtgctcactctctatctgtcagccgttcaccatgcccaatatgattaatctccttctctcagttgacag

SEQ ID NO: 2419 - DNA, 149 bp, Oryza sativa
ggaggaagagaggggtgagaggtgaggctgacagaagagagtgagcacacatggtgactttcttgcatgctgaatggactcatgcttgaagctatgtgtgctcacttctctctctgtcagccatttgatctctctttctctctttctcc

SEQ ID NO: 2420 - DNA, 129 bp, Oryza sativa
ggagaagctctcatgagattgacagaagagagtgagcacacggcgtgatggccggcataaaatctatcccgtcctcgccgcgtgctcactcctctttctgtcaccctctttctctcagggctcaactcc

SEQ ID NO: 2421 - DNA, 104 bp, Oryza sativa
ggcgcgaggtgacagaagagagtgagcacacggccgggcgtgacggcaccggcgggcgtgccgtcgcggccgcgtgctcactgctctttctgtcatccggtgcc

SEQ ID NO: 2422 - DNA, 186 bp, Oryza sativa
agttgacagaagagagtgagcacacagcggccagactgcatcgatctatcaatcttcccttcgacaggatagctagatagaaagaaagagaggccgtcggcggccatggaagagagagagagagagagatgaaatgatgatgatgatacagctgccgctgcgtgctcacttctctttctgtcagct

SEQ ID NO: 2423 - DNA, 116 bp, Oryza sativa
ggctgacagaagagagtgagcacacagcgggcagactgcatctgaattacctgttgcgacgaagaagacgacggacgcagcttgccgttgcgtgctcacttctctctctgtcagct

SEQ ID NO: 2424 - DNA, 101 bp, Oryza sativa
gagattgttgacagaagagagtgagcacacggcgcggcggctagccatcggcgggatgcctgcccccgccgcgtgctcgctcctctttctgtcagcatctc

SEQ ID NO: 2425 - DNA, 90 bp, Oryza sativa
ggtgacagaagagagtgagcacacggccgggcggaacggcaccggcggatgtgccgtcgcggccgcgtgctcactgctctgtctgtcatc

SEQ ID NO: 2426 - DNA, 165 bp, Oryza sativa
ttggggcggggcgggatcgagcatatgaaaggcgagattgttgacagaagagagtgagcacacggcgcggcggctagccatcggcgggatgcctgcccccgccgcgtgctcgctcctctttctgtcagcatctctcatcactccctcccgcatcccccgccccga

SEQ ID NO: 2427 - DNA, 106 bp, Oryza sativa
ttgagagtgatgacagaagagagagagcacaacccggcagcagcgacgacggcggtcgcttctgccagggccgtgtgctctctgatctatctgtcattgccgtcca

SEQ ID NO: 2428 - DNA, 156 bp, Oryza sativa
gctagggagccgacagaagagagtgagcatatatagttctttccttgcatatgtggtcatatgtgtgttgactgaagagatacatatatatagagagagagagttcatgtgcttgaagctatatgtgctcacttctctttctgtcagcaaattatc

SEQ ID NO: 2429 - DNA, 115 bp, Physcomitrella patens
ggcggtggaggatgtgggagtgacagaagagagtgagcacagctgagcatgtacatgaggaagtacttgcccatgtgtgctcactctcttcctgtcgcacctctcctttgacgct

SEQ ID NO: 2430 - DNA, 220 bp, Physcomitrella patens
gtgaggctcgagtgcagacactattcaagtgtgggcggggggagcgggagtgacagaagagagtgagcacggttgcgcctgtacgaggataacgtacttgctcaagtgtgctcactctcttcatgtcgcgcctctccctcgtcgttgtgacgtcatttgtgatgagagggtggggaggggggtgtgtgagggaggaggaggggaggtgaagggtgtggtg

SEQ ID NO: 2431 - DNA, 95 bp, Physcomitrella patens
gagtgggagtgacagaagagagtgagcacagttgagcatgtacgagggtgacgtacttgctgaagtgtgctcactctcttcatgtcacgcctctc

SEQ ID NO: 2432 - DNA, 83 bp, Pinus taeda; identical to SEQ ID NO: 194

SEQ ID NO: 2433 - DNA, 83 bp, Pinus taeda; identical to SEQ ID NO: 195

SEQ ID NO: 2434 - DNA, 101 bp, Populus trichocarpa
aaagaaagactgacagaagagagtgagcacacacgaaagtatatggtatgaaggcattccattgcagggtgtgtgctcacatctcttctgtcagcttccac

SEQ ID NO: 2435 - DNA, 101 bp, Populus trichocarpa
gtaagggaggtgacagaagagagtgagcacacagggtactttcttgcatgacatccatgcttgaaactttgcgtgctcactctctatctgtcaccccacca

SEQ ID NO: 2436 - DNA, 100 bp, Populus trichocarpa
cattagaaactgacagaagagagtgagcacacagaggcatatttgtataaatctataccattgcttttgcgtgctcacttctcattctgtcagcttccag

SEQ ID NO: 2437 - DNA, 101 bp, Populus trichocarpa
gtaagtgagttgacagaagagagtgagcacacagggtactttcttgcatgacgttcatgcttgaagctttgcgtgcccaccctctatctgtcaccccatca

SEQ ID NO: 2438 - DNA, 100 bp, Populus trichocarpa
cattagaaattgacagaagagagtgagcacacagaggcatatttgtataaaattataccattgcttttgcgtgctcatttctctttctgtcacttccaga

SEQ ID NO: 2439 - DNA, 101 bp, Populus trichocarpa
agagaaagactgacagaagagagtgagcacacacgaaagctaattgtatgaaagcataccattgcagggtgtgtgctcacttctcttctgtcagcttacat

SEQ ID NO: 2440 - DNA, 103 bp, Populus trichocarpa
ggtgatgttgttgacagaagatagagagcacagatgatgaaatgcatggagcttaattgcatctcactcctttgtgctctctagtcttctgtcatcaccttca

SEQ ID NO: 2441 - DNA, 103 bp, Populus trichocarpa
ggtgatgctgttgacagaagatagagagcactgacgatgaaatgcatggagcttaattgcatctcactcctttgtgctctctagtcttctgtcatcaccttca

SEQ ID NO: 2442 - DNA, 99 bp, Populus trichocarpa
tgtgatgttgttgacagaagatagagagcacagatgatgttttgcagtagactctggatctcactcctttgtgctctctatgcttctgccatcaccttc

SEQ ID NO: 2443 - DNA, 100 bp, Populus trichocarpa
ggtgatgttgttgacagaagatagagagcacagatgatgatatgcaatggactctgcatcccactcctttgtgctctctatgcttctgtcatcactttca

SEQ ID NO: 2444 - DNA, 101 bp, Populus trichocarpa
ttatgcatgctgacagaagagagggagcacaaccctgtaatagctaaagagagtctttgcttttgttggactgtgctttctcttcttctgtcaccaaccaa

SEQ ID NO: 2445 - DNA, 97 bp, Ricinus communis
gggcgtgacagaagagagtgagcacacatggttttcttgcatatcgatacttgatgcttttagctctgtgtgctcaccctctatctgtcgcccacct

SEQ ID NO: 2446 - DNA, 92 bp, Ricinus communis
gaaattgacagaagagagtgagcacacagaggcatttgtataaatctatacccttgcttttgcgtgctcacttctctttctgtcaagcttcc

SEQ ID NO: 2447 - DNA, 94 bp, Ricinus communis
ggaggtgacagaagagagtgagcacacatggtactttcctgcatgaattcatgctcgaagccttgcgtgcttactctctatctgtcaccccgcc

SEQ ID NO: 2448 - DNA, 93 bp, Ricinus communis
gagactgacagaagagagtgagcacacgcaggcaattgtatggaagccataccactgcaggtgcgtgctcacctctctttctgtcagcttcca

SEQ ID NO: 2449 - DNA, 95 bp, Ricinus communis
aatgttgacagaagagagagagcacaacccggcattaggctaaagagtctttgcctttgttgggagtgtgctctctcctcttctgtcatcatcac

SEQ ID NO: 2450 - DNA, 97 bp, Ricinus communis
ttttgttgacagaagatagagagcacaacttaacatacccaacgacagatttgtgtatgtgaagttttgtgctcttttttcttctgtcaacttatat

SEQ ID NO: 2451 - DNA, 97 bp, Ricinus communis
tgttgttgacagaagatagagagcactgacgatgaaatgcatgatgggactctgcatctcactcctttgtgctctctagtcttctgtcatcatcacc

SEQ ID NO: 2452 - DNA, 97 bp, Ricinus communis
tgttgttgacagaagatagagagcacagatgatgatgtgcaatgactttttctgcatctcactcctttgtgctctctatgcttctgtcatcaccttc

SEQ ID NO: 2453 - DNA, 84 bp, Sorghum bicolor
tgacagaagagagtgagcacacggcgcgacgaacggcataatatgtatgtcgtcctcgccgcgtgctcacttctctttctgtca

SEQ ID NO: 2454 - DNA, 84 bp, Sorghum bicolor
tgacagaagagagtgagcacacacggtggtttcttagcatgagtgccatgttgggagctgtgcgtgctcactctctatctgtca

SEQ ID NO: 2455 - DNA, 95 bp, Sorghum bicolor
tgacagaagagagtgagcacacatggtgcctttcttgcatgatgaatgagtggattcatgctcgaagctatgcgtgctcacttctctctctgtca

SEQ ID NO: 2456 - DNA, 125 bp, Sorghum bicolor
tggacctctggagtgagtgatgacagaagagagagagcacaacccagcaccagcgaggagaagcctcgcttctgcgagggccgtgtgctctctgctctcactgtcatcgccgacaggccacccaa

SEQ ID NO: 2457 - DNA, 123 bp, Sorghum bicolor
cgattaggccctgaagagattgacagaagagagcgagcacccggcgcggcggccggcatggagcgcatgccgtccccgccgcgtgctcgcttctctttctgtcagcctctctctcgtcctggg

SEQ ID NO: 2458 - DNA, 128 bp, Sorghum bicolor
gctgacagaagagagtgagcacgcatcggccagactgcatctatatacggctgctcctggcgagatatggatggatggatgtctaggcgcagctgctgttgcgtgctcacttctctttctgtcagctc

SEQ ID NO: 2459 - DNA, 89 bp, Sorghum bicolor
gtgacagaagagagtgagcacacggccggcggaacggcaccggcggatgtgccgtcgcggccgcgtgctcactgctctatctgtcatcc

SEQ ID NO: 2460 - DNA, 94 bp, Sorghum bicolor
gtgacagaagagagtgagcacacggccgggcgtgacggcaccggtcaaggatgtgccgtcgcggccgcgtgctcactgctctttctgtcatccg

SEQ ID NO: 2461 - DNA, 121 bp, Sorghum bicolor
actgacagaagagagtgagcacacagcgggcagactgcatcgatctgaaccgagacgacgcaagtaggaatgatgatgatgatgcagctgctgctgcgtgctcacttctctctctgtcaga

SEQ ID NO: 2462 - DNA, 100 bp, Solanum lycopersicum
ttgacagaagatagagagcactaatgatgatatgctaatttcattcaatttgggcagcaaaagcatctcaattcatttgtgctctctatgcttctgtcat

SEQ ID NO: 2463 - DNA, 84 bp, Solanum lycopersicum
ttgacagaagatagagagcacgaataatgaggtgctaattggaagctgcaccttaattccttgtgatctctatacttctgtcat

SEQ ID NO: 2464 - DNA, 83 bp, Solanum lycopersicum
ttgacagaagatagagagcacgaataacgaggtgctaattggaacatgcaccttaattctttgtgctctcattcttttgtcat

SEQ ID NO: 2465 - DNA, 102 bp, Selaginella moellendorffii
ttgtcactggcgacagaagagagtgagcacacggggccccgtccatggatcgcatggattgagcttcgcgtgctcactctctgtctgtcagctgtgcctgtt

SEQ ID NO: 2466 - DNA, 112 bp, Selaginella moellendorffii; identical to SEQ ID NO: 198

SEQ ID NO: 2467 - DNA, 100 bp, Selaginella moellendorffii
ggagactgatttgacagaagaaagagagcacatttggctgcacgctcttggttctagtgtgtcactcatgcgtgctcttcttcttctgtcatatcgcaac

SEQ ID NO: 2468 - DNA, 103 bp, Selaginella moellendorffii
ggatctattgttgacagaagacagggagcaccagcagccaccagctctagagaggcttttgggtgcttgtgctctctattcttctgccatcaatccgactcgg

SEQ ID NO: 2469 - DNA, 137 bp, Saccharum officinarum
ggtggagaagaggtggaggctgacagaagagagtgagcacacatggtgcctttcttgcatgatgaacgatcgagaggttcatgctcgaagctatgcgtgctcacttctctctctgtcagccgttagaactctctctc

SEQ ID NO: 2470 - DNA, 543 bp, Saccharum spp
  misc_feature (340)..(340): n is a, c, g, or t
  misc_feature (415)..(415): n is a, c, g, or t
  misc_feature (446)..(446): n is a, c, g, or t
aggctgacagaagagagtgagcacacatggtgcctttcttgcatgatgaacgatcgagaggttcatgctcgaagctatgcgtgctcacttctctctctgtcagccgttagaactctctctcgatcgcaccctccctcgatctctctttcgttctctgtcaatctctcccatggtgatatttatttgcttgtctgcgtgttctctttcctaagcacagacacgaccagttcacggtgccttaggtgtttttttgcactttgcctgaagagaggaaggcaagggggagatgggtttttgaaggtttgacagaagagagtgagcacacacggtggtttcttancatgagtgccatgctgggagctgtgcgtgctcactctctatctgtcagccactcatcaggcccatctctctggtntccgcggctatatgttcgagcccttgaagtntcttggacacagatcgatctcttgtgcaattatatgattatagaagctaaatatgattaacatgtggatctcaatgtcgggtatatcctcctcctat

SEQ ID NO: 2471 - DNA, 278 bp, Triticum aestivum
tcctctctctctctctctctgcgtgtcgaccgtctgctgtgtccgatgggatcggtcgggggctgcggtggagggttgatgatggtgcgaatggctgacagaagagagtgagcacacagcggcagactacgtctggtaaagaggacggatggatgcgaagagagatatagacgcagctgctgttgcgtgctcaccctctctctgtcagcgttccgccatcaatcaatctatccatccatctccccttgccgttcccatcgcttcgcagctcgactgcc

SEQ ID NO: 2472 - DNA, 124 bp, Theobroma cacao
ggggaagatcatgaccatgttgacagaagagagagagcacaacccggcatcagctaaagaaagtctttgcttttgttgggagtgtgctttctcttcttctgtcaccatcatcttttcaccccct

SEQ ID NO: 2473 - DNA, 129 bp, Theobroma cacao
gggttttagggtaagggaggtgacagaagagagtgagcacacagggtgctttcttgcatgcttggctttcatgcttgaagctctgcgtgctcactctctatctgtcatccacctctctctctctctctc

SEQ ID NO: 2474 - DNA, 121 bp, Theobroma cacao
gaagagggacacagagagactgacagaagagagtgagcacacgcaggcaattgtatgaaaagccatgcctttgcgggtgcgtgctcacttctcttctgtcagcttcggcttttgcattgtg

SEQ ID NO: 2475 - DNA, 125 bp, Theobroma cacao
gaccaggtctgtcaggaaggtgacagaagagagtgagcacacagggttctttcttgcatgagtgcctcatgcttgaaactttatgtgcttgctctccttccgtcacccgcctctttctctccccc

SEQ ID NO: 2476 - DNA, 123 bp, Theobroma cacao
aggaggaactggtgatgttgttgacagaagatagagagcacagatgatgagatgcatggagcctgcatttcactcctttgtgctctctattcttctgtcatcacctttcatcccctcacttaa

SEQ ID NO: 2477 - DNA, 124 bp, Theobroma cacao
tacggatgaggacgcttttgttgacagaagatagagagcacaactgaacatacccagaaaaggcctgtgtatgagcagccttgtgctctcttttcttctgtcaatggaattttctgtcagagtt

SEQ ID NO: 2478 - DNA, 120 bp, Theobroma cacao
cattcttgggacatagaaattgacagaagagagtgagcacacagaggcacttgtataagtctatacttttgcttttgcgtgctcacttctctttctgtcagcttccagtgccggaatttg

SEQ ID NO: 2479 - DNA, 104 bp, Vitis vinifera
agaaatatgttgacagaagagagggagcacaacccagcatcagctaaagactctttgcttttcttgggagtgtgctctctcttcttctgtcatcatcacactcc

SEQ ID NO: 2480 - DNA, 102 bp, Vitis vinifera
cattgaaaactgacagaagagagtgagcacacagaggcaattgtataagtttatgcttttgcttttgcgtgctcatttctctttctgtcagcttccagtgcc

SEQ ID NO: 2481 - DNA, 104 bp, Vitis vinifera
aaggaataggtgacagaagagagtgagcacacatggtctgttcttgcatgggtccatgcttgaagctctgcgtgctcactctctatctgtcatctgtcctctct

SEQ ID NO: 2482 - DNA, 103 bp, Vitis vinifera
agagagagactgacagaagagagtgagcacatgcaggcaatttgtataagggtatacctatgccggtgcgtgctcacctctctttctgtcagcttcaggtgct

SEQ ID NO: 2483 - DNA, 108 bp, Vitis vinifera
gtatggtaggtgacagaggagagtgagcactcatggttcttttcttgcatgaagtttctatgcttgaagctctgtgtgcttactccctatctgtcacccctcaagcat

SEQ ID NO: 2484 - DNA, 105 bp, Vitis vinifera
ttatgttctgttgacagaagatagagagcacaactgaacatacccaagagggcttgtgtttgagcagtcttgtcctctctcttctcctgtcaacagaacttgctg

SEQ ID NO: 2485 - DNA, 103 bp, Vitis vinifera
ggtgatgttgttgacagaagatagagagcacagatgatgatgtgcatggagtttgcatctcactcctttgtgctctctagacttctgtcatcacctcagcccc

SEQ ID NO: 2486 - DNA, 228 bp, Vitis vinifera
tgcctcacaatgacagaagagagagagcatgctggtgggaaaacaattacaacttttgatcatctgatctggaaatgcttgtaagcggcattctcttggattgtaatctgaattctgcctctatcatcaacctgcccacaaacgatttccttcaactgagtgcctttccggcttgagccttctgcatgatcagctgagttctttctgcgcctttcattgtgtcctgcc

SEQ ID NO: 2487 - DNA, 103 bp, Vitis vinifera
ggtgacgttgttgacagaagatagagagcacagatgatgaaatgcaaggagccagcatctcactcctttgtgctctctattcttctgtcatcaccttaaggcc

SEQ ID NO: 2488 - DNA, 152 bp, Zea mays
ttcgttccgtggctaactgacagaagagagtgagcacacagcgggcagactgcatcgatcgatctgcatccgagacggcgcacgtacgaatgatgatgcagctgctgctgcgtgctcacttctctctctgtcagtcctctagctgctacggc

SEQ ID NO: 2489 - DNA, 124 bp, Zea mays
agatgagttttttgaaggtttgacagaagagagtgagcacacacggtggtttcttaccatgagtgtcatgctaggagctgtgcgtgctcaccctctatctgtcagtcactcatcaagcccatct

SEQ ID NO: 2490 - DNA, 139 bp, Zea mays
ggtggaggagaggtgaaagctgacagaagagagtgagcacacatggtgcctttcttgcatgatgtatgatcgagagagttcatgctcgaagctatgcgtgctcacttctctctttgtcagccattagaactcctctatc

SEQ ID NO: 2491 - DNA, 119 bp, Zea mays
aggctctcgagagattgacagaagagagtgagcacacggcgcgacgaacgacatagcatgtatgccgtcctcgccgcgtgctcacttctctttctgtcagcctctttctctcgatggct

SEQ ID NO: 2492 - DNA, 126 bp, Zea mays
ccggcgggcgcgcgcgcggtgacagaagagagtgagcacacggccggtgtgacggcaccggcgcggatgtgccgtcgcggccgcgtgctcactgctctctctgtcatccgctggcacaccctcacg

SEQ ID NO: 2493 - DNA, 167 bp, Zea mays
tggctgctagatggtgtggctgacagaagagagtgagcacgcatcggccagactgcatctatatacggctgccccaaagcgacggatcgatggatgcctagcctaggcctaggcgcagctgctgttgcgtgctcacttctctttctgtcagctctctctctcatcct

SEQ ID NO: 2494 - DNA, 121 bp, Zea mays
ggctgacagaagagagtgagcacgcatcggccagactgcatctatatacggctgctcctggcgaatggatagatgccaaggcgcagctgctgttgcgtgctcacttctctttctgtcagct

SEQ ID NO: 2495 - DNA, 115 bp, Zea mays
cgggctcgcgcgcgcgcggtgacagaagagagtgagcacacggccgggcgtgacggcacgtgccgtcgcggccgcgtgctcactgctctttctgtcatccgctggtccgggcctc

SEQ ID NO: 2496 - DNA, 117 bp, Zea mays
cgcggcgggcggtgacagaagagagtgagcacacggccgggcggaacggcaccggcggatggtgccgtcgcggacgcgtgctcactgctctatctgtcatccactctctcccccgct

SEQ ID NO: 2497 - DNA, 125 bp, Zea mays
cgagtggacctcgggagcgatgacagaagagagagagcacaacccagcaccagcgaggaaaagcctcgcttctgcgagggccgtgtgctctctgctctcactgtcatcgcccacaggccaccgaa

SEQ ID NO: 2498 - DNA, 123 bp, Zea mays
ggcttaggccccgaagagattgacagaagagagcgagcacctggcgcggcgaccggcatggaacgcatgccgtccccgccgcgtgctcgcttctctttctgtcagcctctccctcgtcctgag

SEQ ID NO: 2499 - DNA, 90 bp, Zea mays
gtgacagaagagagtgagcacacggccgggcggaacggcaccggcggatgtgccgtcgcggccgcgtgctcactgctctatctgtcaccc

SEQ ID NO: 2500 - DNA, 135 bp, Arachis hypogaea; identical to SEQ ID NO: 2366

SEQ ID NO: 2501 - DNA, 139 bp, Arachis hypogaea; identical to SEQ ID NO: 2367

SEQ ID NO: 2502 - DNA, 123 bp, Arabidopsis lyrata
gaggcattgagagtgttgacagaagatagagagcacagatgataagatacaattcggagcagtttctttgcatcttactcctttgtgctctctagccttctgtcatcaccttttatttgcttt

SEQ ID NO: 2503 - DNA, 97 bp, Arabidopsis lyrata
gtgttgacagaagatagagagcacagatgagaagatacaattcttcgcagcttctttgcatcttactcctttgtgctctctaagcttctgtcatcac

SEQ ID NO: 2504 - DNA, 293 bp, Arabidopsis lyrata
catactttatgatgttgcatatatcacacatacgtttgagagtgatgctggttgttgacagaagatagagagcactaaggatgacatgcaagcacatacatatatcatcacaccccatgtggatgataaaatatgtataacaaattcaagaaagagagagagagagagatcagatgtagagggagagggagagaaagagactgcatctctactcttttgtgctctctatacttctgtcaccacctttatttcttcttctctctcacctacatatacgcacagtcacatctatg

SEQ ID NO: 2505 - DNA, 256 bp, Arabidopsis lyrata
atgttgtatgtatagtggagggtgatagtgtggttgctgacagaagatagagagcactaaggatgatatgcaaaacacacacatatatgtgcttctaattgtatttcatacttaacatcaatgttgatgtgaatcgtgaaaaaaaaaaaagagagaagagctagaggagcatctgcatctctattcctatgtgctctctatgcttctgtcatcacctttttttctctatttctctctacacattacatattcacat

SEQ ID NO: 2506 - DNA, 98 bp, Arabidopsis thaliana; identical to SEQ ID NO: 177

SEQ ID NO: 2507 - DNA, 132 bp, Arabidopsis thaliana
tgggaggcattgatagtgttgacagaagatagagagcacagatgataagatacaattcctcgcagcttctttgcatcttactcctttgtgctctctagccttctgtcatcacccgttatttgccatcaccca

SEQ ID NO: 2508 - DNA, 217 bp, Arabidopsis thaliana
aggtttgagagtgatgttggttgttgacagaagatagagagcactaaggatgacatgcaagtacatacatatatatcatcacaccgcatgtggatgataaaatatgtataacaaattcaaagaaagagagggagagaaagagagagaacctgcatctctactcttttgtgctctctatacttctgtcaccacctttatctcttcttctctctaacct

SEQ ID NO: 2509 - DNA, 221 bp, Arabidopsis thaliana
gtggagggtgatagtgtggttgctgacagaagatagagagcactaaggatgctatgcaaaacagacacagatatgtgtttctaattgtatttcatactttaacctcaaagttgatataaaaaaagaaagaaagatagaagagctagaagactatctgcatctctattcctatgtgctctctatgcttctgtcatcacctttctttctctatttctctctac

SEQ ID NO: 2510 - DNA, 50 bp, Arabidopsis thaliana
gtgtttgatcccttgtgaatccgaagtagttgacagaagagagagagcac

SEQ ID NO: 2511 - DNA, 106 bp, Brassica oleracea
ggttgttgacagaagatagagagcactaaggatgacatgcaagtacaaggatataaggaaattcgcatctttactcttttgtgctctctatacttctgtcaatacc

SEQ ID NO: 2512 - DNA, 149 bp, Brassica rapa
gtgatgctggttgttgacagaagatagagagcactaaggatgacatgcaagtacatatgtatgtatcatcacaccgcctgtggatgattacaaaaatagcctgcatgtctactctttcgtgctctctatacttctgtcaccaccattat

SEQ ID NO: 2513 - DNA, 155 bp, Capsicum annuum
ttgacagaagagagagagcacgaggaaattccggtcctataaccatattgaacgtggattccttggcaccttgatgggaaacctcggctgtggtgcccttggagggcaagaacaagctagatgcattactctgtgcacccacaccccctgaaaac

SEQ ID NO: 2514 - DNA, 152 bp, Gossypium hirsutum
atgacagaagagagagagcacgtcctgttggcgacgatacatacggaaaactcccagtcatcggtttattatcatgacgaaacttcctggtagcagaatcttgaagaggtttttcttctcgctcattatgacctgctaatctccttctgcaa

SEQ ID NO: 2515 - DNA, 147 bp, Glycine max
gtgccaatactctgccgaggaaggaagtggtaagtgatgctgagtgattgagtgtgttgcccgagtggagtgttccaaagaaagggacttagtctcatatgcaccccatgaagatgaagttattcgttgacagaagagagagagcac

SEQ ID NO: 2516 - DNA, 101 bp, Gossypium raimondii
gttgttgacagaagatagagagcacagatgatggtgtgcaattaggagtcttgaagcaatgcatcccactcctttgtgctctttatgcttctgtcatcacc

SEQ ID NO: 2517 - DNA, 91 bp, Gossypium raimondii
gttgttgacagaagatagagagcacagatgatggtgttgcctatgtgcatgcatcccactcctttgtgctctctatgcttctgtcatcatc

SEQ ID NO: 2518 - DNA, 183 bp, Gossypium raimondii
ttgacagaagagagagagcacgatgaagatcttgcgtcgtagccatgtttgaatcaactctggattcttctacacctacaaaatttgaccaaatttgttaagcttgtatatcagttccataaggagagcatcattttaacaaccattaaaggccttcagaaccatcactcatctcccatccaa

SEQ ID NO: 2519 - DNA, 89 bp, Gossypium raimondii
aagttcggagttgatcatgtcatttaacccaagagtcaatccctgatttctggagccccatggttgatttgacagaagagagagagcac

SEQ ID NO: 2520 - DNA, 86 bp, Helianthus annuus
ttgacagaagatagagagcacagagaagcatgaattgcacatagatattgcaattcactccttcgtgctctctatgcttctgtcat

SEQ ID NO: 2521 - DNA, 364 bp, Helianthus annuus
ttgacagaagagagagagcacggtatgcttttgcgttggaacatgcatacgaaagtaactaatcatacgataaattatcaaaactactgtcgatagagtaattaggaaaacaaaccttgatgaaaaacaccggctgtgtgctgggaattgcgtgtggtttcccaaatagagttcaaagcaggttcgggttgaaccagttcaggaacattgttagacacaaaacttatttgatgttgcccatcataaaatgatgaagactgacttcttgagttaaagtggacagtttctttttctttttgtggctttcggcgacgggcattgtggtcagaaagcctctggcgacagctccgcttcttcccatcaa

SEQ ID NO: 2522 - DNA, 283 bp, Ipomoea batatas; identical to SEQ ID NO: 184

SEQ ID NO: 2523 - DNA, 126 bp, Ipomoea nil
ttgacagaagatagagagcatgctagaaattacattgataagctatgtggttcagagaccaatcttcttatgagttccaataaggagttggtttgtccccccactggtattacgtcttcaggttga

SEQ ID NO: 2524 - DNA, 183 bp, Ipomoea nil
ttgacagaagatagagagcatgctagaaattacattgataagctatgtggttcagagaccaatcttcttatgagttccaataaggagttggtttgtccccccactggtattacgtcttcaggttgacccttcaccacgaggatcatatgtaattctcctgcggcgctcattgtgacctgccaa

SEQ ID NO: 2525 - DNA, 58 bp, Lotus japonicus
ttgacagaagatagagagcacaacctgagtcgaaagatccaggtttgccgtctgaaga

SEQ ID NO: 2526 - DNA, 86 bp, Lotus japonicus
ttgacagaagagagagagcacaacccaggaatggtgaaagagagtctttgcttttgttgggagtgtgctctcccttcttctgtcat

SEQ ID NO: 2527 - DNA, 460 bp, Lotus japonicus
ttgacagaagatagagagcatccatgcatagagaccagcaacactatttaaaaggtttcaatgggtgactttattaattcatttatatgcttgcctcaatgcccatctcattgatgaaatcattgtccatgatagtcaattgcatttttgcgacgcctctcattatgcccagccagacgcctcctacaactccttttagagtcatcaaattctgatagctcatggaatctgctacattgctggcaaaaccgttgatgcatccctgcaatgtgtacggcatgagctttggcatggtactcacaaaccttatgccgccggtggtactgcttagcctcacttagatcagcatcacaattttccacctgacaagaaggtggcactgagcttccacctttagaccctctcttgctatatagatctgtaactactctctttcttctaccctcttcttcttcatctt

SEQ ID NO: 2528 - DNA, 357 bp, Lactuca sativa
ttgacagaagagagagagcacagttggagtcctcacggactccattaaaacaccctcctggtggaacataaggaggtggattatccaggttgctttgccatggaagcggtgggaacttttctccggcaattgggaggtcgatggcggctcgaggcggtggtgccgcccttgttcctggccactgaatccttcctcttgagcatgacgaaaagtccattagaaagcctccagaattcccattgttttcaaagattgaggaggagacagttccatagcgagtggatagcagagatggctttcttctacgttcattgtgcccagccaatcgtctcctgcagcttctttttccctggtcaa

SEQ ID NO: 2529 - DNA, 111 bp, Medicago truncatula
ttgacagaagatagagggcactaaggatgatatgcatacacatatatatacaacatggaggaggagcttaattgcatttcatttcctttgtgctctctagacttctgtcat

SEQ ID NO: 2530 - DNA, 140 bp, Nuphar advena
atgcacttgcagctcatcatccaaaacagaaccgaattgcaaatcctgtggcaccattttcgccaatggcttttggttcatggatggagcagtgttgatcccaacattgttccatccctttgacagaagacagagagcac

SEQ ID NO: 2531 - DNA, 191 bp, Nuphar advena
ttgacagaagacagagagcacgcccatcatcagcacccgataaattaatgtcattgtatcaggtgatgaaacaactgcggggtctgctgttgcttcagacatgaggcaaaccggtatgctccttctcggaagctggggtttggacttgtaggttcaggaaagcgtacagctgtgccatctgtattccagga

SEQ ID NO: 2532 - DNA, 69 bp, Nuphar advena
ttgacagaagacagagagcacgcccattgtcagaagtacccgataaatactctgtaccaccaccatcat

SEQ ID NO: 2533 - DNA, 169 bp, Nicotiana benthamiana
ctgctagcttcatttcctttaaaccgcaatgaagggcttgagaagtgattggtaggtgcaccatgggaatcagaaggttgaatggtgtgtatcccatcaatgttagctccaagacttgagggtggattccttgatccccaggaccgatttgacagaagagagagagcac

SEQ ID NO: 2534 - DNA, 207 bp, Nicotiana benthamiana
ttgacagaagagagagagcaccattggaatctgagactccagagaagcagtttccggaaggaataataccaggaccagaataattggcacccctagcaactgaaccttgcagaacaaggtcggatgtcggattttcagaactgttcagccaatgactttggagaagcttccctgacgcagtggattgattatcccatcctcgatcag

SEQ ID NO: 2535 - DNA, 131 bp, Nicotiana tabacum
ttgacagaagatagagagcacagatgatgatcatgtctgctaaatctgggattggagagggcactgaatcaattaaactgcagagaataaaaagcatctcaattcatttgtgctctctatgcttccgtcat

SEQ ID NO: 2536 - DNA, 216 bp, Persea americana
ttgacagaagagagagagcacgccgaatgtccggtgttgcatccaggttagaagtgatcatggatggcttctagaccttgattgaggaccctcggcagtggcgcccttgaatgacaagagcttgtcaaagtcatgacaacgaagagtagagatggtgcttggaagctctacaccaggcagatgcagatgcccatcaatgccttctcctctcgtaga

SEQ ID NO: 2537 - DNA, 116 bp, Prunus armeniaca
ttgacagaagagagagagcacgctaggctagaggtacaaaagaggcattttatatgagagagatatgtagcaatcctcgctttttaataaccatgcctgctctggggttttgttca

SEQ ID NO: 2538 - DNA, 184 bp, Phaseolus coccineus
ttgacagaagatagagagcatcctttgaggccagcaacagtgatttgagtttcaagatctcaatgggaaactttatttcaatcacatgcttgcctcaaggtttattaatgttcatggttacatagaagaaattattctccacgacagtcaactgcatttttgcgacgcctctcattatggccaa

SEQ ID NO: 2539 - DNA, 356 bp, Populus tremuloides
gtgcatctaagctaaatgtcaaactagatactgaccttcacttaatttgttaagatgaatacatcgcttcagcagtaagtcatctggatggaattgaagtcattcccctttgatgttcttaacagctgaaactcttgaaagtaactgctaccatcagtgtgacgtcaaggtatgcacttgagagtcagttgacggttgctcagtccgccaatactctgatgaagcaagtggtgagttttggggtataacttgcagcacagactgagtggtgtgatttgtatgcatgggttgttcaaatgaaatagattgcggttcacgtgaaccccatgaattgtttgacagaagagagagagcac

SEQ ID NO: 2540 - DNA, 86 bp, Sorghum bicolor
ttgacagaagagagtgagcacacggcgcgacgaacggcataatatgtatgtcgtcctcgccgcgtgctcacttctctttcggtcag

SEQ ID NO: 2541 - DNA, 83 bp, Sesamum indicum
ttgacagaagagagagagcacagcccgccattgacaaagaggtctttgccttttgtgggattgtgctctcttgcttctgccaa

SEQ ID NO: 2542 - DNA, 53 bp, Solanum lycopersicum
ttgacagaagatagagagcatgcttaacccacatcttgtttatgttgcttcag

SEQ ID NO: 2543 - DNA, 430 bp, Solanum lycopersicum
ttgacagaagatagagagcatgcttaacccacatcttgtttatgttgcttcagaaagtaggttatttggctgccattgatgctgatgcttcttcagcccaaattttctccatgagagtcatatgtaattttacggcggcgctcattgtgacctgccaaacgccttcggcaactcctcttagcatcatcaaactctgctaacagatgaaatctgctacattgctgacagaatcgcttctggagtccactaataagtactattggagactttgaatggaactcacacaccttgtggcggcgatggtatggcttggcatctgccatatctgcagtgcactgatcgacctggcaagaaggatgtgccgacccttcaccaactagcttcctaccagagagagtcaataccctttttcttttgctatcctcttcaa

SEQ ID NO: 2544 - DNA, 123 bp, Solanum lycopersicum
cggcttattctttttgtccttccctttacacaagggaaatgaaagtactattagctagatacttgaaggtcacaaataacaatttgcttagaaatccgggaattgacagaagatagagagcat

SEQ ID NO: 2545 - DNA, 91 bp, Solanum tuberosum
ttgacagaagatagagagcactaatgatgatatgctaatttcattcagcaaaagcatctcacttcatttgtgctctctatgcttctgtcat

SEQ ID NO: 2546 - DNA, 617 bp, Solanum tuberosum
gtcattcataggtggaacctgtgcagttatgttcaaaagttgaagaatcaagaaattacaattcttgggaattcatggcactggcaaacaaaaatttactgcataattcataatattagactttcttaatagtttaaaagcccaacctatatattatataccagtactaaacagaccttctgcttcatccaagttttgacatgtcaaaagggcaaaatgggaaggtcgccaaatcctgaaaatacaccaacacatcagatgttggcttcagttcaatgcattgagataaaagtctgtgtcgaatggagctttgaacactcccatttcctgaaagctaccgccactgttactattagcagccaatgtatggtaatgagtatcggatgaatgttgtccagcctgctgccagtattgactggacatatgcggcacaccctgtggaattgcctgcatcatctgctcgggcatgctggtttgatttgcatggttgagtgaaacagtctcaggctcggatgaaccccaggaattagttgacagaagagagagagcacgaggaaattccggtcctgtagccatattgaacatggattccttggcacctcgattaaaaacctcgg

SEQ ID NO: 2547 - DNA, 189 bp, Solanum tuberosum
ttgacagaagagagagagcaccacttgaatctgagactccaggaaaatagtctccagaaggaacactaggataactggtcctggtagctgaaccttgcaaaacaagctcactggcagcattttcagagttattcagccaaggacgttgaaggaacttccctgatgattgatgatcccatccttgttcag

SEQ ID NO: 2548 - DNA, 69 bp, Zinnia elegans
ttgacagaagagagagagcacgaagtgcatctacattgggagacgcgggctccttgaaacctggatcaa

SEQ ID NO: 2549 - DNA, 189 bp, Zea mays
gcgcgttcctggcgccgtcggcagcggggtcccgcgagcccgtccaggcgctcgacgccgcgtagctgctcgccatgacggacggcgccaccggggtgccgtcgaaggcgccggccgcgggcattgctggggaccggtggtcgtgggaggtcgtgtcccatggctgagttgacagaagagagagagcac

SEQ ID NO: 2550 - DNA, 135 bp, Arachis hypogaea; identical to SEQ ID NO: 2366

SEQ ID NO: 2551 - DNA, 139 bp, Arachis hypogaea; identical to SEQ ID NO: 2367

SEQ ID NO: 2552 - DNA, 123 bp, Arabidopsis lyrata; identical to SEQ ID NO: 2502

SEQ ID NO: 2553 - DNA, 97 bp, Arabidopsis lyrata; identical to SEQ ID NO: 2503

SEQ ID NO: 2554 - DNA, 293 bp, Arabidopsis lyrata; identical to SEQ ID NO: 2504

SEQ ID NO: 2555 - DNA, 256 bp, Arabidopsis lyrata; identical to SEQ ID NO: 2505

SEQ ID NO: 2556 - DNA, 98 bp, Arabidopsis thaliana; identical to SEQ ID NO: 177

SEQ ID NO: 2557 - DNA, 132 bp, Arabidopsis thaliana; identical to SEQ ID NO: 2507

SEQ ID NO: 2558 - DNA, 217 bp, Arabidopsis thaliana; identical to SEQ ID NO: 2508

SEQ ID NO: 2559 - DNA, 221 bp, Arabidopsis thaliana; identical to SEQ ID NO: 2509

SEQ ID NO: 2560 - DNA, 50 bp, Arabidopsis thaliana; identical to SEQ ID NO: 2510

SEQ ID NO: 2561 - DNA, 106 bp, Brassica oleracea; identical to SEQ ID NO: 2511

SEQ ID NO: 2562 - DNA, 149 bp, Brassica rapa; identical to SEQ ID NO: 2512

SEQ ID NO: 2563 - DNA, 155 bp, Capsicum annuum; identical to SEQ ID NO: 2513

SEQ ID NO: 2564 - DNA, 152 bp, Gossypium hirsutum; identical to SEQ ID NO: 2514

SEQ ID NO: 2565 - DNA, 84 bp, Glycine max; identical to SEQ ID NO: 182

SEQ ID NO: 2566 - DNA, 147 bp, Glycine max; identical to SEQ ID NO: 2515

SEQ ID NO: 2567 - DNA, 101 bp, Gossypium raimondii; identical to SEQ ID NO: 2516

SEQ ID NO: 2568 - DNA, 91 bp, Gossypium raimondii; identical to SEQ ID NO: 2517

SEQ ID NO: 2569 - DNA, 183 bp, Gossypium raimondii; identical to SEQ ID NO: 2518

SEQ ID NO: 2570 - DNA, 89 bp, Gossypium raimondii; identical to SEQ ID NO: 2519

SEQ ID NO: 2571 - DNA, 86 bp, Helianthus annuus; identical to SEQ ID NO: 2520

SEQ ID NO: 2572 - DNA, 364 bp, Helianthus annuus; identical to SEQ ID NO: 2521

SEQ ID NO: 2573 - DNA, 126 bp, Ipomoea nil; identical to SEQ ID NO: 2523

SEQ ID NO: 2574 - DNA, 183 bp, Ipomoea nil; identical to SEQ ID NO: 2524

SEQ ID NO: 2575 - DNA, 58 bp, Lotus japonicus; identical to SEQ ID NO: 2525

SEQ ID NO: 2576 - DNA, 86 bp, Lotus japonicus; identical to SEQ ID NO: 2526

SEQ ID NO: 2577 - DNA, 460 bp, Lotus japonicus; identical to SEQ ID NO: 2527

SEQ ID NO: 2578 - DNA, 357 bp, Lactuca sativa; identical to SEQ ID NO: 2528

SEQ ID NO: 2579 - DNA, 111 bp, Medicago truncatula; identical to SEQ ID NO: 2529

SEQ ID NO: 2580 - DNA, 140 bp, Nuphar advena; identical to SEQ ID NO: 2530

SEQ ID NO: 2581 - DNA, 191 bp, Nuphar advena; identical to SEQ ID NO: 2531

SEQ ID NO: 2582 - DNA, 69 bp, Nuphar advena; identical to SEQ ID NO: 2532

SEQ ID NO: 2583 - DNA, 169 bp, Nicotiana benthamiana; identical to SEQ ID NO: 2533

SEQ ID NO: 2584 - DNA, 207 bp, Nicotiana benthamiana; identical to SEQ ID NO: 2534

SEQ ID NO: 2585 - DNA, 131 bp, Nicotiana tabacum; identical to SEQ ID NO: 2535

SEQ ID NO: 2586 - DNA, 216 bp, Persea americana; identical to SEQ ID NO: 2536

SEQ ID NO: 2587 - DNA, 116 bp, Prunus armeniaca; identical to SEQ ID NO: 2537

SEQ ID NO: 2588 - DNA, 184 bp, Phaseolus coccineus; identical to SEQ ID NO: 2538

SEQ ID NO: 2589 - DNA, 356 bp, Populus tremuloides; identical to SEQ ID NO: 2539

SEQ ID NO: 2590 - DNA, 86 bp, Sorghum bicolor; identical to SEQ ID NO: 2540

SEQ ID NO: 2591 - DNA, 83 bp, Sesamum indicum; identical to SEQ ID NO: 2541

SEQ ID NO: 2592 - DNA, 53 bp, Solanum lycopersicum; identical to SEQ ID NO: 2542

SEQ ID NO: 2593 - DNA, 430 bp, Solanum lycopersicum; identical to SEQ ID NO: 2543

SEQ ID NO: 2594 - DNA, 123 bp, Solanum lycopersicum; identical to SEQ ID NO: 2544

SEQ ID NO: 2595 - DNA, 91 bp, Solanum tuberosum; identical to SEQ ID NO: 2545

SEQ ID NO: 2596 - DNA, 617 bp, Solanum tuberosum; identical to SEQ ID NO: 2546

SEQ ID NO: 2597 - DNA, 189 bp, Solanum tuberosum; identical to SEQ ID NO: 2547

SEQ ID NO: 2598 - DNA, 69 bp, Zinnia elegans; identical to SEQ ID NO: 2548

SEQ ID NO: 2599 - DNA, 189 bp, Zea mays; identical to SEQ ID NO: 2549

SEQ ID NO: 2600 - DNA, 69 bp, Glycine max; identical to SEQ ID NO: 213

SEQ ID NO: 2601 - DNA, 152 bp, Malus x domestica; identical to SEQ ID NO: 185

SEQ ID NO: 2602 - DNA, 133 bp, Phaseolus vulgaris
gggatccggagattggagcaatcagaatttgtgggaatgggctgattgggaagcaatgtgtgctggtgcaatgcatttaatttcttcccaattccgcccattcctatgatctctgatgattctttcctttcct

SEQ ID NO: 2603 - DNA, 191 bp, Arabidopsis cebennensis; identical to SEQ ID NO: 2091

SEQ ID NO: 2604 - DNA, 192 bp, Arabidopsis halleri; identical to SEQ ID NO: 2092

SEQ ID NO: 2605 - DNA, 192 bp, Arabis hirsuta; identical to SEQ ID NO: 2093

SEQ ID NO: 2606 - DNA, 197 bp, Arachis hypogaea; identical to SEQ ID NO: 2094

SEQ ID NO: 2607 - DNA, 222 bp, Arabidopsis lyrata; identical to SEQ ID NO: 2095

SEQ ID NO: 2608 - DNA, 202 bp, Arabidopsis lyrata; identical to SEQ ID NO: 2096

SEQ ID NO: 2609 - DNA, 220 bp, Arabidopsis lyrata; identical to SEQ ID NO: 2097

SEQ ID NO: 2610 - DNA, 192 bp, Alliaria petiolata; identical to SEQ ID NO: 2098

SEQ ID NO: 2611 - DNA, 71 bp, Aquilegia coerulea; identical to SEQ ID NO: 176

SEQ ID NO: 2612 - DNA, 184 bp, Arabidopsis thaliana; identical to SEQ ID NO: 2099

SEQ ID NO: 2613 - DNA, 196 bp, Arabidopsis thaliana; identical to SEQ ID NO: 178

SEQ ID NO: 2614 - DNA, 225 bp, Arabidopsis thaliana; identical to SEQ ID NO: 179

SEQ ID NO: 2615 - DNA, 234 bp, Brachypodium distachyon; identical to SEQ ID NO: 2102

SEQ ID NO: 2616 - DNA, 183 bp, Brassica napus; identical to SEQ ID NO: 2103

SEQ ID NO: 2617 - DNA, 185 bp, Brassica rapa; identical to SEQ ID NO: 2104

SEQ ID NO: 2618 - DNA, 192 bp, Barbarea vulgaris; identical to SEQ ID NO: 2098

SEQ ID NO: 2619 - DNA, 193 bp, Camelina microcarpa; identical to SEQ ID NO: 2106

SEQ ID NO: 2620 - DNA, 193 bp, Conringia orientalis; identical to SEQ ID NO: 2106

SEQ ID NO: 2621 - DNA, 194 bp, Capsella rubella; identical to SEQ ID NO: 2108

SEQ ID NO: 2622 - DNA, 216 bp, Citrus sinensis; identical to SEQ ID NO: 2109

SEQ ID NO: 2623 - DNA, 192 bp, Descurainia sophia; identical to SEQ ID NO: 2110

SEQ ID NO: 2624 - DNA, 192 bp, Erysimum cheiri; identical to SEQ ID NO: 2111

SEQ ID NO: 2625 - DNA, 192 bp, Fourraea alpina; identical to SEQ ID NO: 2112

SEQ ID NO: 2626 - DNA, 200 bp, Festuca arundinacea; identical to SEQ ID NO: 2113

SEQ ID NO: 2627 - DNA, 214 bp, Glycine max; identical to SEQ ID NO: 183

SEQ ID NO: 2628 - DNA, 186 bp, Glycine max; identical to SEQ ID NO: 2115

SEQ ID NO: 2629 - DNA, 185 bp, Glycine max; identical to SEQ ID NO: 2116

SEQ ID NO: 2630 - DNA, 178 bp, Hordeum vulgare; identical to SEQ ID NO: 2117

SEQ ID NO: 2631 - DNA, 122 bp, Hordeum vulgare; identical to SEQ ID NO: 2118

SEQ ID NO: 2632 - DNA, 303 bp, Hordeum vulgare subsp. Vulgare; identical to SEQ ID NO: 2119

SEQ ID NO: 2633 - DNA, 174 bp, Hordeum vulgare subsp. Vulgare; identical to SEQ ID NO: 2120

SEQ ID NO: 2634 - DNA, 345 bp, Liriodendron tulipifera; identical to SEQ ID NO: 2121

SEQ ID NO: 2635 - DNA, 192 bp, Malcolmia maritima; identical to SEQ ID NO: 2122

SEQ ID NO: 2636 - DNA, 183 bp, Medicago truncatula; identical to SEQ ID NO: 2123

SEQ ID NO: 2637 - DNA, 62 bp, Medicago truncatula; identical to SEQ ID NO: 2124

SEQ ID NO: 2638 - DNA, 44 bp, Medicago truncatula; identical to SEQ ID NO: 2125

SEQ ID NO: 2639 - DNA, 192 bp, Nasturtium officinale; identical to SEQ ID NO: 2126

SEQ ID NO: 2640 - DNA, 274 bp, Oryza rufipogon; identical to SEQ ID NO: 2127

SEQ ID NO: 2641 - DNA, 272 bp, Oryza sativa; identical to SEQ ID NO: 2128

SEQ ID NO: 2642 - DNA, 272 bp, Oryza sativa; identical to SEQ ID NO: 2128

SEQ ID NO: 2643 - DNA, 188 bp, Oryza sativa; identical to SEQ ID NO: 2130

SEQ ID NO: 2644 - DNA, 197 bp, Oryza sativa; identical to SEQ ID NO: 2131

SEQ ID NO: 2645 - DNA, 189 bp, Oryza sativa; identical to SEQ ID NO: 2132

SEQ ID NO: 2646 - DNA, 188 bp, Oryza sativa; identical to SEQ ID NO: 188

SEQ ID NO: 2647 - DNA, 249 bp, Oryza sativa; identical to SEQ ID NO: 2135

SEQ ID NO: 2648 - DNA, 226 bp, Pennisetum glaucum; identical to SEQ ID NO: 2136

SEQ ID NO: 2649 - DNA, 193 bp, Picea sitchensis; identical to SEQ ID NO: 193

SEQ ID NO: 2650 - DNA, 210 bp, Pinus taeda; identical to SEQ ID NO: 2138

SEQ ID NO: 2651 - DNA, 184 bp, Pinus taeda; identical to SEQ ID NO: 2139

SEQ ID NO: 2652 - DNA, 85 bp, Pinus taeda; identical to SEQ ID NO: 2140

SEQ ID NO: 2653 - DNA, 183 bp, Populus trichocarpa; identical to SEQ ID NO: 2141

SEQ ID NO: 2654 - DNA, 187 bp, Populus trichocarpa; identical to SEQ ID NO: 2142

SEQ ID NO: 2655 - DNA, 183 bp, Populus trichocarpa; identical to SEQ ID NO: 2143

SEQ ID NO: 2656 - DNA, 194 bp, Populus trichocarpa; identical to SEQ ID NO: 2144

SEQ ID NO: 2657 - DNA, 192 bp, Populus trichocarpa; identical to SEQ ID NO: 2145

SEQ ID NO: 2658 - DNA, 201 bp, Populus trichocarpa; identical to SEQ ID NO: 2146

SEQ ID NO: 2659 - DNA, 174 bp, Phaseolus vulgaris; identical to SEQ ID NO: 2147

SEQ ID NO: 2660 - DNA, 174 bp, Phaseolus vulgaris; identical to SEQ ID NO: 2147

SEQ ID NO: 2661 - DNA, 174 bp, Phaseolus vulgaris; identical to SEQ ID NO: 2147

SEQ ID NO: 2662 - DNA, 174 bp, Phaseolus vulgaris; identical to SEQ ID NO: 2147

SEQ ID NO: 2663 - DNA, 180 bp, Ricinus communis; identical to SEQ ID NO: 2149

SEQ ID NO: 2664 - DNA, 192 bp, Rorippa indica; identical to SEQ ID NO: 2150

SEQ ID NO: 2665 - DNA, 175 bp, Schedonorus arundinaceus; identical to SEQ ID NO: 2151

SEQ ID NO: 2666 - DNA, 226 bp, Sorghum bicolor; identical to SEQ ID NO: 196

SEQ ID NO: 2667 - DNA, 253 bp, Sorghum bicolor; identical to SEQ ID NO: 2153

SEQ ID NO: 2668 - DNA, 177 bp, Solanum lycopersicum; identical to SEQ ID NO: 2154

SEQ ID NO: 2669 - DNA, 279 bp, Selaginella moellendorffii; identical to SEQ ID NO: 2155

SEQ ID NO: 2670 - DNA, 265 bp, Saccharum officinarum; identical to SEQ ID NO: 2156

SEQ ID NO: 2671 - DNA, 266 bp, Saccharum officinarum; identical to SEQ ID NO: 2157

SEQ ID NO: 2672 - DNA, 238 bp, Saccharum officinarum; identical to SEQ ID NO: 2158

SEQ ID NO: 2673 - DNA, 265 bp, Saccharum officinarum; identical to SEQ ID NO: 2159

SEQ ID NO: 2674 - DNA, 264 bp, Saccharum officinarum; identical to SEQ ID NO: 2160

SEQ ID NO: 2675 - DNA, 392 bp, Sorghum Propinquum; identical to SEQ ID NO: 2161

SEQ ID NO: 2676 - DNA, 261 bp, Saccharum spp; identical to SEQ ID NO: 2162

SEQ ID NO: 2677 - DNA, 191 bp, Sibara virginica; identical to SEQ ID NO: 2163

SEQ ID NO: 2678 - DNA, 177 bp, Triticum aestivum; identical to SEQ ID NO: 2164

SEQ ID NO: 2679 - DNA, 255 bp, Triticum aestivum; identical to SEQ ID NO: 2165

SEQ ID NO: 2680 - DNA, 192 bp, Thlaspi arvense; identical to SEQ ID NO: 2166

SEQ ID NO: 2681 - DNA, 194 bp, Vitis vinifera; identical to SEQ ID NO: 2167

SEQ ID NO: 2682 - DNA, 185 bp, Vitis vinifera; identical to SEQ ID NO: 2168

SEQ ID NO: 2683 - DNA, 190 bp, Vitis vinifera; identical to SEQ ID NO: 2169

SEQ ID NO: 2684 - DNA, 246 bp, Zea mays; identical to SEQ ID NO: 2170

SEQ ID NO: 2685 - DNA, 221 bp, Zea mays; identical to SEQ ID NO: 2171

SEQ ID NO: 2686 - DNA, 217 bp, Zea mays; identical to SEQ ID NO: 2172

SEQ ID NO: 2687 - DNA, 217 bp, Zea mays; identical to SEQ ID NO: 2173

SEQ ID NO: 2688 - DNA, 127 bp, Zea mays; identical to SEQ ID NO: 2174

SEQ ID NO: 2689 - DNA, 215 bp, Zea mays; identical to SEQ ID NO: 2175

SEQ ID NO: 2690 - DNA, 252 bp, Zea mays; identical to SEQ ID NO: 2176

SEQ ID NO: 2691 - DNA, 200 bp, Zea mays; identical to SEQ ID NO: 2177

SEQ ID NO: 2692 - DNA, 252 bp, Zea mays; identical to SEQ ID NO: 2178

SEQ ID NO: 2693 - DNA, 252 bp, Zea mays; identical to SEQ ID NO: 2179

SEQ ID NO: 2694 - DNA, 200 bp, Zea mays; identical to SEQ ID NO: 2180

SEQ ID NO: 2695 - DNA, 457 bp, Zea mays; identical to SEQ ID NO: 2181

SEQ ID NO: 2696 - DNA, 191 bp, Arabidopsis cebennensis; identical to SEQ ID NO: 2091

SEQ ID NO: 2697 - DNA, 192 bp, Arabidopsis halleri; identical to SEQ ID NO: 2092

SEQ ID NO: 2698 - DNA, 192 bp, Arabis hirsuta; identical to SEQ ID NO: 2093

SEQ ID NO: 2699 - DNA, 197 bp, Arachis hypogaea; identical to SEQ ID NO: 2094

SEQ ID NO: 2700 - DNA, 222 bp, Arabidopsis lyrata; identical to SEQ ID NO: 2095

SEQ ID NO: 2701 - DNA, 202 bp, Arabidopsis lyrata; identical to SEQ ID NO: 2096

SEQ ID NO: 2702 - DNA, 220 bp, Arabidopsis lyrata; identical to SEQ ID NO: 2097

SEQ ID NO: 2703 - DNA, 192 bp, Alliaria petiolata; identical to SEQ ID NO: 2098

SEQ ID NO: 2704 - DNA, 71 bp, Aquilegia coerulea; identical to SEQ ID NO: 176

SEQ ID NO: 2705 - DNA, 184 bp, Arabidopsis thaliana; identical to SEQ ID NO: 2099

SEQ ID NO: 2706 - DNA, 196 bp, Arabidopsis thaliana; identical to SEQ ID NO: 178

SEQ ID NO: 2707 - DNA, 225 bp, Arabidopsis thaliana; identical to SEQ ID NO: 179

SEQ ID NO: 2708 - DNA, 234 bp, Brachypodium distachyon; identical to SEQ ID NO: 2102

SEQ ID NO: 2709 - DNA, 183 bp, Brassica napus; identical to SEQ ID NO: 2103

SEQ ID NO: 2710 - DNA, 185 bp, Brassica rapa; identical to SEQ ID NO: 2104

SEQ ID NO: 2711 - DNA, 192 bp, Barbarea vulgaris; identical to SEQ ID NO: 2098

SEQ ID NO: 2712 - DNA, 193 bp, Camelina microcarpa; identical to SEQ ID NO: 2106

SEQ ID NO: 2713 - DNA, 193 bp, Conringia orientalis; identical to SEQ ID NO: 2106

SEQ ID NO: 2714 - DNA, 194 bp, Capsella rubella; identical to SEQ ID NO: 2108

SEQ ID NO: 2715 - DNA, 216 bp, Citrus sinensis; identical to SEQ ID NO: 2109

SEQ ID NO: 2716 - DNA, 192 bp, Descurainia sophia; identical to SEQ ID NO: 2110

SEQ ID NO: 2717 - DNA, 192 bp, Erysimum cheiri; identical to SEQ ID NO: 2111

SEQ ID NO: 2718 - DNA, 192 bp, Fourraea alpina; identical to SEQ ID NO: 2112

SEQ ID NO: 2719 - DNA, 200 bp, Festuca arundinacea; identical to SEQ ID NO: 2113

SEQ ID NO: 2720 - DNA, 214 bp, Glycine max; identical to SEQ ID NO: 183

SEQ ID NO: 2721 - DNA, 186 bp, Glycine max; identical to SEQ ID NO: 2115

SEQ ID NO: 2722 - DNA, 185 bp, Glycine max; identical to SEQ ID NO: 2116

SEQ ID NO: 2723 - DNA, 178 bp, Hordeum vulgare; identical to SEQ ID NO: 2117

SEQ ID NO: 2724 - DNA, 122 bp, Hordeum vulgare; identical to SEQ ID NO: 2118

SEQ ID NO: 2725 - DNA, 303 bp, Hordeum vulgare subsp. Vulgare; identical to SEQ ID NO: 2119

SEQ ID NO: 2726 - DNA, 174 bp, Hordeum vulgare subsp. Vulgare; identical to SEQ ID NO: 2120

SEQ ID NO: 2727 - DNA, 345 bp, Liriodendron tulipifera; identical to SEQ ID NO: 2121

SEQ ID NO: 2728 - DNA, 192 bp, Malcolmia maritima; identical to SEQ ID NO: 2122

SEQ ID NO: 2729 - DNA, 183 bp, Medicago truncatula; identical to SEQ ID NO: 2123

SEQ ID NO: 2730 - DNA, 62 bp, Medicago truncatula; identical to SEQ ID NO: 2124

SEQ ID NO: 2731 - DNA, 44 bp, Medicago truncatula; identical to SEQ ID NO: 2125

SEQ ID NO: 2732 - DNA, 192 bp, Nasturtium officinale; identical to SEQ ID NO: 2126

SEQ ID NO: 2733 - DNA, 274 bp, Oryza rufipogon; identical to SEQ ID NO: 2127

SEQ ID NO: 2734 - DNA, 272 bp, Oryza sativa; identical to SEQ ID NO: 2128

SEQ ID NO: 2735 - DNA, 272 bp, Oryza sativa; identical to SEQ ID NO: 2128

SEQ ID NO: 2736 - DNA, 188 bp, Oryza sativa; identical to SEQ ID NO: 2130

SEQ ID NO: 2737 - DNA, 197 bp, Oryza sativa; identical to SEQ ID NO: 2131

SEQ ID NO: 2738 - DNA, 189 bp, Oryza sativa; identical to SEQ ID NO: 2132

SEQ ID NO: 2739 - DNA, 191 bp, Oryza sativa; identical to SEQ ID NO: 187

SEQ ID NO: 2740 - DNA, 249 bp, Oryza sativa; identical to SEQ ID NO: 2135

SEQ ID NO: 2741 - DNA, 226 bp, Pennisetum glaucum; identical to SEQ ID NO: 2136

SEQ ID NO: 2742 - DNA, 193 bp, Picea sitchensis; identical to SEQ ID NO: 193

SEQ ID NO: 2743 - DNA, 210 bp, Pinus taeda; identical to SEQ ID NO: 2138

SEQ ID NO: 2744 - DNA, 184 bp, Pinus taeda; identical to SEQ ID NO: 2139

SEQ ID NO: 2745 - DNA, 85 bp, Pinus taeda; identical to SEQ ID NO: 2140

SEQ ID NO: 2746 - DNA, 183 bp, Populus trichocarpa; identical to SEQ ID NO: 2141

SEQ ID NO: 2747 - DNA, 187 bp, Populus trichocarpa; identical to SEQ ID NO: 2142

SEQ ID NO: 2748 - DNA, 183 bp, Populus trichocarpa; identical to SEQ ID NO: 2143

SEQ ID NO: 2749 - DNA, 194 bp, Populus trichocarpa; identical to SEQ ID NO: 2144

SEQ ID NO: 2750 - DNA, 192 bp, Populus trichocarpa; identical to SEQ ID NO: 2145

SEQ ID NO: 2751 - DNA, 201 bp, Populus trichocarpa; identical to SEQ ID NO: 2146

SEQ ID NO: 2752 - DNA, 174 bp, Phaseolus vulgaris; identical to SEQ ID NO: 2147

SEQ ID NO: 2753 - DNA, 174 bp, Phaseolus vulgaris; identical to SEQ ID NO: 2147

SEQ ID NO: 2754 - DNA, 174 bp, Phaseolus vulgaris; identical to SEQ ID NO: 2147

SEQ ID NO: 2755 - DNA, 174 bp, Phaseolus vulgaris; identical to SEQ ID NO: 2147

SEQ ID NO: 2756 - DNA, 180 bp, Ricinus communis; identical to SEQ ID NO: 2149

SEQ ID NO: 2757 - DNA, 192 bp, Rorippa indica; identical to SEQ ID NO: 2150

SEQ ID NO: 2758 - DNA, 175 bp, Schedonorus arundinaceus; identical to SEQ ID NO: 2151

SEQ ID NO: 2759 - DNA, 226 bp, Sorghum bicolor; identical to SEQ ID NO: 196

SEQ ID NO: 2760 - DNA, 253 bp, Sorghum bicolor; identical to SEQ ID NO: 2153

SEQ ID NO: 2761 - DNA, 177 bp, Solanum lycopersicum; identical to SEQ ID NO: 2154

SEQ ID NO: 2762 - DNA, 279 bp, Selaginella moellendorffii; identical to SEQ ID NO: 2155

SEQ ID NO: 2763 - DNA, 265 bp, Saccharum officinarum; identical to SEQ ID NO: 2156

SEQ ID NO: 2764 - DNA, 266 bp, Saccharum officinarum; identical to SEQ ID NO: 2157

SEQ ID NO: 2765 - DNA, 238 bp, Saccharum officinarum; identical to SEQ ID NO: 2158

SEQ ID NO: 2766 - DNA, 265 bp, Saccharum officinarum; identical to SEQ ID NO: 2159

SEQ ID NO: 2767 - DNA, 264 bp, Saccharum officinarum; identical to SEQ ID NO: 2160

SEQ ID NO: 2768 - DNA, 392 bp, Sorghum Propinquum; identical to SEQ ID NO: 2161

SEQ ID NO: 2769 - DNA, 261 bp, Saccharum spp; identical to SEQ ID NO: 2162

SEQ ID NO: 2770 - DNA, 191 bp, Sibara virginica; identical to SEQ ID NO: 2163

SEQ ID NO: 2771 - DNA, 177 bp, Triticum aestivum; identical to SEQ ID NO: 2164

SEQ ID NO: 2772 - DNA, 255 bp, Triticum aestivum; identical to SEQ ID NO: 2165

SEQ ID NO: 2773 - DNA, 192 bp, Thlaspi arvense; identical to SEQ ID NO: 2166

SEQ ID NO: 2774 - DNA, 194 bp, Vitis vinifera; identical to SEQ ID NO: 2167

SEQ ID NO: 2775 - DNA, 185 bp, Vitis vinifera; identical to SEQ ID NO: 2168

SEQ ID NO: 2776 - DNA, 190 bp, Vitis vinifera; identical to SEQ ID NO: 2169

SEQ ID NO: 2777 - DNA, 246 bp, Zea mays; identical to SEQ ID NO: 2170

SEQ ID NO: 2778 - DNA, 221 bp, Zea mays; identical to SEQ ID NO: 2171

SEQ ID NO: 2779 - DNA, 217 bp, Zea mays; identical to SEQ ID NO: 2172

SEQ ID NO: 2780 - DNA, 217 bp, Zea mays; identical to SEQ ID NO: 2173

SEQ ID NO: 2781 - DNA, 127 bp, Zea mays; identical to SEQ ID NO: 2174

SEQ ID NO: 2782 - DNA, 215 bp, Zea mays; identical to SEQ ID NO: 2175

SEQ ID NO: 2783 - DNA, 252 bp, Zea mays; identical to SEQ ID NO: 2176

SEQ ID NO: 2784 - DNA, 200 bp, Zea mays; identical to SEQ ID NO: 2177

SEQ ID NO: 2785 - DNA, 252 bp, Zea mays; identical to SEQ ID NO: 2178

SEQ ID NO: 2786 - DNA, 252 bp, Zea mays; identical to SEQ ID NO: 2179

SEQ ID NO: 2787 - DNA, 200 bp, Zea mays; identical to SEQ ID NO: 2180

SEQ ID NO: 2788 - DNA, 457 bp, Zea mays; identical to SEQ ID NO: 2181

SEQ ID NO: 2789 - DNA, 194 bp, Oryza sativa
tcccgtcatcgctgccggcaaaggggggggtgccgcaacaaggagaggaggacggagtggggcaagtggagcgtcaaaggggatgtcatcgctgccgaatctgctagtgggacatccccttcgatgctccactcgccccaatatgtcctcctctccttgttgcggcaccccccttcgctggcagcgacgatggc

SEQ ID NO: 2790 - DNA, 191 bp, Arabidopsis cebennensis; identical to SEQ ID NO: 2091

SEQ ID NO: 2791 - DNA, 192 bp, Arabidopsis halleri; identical to SEQ ID NO: 2092

SEQ ID NO: 2792 - DNA, 192 bp, Arabis hirsuta; identical to SEQ ID NO: 2093

SEQ ID NO: 2793 - DNA, 197 bp, Arachis hypogaea; identical to SEQ ID NO: 2094

SEQ ID NO: 2794 - DNA, 222 bp, Arabidopsis lyrata; identical to SEQ ID NO: 2095

SEQ ID NO: 2795 - DNA, 202 bp, Arabidopsis lyrata; identical to SEQ ID NO: 2096

SEQ ID NO: 2796 - DNA, 220 bp, Arabidopsis lyrata; identical to SEQ ID NO: 2097

SEQ ID NO: 2797 - DNA, 192 bp, Alliaria petiolata; identical to SEQ ID NO: 2098

SEQ ID NO: 2798 - DNA, 71 bp, Aquilegia coerulea; identical to SEQ ID NO: 176

SEQ ID NO: 2799 - DNA, 184 bp, Arabidopsis thaliana; identical to SEQ ID NO: 2099

SEQ ID NO: 2800 - DNA, 196 bp, Arabidopsis thaliana; identical to SEQ ID NO: 178

SEQ ID NO: 2801 - DNA, 225 bp, Arabidopsis thaliana; identical to SEQ ID NO: 179

SEQ ID NO: 2802 - DNA, 234 bp, Brachypodium distachyon; identical to SEQ ID NO: 2102

SEQ ID NO: 2803 - DNA, 183 bp, Brassica napus; identical to SEQ ID NO: 2103

SEQ ID NO: 2804 - DNA, 185 bp, Brassica rapa; identical to SEQ ID NO: 2104

SEQ ID NO: 2805 - DNA, 192 bp, Barbarea vulgaris; identical to SEQ ID NO: 2098

SEQ ID NO: 2806 - DNA, 193 bp, Camelina microcarpa; identical to SEQ ID NO: 2106

SEQ ID NO: 2807 - DNA, 193 bp, Conringia orientalis; identical to SEQ ID NO: 2106

SEQ ID NO: 2808 - DNA, 194 bp, Capsella rubella; identical to SEQ ID NO: 2108

SEQ ID NO: 2809 - DNA, 216 bp, Citrus sinensis; identical to SEQ ID NO: 2109

SEQ ID NO: 2810 - DNA, 192 bp, Descurainia sophia; identical to SEQ ID NO: 2110

SEQ ID NO: 2811 - DNA, 192 bp, Erysimum cheiri; identical to SEQ ID NO: 2111

SEQ ID NO: 2812 - DNA, 192 bp, Fourraea alpina; identical to SEQ ID NO: 2112

SEQ ID NO: 2813 - DNA, 200 bp, Festuca arundinacea; identical to SEQ ID NO: 2113

SEQ ID NO: 2814 - DNA, 214 bp, Glycine max; identical to SEQ ID NO: 183

SEQ ID NO: 2815 - DNA, 186 bp, Glycine max; identical to SEQ ID NO: 2115

SEQ ID NO: 2816 - DNA, 185 bp, Glycine max; identical to SEQ ID NO: 2116

SEQ ID NO: 2817 - DNA, 178 bp, Hordeum vulgare; identical to SEQ ID NO: 2117

SEQ ID NO: 2818 - DNA, 122 bp, Hordeum vulgare; identical to SEQ ID NO: 2118

SEQ ID NO: 2819 - DNA, 303 bp, Hordeum vulgare subsp. Vulgare; identical to SEQ ID NO: 2119

SEQ ID NO: 2820 - DNA, 174 bp, Hordeum vulgare subsp. Vulgare; identical to SEQ ID NO: 2120

SEQ ID NO: 2821 - DNA, 345 bp, Liriodendron tulipifera; identical to SEQ ID NO: 2121

SEQ ID NO: 2822 - DNA, 192 bp, Malcolmia maritima; identical to SEQ ID NO: 2122

SEQ ID NO: 2823 - DNA, 183 bp, Medicago truncatula; identical to SEQ ID NO: 2123

SEQ ID NO: 2824 - DNA, 62 bp, Medicago truncatula; identical to SEQ ID NO: 2124

SEQ ID NO: 2825 - DNA, 44 bp, Medicago truncatula; identical to SEQ ID NO: 2125

SEQ ID NO: 2826 - DNA, 192 bp, Nasturtium officinale; identical to SEQ ID NO: 2126

SEQ ID NO: 2827 - DNA, 274 bp, Oryza rufipogon; identical to SEQ ID NO: 2127

SEQ ID NO: 2828 - DNA, 272 bp, Oryza sativa; identical to SEQ ID NO: 2128

SEQ ID NO: 2829 - DNA, 272 bp, Oryza sativa; identical to SEQ ID NO: 2128

SEQ ID NO: 2830 - DNA, 272 bp, Oryza sativa; identical to SEQ ID NO: 2128

SEQ ID NO: 2831 - DNA, 188 bp, Oryza sativa; identical to SEQ ID NO: 2130

SEQ ID NO: 2832 - DNA, 197 bp, Oryza sativa; identical to SEQ ID NO: 2131

SEQ ID NO: 2833 - DNA, 189 bp, Oryza sativa; identical to SEQ ID NO: 2132

SEQ ID NO: 2834 - DNA, 191 bp, Oryza sativa; identical to SEQ ID NO: 187

SEQ ID NO: 2835 - DNA, 188 bp, Oryza sativa; identical to SEQ ID NO: 188

SEQ ID NO: 2836 - DNA, 249 bp, Oryza sativa; identical to SEQ ID NO: 2135

SEQ ID NO: 2837 - DNA, 226 bp, Pennisetum glaucum; identical to SEQ ID NO: 2136

SEQ ID NO: 2838 - DNA, 210 bp, Pinus taeda; identical to SEQ ID NO: 2138

SEQ ID NO: 2839 - DNA, 184 bp, Pinus taeda; identical to SEQ ID NO: 2139

SEQ ID NO: 2840 - DNA, 85 bp, Pinus taeda; identical to SEQ ID NO: 2140

SEQ ID NO: 2841 - DNA, 183 bp, Populus trichocarpa; identical to SEQ ID NO: 2141

SEQ ID NO: 2842 - DNA, 187 bp, Populus trichocarpa; identical to SEQ ID NO: 2142

SEQ ID NO: 2843 - DNA, 183 bp, Populus trichocarpa; identical to SEQ ID NO: 2143

SEQ ID NO: 2844 - DNA, 194 bp, Populus trichocarpa; identical to SEQ ID NO: 2144

SEQ ID NO: 2845 - DNA, 192 bp, Populus trichocarpa; identical to SEQ ID NO: 2145

SEQ ID NO: 2846 - DNA, 201 bp, Populus trichocarpa; identical to SEQ ID NO: 2146

SEQ ID NO: 2847 - DNA, 174 bp, Phaseolus vulgaris; identical to SEQ ID NO: 2147

SEQ ID NO: 2848 - DNA, 174 bp, Phaseolus vulgaris; identical to SEQ ID NO: 2147

SEQ ID NO: 2849 - DNA, 174 bp, Phaseolus vulgaris; identical to SEQ ID NO: 2147

SEQ ID NO: 2850 - DNA, 174 bp, Phaseolus vulgaris; identical to SEQ ID NO: 2147

SEQ ID NO: 2851 - DNA, 180 bp, Ricinus communis; identical to SEQ ID NO: 2149

SEQ ID NO: 2852 - DNA, 192 bp, Rorippa indica; identical to SEQ ID NO: 2150

SEQ ID NO: 2853 - DNA, 175 bp, Schedonorus arundinaceus; identical to SEQ ID NO: 2151

SEQ ID NO: 2854 - DNA, 226 bp, Sorghum bicolor; identical to SEQ ID NO: 196

SEQ ID NO: 2855 - DNA, 253 bp, Sorghum bicolor; identical to SEQ ID NO: 2153

SEQ ID NO: 2856 - DNA, 177 bp, Solanum lycopersicum; identical to SEQ ID NO: 2154

SEQ ID NO: 2857 - DNA, 279 bp, Selaginella moellendorffii; identical to SEQ ID NO: 2155

SEQ ID NO: 2858 - DNA, 265 bp, Saccharum officinarum; identical to SEQ ID NO: 2156

SEQ ID NO: 2859 - DNA, 266 bp, Saccharum officinarum; identical to SEQ ID NO: 2157

SEQ ID NO: 2860 - DNA, 238 bp, Saccharum officinarum; identical to SEQ ID NO: 2158

SEQ ID NO: 2861 - DNA, 265 bp, Saccharum officinarum; identical to SEQ ID NO: 2159

SEQ ID NO: 2862 - DNA, 264 bp, Saccharum officinarum; identical to SEQ ID NO: 2160

SEQ ID NO: 2863 - DNA, 392 bp, Sorghum Propinquum; identical to SEQ ID NO: 2161

SEQ ID NO: 2864 - DNA, 261 bp, Saccharum spp; identical to SEQ ID NO: 2162

SEQ ID NO: 2865 - DNA, 191 bp, Sibara virginica; identical to SEQ ID NO: 2163

SEQ ID NO: 2866 - DNA, 177 bp, Triticum aestivum; identical to SEQ ID NO: 2164

SEQ ID NO: 2867 - DNA, 255 bp, Triticum aestivum; identical to SEQ ID NO: 2165

SEQ ID NO: 2868 - DNA, 192 bp, Thlaspi arvense; identical to SEQ ID NO: 2166

SEQ ID NO: 2869 - DNA, 194 bp, Vitis vinifera; identical to SEQ ID NO: 2167

SEQ ID NO: 2870 - DNA, 185 bp, Vitis vinifera; identical to SEQ ID NO: 2168

SEQ ID NO: 2871 - DNA, 190 bp, Vitis vinifera; identical to SEQ ID NO: 2169

SEQ ID NO: 2872 - DNA, 246 bp, Zea mays; identical to SEQ ID NO: 2170

SEQ ID NO: 2873 - DNA, 221 bp, Zea mays; identical to SEQ ID NO: 2171

SEQ ID NO: 2874 - DNA, 217 bp, Zea mays; identical to SEQ ID NO: 2172

SEQ ID NO: 2875 - DNA, 217 bp, Zea mays; identical to SEQ ID NO: 2173

SEQ ID NO: 2876 - DNA, 127 bp, Zea mays; identical to SEQ ID NO: 2174

SEQ ID NO: 2877 - DNA, 215 bp, Zea mays; identical to SEQ ID NO: 2175

SEQ ID NO: 2878 - DNA, 252 bp, Zea mays; identical to SEQ ID NO: 2176

SEQ ID NO: 2879 - DNA, 200 bp, Zea mays; identical to SEQ ID NO: 2177

SEQ ID NO: 2880 - DNA, 252 bp, Zea mays; identical to SEQ ID NO: 2178

SEQ ID NO: 2881 - DNA, 252 bp, Zea mays; identical to SEQ ID NO: 2179

SEQ ID NO: 2882 - DNA, 200 bp, Zea mays; identical to SEQ ID NO: 2180

SEQ ID NO: 2883 - DNA, 457 bp, Zea mays; identical to SEQ ID NO: 2181

SEQ ID NO: 2884 - DNA, 116 bp, Arachis hypogaea; identical to SEQ ID NO: 2365

SEQ ID NO: 2885 - DNA, 135 bp, Arachis hypogaea; identical to SEQ ID NO: 2366

SEQ ID NO: 2886 - DNA, 139 bp, Arachis hypogaea; identical to SEQ ID NO: 2367

SEQ ID NO: 2887 - DNA, 184 bp, Arabidopsis lyrata; identical to SEQ ID NO: 2368

SEQ ID NO: 2888 - DNA, 109 bp, Arabidopsis lyrata; identical to SEQ ID NO: 2369

SEQ ID NO: 2889 - DNA, 102 bp, Arabidopsis lyrata; identical to SEQ ID NO: 2370

SEQ ID NO: 2890 - DNA, 118 bp, Arabidopsis lyrata; identical to SEQ ID NO: 2371

SEQ ID NO: 2891 - DNA, 150 bp, Arabidopsis lyrata; identical to SEQ ID NO: 2372

SEQ ID NO: 2892 - DNA, 228 bp, Arabidopsis lyrata; identical to SEQ ID NO: 2373

SEQ ID NO: 2893 - DNA, 138 bp, Arabidopsis lyrata; identical to SEQ ID NO: 2374

SEQ ID NO: 2894 - DNA, 99 bp, Arabidopsis lyrata; identical to SEQ ID NO: 2375

SEQ ID NO: 2895 - DNA, 81 bp, Aquilegia coerulea; identical to SEQ ID NO: 2376

SEQ ID NO: 2896 - DNA, 83 bp, Aquilegia coerulea; identical to SEQ ID NO: 2377

SEQ ID NO: 2897 - DNA, 123 bp, Arabidopsis thaliana; identical to SEQ ID NO: 2378

SEQ ID NO: 2898 - DNA, 183 bp, Arabidopsis thaliana; identical to SEQ ID NO: 2379

SEQ ID NO: 2899 - DNA, 104 bp, Arabidopsis thaliana; identical to SEQ ID NO: 2380

SEQ ID NO: 2900 - DNA, 118 bp, Arabidopsis thaliana; identical to SEQ ID NO: 2381

SEQ ID NO: 2901 - DNA, 107 bp, Arabidopsis thaliana; identical to SEQ ID NO: 2382

SEQ ID NO: 2902 - DNA, 132 bp, Arabidopsis thaliana; identical to SEQ ID NO: 2383

SEQ ID NO: 2903 - DNA, 103 bp, Arabidopsis thaliana; identical to SEQ ID NO: 2384

SEQ ID NO: 2904 - DNA, 106 bp, Arabidopsis thaliana; identical to SEQ ID NO: 2385

SEQ ID NO: 2905 - DNA, 268 bp, Arabidopsis thaliana
  misc_feature (185)..(229): n is a, c, g, or t
  misc_feature (248)..(248): n is a, c, g, or t
gtgccactacttatctgacaattatctggctcggtgtatcgacctaaattcaaaacaggagacatatcattatcattgtccttgaatacccaaggcgggttcagatactgatgctggctaggtgcaggtggtggttgagccattgtaaccgtcatcgggccaaaacctgaagaagctcgccatgnnnnnnnnnnnnnnnnnnnnnnnnnnnnnnnnnnnnnnnnnnnnncatgtggttgatgtggatntgacagaagagagagagcac

SEQ ID NO: 2906 - DNA, 245 bp, Arabidopsis thaliana
tagatctttctgattctatctatctacctacttcttcttctactactcccaatgaaacgggaatgtctgcggaagacggacagcctcgttaccggatataaccgatccatcagagactgcactcgcattctcaaacaatcccgacccgtaaaaaactgtctcaactgcttcttgggacaaagaaagtggtggttgaagcaaatgagggactgacgaagaggaggatgacagaagagagagagcac

SEQ ID NO: 2907 - DNA, 47 bp, Arabidopsis thaliana
tgacagaagagagagagcacaatcagagtcatggatgcaactcgtca

SEQ ID NO: 2908 - DNA, 59 bp, Arabidopsis thaliana
tgacagaagagagagagcacagtttgagtcgccaattcccttgtagctctctagtttag

SEQ ID NO: 2909 - DNA, 326 bp, Arabidopsis thaliana
tgacagaagagagagagcacggtggatatcttgagattcatggaggactcctgagtattctcccacatcttcgccatgaagttgaaacttggactttcctgctgggaacccacctgaggtttgagatgtagagaacatacggctgctactagcaaccagctggtcctcagagccattacctctctggaagctcagagtaaagcttttttccgtttgtctaggctttgtatcataagtgttattaccccattcatacatttcttcagatctcgcgttaagggacaccccattccacaacatatttgtatgctgtcttcgatcataca

SEQ ID NO: 2910 - DNA, 218 bp, Arabidopsis thaliana
tgacagaagagagagagcacggtggatatcttgagattcatggaggactcctgagtattctcccacatcttcgccatgaagttgaaacttggactttcctgctgggaacccacctgaggtttgagatgtagagaacatacggctgctactagcaaccagctggtcctcagagccattacctctctggaagctcagagtaaagcttttttccgtttgtc

SEQ ID NO: 2911 - DNA, 147 bp, Brachypodium distachyon; identical to SEQ ID NO: 2386

SEQ ID NO: 2912 - DNA, 205 bp, Brachypodium distachyon; identical to SEQ ID NO: 2387

SEQ ID NO: 2913 - DNA, 146 bp, Brachypodium distachyon; identical to SEQ ID NO: 2388

SEQ ID NO: 2914 - DNA, 151 bp, Brachypodium distachyon; identical to SEQ ID NO: 2389

SEQ ID NO: 2915 - DNA, 82 bp, Brassica napus; identical to SEQ ID NO: 2390

SEQ ID NO: 2916 - DNA, 208 bp, Brassica napus; identical to SEQ ID NO: 2391

SEQ ID NO: 2917 - DNA, 155 bp, Brassica napus; identical to SEQ ID NO: 2392

SEQ ID NO: 2918 - DNA, 152 bp, Capsicum annuum
tgacagaagagagagagcacgaggaaattccggtcctataaccatattgaacgtggattccttggcaccttgatgggaaacctcggctgtggtgcccttggagggcaagaacaagctagatgcattactctgtgcacccacaccccctgaaa

SEQ ID NO: 2919 - DNA, 65 bp, Capsicum annuum
atggtttccttgaaccatccaaggcagagttgatgaaatgcctgttgacagaagagagggagcac

SEQ ID NO: 2920 - DNA, 101 bp, Citrus x paradisi x Poncirus trifoliata
agagagctactgacagaagagagtgagcacacgcaggtaattgtattagaaaatatctttgcaggtgcgtgctcgctcctcttctgtcagcgtcatttttg

SEQ ID NO: 2921 - DNA, 185 bp, Citrus x paradisi x Poncirus trifoliata
  misc_feature (8)..(8): n is a, c, g, or t
cagctttngatgacagaagagagagagcacgtcctgttggcgatggaaatggaaatctcccagtcatcaactcgtttacttgagaagagttccttgaaagagaatcgtgagagctctttcttctacgctcattgtggccggccagtctccttctgcaactcctcttcgagtcgtcaaattctgac

SEQ ID NO: 2922 - DNA, 67 bp, Cycas rumphii
atatcaaaagaagctgtccctggagcacttgaactccaagattgggatgacagaagagagagagcac

SEQ ID NO: 2923 - DNA, 103 bp, Citrus sinensis; identical to SEQ ID NO: 2393

SEQ ID NO: 2924 - DNA, 56 bp, Citrus sinensis
tgacagaagagagagagcacgtcctgttggcgaaggaaatggaaatctcccagtca

SEQ ID NO: 2925 - DNA, 515 bp, Citrus sinensis
gtaaattaaaatctccatatcacatgttacattatgcacaggctacattctggaaagacattttcataaagttataaatcaaaatcatatggactttttcaaatcaagaaattaatttcaagctggtaagcttgatgaaaggcaaactttaacaacaaaccaacattctagtcttgagaataagttcattgcagcaggattttcaagaagagaatccagaattattatatggaaagataacaacctcttagtgacttactactcccaatgaaagggaattgtttgaggggtatcactggctgcggacccatcatatcccaaatgaaacactccagggcaatgaacattatcatcctgatcactggataccagaacagattccatgggctctacactgtgattatgcaggcttgtgcccaaggaccgcaccagtggcattgaactaggcggcatcatttggctcaaactgataccagatgtctgtgttgttggtgatgacagaagagagagagcac

SEQ ID NO: 2926 - DNA, 190 bp, Citrus trifoliata; identical to SEQ ID NO: 2394

SEQ ID NO: 2927 - DNA, 150 bp, Eschscholzia californica
tgacagaagagagagagcacgaccggttggtggtgttaaaaatgagaaactgtcatcagtcaatctactctcttgagaagggtttcttgtgattgaatcactagaactcttccttcttctctcattatgtcctgctaatctccttctaca

SEQ ID NO: 2928 - DNA, 180 bp, Festuca arundinacea; identical to SEQ ID NO: 2395

SEQ ID NO: 2929 - DNA, 180 bp, Festuca arundinacea; identical to SEQ ID NO: 2395

SEQ ID NO: 2930 - DNA, 104 bp, Gossypium hirsutum; identical to SEQ ID NO: 2397

SEQ ID NO: 2931 - DNA, 113 bp, Gossypium hirsutum; identical to SEQ ID NO: 2398

SEQ ID NO: 2932 - DNA, 97 bp, Gossypium hirsutum; identical to SEQ ID NO: 2399

SEQ ID NO: 2933 - DNA, 96 bp, Gossypium hirsutum; identical to SEQ ID NO: 2400

SEQ ID NO: 2934 - DNA, 122 bp, Glycine max; identical to SEQ ID NO: 2401

SEQ ID NO: 2935 - DNA, 120 bp, Glycine max; identical to SEQ ID NO: 2402

SEQ ID NO: 2936 - DNA, 185 bp, Glycine max; identical to SEQ ID NO: 2403

SEQ ID NO: 2937 - DNA, 151 bp, Glycine max; identical to SEQ ID NO: 2404

SEQ ID NO: 2938 - DNA, 124 bp, Glycine max; identical to SEQ ID NO: 2405

SEQ ID NO: 2939 - DNA, 106 bp, Glycine max; identical to SEQ ID NO: 2406

SEQ ID NO: 2940 - DNA, 118 bp, Glycine max; identical to SEQ ID NO: 181

SEQ ID NO: 2941 - DNA, 147 bp, Glycine max
gtgaacttattcctatcatcttttcagaaacccgactcatgttgtaatggctgtggctgcttggaataaccatcgggtgagcaatgggaatccctgatgattggcccgaagagttctgggattgagatgacagaagagagagagcac

SEQ ID NO: 2942 - DNA, 117 bp, Glycine max
tgacagaagagagagagcacaaggaatagtgtcatgcagcgagttgttattattattacttgctgttgttgttgttgttaagctttcacagaacattttgcttctcgctcctccgcc

SEQ ID NO: 2943 - DNA, 362 bp, Helianthus annuus
tgacagaagagagagagcacggtatgcttttgcgttggaacatgcatacgaaagtaactaatcatacgataaattatcaaaactactgtcgatagagtaattaggaaaacaaaccttgatgaaaaacaccggctgtgtgctgggaattgcgtgtggtttcccaaatagagttcaaagcaggttcgggttgaaccagttcaggaacattgttagacacaaaacttatttgatgttgcccatcataaaatgatgaagactgacttcttgagttaaagtggacagtttctttttctttttgtggctttcggcgacgggcattgtggtcagaaagcctctggcgacagctccgcttcttcccatca

SEQ ID NO: 2944 - DNA, 178 bp, Hordeum vulgare subsp. Spontaneum
tgacagaagagagagagcacagtcggagtcgagcacgtgcgtcaactgtccatcggagaacatcttgttgctgctgctgctctcgggcggcggcggcagcggggcgacggccttgaggagaggctggcacacggggatctcgagtgccggcgcgccggtgctgaagctcatctggtct

SEQ ID NO: 2945 - DNA, 135 bp, Hordeum vulgare; identical to SEQ ID NO: 2407

SEQ ID NO: 2946 - DNA, 394 bp, Hordeum vulgare subsp. Vulgare
  misc_feature (266)..(266): n is a, c, g, or t
tgacagaagagagtgagcacacagcggcaggctacgtctgataagagcatggttaatagtatagccaactgctggctataagcatctttatagctcatcttatagctggcttgtacaatagttagctgtaaaagagtactacttttatcatatatggcctacctttcattctcacaaagcacctatgagcacgtgctagagccggctcttcacgaagagcccgcttcccttctctctcctcttctctctcatccaactcagcaaanatatagtattttaatccttacagcctgctgactgtaccttattgtacttgctctaaagaggacggatggatgcgaagagagagagagatagacgcagctgctgttgcgtgctcaccctctctctgtct

SEQ ID NO: 2947 - DNA, 86 bp, Hordeum vulgare subsp. Vulgare
ggccgtcgacattgccggggaccggatgtggctggagctgtgggcactactatcccatggctgagttgacagaagagagagagcac

SEQ ID NO: 2948 - DNA, 178 bp, Hordeum vulgare subsp. Vulgare
tgacagaagagagagagcacagtcggagtcgagcacgtgcgtcaactgtccatcggagaacatcttgttgctgctgctgctctcgggcggcggcggcagcggggcgacggccttgaggagaggctggcacacggggatctcgagtgctggcgcgccggtgctgaagctcatctggtct

SEQ ID NO: 2949 - DNA, 203 bp, Hordeum vulgare subsp. Vulgare
tgacagaagagagagagcacagctagagtcactaacttccgtgaaccattctccttgagaagttgtggtactggaaaaaccggtccctcctagtgaaccttgaaggaaaatatcacccgaagaaggattctcctagttgtttgaccacggatgatgatgatgaagtgactttcccggagctgtgttttgatttccctcgtgcc

SEQ ID NO: 2950 - DNA, 47 bp, Lotus japonicus
tgacagaagagagagagcacaagaggactcttggactgaacttgtta

SEQ ID NO: 2951 - DNA, 355 bp, Lactuca sativa
tgacagaagagagagagcacagttggagtcctcacggactccattaaaacaccctcctggtggaacataaggaggtggattatccaggttgctttgccatggaagcggtgggaacttttctccggcaattgggaggtcgatggcggctcgaggcggtggtgccgcccttgttcctggccactgaatccttcctcttgagcatgacgaaaagtccattagaaagcctccagaattcccattgttttcaaagattgaggaggagacagttccatagcgagtggatagcagagatggctttcttctacgttcattgtgcccagccaatcgtctcctgcagcttctttttccctggtca

SEQ ID NO: 2952 - DNA, 109 bp, Malus x domestica
tgcatcccctgttgaggcgagttgttatgatagctttggctggtatcaagtggaacaggtttcgacccgcttgaaacccaaggactcgttgacagaagagagagagcac

SEQ ID NO: 2953 - DNA, 79 bp, Malus x domestica
tgacagaagagagagagcacagtccgaatcgtgggtttgagttgttaacctgtcacaaaacgtcttgctctttgttgtc

SEQ ID NO: 2954 - DNA, 460 bp, Medicago truncatula; identical to SEQ ID NO: 2408

SEQ ID NO: 2955 - DNA, 95 bp, Medicago truncatula; identical to SEQ ID NO: 2409

SEQ ID NO: 2956 - DNA, 98 bp, Medicago truncatula; identical to SEQ ID NO: 2410

SEQ ID NO: 2957 - DNA, 90 bp, Medicago truncatula; identical to SEQ ID NO: 2411

SEQ ID NO: 2958 - DNA, 172 bp, Medicago truncatula; identical to SEQ ID NO: 2412

SEQ ID NO: 2959 - DNA, 94 bp, Medicago truncatula; identical to SEQ ID NO: 2413

SEQ ID NO: 2960 - DNA, 120 bp, Medicago truncatula; identical to SEQ ID NO: 2414

SEQ ID NO: 2961 - DNA, 94 bp, Medicago truncatula; identical to SEQ ID NO: 2415

SEQ ID NO: 2962 - DNA, 93 bp, Medicago truncatula; identical to SEQ ID NO: 2416

SEQ ID NO: 2963 - DNA, 205 bp, Nicotiana benthamiana
tgacagaagagagagagcaccattggaatctgagactccagagaagcagtttccggaaggaataataccaggaccagaataattggcacccctagcaactgaaccttgcagaacaaggtcggatgtcggattttcagaactgttcagccaatgactttggagaagcttccctgacgcagtggattgattatcccatcctcgatca

SEQ ID NO: 2964 - DNA, 169 bp, Nicotiana benthamiana; identical to SEQ ID NO: 2533

SEQ ID NO: 2965 - DNA, 93 bp, Oryza rufipogon
ctgacagaagagagtgagcacacatggtgactttcttgcatgctgaatggactcatgcttgaagctatgtgtgctcacttctctctctgtcag

SEQ ID NO: 2966 - DNA, 100 bp, Oryza sativa; identical to SEQ ID NO: 2417

SEQ ID NO: 2967 - DNA, 176 bp, Oryza sativa; identical to SEQ ID NO: 2418

SEQ ID NO: 2968 - DNA, 149 bp, Oryza sativa; identical to SEQ ID NO: 2419

SEQ ID NO: 2969 - DNA, 129 bp, Oryza sativa; identical to SEQ ID NO: 2420

SEQ ID NO: 2970 - DNA, 104 bp, Oryza sativa; identical to SEQ ID NO: 2421

SEQ ID NO: 2971 - DNA, 186 bp, Oryza sativa; identical to SEQ ID NO: 2422

SEQ ID NO: 2972 - DNA, 116 bp, Oryza sativa; identical to SEQ ID NO: 2423

SEQ ID NO: 2973 - DNA, 101 bp, Oryza sativa; identical to SEQ ID NO: 2424

SEQ ID NO: 2974 - DNA, 90 bp, Oryza sativa; identical to SEQ ID NO: 2425

SEQ ID NO: 2975 - DNA, 165 bp, Oryza sativa; identical to SEQ ID NO: 2426

SEQ ID NO: 2976 - DNA, 106 bp, Oryza sativa; identical to SEQ ID NO: 2427

SEQ ID NO: 2977 - DNA, 156 bp, Oryza sativa; identical to SEQ ID NO: 2428

SEQ ID NO: 2978 - DNA, 86 bp, Oryza sativa
tgacagaagagagtgagcacacggcgcggcggctagccatcggcgggatgcctgcccccgccgcgtgctcgctcctctttctgtca

SEQ ID NO: 2979 - DNA, 97 bp, Oryza sativa
tgacagaagagagtgagcaccctgcgtcgatgttgcgatcatatctcctctcccgccctcgcggaaagtaatggcgtatttgcggccttgccggtca

SEQ ID NO: 2980 - DNA, 179 bp, Oryza sativa
atgattctttctcttgagttcttgaggttttatttggtttttctttgagtttttactcgtttttctcgatttctcgatttcgatgactcggaactaaataggttctctaatgacaagtaagagcaagaaatttctagcacggagaagctctcatgagattgacagaagagagtgagcat

SEQ ID NO: 2981 - DNA, 133 bp, Oryza sativa
gagtttttactcgtttttctcgatttctcgatttcgatgactcggaactaaataggttctctaatgacaagtaagagcaagaaatttctagcacggagaagctctcatgagattgacagaagagagtgagctc

SEQ ID NO: 2982 - DNA, 243 bp, Oryza sativa
ccctctctctctatctccctgcagctgctgcctagctccagtacggccaccgtcgaacgatcggtctctctctctcaccggatccgagaagcaaagaaccgatcttttttcttcttttttcccctgcgtgatgcttcttgtttactactacgtgggtgcagtgcaagtttgttgatcgatcttggggcggggcgggatcgatcatatgaaaggcgtagattgttgacagaacagagtgagcac

SEQ ID NO: 2983 - DNA, 83 bp, Oryza sativa
tgacagaagagagagagcacgctgaacatctagtgctccatctagttttgaagcagtttcagatgcatctgcaccttttattg

SEQ ID NO: 2984 - DNA, 114 bp, Prunus armeniaca
tgacagaagagagagagcacgctaggctagaggtacaaaagaggcattttatatgagagagatatgtagcaatcctcgctttttaataaccatgcctgctctggggttttgttc

SEQ ID NO: 2985 - DNA, 146 bp, Populus trichocarpa x Populus deltoides
tgctggttcactttccattccaagggcattatagttcaagcttgggatcaaggactgagcaggagagttcaggtctggctgcatcatgtcgctcaaaccaatctcccgagtctcagatggtggagatgacagaagagagagagcac

SEQ ID NO: 2986 - DNA, 103 bp, Phleum pratense
ctgacagaagagagtgagcacacatggtgcttttcttgcatggtgaattaatgggagagagttcatgcttgaagctatgtgtgctcacttctctctctgtcag

SEQ ID NO: 2987 - DNA, 115 bp, Physcomitrella patens; identical to SEQ ID NO: 2429

SEQ ID NO: 2988 - DNA, 220 bp, Physcomitrella patens; identical to SEQ ID NO: 2430

SEQ ID NO: 2989 - DNA, 95 bp, Physcomitrella patens; identical to SEQ ID NO: 2431

SEQ ID NO: 2990 - DNA, 83 bp, Pinus taeda; identical to SEQ ID NO: 195

SEQ ID NO: 2991 - DNA, 101 bp, Populus trichocarpa; identical to SEQ ID NO: 2434

SEQ ID NO: 2992 - DNA, 101 bp, Populus trichocarpa; identical to SEQ ID NO: 2435

SEQ ID NO: 2993 - DNA, 100 bp, Populus trichocarpa; identical to SEQ ID NO: 2436

SEQ ID NO: 2994 - DNA, 101 bp, Populus trichocarpa; identical to SEQ ID NO: 2437

SEQ ID NO: 2995 - DNA, 100 bp, Populus trichocarpa; identical to SEQ ID NO: 2438

SEQ ID NO: 2996 - DNA, 101 bp, Populus trichocarpa; identical to SEQ ID NO: 2439

SEQ ID NO: 2997 - DNA, 103 bp, Populus trichocarpa; identical to SEQ ID NO: 2440

SEQ ID NO: 2998 - DNA, 103 bp, Populus trichocarpa; identical to SEQ ID NO: 2441

SEQ ID NO: 2999 - DNA, 99 bp, Populus trichocarpa; identical to SEQ ID NO: 2442

SEQ ID NO: 3000 - DNA, 100 bp, Populus trichocarpa; identical to SEQ ID NO: 2443

SEQ ID NO: 3001 - DNA, 101 bp, Populus trichocarpa; identical to SEQ ID NO: 2444

SEQ ID NO: 3002 - DNA, 373 bp, Populus tremula
catgctcatagttcacatcagagccatataagggctaaaagatcattcagaccttcacttaatttgttaagatgaatacatcgcttcagcagtaagtcatctggatggaattgaagtcattcccctttgatgttcttaacagctgaaactcttgaaagtaactgctaccatcagtgtgacgtcgaggtatgcacttgagagtcagttgacggttgctcagtccgccaatactctgatgaagccagtggtgagttttggggtataacttgcagcacagactgagtggtgtgatttgtatgcatgggttgttcaaatgaaatagattgcggttcacgcgaaccccatgaattgtttgacagaagagagagagcac

SEQ ID NO: 3003 - DNA, 46 bp, Populus tremuloides
tgacagaagagagtgagcgcgcaatccgagtcttgtacttgtgttg

SEQ ID NO: 3004 - DNA, 356 bp, Populus tremuloides; identical to SEQ ID NO: 2539

SEQ ID NO: 3005 - DNA, 85 bp, Populus tremuloides
tgacagaagagagagagcacaatccgagtcttgtatttgtgttaacctgtcacagaacattctatggctacttgctccactactt

SEQ ID NO: 3006 - DNA, 97 bp, Ricinus communis; identical to SEQ ID NO: 2445

SEQ ID NO: 3007 - DNA, 92 bp, Ricinus communis; identical to SEQ ID NO: 2446

SEQ ID NO: 3008 - DNA, 94 bp, Ricinus communis; identical to SEQ ID NO: 2447

SEQ ID NO: 3009 - DNA, 93 bp, Ricinus communis; identical to SEQ ID NO: 2448

SEQ ID NO: 3010 - DNA, 95 bp, Ricinus communis; identical to SEQ ID NO: 2449

SEQ ID NO: 3011 - DNA, 97 bp, Ricinus communis; identical to SEQ ID NO: 2450

SEQ ID NO: 3012 - DNA, 97 bp, Ricinus communis; identical to SEQ ID NO: 2451

SEQ ID NO: 3013 - DNA, 97 bp, Ricinus communis; identical to SEQ ID NO: 2452

SEQ ID NO: 3014 - DNA, 84 bp, Sorghum bicolor; identical to SEQ ID NO: 2453

SEQ ID NO: 3015 - DNA, 84 bp, Sorghum bicolor; identical to SEQ ID NO: 2454

SEQ ID NO: 3016 - DNA, 95 bp, Sorghum bicolor; identical to SEQ ID NO: 2455

SEQ ID NO: 3017 - DNA, 125 bp, Sorghum bicolor; identical to SEQ ID NO: 2456

SEQ ID NO: 3018 - DNA, 123 bp, Sorghum bicolor; identical to SEQ ID NO: 2457

SEQ ID NO: 3019 - DNA, 128 bp, Sorghum bicolor; identical to SEQ ID NO: 2458

SEQ ID NO: 3020 - DNA, 89 bp, Sorghum bicolor; identical to SEQ ID NO: 2459

SEQ ID NO: 3021 - DNA, 94 bp, Sorghum bicolor; identical to SEQ ID NO: 2460

SEQ ID NO: 3022 - DNA, 121 bp, Sorghum bicolor; identical to SEQ ID NO: 2461

SEQ ID NO: 3023 - DNA, 81 bp, Sesamum indicum
tgacagaagagagagagcacagcccgccattgacaaagaggtctttgccttttgtgggattgtgctctcttgcttctgcca

SEQ ID NO: 3024 - DNA, 100 bp, Solanum lycopersicum; identical to SEQ ID NO: 2462

SEQ ID NO: 3025 - DNA, 84 bp, Solanum lycopersicum; identical to SEQ ID NO: 2463

SEQ ID NO: 3026 - DNA, 83 bp, Solanum lycopersicum; identical to SEQ ID NO: 2464

SEQ ID NO: 3027 - DNA, 102 bp, Selaginella moellendorffii; identical to SEQ ID NO: 2465

SEQ ID NO: 3028 - DNA, 112 bp, Selaginella moellendorffii; identical to SEQ ID NO: 198

SEQ ID NO: 3029 - DNA, 100 bp, Selaginella moellendorffii; identical to SEQ ID NO: 2467

SEQ ID NO: 3030 - DNA, 103 bp, Selaginella moellendorffii; identical to SEQ ID NO: 2468

SEQ ID NO: 3031 - DNA, 137 bp, Saccharum officinarum; identical to SEQ ID NO: 2469

SEQ ID NO: 3032 - DNA, 68 bp, Saccharum officinarum
tgacagaagagagagagcacagctagagtccgaggggactcctgcaagacatcctttcgccaggtcga

SEQ ID NO: 3033 - DNA, 327 bp, Saccharum officinarum
gcacgctccccagtccaagtcctcagcactaccatcaattttgaacccagcagctgcacataaacccagcagcagcacataaaaacaggacaatttaattctactgccaacagaatggcagtgcctgtgaagaatcctcaaacatagcatcaggaacaaacacatggtggccaacaccggccgcaaatgcaatggtcatagctgttgttgcagcctgcgacacagcagcgatccgagagagtgaagaggcaacctggggttggccatcggtggggatgccagcagcagaggggcgatgcagcaacggtgacagaagagagagagcac

SEQ ID NO: 3034 - DNA, 70 bp, Saccharum officinarum
cgtgagaagtagtctgctggatgacggctgaacttccccacgagccgtctgacagaagagagagagcacg

SEQ ID NO: 3035 - DNA, 46 bp, Saccharum officinarum
tgacagaagagagagagcacaactggagtcggtggtaactcctgca

SEQ ID NO: 3036 - DNA, 403 bp, Saccharum officinarum
tgacagaagagagagagcacactcagagtcgagcacgggggtgagcccgtcggagaacatcttgttgctgctgctgctctcgggcggcagcagggccacggcggcggtggtcttgaggaggggctggcacaccgtggagacctccagcgtcccggctcctgcgctgaagctgatttggtcgccatcctggaggaacgggaagcgccggccttccttggagtaggccgacgacgtggagccaccggcgaagtgcggcctgttgctgaggaccgcgtggggtgtgtagtatgaagtgtcctcggatttgatgactccagaccagcttggctccggtcttggagccgggaacgacgagaaccttgtcccttgttgacttgtcataaagctcccagagttcatggta

SEQ ID NO: 3037 - DNA, 343 bp, Saccharum officinarum
gtgcttgctgtctgcataaggtccagcgtcgtgtgccacgcaccgggcggcgccacgtggtaccggccaccgccaacgccactgtgggggtgcgggcgccagctgctggctgcctgatcgggcagcgggagggcgcaacccgccgccgacgaagaggcaaaatgctggccgggcgccgatgagcggtccgacaagtactgccacgcgaggagtgaggcgcggttctcggcgataaggtcgtcgagcgccgcgctggagcgcgcggagatgtccggcgtcgtgaccagccagggagcaccgctcgccgcgccgcctctggccgatgacagaagagagagagcac

SEQ ID NO: 3038 - DNA, 82 bp, Saccharum officinarum
gttgcaggcattgatccgccatggctgtggccggcgctgtgggtagtatcccatggctgagttgacagaagagagagagcac

SEQ ID NO: 3039 - DNA, 125 bp, Sorghum Propinquum
tgacagaagagagagagcacattccgagtcgagcacgcgagtcagcccgtcggagaacatcttgttgcccccgccggcgctgctgctgctgctgctctcgggtggtgctactgctaccgtcttga

SEQ ID NO: 3040 - DNA, 543 bp, Saccharum spp; identical to SEQ ID NO: 2470
  misc_feature (340)..(340): n is a, c, g, or t
  misc_feature (415)..(415): n is a, c, g, or t
  misc_feature (446)..(446): n is a, c, g, or t

SEQ ID NO: 3041 - DNA, 86 bp, Solanum tuberosum
tgacagaagagagtgagcacacgcagtcgaattgtataaacatttatacaattgtcatttgcgtgtgctcacttctcattctgtca

SEQ ID NO: 3042 - DNA, 382 bp, Solanum tuberosum
atgctgcttcatttcatggaatgtctttgatgctccacttgatgaagctgcgacgacaactgaagcaaatcaatagtggtaccatcttcacaagaaagtagattcctggtgtttacgtaatctgatccttgaagacttccacaattgtttcttagcatctgttccaagtgaccctctgcagaaattacttcagataaattataaatattggacactgtacttgctgaaccctttgggctagctcctgggaaacattcagatgtctgtgtcatgttgtaatgggtgttactgcgaggtgtaataaggtggtgagcactaggaggaactacagatgaataatttgatgtgtcctgtgattgagatgacagaagagagagagcac

SEQ ID NO: 3043 - DNA, 85 bp, Solanum tuberosum
tgacagaagagagagagcacgaggaaattccggtcctgtagccatattgaacatggattccttggcacctcgattaaaaacctcg

SEQ ID NO: 3044 - DNA, 171 bp, Solanum tuberosum
tgacagaagagagagagcacgatcagaatcaacaatatcatttaatccactggagaagatcttttgtccgctgctagaaattcctgctgcagaagtgggatgttcaaaaagtggctggcagattgaagaagattcagtcagactatgatcactgccttgcatgaactggaa

SEQ ID NO: 3045 - DNA, 72 bp, Solanum tuberosum
tgacagaagagagagagcacgaggaaattccggtcctgtaaccatattgaacatggattccttggcacctcg

SEQ ID NO: 3046 - DNA, 278 bp, Triticum aestivum; identical to SEQ ID NO: 2471

SEQ ID NO: 3047 - DNA, 52 bp, Triticum aestivum
tgacagaagagagagagcacgctgaagatccggtgctccacctaattttgaa

SEQ ID NO: 3048 - DNA, 416 bp, Triticum aestivum
tgacagaagagagagagcacgctgaagatccggtgctccacctaattttgaagcggttacagatgcgtccggacctttcattggtagcagctcagctatgtcatgactcagtgctggaacagcattgggtagatgagatttatcaaaatgaacttgtccattgattgatacttctcttatttccttcacttgcgggagcttgaagtcagatgggctgtcccatggagaacatgggaaaggccttgcatggctgagtggatctttattccagacaaaacttatttgccgtctatcatcaaacaccaatgacgacgggagccttgccggtgtaaaggagaatgcgtctggctgtggtttccggcgccgagcattgtgatcggacagccgcctccggcagctcctcttcttctggtcga

SEQ ID NO: 3049 - DNA, 124 bp, Theobroma cacao; identical to SEQ ID NO: 2472

SEQ ID NO: 3050 - DNA, 129 bp, Theobroma cacao; identical to SEQ ID NO: 2473

SEQ ID NO: 3051 - DNA, 121 bp, Theobroma cacao; identical to SEQ ID NO: 2474

SEQ ID NO: 3052 - DNA, 125 bp, Theobroma cacao; identical to SEQ ID NO: 2475

SEQ ID NO: 3053 - DNA, 123 bp, Theobroma cacao; identical to SEQ ID NO: 2476

SEQ ID NO: 3054 - DNA, 124 bp, Theobroma cacao; identical to SEQ ID NO: 2477

SEQ ID NO: 3055 - DNA, 120 bp, Theobroma cacao; identical to SEQ ID NO: 2478

SEQ ID NO: 3056 - DNA, 85 bp, Trifolium repens
ttgacagaagagagtgagcacatgttggttgtgattgtatgatagcatataattcttagtgtgtgctcactcctctttctgtcat

SEQ ID NO: 3057 - DNA, 104 bp, Vitis vinifera; identical to SEQ ID NO: 2479

SEQ ID NO: 3058 - DNA, 102 bp, Vitis vinifera; identical to SEQ ID NO: 2480

SEQ ID NO: 3059 - DNA, 104 bp, Vitis vinifera; identical to SEQ ID NO: 2481

SEQ ID NO: 3060 - DNA, 103 bp, Vitis vinifera; identical to SEQ ID NO: 2482

SEQ ID NO: 3061 - DNA, 108 bp, Vitis vinifera; identical to SEQ ID NO: 2483

SEQ ID NO: 3062 - DNA, 105 bp, Vitis vinifera; identical to SEQ ID NO: 2484

SEQ ID NO: 3063 - DNA, 103 bp, Vitis vinifera; identical to SEQ ID NO: 2485

SEQ ID NO: 3064 - DNA, 228 bp, Vitis vinifera; identical to SEQ ID NO: 2486

SEQ ID NO: 3065 - DNA, 103 bp, Vitis vinifera; identical to SEQ ID NO: 2487

SEQ ID NO: 3066 - DNA, 67 bp, Zinnia elegans
tgacagaagagagagagcacgaagtgcatctacattgggagacgcgggctccttgaaacctggatca

SEQ ID NO: 3067 - DNA, 152 bp, Zea mays; identical to SEQ ID NO: 2488

SEQ ID NO: 3068 - DNA, 124 bp, Zea mays; identical to SEQ ID NO: 2489

SEQ ID NO: 3069 - DNA, 139 bp, Zea mays; identical to SEQ ID NO: 2490

SEQ ID NO: 3070 - DNA, 119 bp, Zea mays; identical to SEQ ID NO: 2491

SEQ ID NO: 3071 - DNA, 126 bp, Zea mays; identical to SEQ ID NO: 2492

SEQ ID NO: 3072 - DNA, 167 bp, Zea mays; identical to SEQ ID NO: 2493

SEQ ID NO: 3073 - DNA, 121 bp, Zea mays; identical to SEQ ID NO: 2494

SEQ ID NO: 3074 - DNA, 115 bp, Zea mays; identical to SEQ ID NO: 2495

SEQ ID NO: 3075 - DNA, 117 bp, Zea mays; identical to SEQ ID NO: 2496

SEQ ID NO: 3076 - DNA, 125 bp, Zea mays; identical to SEQ ID NO: 2497

SEQ ID NO: 3077 - DNA, 123 bp, Zea mays; identical to SEQ ID NO: 2498

SEQ ID NO: 3078 - DNA, 90 bp, Zea mays; identical to SEQ ID NO: 2499

SEQ ID NO: 3079 - DNA, 83 bp, Zea mays
tgacagaagagagtgagcacacacggtggttccttaccatgagtgtcatgctaggagctgtgcgtgctcactctctatctgtc

SEQ ID NO: 3080 - DNA, 84 bp, Zea mays
tgacagaagagagtgagcacacggcgcgacgaacgacatagcatgtatgccgtcctcgccgcgtgctcacttctctttctgtca

SEQ ID NO: 3081 - DNA, 99 bp, Zea mays
tgacagaagagagtgagcacacatggtgcctttcttgcatgatgtatgatcgagagagttcatgctcgaagctatgcgtgctcacttctctctctgtca

SEQ ID NO: 3082 - DNA, 189 bp, Zea mays; identical to SEQ ID NO: 2549

SEQ ID NO: 3083 - DNA, 189 bp, Zea mays; identical to SEQ ID NO: 2549

SEQ ID NO: 3084 - DNA, 99 bp, Zea mays
tgacagaagagagtgggcacacatggtgcctttcttgcatgatgtatgatcgagagagttcatgctcgaagctatgcgtgctcacttctctctctgtca

SEQ ID NO: 3085 - DNA, 116 bp, Arachis hypogaea; identical to SEQ ID NO: 2365

SEQ ID NO: 3086 - DNA, 135 bp, Arachis hypogaea; identical to SEQ ID NO: 2366

SEQ ID NO: 3087 - DNA, 139 bp, Arachis hypogaea; identical to SEQ ID NO: 2367

SEQ ID NO: 3088 - DNA, 184 bp, Arabidopsis lyrata; identical to SEQ ID NO: 2368

SEQ ID NO: 3089 - DNA, 109 bp, Arabidopsis lyrata; identical to SEQ ID NO: 2369

SEQ ID NO: 3090 - DNA, 102 bp, Arabidopsis lyrata; identical to SEQ ID NO: 2370

SEQ ID NO: 3091 - DNA, 118 bp, Arabidopsis lyrata; identical to SEQ ID NO: 2371

SEQ ID NO: 3092 - DNA, 150 bp, Arabidopsis lyrata; identical to SEQ ID NO: 2372

SEQ ID NO: 3093 - DNA, 228 bp, Arabidopsis lyrata; identical to SEQ ID NO: 2373

SEQ ID NO: 3094 - DNA, 138 bp, Arabidopsis lyrata; identical to SEQ ID NO: 2374

SEQ ID NO: 3095 - DNA, 99 bp, Arabidopsis lyrata; identical to SEQ ID NO: 2375

SEQ ID NO: 3096 - DNA, 81 bp, Aquilegia coerulea; identical to SEQ ID NO: 2376

SEQ ID NO: 3097 - DNA, 83 bp, Aquilegia coerulea; identical to SEQ ID NO: 2377

SEQ ID NO: 3098 - DNA, 123 bp, Arabidopsis thaliana; identical to SEQ ID NO: 2378

SEQ ID NO: 3099 - DNA, 183 bp, Arabidopsis thaliana; identical to SEQ ID NO: 2379

SEQ ID NO: 3100 - DNA, 104 bp, Arabidopsis thaliana; identical to SEQ ID NO: 2380

SEQ ID NO: 3101 - DNA, 118 bp, Arabidopsis thaliana; identical to SEQ ID NO: 2381

SEQ ID NO: 3102 - DNA, 107 bp, Arabidopsis thaliana; identical to SEQ ID NO: 2382

SEQ ID NO: 3103 - DNA, 132 bp, Arabidopsis thaliana; identical to SEQ ID NO: 2383

SEQ ID NO: 3104 - DNA, 103 bp, Arabidopsis thaliana; identical to SEQ ID NO: 2384

SEQ ID NO: 3105 - DNA, 106 bp, Arabidopsis thaliana; identical to SEQ ID NO: 2385

SEQ ID NO: 3106 - DNA, 268 bp, Arabidopsis thaliana; identical to SEQ ID NO: 2905
  misc_feature (185)..(229): n is a, c, g, or t
  misc_feature (248)..(248): n is a, c, g, or t

SEQ ID NO: 3107 - DNA, 245 bp, Arabidopsis thaliana; identical to SEQ ID NO: 2906

SEQ ID NO: 3108 - DNA, 47 bp, Arabidopsis thaliana; identical to SEQ ID NO: 2907

SEQ ID NO: 3109 - DNA, 59 bp, Arabidopsis thaliana; identical to SEQ ID NO: 2908

SEQ ID NO: 3110 - DNA, 326 bp, Arabidopsis thaliana; identical to SEQ ID NO: 2909

SEQ ID NO: 3111 - DNA, 218 bp, Arabidopsis thaliana; identical to SEQ ID NO: 2910

SEQ ID NO: 3112 - DNA, 147 bp, Brachypodium distachyon; identical to SEQ ID NO: 2386

SEQ ID NO: 3113 - DNA, 205 bp, Brachypodium distachyon; identical to SEQ ID NO: 2387

SEQ ID NO: 3114 - DNA, 146 bp, Brachypodium distachyon; identical to SEQ ID NO: 2388

SEQ ID NO: 3115 - DNA, 151 bp, Brachypodium distachyon; identical to SEQ ID NO: 2389

SEQ ID NO: 3116 - DNA, 82 bp, Brassica napus; identical to SEQ ID NO: 2390

SEQ ID NO: 3117 - DNA, 208 bp, Brassica napus; identical to SEQ ID NO: 2391

SEQ ID NO: 3118 - DNA, 155 bp, Brassica napus; identical to SEQ ID NO: 2392

SEQ ID NO: 3119 - DNA, 152 bp, Capsicum annuum; identical to SEQ ID NO: 2918

SEQ ID NO: 3120 - DNA, 65 bp, Capsicum annuum; identical to SEQ ID NO: 2919

SEQ ID NO: 3121 - DNA, 101 bp, Citrus x paradisi x Poncirus trifoliata; identical to SEQ ID NO: 2920

SEQ ID NO: 3122 - DNA, 185 bp, Citrus x paradisi x Poncirus trifoliata; identical to SEQ ID NO: 2921
  misc_feature (8)..(8): n is a, c, g, or t

SEQ ID NO: 3123 - DNA, 67 bp, Cycas rumphii; identical to SEQ ID NO: 2922

SEQ ID NO: 3124 - DNA, 103 bp, Citrus sinensis; identical to SEQ ID NO: 2393

SEQ ID NO: 3125 - DNA, 56 bp, Citrus sinensis; identical to SEQ ID NO: 2924

SEQ ID NO: 3126 - DNA, 515 bp, Citrus sinensis; identical to SEQ ID NO: 2925

SEQ ID NO: 3127 - DNA, 190 bp, Citrus trifoliata; identical to SEQ ID NO: 2394

SEQ ID NO: 3128 - DNA, 150 bp, Eschscholzia californica; identical to SEQ ID NO: 2927

SEQ ID NO: 3129 - DNA, 180 bp, Festuca arundinacea; identical to SEQ ID NO: 2395

SEQ ID NO: 3130 - DNA, 180 bp, Festuca arundinacea; identical to SEQ ID NO: 2395

SEQ ID NO: 3131 - DNA, 104 bp, Gossypium hirsutum; identical to SEQ ID NO: 2397

SEQ ID NO: 3132 - DNA, 113 bp, Gossypium hirsutum; identical to SEQ ID NO: 2398

SEQ ID NO: 3133 - DNA, 97 bp, Gossypium hirsutum; identical to SEQ ID NO: 2399

SEQ ID NO: 3134 - DNA, 96 bp, Gossypium hirsutum; identical to SEQ ID NO: 2400

SEQ ID NO: 3135 - DNA, 122 bp, Glycine max; identical to SEQ ID NO: 2401

SEQ ID NO: 3136 - DNA, 120 bp, Glycine max; identical to SEQ ID NO: 2402

SEQ ID NO: 3137 - DNA, 185 bp, Glycine max; identical to SEQ ID NO: 2403

SEQ ID NO: 3138 - DNA, 151 bp, Glycine max; identical to SEQ ID NO: 2404

SEQ ID NO: 3139 - DNA, 124 bp, Glycine max; identical to SEQ ID NO: 2405

SEQ ID NO: 3140 - DNA, 106 bp, Glycine max; identical to SEQ ID NO: 2406

SEQ ID NO: 3141 - DNA, 118 bp, Glycine max; identical to SEQ ID NO: 181

SEQ ID NO: 3142 - DNA, 147 bp, Glycine max; identical to SEQ ID NO: 2941

SEQ ID NO: 3143 - DNA, 117 bp, Glycine max; identical to SEQ ID NO: 2942

SEQ ID NO: 3144 - DNA, 362 bp, Helianthus annuus; identical to SEQ ID NO: 2943

SEQ ID NO: 3145 - DNA, 178 bp, Hordeum vulgare subsp. Spontaneum; identical to SEQ ID NO: 2944

SEQ ID NO: 3146 - DNA, 135 bp, Hordeum vulgare; identical to SEQ ID NO: 2407

SEQ ID NO: 3147 - DNA, 394 bp, Hordeum vulgare subsp. Vulgare; identical to SEQ ID NO: 2946
  misc_feature (266)..(266): n is a, c, g, or t

SEQ ID NO: 3148 - DNA, 86 bp, Hordeum vulgare subsp. Vulgare; identical to SEQ ID NO: 2947

SEQ ID NO: 3149 - DNA, 178 bp, Hordeum vulgare subsp. Vulgare; identical to SEQ ID NO: 2948

SEQ ID NO: 3150 - DNA, 203 bp, Hordeum vulgare subsp. Vulgare; identical to SEQ ID NO: 2949

SEQ ID NO: 3151 - DNA, 47 bp, Lotus japonicus; identical to SEQ ID NO: 2950

SEQ ID NO: 3152 - DNA, 355 bp, Lactuca sativa; identical to SEQ ID NO: 2951

SEQ ID NO: 3153 - DNA, 109 bp, Malus x domestica; identical to SEQ ID NO: 2952

SEQ ID NO: 3154 - DNA, 79 bp, Malus x domestica; identical to SEQ ID NO: 2953

SEQ ID NO: 3155 - DNA, 460 bp, Medicago truncatula; identical to SEQ ID NO: 2408

SEQ ID NO: 3156 - DNA, 95 bp, Medicago truncatula; identical to SEQ ID NO: 2409

SEQ ID NO: 3157 - DNA, 98 bp, Medicago truncatula; identical to SEQ ID NO: 2410

SEQ ID NO: 3158 - DNA, 90 bp, Medicago truncatula; identical to SEQ ID NO: 2411

SEQ ID NO: 3159 - DNA, 172 bp, Medicago truncatula; identical to SEQ ID NO: 2412

SEQ ID NO: 3160 - DNA, 94 bp, Medicago truncatula; identical to SEQ ID NO: 2413

SEQ ID NO: 3161 - DNA, 120 bp, Medicago truncatula; identical to SEQ ID NO: 2414

SEQ ID NO: 3162 - DNA, 94 bp, Medicago truncatula; identical to SEQ ID NO: 2415

SEQ ID NO: 3163 - DNA, 93 bp, Medicago truncatula; identical to SEQ ID NO: 2416

SEQ ID NO: 3164 - DNA, 205 bp, Nicotiana benthamiana; identical to SEQ ID NO: 2963

SEQ ID NO: 3165 - DNA, 169 bp, Nicotiana benthamiana; identical to SEQ ID NO: 2533

SEQ ID NO: 3166 - DNA, 93 bp, Oryza rufipogon; identical to SEQ ID NO: 2965

SEQ ID NO: 3167 - DNA, 100 bp, Oryza sativa; identical to SEQ ID NO: 2417

SEQ ID NO: 3168 - DNA, 176 bp, Oryza sativa; identical to SEQ ID NO: 2418

SEQ ID NO: 3169 - DNA, 149 bp, Oryza sativa; identical to SEQ ID NO: 2419

SEQ ID NO: 3170 - DNA, 129 bp, Oryza sativa; identical to SEQ ID NO: 2420

SEQ ID NO: 3171 - DNA, 104 bp, Oryza sativa; identical to SEQ ID NO: 2421

SEQ ID NO: 3172 - DNA, 186 bp, Oryza sativa; identical to SEQ ID NO: 2422

SEQ ID NO: 3173 - DNA, 116 bp, Oryza sativa; identical to SEQ ID NO: 2423

SEQ ID NO: 3174 - DNA, 101 bp, Oryza sativa; identical to SEQ ID NO: 2424

SEQ ID NO: 3175 - DNA, 90 bp, Oryza sativa; identical to SEQ ID NO: 2425

SEQ ID NO: 3176 - DNA, 165 bp, Oryza sativa; identical to SEQ ID NO: 2426

SEQ ID NO: 3177 - DNA, 106 bp, Oryza sativa; identical to SEQ ID NO: 2427

SEQ ID NO: 3178 - DNA, 156 bp, Oryza sativa; identical to SEQ ID NO: 2428

SEQ ID NO: 3179 - DNA, 86 bp, Oryza sativa; identical to SEQ ID NO: 2978

SEQ ID NO: 3180 - DNA, 97 bp, Oryza sativa; identical to SEQ ID NO: 2979

SEQ ID NO: 3181 - DNA, 179 bp, Oryza sativa; identical to SEQ ID NO: 2980

SEQ ID NO: 3182 - DNA, 133 bp, Oryza sativa; identical to SEQ ID NO: 2981

SEQ ID NO: 3183 - DNA, 243 bp, Oryza sativa; identical to SEQ ID NO: 2982

SEQ ID NO: 3184 - DNA, 83 bp, Oryza sativa; identical to SEQ ID NO: 2983

SEQ ID NO: 3185 - DNA, 114 bp, Prunus armeniaca; identical to SEQ ID NO: 2984

SEQ ID NO: 3186 - DNA, 146 bp, Populus trichocarpa x Populus deltoides; identical to SEQ ID NO: 2985

SEQ ID NO: 3187 - DNA, 103 bp, Phleum pratense; identical to SEQ ID NO: 2986

SEQ ID NO: 3188 - DNA, 115 bp, Physcomitrella patens; identical to SEQ ID NO: 2429

SEQ ID NO: 3189 - DNA, 220 bp, Physcomitrella patens; identical to SEQ ID NO: 2430

SEQ ID NO: 3190 - DNA, 95 bp, Physcomitrella patens; identical to SEQ ID NO: 2431

SEQ ID NO: 3191 - DNA, 83 bp, Pinus taeda; identical to SEQ ID NO: 194

SEQ ID NO: 3192 - DNA, 101 bp, Populus trichocarpa; identical to SEQ ID NO: 2434

SEQ ID NO: 3193 - DNA, 101 bp, Populus trichocarpa; identical to SEQ ID NO: 2435

SEQ ID NO: 3194 - DNA, 100 bp, Populus trichocarpa; identical to SEQ ID NO: 2436

SEQ ID NO: 3195 - DNA, 101 bp, Populus trichocarpa; identical to SEQ ID NO: 2437

SEQ ID NO: 3196 - DNA, 100 bp, Populus trichocarpa; identical to SEQ ID NO: 2438

SEQ ID NO: 3197 - DNA, 101 bp, Populus trichocarpa; identical to SEQ ID NO: 2439

SEQ ID NO: 3198 - DNA, 103 bp, Populus trichocarpa; identical to SEQ ID NO: 2440

SEQ ID NO: 3199 - DNA, 103 bp, Populus trichocarpa; identical to SEQ ID NO: 2441

SEQ ID NO: 3200 - DNA, 99 bp, Populus trichocarpa; identical to SEQ ID NO: 2442

SEQ ID NO: 3201 - DNA, 100 bp, Populus trichocarpa; identical to SEQ ID NO: 2443

SEQ ID NO: 3202 - DNA, 101 bp, Populus trichocarpa; identical to SEQ ID NO: 2444

SEQ ID NO: 3203 - DNA, 373 bp, Populus tremula; identical to SEQ ID NO: 3002

SEQ ID NO: 3204 - DNA, 46 bp, Populus tremuloides; identical to SEQ ID NO: 3003

SEQ ID NO: 3205 - DNA, 356 bp, Populus tremuloides; identical to SEQ ID NO: 2539

SEQ ID NO: 3206 - DNA, 85 bp, Populus tremuloides; identical to SEQ ID NO: 3005

SEQ ID NO: 3207 - DNA, 97 bp, Ricinus communis; identical to SEQ ID NO: 2445

SEQ ID NO: 3208 - DNA, 92 bp, Ricinus communis; identical to SEQ ID NO: 2446

SEQ ID NO: 3209 - DNA, 94 bp, Ricinus communis; identical to SEQ ID NO: 2447

SEQ ID NO: 3210 - DNA, 93 bp, Ricinus communis; identical to SEQ ID NO: 2448

SEQ ID NO: 3211 - DNA, 95 bp, Ricinus communis; identical to SEQ ID NO: 2449

SEQ ID NO: 3212 - DNA, 97 bp, Ricinus communis; identical to SEQ ID NO: 2450

SEQ ID NO: 3213 - DNA, 97 bp, Ricinus communis; identical to SEQ ID NO: 2451

SEQ ID NO: 3214 - DNA, 97 bp, Ricinus communis; identical to SEQ ID NO: 2452

SEQ ID NO: 3215 - DNA, 84 bp, Sorghum bicolor; identical to SEQ ID NO: 2453

SEQ ID NO: 3216 - DNA, 84 bp, Sorghum bicolor; identical to SEQ ID NO: 2454

SEQ ID NO: 3217 - DNA, 95 bp, Sorghum bicolor; identical to SEQ ID NO: 2455

SEQ ID NO: 3218 - DNA, 125 bp, Sorghum bicolor; identical to SEQ ID NO: 2456

SEQ ID NO: 3219 - DNA, 123 bp, Sorghum bicolor; identical to SEQ ID NO: 2457

SEQ ID NO: 3220 - DNA, 128 bp, Sorghum bicolor; identical to SEQ ID NO: 2458

SEQ ID NO: 3221 - DNA, 89 bp, Sorghum bicolor; identical to SEQ ID NO: 2459

SEQ ID NO: 3222 - DNA, 94 bp, Sorghum bicolor; identical to SEQ ID NO: 2460

SEQ ID NO: 3223 - DNA, 121 bp, Sorghum bicolor; identical to SEQ ID NO: 2461

SEQ ID NO: 3224 - DNA, 81 bp, Sesamum indicum; identical to SEQ ID NO: 3023

SEQ ID NO: 3225 - DNA, 100 bp, Solanum lycopersicum; identical to SEQ ID NO: 2462

SEQ ID NO: 3226 - DNA, 84 bp, Solanum lycopersicum; identical to SEQ ID NO: 2463

SEQ ID NO: 3227 - DNA, 83 bp, Solanum lycopersicum; identical to SEQ ID NO: 2464

SEQ ID NO: 3228 - DNA, 102 bp, Selaginella moellendorffii; identical to SEQ ID NO: 2465

SEQ ID NO: 3229 - DNA, 112 bp, Selaginella moellendorffii; identical to SEQ ID NO: 198

SEQ ID NO: 3230 - DNA, 100 bp, Selaginella moellendorffii; identical to SEQ ID NO: 2467

SEQ ID NO: 3231 - DNA, 103 bp, Selaginella moellendorffii; identical to SEQ ID NO: 2468

SEQ ID NO: 3232 - DNA, 137 bp, Saccharum officinarum; identical to SEQ ID NO: 2469

SEQ ID NO: 3233 - DNA, 68 bp, Saccharum officinarum; identical to SEQ ID NO: 3032

SEQ ID NO: 3234 - DNA, 327 bp, Saccharum officinarum; identical to SEQ ID NO: 3033

SEQ ID NO: 3235 - DNA, 70 bp, Saccharum officinarum; identical to SEQ ID NO: 3034

SEQ ID NO: 3236 - DNA, 46 bp, Saccharum officinarum; identical to SEQ ID NO: 3035

SEQ ID NO: 3237 - DNA, 403 bp, Saccharum officinarum; identical to SEQ ID NO: 3036

SEQ ID NO: 3238 - DNA, 343 bp, Saccharum officinarum; identical to SEQ ID NO: 3037

SEQ ID NO: 3239 - DNA, 82 bp, Saccharum officinarum; identical to SEQ ID NO: 3038

SEQ ID NO: 3240 - DNA, 125 bp, Sorghum Propinquum; identical to SEQ ID NO: 3039

SEQ ID NO: 3241 - DNA, 543 bp, Saccharum spp; identical to SEQ ID NO: 2470
  misc_feature (340)..(340): n is a, c, g, or t
  misc_feature (415)..(415): n is a, c, g, or t
  misc_feature (446)..(446): n is a, c, g, or t

SEQ ID NO: 3242 - DNA, 86 bp, Solanum tuberosum; identical to SEQ ID NO: 3041

SEQ ID NO: 3243 - DNA, 382 bp, Solanum tuberosum; identical to SEQ ID NO: 3042

SEQ ID NO: 3244 - DNA, 85 bp, Solanum tuberosum; identical to SEQ ID NO: 3043

SEQ ID NO: 3245 - DNA, 171 bp, Solanum tuberosum; identical to SEQ ID NO: 3044

SEQ ID NO: 3246 - DNA, 72 bp, Solanum tuberosum; identical to SEQ ID NO: 3045

SEQ ID NO: 3247 - DNA, 278 bp, Triticum aestivum; identical to SEQ ID NO: 2471

SEQ ID NO: 3248 - DNA, 52 bp, Triticum aestivum; identical to SEQ ID NO: 3047

SEQ ID NO: 3249 - DNA, 416 bp, Triticum aestivum; identical to SEQ ID NO: 3048

SEQ ID NO: 3250 - DNA, 124 bp, Theobroma cacao; identical to SEQ ID NO: 2472

SEQ ID NO: 3251 - DNA, 129 bp, Theobroma cacao; identical to SEQ ID NO: 2473

SEQ ID NO: 3252 - DNA, 121 bp, Theobroma cacao; identical to SEQ ID NO: 2474

SEQ ID NO: 3253 - DNA, 125 bp, Theobroma cacao; identical to SEQ ID NO: 2475

SEQ ID NO: 3254 - DNA, 123 bp, Theobroma cacao; identical to SEQ ID NO: 2476

SEQ ID NO: 3255 - DNA, 124 bp, Theobroma cacao; identical to SEQ ID NO: 2477

SEQ ID NO: 3256 - DNA, 120 bp, Theobroma cacao; identical to SEQ ID NO: 2478

SEQ ID NO: 3257 - DNA, 85 bp, Trifolium repens; identical to SEQ ID NO: 3056

SEQ ID NO: 3258 - DNA, 104 bp, Vitis vinifera; identical to SEQ ID NO: 2479

SEQ ID NO: 3259 - DNA, 102 bp, Vitis vinifera; identical to SEQ ID NO: 2480

SEQ ID NO: 3260 - DNA, 104 bp, Vitis vinifera; identical to SEQ ID NO: 2481

SEQ ID NO: 3261 - DNA, 103 bp, Vitis vinifera; identical to SEQ ID NO: 2482

SEQ ID NO: 3262 - DNA, 108 bp, Vitis vinifera; identical to SEQ ID NO: 2483

SEQ ID NO: 3263 - DNA, 105 bp, Vitis vinifera; identical to SEQ ID NO: 2484

SEQ ID NO: 3264 - DNA, 103 bp, Vitis vinifera; identical to SEQ ID NO: 2485

SEQ ID NO: 3265 - DNA, 228 bp, Vitis vinifera; identical to SEQ ID NO: 2486

SEQ ID NO: 3266 - DNA, 103 bp, Vitis vinifera; identical to SEQ ID NO: 2487

SEQ ID NO: 3267 - DNA, 67 bp, Zinnia elegans; identical to SEQ ID NO: 3066

SEQ ID NO: 3268 - DNA, 152 bp, Zea mays; identical to SEQ ID NO: 2488

SEQ ID NO: 3269 - DNA, 124 bp, Zea mays; identical to SEQ ID NO: 2489

SEQ ID NO: 3270 - DNA, 139 bp, Zea mays; identical to SEQ ID NO: 2490

SEQ ID NO: 3271 - DNA, 119 bp, Zea mays; identical to SEQ ID NO: 2491

SEQ ID NO: 3272 - DNA, 126 bp, Zea mays; identical to SEQ ID NO: 2492

SEQ ID NO: 3273 - DNA, 167 bp, Zea mays; identical to SEQ ID NO: 2493

SEQ ID NO: 3274 - DNA, 121 bp, Zea mays; identical to SEQ ID NO: 2494

SEQ ID NO: 3275 - DNA, 115 bp, Zea mays; identical to SEQ ID NO: 2495

SEQ ID NO: 3276 - DNA, 117 bp, Zea mays; identical to SEQ ID NO: 2496

SEQ ID NO: 3277 - DNA, 125 bp, Zea mays; identical to SEQ ID NO: 2497

SEQ ID NO: 3278 - DNA, 123 bp, Zea mays; identical to SEQ ID NO: 2498

SEQ ID NO: 3279 - DNA, 90 bp, Zea mays; identical to SEQ ID NO: 2499

SEQ ID NO: 3280 - DNA, 83 bp, Zea mays; identical to SEQ ID NO: 3079

SEQ ID NO: 3281 - DNA, 84 bp, Zea mays; identical to SEQ ID NO: 3080

SEQ ID NO: 3282 - DNA, 99 bp, Zea mays; identical to SEQ ID NO: 3081

SEQ ID NO: 3283 - DNA, 189 bp, Zea mays; identical to SEQ ID NO: 2549

SEQ ID NO: 3284 - DNA, 189 bp, Zea mays; identical to SEQ ID NO: 2549

SEQ ID NO: 3285 - DNA, 99 bp, Zea mays; identical to SEQ ID NO: 3084

SEQ ID NO: 3286 - DNA, 197 bp, Arachis hypogaea; identical to SEQ ID NO: 2094

SEQ ID NO: 3287 - DNA, 222 bp, Arabidopsis lyrata; identical to SEQ ID NO: 2095

SEQ ID NO: 3288 - DNA, 202 bp, Arabidopsis lyrata; identical to SEQ ID NO: 2096

SEQ ID NO: 3289 - DNA, 71 bp, Aquilegia coerulea; identical to SEQ ID NO: 176

SEQ ID NO: 3290 - DNA, 184 bp, Arabidopsis thaliana; identical to SEQ ID NO: 2099

SEQ ID NO: 3291 - DNA, 196 bp, Arabidopsis thaliana; identical to SEQ ID NO: 178

SEQ ID NO: 3292 - DNA, 234 bp, Brachypodium distachyon; identical to SEQ ID NO: 2102

SEQ ID NO: 3293 - DNA, 183 bp, Brassica napus; identical to SEQ ID NO: 2103

SEQ ID NO: 3294 - DNA, 185 bp, Brassica rapa; identical to SEQ ID NO: 2104

SEQ ID NO: 3295 - DNA, 216 bp, Citrus sinensis; identical to SEQ ID NO: 2109

SEQ ID NO: 3296 - DNA, 200 bp, Festuca arundinacea; identical to SEQ ID NO: 2113

SEQ ID NO: 3297 - DNA, 214 bp, Glycine max; identical to SEQ ID NO: 183

SEQ ID NO: 3298 - DNA, 178 bp, Hordeum vulgare; identical to SEQ ID NO: 2117

SEQ ID NO: 3299 - DNA, 122 bp, Hordeum vulgare; identical to SEQ ID NO: 2118

SEQ ID NO: 3300 - DNA, 183 bp, Medicago truncatula; identical to SEQ ID NO: 2123

SEQ ID NO: 3301 - DNA, 272 bp, Oryza sativa; identical to SEQ ID NO: 2128

SEQ ID NO: 3302 - DNA, 188 bp, Oryza sativa; identical to SEQ ID NO: 2130

SEQ ID NO: 3303 - DNA, 197 bp, Oryza sativa; identical to SEQ ID NO: 2131

SEQ ID NO: 3304 - DNA, 188 bp, Oryza sativa; identical to SEQ ID NO: 188

SEQ ID NO: 3305 - DNA, 210 bp, Pinus taeda; identical to SEQ ID NO: 2138

SEQ ID NO: 3306 - DNA, 183 bp, Populus trichocarpa; identical to SEQ ID NO: 2141

SEQ ID NO: 3307 - DNA, 187 bp, Populus trichocarpa; identical to SEQ ID NO: 2142

SEQ ID NO: 3308 - DNA, 183 bp, Populus trichocarpa; identical to SEQ ID NO: 2143

SEQ ID NO: 3309 - DNA, 174 bp, Phaseolus vulgaris; identical to SEQ ID NO: 2147

SEQ ID NO: 3310 - DNA, 180 bp, Ricinus communis; identical to SEQ ID NO: 2149

SEQ ID NO: 3311 - DNA, 226 bp, Sorghum bicolor; identical to SEQ ID NO: 196

SEQ ID NO: 3312 - DNA, 177 bp, Solanum lycopersicum; identical to SEQ ID NO: 2154

SEQ ID NO: 3313 - DNA, 265 bp, Saccharum officinarum; identical to SEQ ID NO: 2156

SEQ ID NO: 3314 - DNA, 266 bp, Saccharum officinarum; identical to SEQ ID NO: 2157

SEQ ID NO: 3315 - DNA, 265 bp, Saccharum officinarum; identical to SEQ ID NO: 2159

SEQ ID NO: 3316 - DNA, 261 bp, Saccharum spp; identical to SEQ ID NO: 2162

SEQ ID NO: 3317 - DNA, 177 bp, Triticum aestivum; identical to SEQ ID NO: 2164

SEQ ID NO: 3318 - DNA, 255 bp, Triticum aestivum; identical to SEQ ID NO: 2165

SEQ ID NO: 3319 - DNA, 190 bp, Vitis vinifera; identical to SEQ ID NO: 2169

SEQ ID NO: 3320 - DNA, 246 bp, Zea mays; identical to SEQ ID NO: 2170

SEQ ID NO: 3321 - DNA, 221 bp, Zea mays; identical to SEQ ID NO: 2171

SEQ ID NO: 3322 - DNA, 215 bp, Zea mays; identical to SEQ ID NO: 2175

SEQ ID NO: 3323 - DNA, 252 bp, Zea mays; identical to SEQ ID NO: 2179

SEQ ID NO: 3324 - DNA, 200 bp, Zea mays; identical to SEQ ID NO: 2180

SEQ ID NO: 3325 - DNA, 118 bp, Glycine max; identical to SEQ ID NO: 181

SEQ ID NO: 3326 - DNA, 116 bp, Arachis hypogaea; identical to SEQ ID NO: 2365

SEQ ID NO: 3327 - DNA, 135 bp, Arachis hypogaea; identical to SEQ ID NO: 2366

SEQ ID NO: 3328 - DNA, 139 bp, Arachis hypogaea; identical to SEQ ID NO: 2367

SEQ ID NO: 3329 - DNA, 184 bp, Arabidopsis lyrata; identical to SEQ ID NO: 2368

SEQ ID NO: 3330 - DNA, 109 bp, Arabidopsis lyrata; identical to SEQ ID NO: 2369

SEQ ID NO: 3331 - DNA, 102 bp, Arabidopsis lyrata; identical to SEQ ID NO: 2370

SEQ ID NO: 3332 - DNA, 118 bp, Arabidopsis lyrata; identical to SEQ ID NO: 2371

SEQ ID NO: 3333 - DNA, 150 bp, Arabidopsis lyrata; identical to SEQ ID NO: 2372

SEQ ID NO: 3334 - DNA, 228 bp, Arabidopsis lyrata; identical to SEQ ID NO: 2373

SEQ ID NO: 3335 - DNA, 138 bp, Arabidopsis lyrata; identical to SEQ ID NO: 2374

SEQ ID NO: 3336 - DNA, 99 bp, Arabidopsis lyrata; identical to SEQ ID NO: 2375

SEQ ID NO: 3337 - DNA, 81 bp, Aquilegia coerulea; identical to SEQ ID NO: 2376

SEQ ID NO: 3338 - DNA, 83 bp, Aquilegia coerulea; identical to SEQ ID NO: 2377

SEQ ID NO: 3339 - DNA, 123 bp, Arabidopsis thaliana; identical to SEQ ID NO: 2378

SEQ ID NO: 3340 - DNA, 183 bp, Arabidopsis thaliana; identical to SEQ ID NO: 2379

SEQ ID NO: 3341 - DNA, 104 bp, Arabidopsis thaliana; identical to SEQ ID NO: 2380

SEQ ID NO: 3342 - DNA, 118 bp, Arabidopsis thaliana; identical to SEQ ID NO: 2381

SEQ ID NO: 3343 - DNA, 107 bp, Arabidopsis thaliana; identical to SEQ ID NO: 2382

SEQ ID NO: 3344 - DNA, 132 bp, Arabidopsis thaliana; identical to SEQ ID NO: 2383

SEQ ID NO: 3345 - DNA, 103 bp, Arabidopsis thaliana; identical to SEQ ID NO: 2384

SEQ ID NO: 3346 - DNA, 106 bp, Arabidopsis thaliana; identical to SEQ ID NO: 2385

SEQ ID NO: 3347 - DNA, 268 bp, Arabidopsis thaliana; identical to SEQ ID NO: 2905
  misc_feature (185)..(229): n is a, c, g, or t
  misc_feature (248)..(248): n is a, c, g, or t

SEQ ID NO: 3348 - DNA, 245 bp, Arabidopsis thaliana; identical to SEQ ID NO: 2906

SEQ ID NO: 3349 - DNA, 47 bp, Arabidopsis thaliana; identical to SEQ ID NO: 2907

SEQ ID NO: 3350 - DNA, 59 bp, Arabidopsis thaliana; identical to SEQ ID NO: 2908

SEQ ID NO: 3351 - DNA, 326 bp, Arabidopsis thaliana; identical to SEQ ID NO: 2909

SEQ ID NO: 3352 - DNA, 218 bp, Arabidopsis thaliana; identical to SEQ ID NO: 2910

SEQ ID NO: 3353 - DNA, 147 bp, Brachypodium distachyon; identical to SEQ ID NO: 2386

SEQ ID NO: 3354 - DNA, 205 bp, Brachypodium distachyon; identical to SEQ ID NO: 2387

SEQ ID NO: 3355 - DNA, 146 bp, Brachypodium distachyon; identical to SEQ ID NO: 2388

SEQ ID NO: 3356 - DNA, 151 bp, Brachypodium distachyon; identical to SEQ ID NO: 2389

SEQ ID NO: 3357 - DNA, 82 bp, Brassica napus; identical to SEQ ID NO: 2390

SEQ ID NO: 3358 - DNA, 208 bp, Brassica napus; identical to SEQ ID NO: 2391

SEQ ID NO: 3359 - DNA, 155 bp, Brassica napus; identical to SEQ ID NO: 2392

SEQ ID NO: 3360 - DNA, 152 bp, Capsicum annuum; identical to SEQ ID NO: 2918

SEQ ID NO: 3361 - DNA, 65 bp, Capsicum annuum; identical to SEQ ID NO: 2919

SEQ ID NO: 3362 - DNA, 101 bp, Citrus x paradisi x Poncirus trifoliata; identical to SEQ ID NO: 2920

SEQ ID NO: 3363 - DNA, 185 bp, Citrus x paradisi x Poncirus trifoliata; identical to SEQ ID NO: 2921
  misc_feature (8)..(8): n is a, c, g, or t

SEQ ID NO: 3364 - DNA, 67 bp, Cycas rumphii; identical to SEQ ID NO: 2922

SEQ ID NO: 3365 - DNA, 103 bp, Citrus sinensis; identical to SEQ ID NO: 2393

SEQ ID NO: 3366 - DNA, 56 bp, Citrus sinensis; identical to SEQ ID NO: 2924

SEQ ID NO: 3367 - DNA, 515 bp, Citrus sinensis; identical to SEQ ID NO: 2925

SEQ ID NO: 3368 - DNA, 190 bp, Citrus trifoliata; identical to SEQ ID NO: 2394

SEQ ID NO: 3369 - DNA, 150 bp, Eschscholzia californica; identical to SEQ ID NO: 2927

SEQ ID NO: 3370 - DNA, 180 bp, Festuca arundinacea; identical to SEQ ID NO: 2395

SEQ ID NO: 3371 - DNA, 180 bp, Festuca arundinacea; identical to SEQ ID NO: 2395

SEQ ID NO: 3372 - DNA, 104 bp, Gossypium hirsutum; identical to SEQ ID NO: 2397

SEQ ID NO: 3373 - DNA, 113 bp, Gossypium hirsutum; identical to SEQ ID NO: 2398

SEQ ID NO: 3374 - DNA, 97 bp, Gossypium hirsutum; identical to SEQ ID NO: 2399

SEQ ID NO: 3375 - DNA, 96 bp, Gossypium hirsutum; identical to SEQ ID NO: 2400

SEQ ID NO: 3376 - DNA, 122 bp, Glycine max; identical to SEQ ID NO: 2401

SEQ ID NO: 3377 - DNA, 120 bp, Glycine max; identical to SEQ ID NO: 2402

SEQ ID NO: 3378 - DNA, 185 bp, Glycine max; identical to SEQ ID NO: 2403

SEQ ID NO: 3379 - DNA, 151 bp, Glycine max; identical to SEQ ID NO: 2404

SEQ ID NO: 3380 - DNA, 124 bp, Glycine max; identical to SEQ ID NO: 2405

SEQ ID NO: 3381 - DNA, 106 bp, Glycine max; identical to SEQ ID NO: 2406

SEQ ID NO: 3382 - DNA, 118 bp, Glycine max; identical to SEQ ID NO: 181

SEQ ID NO: 3383 - DNA, 147 bp, Glycine max; identical to SEQ ID NO: 2941

SEQ ID NO: 3384 - DNA, 117 bp, Glycine max; identical to SEQ ID NO: 2942

SEQ ID NO: 3385 - DNA, 362 bp, Helianthus annuus; identical to SEQ ID NO: 2943

SEQ ID NO: 3386 - DNA, 178 bp, Hordeum vulgare subsp. Spontaneum; identical to SEQ ID NO: 2944

SEQ ID NO: 3387 - DNA, 135 bp, Hordeum vulgare; identical to SEQ ID NO: 2407

SEQ ID NO: 3388 - DNA, 394 bp, Hordeum vulgare subsp. Vulgare; identical to SEQ ID NO: 2946
  misc_feature (266)..(266): n is a, c, g, or t

SEQ ID NO: 3389 - DNA, 86 bp, Hordeum vulgare subsp. Vulgare; identical to SEQ ID NO: 2947

SEQ ID NO: 3390 - DNA, 178 bp, Hordeum vulgare subsp. Vulgare; identical to SEQ ID NO: 2948

SEQ ID NO: 3391 - DNA, 203 bp, Hordeum vulgare subsp. Vulgare; identical to SEQ ID NO: 2949

SEQ ID NO: 3392 - DNA, 47 bp, Lotus japonicus; identical to SEQ ID NO: 2950

SEQ ID NO: 3393 - DNA, 355 bp, Lactuca sativa; identical to SEQ ID NO: 2951

SEQ ID NO: 3394 - DNA, 109 bp, Malus x domestica; identical to SEQ ID NO: 2952

SEQ ID NO: 3395 - DNA, 79 bp, Malus x domestica; identical to SEQ ID NO: 2953

SEQ ID NO: 3396 - DNA, 460 bp, Medicago truncatula; identical to SEQ ID NO: 2408

SEQ ID NO: 3397 - DNA, 95 bp, Medicago truncatula; identical to SEQ ID NO: 2409

SEQ ID NO: 3398 - DNA, 98 bp, Medicago truncatula; identical to SEQ ID NO: 2410

SEQ ID NO: 3399 - DNA, 90 bp, Medicago truncatula; identical to SEQ ID NO: 2411

SEQ ID NO: 3400 - DNA, 172 bp, Medicago truncatula; identical to SEQ ID NO: 2412

SEQ ID NO: 3401 - DNA, 94 bp, Medicago truncatula; identical to SEQ ID NO: 2413

SEQ ID NO: 3402 - DNA, 120 bp, Medicago truncatula; identical to SEQ ID NO: 2414

SEQ ID NO: 3403 - DNA, 94 bp, Medicago truncatula; identical to SEQ ID NO: 2415

SEQ ID NO: 3404 - DNA, 93 bp, Medicago truncatula; identical to SEQ ID NO: 2416

SEQ ID NO: 3405 - DNA, 205 bp, Nicotiana benthamiana; identical to SEQ ID NO: 2963

SEQ ID NO: 3406 - DNA, 169 bp, Nicotiana benthamiana; identical to SEQ ID NO: 2533

SEQ ID NO: 3407 - DNA, 93 bp, Oryza rufipogon; identical to SEQ ID NO: 2965

SEQ ID NO: 3408 - DNA, 100 bp, Oryza sativa; identical to SEQ ID NO: 2417

SEQ ID NO: 3409 - DNA, 176 bp, Oryza sativa; identical to SEQ ID NO: 2418

SEQ ID NO: 3410 - DNA, 149 bp, Oryza sativa; identical to SEQ ID NO: 2419

SEQ ID NO: 3411 - DNA, 129 bp, Oryza sativa; identical to SEQ ID NO: 2420

SEQ ID NO: 3412 - DNA, 104 bp, Oryza sativa; identical to SEQ ID NO: 2421

SEQ ID NO: 3413 - DNA, 186 bp, Oryza sativa; identical to SEQ ID NO: 2422

SEQ ID NO: 3414 - DNA, 116 bp, Oryza sativa; identical to SEQ ID NO: 2423

SEQ ID NO: 3415 - DNA, 101 bp, Oryza sativa; identical to SEQ ID NO: 2424

SEQ ID NO: 3416 - DNA, 90 bp, Oryza sativa; identical to SEQ ID NO: 2425

SEQ ID NO: 3417 - DNA, 165 bp, Oryza sativa; identical to SEQ ID NO: 2426

SEQ ID NO: 3418 - DNA, 106 bp, Oryza sativa; identical to SEQ ID NO: 2427

SEQ ID NO: 3419 - DNA, 156 bp, Oryza sativa; identical to SEQ ID NO: 2428

SEQ ID NO: 3420 - DNA, 86 bp, Oryza sativa; identical to SEQ ID NO: 2978

SEQ ID NO: 3421 - DNA, 97 bp, Oryza sativa; identical to SEQ ID NO: 2979

SEQ ID NO: 3422 - DNA, 179 bp, Oryza sativa; identical to SEQ ID NO: 2980

SEQ ID NO: 3423 - DNA, 133 bp, Oryza sativa; identical to SEQ ID NO: 2981

SEQ ID NO: 3424 - DNA, 243 bp, Oryza sativa; identical to SEQ ID NO: 2982

SEQ ID NO: 3425 - DNA, 83 bp, Oryza sativa; identical to SEQ ID NO: 2983

SEQ ID NO: 3426 - DNA, 114 bp, Prunus armeniaca; identical to SEQ ID NO: 2984

SEQ ID NO: 3427 - DNA, 115 bp, Picea glauca
gatccatggtagaatgattctcgtgcataaactgttccaatgtggcacctggtcgagtggccagatctaatgaagctgatcctagagcccttgagcccaatgactgcgatgacag

SEQ ID NO: 3428 - DNA, 146 bp, Populus trichocarpa x Populus deltoides; identical to SEQ ID NO: 2985

SEQ ID NO: 3429 - DNA, 103 bp, Phleum pratense; identical to SEQ ID NO: 2986

SEQ ID NO: 3430 - DNA, 115 bp, Physcomitrella patens; identical to SEQ ID NO: 2429

SEQ ID NO: 3431 - DNA, 220 bp, Physcomitrella patens; identical to SEQ ID NO: 2430

SEQ ID NO: 3432 - DNA, 95 bp, Physcomitrella patens; identical to SEQ ID NO: 2431

SEQ ID NO: 3433 - DNA, 83 bp, Pinus taeda; identical to SEQ ID NO: 194

SEQ ID NO: 3434 - DNA, 83 bp, Pinus taeda; identical to SEQ ID NO: 195

SEQ ID NO: 3435 - DNA, 101 bp, Populus trichocarpa; identical to SEQ ID NO: 2434

SEQ ID NO: 3436 - DNA, 101 bp, Populus trichocarpa; identical to SEQ ID NO: 2435

SEQ ID NO: 3437 - DNA, 100 bp, Populus trichocarpa; identical to SEQ ID NO: 2436

SEQ ID NO: 3438 - DNA, 101 bp, Populus trichocarpa; identical to SEQ ID NO: 2437

SEQ ID NO: 3439 - DNA, 100 bp, Populus trichocarpa; identical to SEQ ID NO: 2438

SEQ ID NO: 3440 - DNA, 101 bp, Populus trichocarpa; identical to SEQ ID NO: 2439

SEQ ID NO: 3441 - DNA, 103 bp, Populus trichocarpa; identical to SEQ ID NO: 2440

SEQ ID NO: 3442 - DNA, 103 bp, Populus trichocarpa; identical to SEQ ID NO: 2441

SEQ ID NO: 3443 - DNA, 99 bp, Populus trichocarpa; identical to SEQ ID NO: 2442

SEQ ID NO: 3444 - DNA, 100 bp, Populus trichocarpa; identical to SEQ ID NO: 2443

SEQ ID NO: 3445 - DNA, 101 bp, Populus trichocarpa; identical to SEQ ID NO: 2444

SEQ ID NO: 3446 - DNA, 373 bp, Populus tremula; identical to SEQ ID NO: 3002

SEQ ID NO: 3447 - DNA, 46 bp, Populus tremuloides; identical to SEQ ID NO: 3003

SEQ ID NO: 3448 - DNA, 356 bp, Populus tremuloides; identical to SEQ ID NO: 2539

SEQ ID NO: 3449 - DNA, 85 bp, Populus tremuloides; identical to SEQ ID NO: 3005

SEQ ID NO: 3450 - DNA, 97 bp, Ricinus communis; identical to SEQ ID NO: 2445

SEQ ID NO: 3451 - DNA, 92 bp, Ricinus communis; identical to SEQ ID NO: 2446

SEQ ID NO: 3452 - DNA, 94 bp, Ricinus communis; identical to SEQ ID NO: 2447

SEQ ID NO: 3453 - DNA, 93 bp, Ricinus communis; identical to SEQ ID NO: 2448

SEQ ID NO: 3454 - DNA, 95 bp, Ricinus communis; identical to SEQ ID NO: 2449

SEQ ID NO: 3455 - DNA, 97 bp, Ricinus communis; identical to SEQ ID NO: 2450

SEQ ID NO: 3456 - DNA, 97 bp, Ricinus communis; identical to SEQ ID NO: 2451

SEQ ID NO: 3457 - DNA, 97 bp, Ricinus communis; identical to SEQ ID NO: 2452

SEQ ID NO: 3458 - DNA, 84 bp, Sorghum bicolor; identical to SEQ ID NO: 2453

SEQ ID NO: 3459 - DNA, 84 bp, Sorghum bicolor; identical to SEQ ID NO: 2454

SEQ ID NO: 3460 - DNA, 95 bp, Sorghum bicolor; identical to SEQ ID NO: 2455

SEQ ID NO: 3461 - DNA, 125 bp, Sorghum bicolor; identical to SEQ ID NO: 2456

SEQ ID NO: 3462 - DNA, 123 bp, Sorghum bicolor; identical to SEQ ID NO: 2457

SEQ ID NO: 3463 - DNA, 128 bp, Sorghum bicolor; identical to SEQ ID NO: 2458

SEQ ID NO: 3464 - DNA, 89 bp, Sorghum bicolor; identical to SEQ ID NO: 2459

SEQ ID NO: 3465 - DNA, 94 bp, Sorghum bicolor; identical to SEQ ID NO: 2460

SEQ ID NO: 3466 - DNA, 121 bp, Sorghum bicolor; identical to SEQ ID NO: 2461

SEQ ID NO: 3467 - DNA, 81 bp, Sesamum indicum; identical to SEQ ID NO: 3023

SEQ ID NO: 3468 - DNA, 100 bp, Solanum lycopersicum; identical to SEQ ID NO: 2462

SEQ ID NO: 3469 - DNA, 84 bp, Solanum lycopersicum; identical to SEQ ID NO: 2463

SEQ ID NO: 3470 - DNA, 83 bp, Solanum lycopersicum; identical to SEQ ID NO: 2464

SEQ ID NO: 3471 - DNA, 102 bp, Selaginella moellendorffii; identical to SEQ ID NO: 2465

SEQ ID NO: 3472 - DNA, 112 bp, Selaginella moellendorffii; identical to SEQ ID NO: 198

SEQ ID NO: 3473 - DNA, 100 bp, Selaginella moellendorffii; identical to SEQ ID NO: 2467

SEQ ID NO: 3474 - DNA, 103 bp, Selaginella moellendorffii; identical to SEQ ID NO: 2468

SEQ ID NO: 3475 - DNA, 137 bp, Saccharum officinarum; identical to SEQ ID NO: 2469

SEQ ID NO: 3476 - DNA, 68 bp, Saccharum officinarum; identical to SEQ ID NO: 3032

SEQ ID NO: 3477 - DNA, 327 bp, Saccharum officinarum; identical to SEQ ID NO: 3033

SEQ ID NO: 3478 - DNA, 70 bp, Saccharum officinarum; identical to SEQ ID NO: 3034

SEQ ID NO: 3479 - DNA, 46 bp, Saccharum officinarum; identical to SEQ ID NO: 3035

SEQ ID NO: 3480 - DNA, 403 bp, Saccharum officinarum; identical to SEQ ID NO: 3036

SEQ ID NO: 3481 - DNA, 343 bp, Saccharum officinarum; identical to SEQ ID NO: 3037

SEQ ID NO: 3482 - DNA, 82 bp, Saccharum officinarum; identical to SEQ ID NO: 3038

SEQ ID NO: 3483 - DNA, 125 bp, Sorghum Propinquum; identical to SEQ ID NO: 3039

SEQ ID NO: 3484 - DNA, 543 bp, Saccharum spp; identical to SEQ ID NO: 2470
  misc_feature (340)..(340): n is a, c, g, or t
  misc_feature (415)..(415): n is a, c, g, or t
  misc_feature (446)..(446): n is a, c, g, or t

SEQ ID NO: 3485 - DNA, 86 bp, Solanum tuberosum; identical to SEQ ID NO: 3041

SEQ ID NO: 3486 - DNA, 382 bp, Solanum tuberosum; identical to SEQ ID NO: 3042

SEQ ID NO: 3487 - DNA, 85 bp, Solanum tuberosum; identical to SEQ ID NO: 3043

SEQ ID NO: 3488 - DNA, 171 bp, Solanum tuberosum; identical to SEQ ID NO: 3044

SEQ ID NO: 3489 - DNA, 72 bp, Solanum tuberosum; identical to SEQ ID NO: 3045

SEQ ID NO: 3490 - DNA, 278 bp, Triticum aestivum; identical to SEQ ID NO: 2471

SEQ ID NO: 3491 - DNA, 52 bp, Triticum aestivum; identical to SEQ ID NO: 3047

SEQ ID NO: 3492 - DNA, 416 bp, Triticum aestivum; identical to SEQ ID NO: 3048

SEQ ID NO: 3493 - DNA, 124 bp, Theobroma cacao; identical to SEQ ID NO: 2472

SEQ ID NO: 3494 - DNA, 129 bp, Theobroma cacao; identical to SEQ ID NO: 2473

SEQ ID NO: 3495 - DNA, 121 bp, Theobroma cacao; identical to SEQ ID NO: 2474

SEQ ID NO: 3496 - DNA, 125 bp, Theobroma cacao; identical to SEQ ID NO: 2475

SEQ ID NO: 3497 - DNA, 123 bp, Theobroma cacao; identical to SEQ ID NO: 2476

SEQ ID NO: 3498 - DNA, 124 bp, Theobroma cacao; identical to SEQ ID NO: 2477

SEQ ID NO: 3499 - DNA, 120 bp, Theobroma cacao; identical to SEQ ID NO: 2478

SEQ ID NO: 3500 - DNA, 85 bp, Trifolium repens; identical to SEQ ID NO: 3056

SEQ ID NO: 3501 - DNA, 104 bp, Vitis vinifera; identical to SEQ ID NO: 2479

SEQ ID NO: 3502 - DNA, 102 bp, Vitis vinifera; identical to SEQ ID NO: 2480

SEQ ID NO: 3503 - DNA, 104 bp, Vitis vinifera; identical to SEQ ID NO: 2481

SEQ ID NO: 3504 - DNA, 103 bp, Vitis vinifera; identical to SEQ ID NO: 2482

SEQ ID NO: 3505 - DNA, 108 bp, Vitis vinifera; identical to SEQ ID NO: 2483

SEQ ID NO: 3506 - DNA, 105 bp, Vitis vinifera; identical to SEQ ID NO: 2484

SEQ ID NO: 3507 - DNA, 103 bp, Vitis vinifera; identical to SEQ ID NO: 2485

SEQ ID NO: 3508 - DNA, 228 bp, Vitis vinifera; identical to SEQ ID NO: 2486

SEQ ID NO: 3509 - DNA, 103 bp, Vitis vinifera; identical to SEQ ID NO: 2487

SEQ ID NO: 3510 - DNA, 67 bp, Zinnia elegans; identical to SEQ ID NO: 3066

SEQ ID NO: 3511 - DNA, 152 bp, Zea mays; identical to SEQ ID NO: 2488

SEQ ID NO: 3512 - DNA, 124 bp, Zea mays; identical to SEQ ID NO: 2489

SEQ ID NO: 3513 - DNA, 139 bp, Zea mays; identical to SEQ ID NO: 2490

SEQ ID NO: 3514 - DNA, 119 bp, Zea mays; identical to SEQ ID NO: 2491

SEQ ID NO: 3515 - DNA, 126 bp, Zea mays; identical to SEQ ID NO: 2492

SEQ ID NO: 3516 - DNA, 167 bp, Zea mays; identical to SEQ ID NO: 2493

SEQ ID NO: 3517 - DNA, 121 bp, Zea mays; identical to SEQ ID NO: 2494

SEQ ID NO: 3518 - DNA, 115 bp, Zea mays; identical to SEQ ID NO: 2495

SEQ ID NO: 3519 - DNA, 117 bp, Zea mays; identical to SEQ ID NO: 2496

SEQ ID NO: 3520 - DNA, 125 bp, Zea mays; identical to SEQ ID NO: 2497

SEQ ID NO: 3521 - DNA, 123 bp, Zea mays; identical to SEQ ID NO: 2498

SEQ ID NO: 3522 - DNA, 90 bp, Zea mays; identical to SEQ ID NO: 2499

SEQ ID NO: 3523 - DNA, 83 bp, Zea mays; identical to SEQ ID NO: 3079

SEQ ID NO: 3524 - DNA, 84 bp, Zea mays; identical to SEQ ID NO: 3080

SEQ ID NO: 3525 - DNA, 99 bp, Zea mays; identical to SEQ ID NO: 3081

SEQ ID NO: 3526 - DNA, 189 bp, Zea mays; identical to SEQ ID NO: 2549

SEQ ID NO: 3527 - DNA, 189 bp, Zea mays; identical to SEQ ID NO: 2549

SEQ ID NO: 3528 - DNA, 99 bp, Zea mays; identical to SEQ ID NO: 3084

SEQ ID NO: 3529 - DNA, 116 bp, Arachis hypogaea; identical to SEQ ID NO: 2365

SEQ ID NO: 3530 - DNA, 135 bp, Arachis hypogaea; identical to SEQ ID NO: 2366

SEQ ID NO: 3531 - DNA, 139 bp, Arachis hypogaea; identical to SEQ ID NO: 2367

SEQ ID NO: 3532 - DNA, 184 bp, Arabidopsis lyrata; identical to SEQ ID NO: 2368

SEQ ID NO: 3533 - DNA, 109 bp, Arabidopsis lyrata; identical to SEQ ID NO: 2369

SEQ ID NO: 3534 - DNA, 102 bp, Arabidopsis lyrata; identical to SEQ ID NO: 2370

SEQ ID NO: 3535 - DNA, 118 bp, Arabidopsis lyrata; identical to SEQ ID NO: 2371

SEQ ID NO: 3536 - DNA, 150 bp, Arabidopsis lyrata; identical to SEQ ID NO: 2372

SEQ ID NO: 3537 - DNA, 228 bp, Arabidopsis lyrata; identical to SEQ ID NO: 2373

SEQ ID NO: 3538 - DNA, 138 bp, Arabidopsis lyrata; identical to SEQ ID NO: 2374

SEQ ID NO: 3539 - DNA, 99 bp, Arabidopsis lyrata; identical to SEQ ID NO: 2375

SEQ ID NO: 3540 - DNA, 81 bp, Aquilegia coerulea; identical to SEQ ID NO: 2376

SEQ ID NO: 3541 - DNA, 83 bp, Aquilegia coerulea; identical to SEQ ID NO: 2377

SEQ ID NO: 3542 - DNA, 123 bp, Arabidopsis thaliana; identical to SEQ ID NO: 2378

SEQ ID NO: 3543 - DNA, 183 bp, Arabidopsis thaliana; identical to SEQ ID NO: 2379

SEQ ID NO: 3544 - DNA, 104 bp, Arabidopsis thaliana; identical to SEQ ID NO: 2380

SEQ ID NO: 3545 - DNA, 118 bp, Arabidopsis thaliana; identical to SEQ ID NO: 2381

SEQ ID NO: 3546 - DNA, 107 bp, Arabidopsis thaliana; identical to SEQ ID NO: 2382

SEQ ID NO: 3547 - DNA, 132 bp, Arabidopsis thaliana; identical to SEQ ID NO: 2383

SEQ ID NO: 3548 - DNA, 103 bp, Arabidopsis thaliana; identical to SEQ ID NO: 2384

SEQ ID NO: 3549 - DNA, 106 bp, Arabidopsis thaliana; identical to SEQ ID NO: 2385

SEQ ID NO: 3550 - DNA, 268 bp, Arabidopsis thaliana; identical to SEQ ID NO: 2905
  misc_feature (185)..(229): n is a, c, g, or t
  misc_feature (248)..(248): n is a, c, g, or t

SEQ ID NO: 3551 - DNA, 245 bp, Arabidopsis thaliana; identical to SEQ ID NO: 2906

SEQ ID NO: 3552 - DNA, 47 bp, Arabidopsis thaliana; identical to SEQ ID NO: 2907

SEQ ID NO: 3553 - DNA, 59 bp, Arabidopsis thaliana; identical to SEQ ID NO: 2908

SEQ ID NO: 3554 - DNA, 326 bp, Arabidopsis thaliana; identical to SEQ ID NO: 2909

SEQ ID NO: 3555 - DNA, 218 bp, Arabidopsis thaliana; identical to SEQ ID NO: 2910

SEQ ID NO: 3556 - DNA, 147 bp, Brachypodium distachyon; identical to SEQ ID NO: 2386

SEQ ID NO: 3557 - DNA, 205 bp, Brachypodium distachyon; identical to SEQ ID NO: 2387

SEQ ID NO: 3558 - DNA, 146 bp, Brachypodium distachyon; identical to SEQ ID NO: 2388

SEQ ID NO: 3559 - DNA, 151 bp, Brachypodium distachyon; identical to SEQ ID NO: 2389

SEQ ID NO: 3560 - DNA, 82 bp, Brassica napus; identical to SEQ ID NO: 2390

SEQ ID NO: 3561 - DNA, 208 bp, Brassica napus; identical to SEQ ID NO: 2391

SEQ ID NO: 3562 - DNA, 155 bp, Brassica napus; identical to SEQ ID NO: 2392

SEQ ID NO: 3563 - DNA, 152 bp, Capsicum annuum; identical to SEQ ID NO: 2918

SEQ ID NO: 3564 - DNA, 65 bp, Capsicum annuum; identical to SEQ ID NO: 2919

SEQ ID NO: 3565 - DNA, 101 bp, Citrus x paradisi x Poncirus trifoliata; identical to SEQ ID NO: 2920

SEQ ID NO: 3566 - DNA, 185 bp, Citrus x paradisi x Poncirus trifoliata; identical to SEQ ID NO: 2921
  misc_feature (8)..(8): n is a, c, g, or t

SEQ ID NO: 3567 - DNA, 67 bp, Cycas rumphii; identical to SEQ ID NO: 2922

SEQ ID NO: 3568 - DNA, 103 bp, Citrus sinensis; identical to SEQ ID NO: 2393

SEQ ID NO: 3569 - DNA, 56 bp, Citrus sinensis; identical to SEQ ID NO: 2924

SEQ ID NO: 3570 - DNA, 515 bp, Citrus sinensis; identical to SEQ ID NO: 2925

SEQ ID NO: 3571 - DNA, 190 bp, Citrus trifoliata; identical to SEQ ID NO: 2394

SEQ ID NO: 3572 - DNA, 150 bp, Eschscholzia californica; identical to SEQ ID NO: 2927

SEQ ID NO: 3573 - DNA, 180 bp, Festuca arundinacea; identical to SEQ ID NO: 2395

SEQ ID NO: 3574 - DNA, 180 bp, Festuca arundinacea; identical to SEQ ID NO: 2395

SEQ ID NO: 3575 - DNA, 104 bp, Gossypium hirsutum; identical to SEQ ID NO: 2397

SEQ ID NO: 3576 - DNA, 113 bp, Gossypium hirsutum; identical to SEQ ID NO: 2398

SEQ ID NO: 3577 - DNA, 97 bp, Gossypium hirsutum; identical to SEQ ID NO: 2399

SEQ ID NO: 3578 - DNA, 96 bp, Gossypium hirsutum; identical to SEQ ID NO: 2400

SEQ ID NO: 3579 - DNA, 122 bp, Glycine max; identical to SEQ ID NO: 2401

SEQ ID NO: 3580 - DNA, 120 bp, Glycine max; identical to SEQ ID NO: 2402

SEQ ID NO: 3581 - DNA, 185 bp, Glycine max; identical to SEQ ID NO: 2403

SEQ ID NO: 3582 - DNA, 151 bp, Glycine max; identical to SEQ ID NO: 2404

SEQ ID NO: 3583 - DNA, 124 bp, Glycine max; identical to SEQ ID NO: 2405

SEQ ID NO: 3584 - DNA, 106 bp, Glycine max; identical to SEQ ID NO: 2406

SEQ ID NO: 3585 - DNA, 118 bp, Glycine max; identical to SEQ ID NO: 181

SEQ ID NO: 3586 - DNA, 147 bp, Glycine max; identical to SEQ ID NO: 2941

SEQ ID NO: 3587 - DNA, 117 bp, Glycine max; identical to SEQ ID NO: 2942

SEQ ID NO: 3588 - DNA, 362 bp, Helianthus annuus; identical to SEQ ID NO: 2943

SEQ ID NO: 3589 - DNA, 178 bp, Hordeum vulgare subsp. Spontaneum; identical to SEQ ID NO: 2944

SEQ ID NO: 3590 - DNA, 135 bp, Hordeum vulgare; identical to SEQ ID NO: 2407

SEQ ID NO: 3591 - DNA, 394 bp, Hordeum vulgare subsp. Vulgare; identical to SEQ ID NO: 2946
  misc_feature (266)..(266): n is a, c, g, or t

SEQ ID NO: 3592 - DNA, 86 bp, Hordeum vulgare subsp. Vulgare; identical to SEQ ID NO: 2947

SEQ ID NO: 3593 - DNA, 178 bp, Hordeum vulgare subsp. Vulgare; identical to SEQ ID NO: 2948

SEQ ID NO: 3594 - DNA, 203 bp, Hordeum vulgare subsp. Vulgare; identical to SEQ ID NO: 2949

SEQ ID NO: 3595 - DNA, 47 bp, Lotus japonicus; identical to SEQ ID NO: 2950

SEQ ID NO: 3596 - DNA, 355 bp, Lactuca sativa; identical to SEQ ID NO: 2951

SEQ ID NO: 3597 - DNA, 109 bp, Malus x domestica; identical to SEQ ID NO: 2952

SEQ ID NO: 3598 - DNA, 79 bp, Malus x domestica; identical to SEQ ID NO: 2953

SEQ ID NO: 3599 - DNA, 460 bp, Medicago truncatula; identical to SEQ ID NO: 2408

SEQ ID NO: 3600 - DNA, 95 bp, Medicago truncatula; identical to SEQ ID NO: 2409

SEQ ID NO: 3601 - DNA, 98 bp, Medicago truncatula; identical to SEQ ID NO: 2410

SEQ ID NO: 3602 - DNA, 90 bp, Medicago truncatula; identical to SEQ ID NO: 2411

SEQ ID NO: 3603 - DNA, 172 bp, Medicago truncatula; identical to SEQ ID NO: 2412

SEQ ID NO: 3604 - DNA, 94 bp, Medicago truncatula; identical to SEQ ID NO: 2413

SEQ ID NO: 3605 - DNA, 120 bp, Medicago truncatula; identical to SEQ ID NO: 2414

SEQ ID NO: 3606 - DNA, 94 bp, Medicago truncatula; identical to SEQ ID NO: 2415

SEQ ID NO: 3607 - DNA, 93 bp, Medicago truncatula; identical to SEQ ID NO: 2416

SEQ ID NO: 3608 - DNA, 205 bp, Nicotiana benthamiana; identical to SEQ ID NO: 2963

SEQ ID NO: 3609 - DNA, 169 bp, Nicotiana benthamiana; identical to SEQ ID NO: 2533

SEQ ID NO: 3610 - DNA, 93 bp, Oryza rufipogon; identical to SEQ ID NO: 2965

SEQ ID NO: 3611 - DNA, 100 bp, Oryza sativa; identical to SEQ ID NO: 2417

SEQ ID NO: 3612 - DNA, 176 bp, Oryza sativa; identical to SEQ ID NO: 2418

SEQ ID NO: 3613 - DNA, 149 bp, Oryza sativa; identical to SEQ ID NO: 2419

SEQ ID NO: 3614 - DNA, 129 bp, Oryza sativa; identical to SEQ ID NO: 2420

SEQ ID NO: 3615 - DNA, 104 bp, Oryza sativa; identical to SEQ ID NO: 2421

SEQ ID NO: 3616 - DNA, 186 bp, Oryza sativa; identical to SEQ ID NO: 2422

SEQ ID NO: 3617 - DNA, 116 bp, Oryza sativa; identical to SEQ ID NO: 2423

SEQ ID NO: 3618 - DNA, 101 bp, Oryza sativa; identical to SEQ ID NO: 2424

SEQ ID NO: 3619 - DNA, 90 bp, Oryza sativa; identical to SEQ ID NO: 2425

SEQ ID NO: 3620 - DNA, 165 bp, Oryza sativa; identical to SEQ ID NO: 2426

SEQ ID NO: 3621 - DNA, 106 bp, Oryza sativa; identical to SEQ ID NO: 2427

SEQ ID NO: 3622 - DNA, 156 bp, Oryza sativa; identical to SEQ ID NO: 2428

SEQ ID NO: 3623 - DNA, 86 bp, Oryza sativa; identical to SEQ ID NO: 2978

SEQ ID NO: 3624 - DNA, 97 bp, Oryza sativa; identical to SEQ ID NO: 2979

SEQ ID NO: 3625 - DNA, 179 bp, Oryza sativa; identical to SEQ ID NO: 2980

SEQ ID NO: 3626 - DNA, 133 bp, Oryza sativa; identical to SEQ ID NO: 2981

SEQ ID NO: 3627 - DNA, 243 bp, Oryza sativa; identical to SEQ ID NO: 2982

SEQ ID NO: 3628 - DNA, 83 bp, Oryza sativa; identical to SEQ ID NO: 2983

SEQ ID NO: 3629 - DNA, 114 bp, Prunus armeniaca; identical to SEQ ID NO: 2984

SEQ ID NO: 3630 - DNA, 146 bp, Populus trichocarpa x Populus deltoides; identical to SEQ ID NO: 2985

SEQ ID NO: 3631 - DNA, 103 bp, Phleum pratense; identical to SEQ ID NO: 2986

SEQ ID NO: 3632 - DNA, 115 bp, Physcomitrella patens; identical to SEQ ID NO: 2429

SEQ ID NO: 3633 - DNA, 220 bp, Physcomitrella patens; identical to SEQ ID NO: 2430

SEQ ID NO: 3634 - DNA, 95 bp, Physcomitrella patens; identical to SEQ ID NO: 2431

SEQ ID NO: 3635 - DNA, 83 bp, Pinus taeda; identical to SEQ ID NO: 194

SEQ ID NO: 3636 - DNA, 83 bp, Pinus taeda; identical to SEQ ID NO: 195

SEQ ID NO: 3637 - DNA, 101 bp, Populus trichocarpa; identical to SEQ ID NO: 2434

SEQ ID NO: 3638 - DNA, 101 bp, Populus trichocarpa; identical to SEQ ID NO: 2435

SEQ ID NO: 3639 - DNA, 100 bp, Populus trichocarpa; identical to SEQ ID NO: 2436

SEQ ID NO: 3640 - DNA, 101 bp, Populus trichocarpa; identical to SEQ ID NO: 2437

SEQ ID NO: 3641 - DNA, 100 bp, Populus trichocarpa; identical to SEQ ID NO: 2438

SEQ ID NO: 3642 - DNA, 101 bp, Populus trichocarpa; identical to SEQ ID NO: 2439

SEQ ID NO: 3643 - DNA, 103 bp, Populus trichocarpa; identical to SEQ ID NO: 2440

SEQ ID NO: 3644 - DNA, 103 bp, Populus trichocarpa; identical to SEQ ID NO: 2441

SEQ ID NO: 3645 - DNA, 99 bp, Populus trichocarpa; identical to SEQ ID NO: 2442

SEQ ID NO: 3646 - DNA, 100 bp, Populus trichocarpa; identical to SEQ ID NO: 2443

SEQ ID NO: 3647 - DNA, 101 bp, Populus trichocarpa; identical to SEQ ID NO: 2444

SEQ ID NO: 3648 - DNA, 373 bp, Populus tremula; identical to SEQ ID NO: 3002

SEQ ID NO: 3649 - DNA, 46 bp, Populus tremuloides; identical to SEQ ID NO: 3003

SEQ ID NO: 3650 - DNA, 356 bp, Populus tremuloides; identical to SEQ ID NO: 2539

SEQ ID NO: 3651 - DNA, 85 bp, Populus tremuloides; identical to SEQ ID NO: 3005

SEQ ID NO: 3652 - DNA, 97 bp, Ricinus communis; identical to SEQ ID NO: 2445

SEQ ID NO: 3653 - DNA, 92 bp, Ricinus communis; identical to SEQ ID NO: 2446

SEQ ID NO: 3654 - DNA, 94 bp, Ricinus communis; identical to SEQ ID NO: 2447

SEQ ID NO: 3655 - DNA, 93 bp, Ricinus communis; identical to SEQ ID NO: 2448

SEQ ID NO: 3656 - DNA, 95 bp, Ricinus communis; identical to SEQ ID NO: 2449

SEQ ID NO: 3657 - DNA, 97 bp, Ricinus communis; identical to SEQ ID NO: 2450

SEQ ID NO: 3658 - DNA, 97 bp, Ricinus communis; identical to SEQ ID NO: 2451

SEQ ID NO: 3659 - DNA, 97 bp, Ricinus communis; identical to SEQ ID NO: 2452

SEQ ID NO: 3660 - DNA, 84 bp, Sorghum bicolor; identical to SEQ ID NO: 2453

SEQ ID NO: 3661 - DNA, 84 bp, Sorghum bicolor; identical to SEQ ID NO: 2454

SEQ ID NO: 3662 - DNA, 95 bp, Sorghum bicolor; identical to SEQ ID NO: 2455

SEQ ID NO: 3663 - DNA, 125 bp, Sorghum bicolor; identical to SEQ ID NO: 2456

SEQ ID NO: 3664 - DNA, 123 bp, Sorghum bicolor; identical to SEQ ID NO: 2457

SEQ ID NO: 3665 - DNA, 128 bp, Sorghum bicolor; identical to SEQ ID NO: 2458

SEQ ID NO: 3666 - DNA, 89 bp, Sorghum bicolor; identical to SEQ ID NO: 2459

SEQ ID NO: 3667 - DNA, 94 bp, Sorghum bicolor; identical to SEQ ID NO: 2460

SEQ ID NO: 3668 - DNA, 121 bp, Sorghum bicolor; identical to SEQ ID NO: 2461

SEQ ID NO: 3669 - DNA, 81 bp, Sesamum indicum; identical to SEQ ID NO: 3023

SEQ ID NO: 3670 - DNA, 100 bp, Solanum lycopersicum; identical to SEQ ID NO: 2462

SEQ ID NO: 3671 - DNA, 84 bp, Solanum lycopersicum; identical to SEQ ID NO: 2463

SEQ ID NO: 3672 - DNA, 83 bp, Solanum lycopersicum; identical to SEQ ID NO: 2464

SEQ ID NO: 3673 - DNA, 102 bp, Selaginella moellendorffii; identical to SEQ ID NO: 2465

SEQ ID NO: 3674 - DNA, 100 bp, Selaginella moellendorffii; identical to SEQ ID NO: 2467

SEQ ID NO: 3675 - DNA, 103 bp, Selaginella moellendorffii; identical to SEQ ID NO: 2468

SEQ ID NO: 3676 - DNA, 137 bp, Saccharum officinarum; identical to SEQ ID NO: 2469

SEQ ID NO: 3677 - DNA, 68 bp, Saccharum officinarum; identical to SEQ ID NO: 3032

SEQ ID NO: 3678 - DNA, 327 bp, Saccharum officinarum; identical to SEQ ID NO: 3033

SEQ ID NO: 3679 - DNA, 70 bp, Saccharum officinarum; identical to SEQ ID NO: 3034

SEQ ID NO: 3680 - DNA, 46 bp, Saccharum officinarum; identical to SEQ ID NO: 3035

SEQ ID NO: 3681 - DNA, 403 bp, Saccharum officinarum; identical to SEQ ID NO: 3036

SEQ ID NO: 3682 - DNA, 343 bp, Saccharum officinarum; identical to SEQ ID NO: 3037

SEQ ID NO: 3683 - DNA, 82 bp, Saccharum officinarum; identical to SEQ ID NO: 3038

SEQ ID NO: 3684 - DNA, 125 bp, Sorghum Propinquum; identical to SEQ ID NO: 3039

SEQ ID NO: 3685 - DNA, 543 bp, Saccharum spp; identical to SEQ ID NO: 2470
  misc_feature (340)..(340): n is a, c, g, or t
  misc_feature (415)..(415): n is a, c, g, or t
  misc_feature (446)..(446): n is a, c, g, or t

SEQ ID NO: 3686 - DNA, 86 bp, Solanum tuberosum; identical to SEQ ID NO: 3041

SEQ ID NO: 3687 - DNA, 382 bp, Solanum tuberosum; identical to SEQ ID NO: 3042

SEQ ID NO: 3688 - DNA, 85 bp, Solanum tuberosum; identical to SEQ ID NO: 3043

SEQ ID NO: 3689 - DNA, 171 bp, Solanum tuberosum; identical to SEQ ID NO: 3044

SEQ ID NO: 3690 - DNA, 72 bp, Solanum tuberosum; identical to SEQ ID NO: 3045

SEQ ID NO: 3691 - DNA, 278 bp, Triticum aestivum; identical to SEQ ID NO: 2471

SEQ ID NO: 3692 - DNA, 52 bp, Triticum aestivum; identical to SEQ ID NO: 3047

SEQ ID NO: 3693 - DNA, 416 bp, Triticum aestivum; identical to SEQ ID NO: 3048

SEQ ID NO: 3694 - DNA, 124 bp, Theobroma cacao; identical to SEQ ID NO: 2472

SEQ ID NO: 3695 - DNA, 129 bp, Theobroma cacao; identical to SEQ ID NO: 2473

SEQ ID NO: 3696 - DNA, 121 bp, Theobroma cacao; identical to SEQ ID NO: 2474

SEQ ID NO: 3697 - DNA, 125 bp, Theobroma cacao; identical to SEQ ID NO: 2475

SEQ ID NO: 3698 - DNA, 123 bp, Theobroma cacao; identical to SEQ ID NO: 2476

SEQ ID NO: 3699 - DNA, 124 bp, Theobroma cacao; identical to SEQ ID NO: 2477

SEQ ID NO: 3700 - DNA, 120 bp, Theobroma cacao; identical to SEQ ID NO: 2478

SEQ ID NO: 3701 - DNA, 85 bp, Trifolium repens; identical to SEQ ID NO: 3056

SEQ ID NO: 3702 - DNA, 104 bp, Vitis vinifera; identical to SEQ ID NO: 2479

SEQ ID NO: 3703 - DNA, 102 bp, Vitis vinifera; identical to SEQ ID NO: 2480

SEQ ID NO: 3704 - DNA, 104 bp, Vitis vinifera; identical to SEQ ID NO: 2481

SEQ ID NO: 3705 - DNA, 103 bp, Vitis vinifera; identical to SEQ ID NO: 2482

SEQ ID NO: 3706 - DNA, 108 bp, Vitis vinifera; identical to SEQ ID NO: 2483

SEQ ID NO: 3707 - DNA, 105 bp, Vitis vinifera; identical to SEQ ID NO: 2484

SEQ ID NO: 3708 - DNA, 103 bp, Vitis vinifera; identical to SEQ ID NO: 2485

SEQ ID NO: 3709 - DNA, 228 bp, Vitis vinifera; identical to SEQ ID NO: 2486

SEQ ID NO: 3710 - DNA, 103 bp, Vitis vinifera; identical to SEQ ID NO: 2487

SEQ ID NO: 3711 - DNA, 67 bp, Zinnia elegans; identical to SEQ ID NO: 3066

SEQ ID NO: 3712 - DNA, 152 bp, Zea mays; identical to SEQ ID NO: 2488

SEQ ID NO: 3713 - DNA, 124 bp, Zea mays; identical to SEQ ID NO: 2489

SEQ ID NO: 3714 - DNA, 139 bp, Zea mays; identical to SEQ ID NO: 2490

SEQ ID NO: 3715 - DNA, 119 bp, Zea mays; identical to SEQ ID NO: 2491

SEQ ID NO: 3716 - DNA, 126 bp, Zea mays; identical to SEQ ID NO: 2492

SEQ ID NO: 3717 - DNA, 167 bp, Zea mays; identical to SEQ ID NO: 2493

SEQ ID NO: 3718 - DNA, 121 bp, Zea mays; identical to SEQ ID NO: 2494

SEQ ID NO: 3719 - DNA, 115 bp, Zea mays; identical to SEQ ID NO: 2495

SEQ ID NO: 3720 - DNA, 117 bp, Zea mays; identical to SEQ ID NO: 2496

SEQ ID NO: 3721 - DNA, 125 bp, Zea mays; identical to SEQ ID NO: 2497

SEQ ID NO: 3722 - DNA, 123 bp, Zea mays; identical to SEQ ID NO: 2498

SEQ ID NO: 3723 - DNA, 90 bp, Zea mays; identical to SEQ ID NO: 2499

SEQ ID NO: 3724 - DNA, 83 bp, Zea mays; identical to SEQ ID NO: 3079

SEQ ID NO: 3725 - DNA, 84 bp, Zea mays; identical to SEQ ID NO: 3080

SEQ ID NO: 3726 - DNA, 99 bp, Zea mays; identical to SEQ ID NO: 3081

SEQ ID NO: 3727 - DNA, 189 bp, Zea mays; identical to SEQ ID NO: 2549

SEQ ID NO: 3728 - DNA, 189 bp, Zea mays; identical to SEQ ID NO: 2549

SEQ ID NO: 3729 - DNA, 99 bp, Zea mays; identical to SEQ ID NO: 3084

SEQ ID NO: 3730 - DNA, 191 bp, Arabidopsis cebennensis; identical to SEQ ID NO: 2091

SEQ ID NO: 3731 - DNA, 192 bp, Arabidopsis halleri; identical to SEQ ID NO: 2092

SEQ ID NO: 3732 - DNA, 192 bp, Arabis hirsuta; identical to SEQ ID NO: 2093

SEQ ID NO: 3733 - DNA, 197 bp, Arachis hypogaea; identical to SEQ ID NO: 2094

SEQ ID NO: 3734 - DNA, 222 bp, Arabidopsis lyrata; identical to SEQ ID NO: 2095

SEQ ID NO: 3735 - DNA, 202 bp, Arabidopsis lyrata; identical to SEQ ID NO: 2096

SEQ ID NO: 3736 - DNA, 220 bp, Arabidopsis lyrata; identical to SEQ ID NO: 2097

SEQ ID NO: 3737 - DNA, 192 bp, Alliaria petiolata; identical to SEQ ID NO: 2098

SEQ ID NO: 3738 - DNA, 71 bp, Aquilegia coerulea; identical to SEQ ID NO: 176

SEQ ID NO: 3739 - DNA, 184 bp, Arabidopsis thaliana; identical to SEQ ID NO: 2099

SEQ ID NO: 3740 - DNA, 196 bp, Arabidopsis thaliana; identical to SEQ ID NO: 178

SEQ ID NO: 3741 - DNA, 225 bp, Arabidopsis thaliana; identical to SEQ ID NO: 179

SEQ ID NO: 3742 - DNA, 234 bp, Brachypodium distachyon; identical to SEQ ID NO: 2102

SEQ ID NO: 3743 - DNA, 183 bp, Brassica napus; identical to SEQ ID NO: 2103

SEQ ID NO: 3744 - DNA, 185 bp, Brassica rapa; identical to SEQ ID NO: 2104

SEQ ID NO: 3745 - DNA, 192 bp, Barbarea vulgaris; identical to SEQ ID NO: 2098

SEQ ID NO: 3746 - DNA, 193 bp, Camelina microcarpa; identical to SEQ ID NO: 2106

SEQ ID NO: 3747 - DNA, 193 bp, Conringia orientalis; identical to SEQ ID NO: 2106

SEQ ID NO: 3748 - DNA, 194 bp, Capsella rubella; identical to SEQ ID NO: 2108

SEQ ID NO: 3749 - DNA, 216 bp, Citrus sinensis; identical to SEQ ID NO: 2109

SEQ ID NO: 3750 - DNA, 192 bp, Descurainia sophia; identical to SEQ ID NO: 2110

SEQ ID NO: 3751 - DNA, 192 bp, Erysimum cheiri; identical to SEQ ID NO: 2111

SEQ ID NO: 3752 - DNA, 192 bp, Fourraea alpina; identical to SEQ ID NO: 2112

SEQ ID NO: 3753 - DNA, 200 bp, Festuca arundinacea; identical to SEQ ID NO: 2113

SEQ ID NO: 3754 - DNA, 186 bp, Glycine max; identical to SEQ ID NO: 2115

SEQ ID NO: 3755 - DNA, 185 bp, Glycine max; identical to SEQ ID NO: 2116

SEQ ID NO: 3756 - DNA, 178 bp, Hordeum vulgare; identical to SEQ ID NO: 2117

SEQ ID NO: 3757 - DNA, 122 bp, Hordeum vulgare; identical to SEQ ID NO: 2118

SEQ ID NO: 3758 - DNA, 303 bp, Hordeum vulgare subsp. Vulgare; identical to SEQ ID NO: 2119

SEQ ID NO: 3759 - DNA, 174 bp, Hordeum vulgare subsp. Vulgare; identical to SEQ ID NO: 2120

SEQ ID NO: 3760 - DNA, 345 bp, Liriodendron tulipifera; identical to SEQ ID NO: 2121

SEQ ID NO: 3761 - DNA, 192 bp, Malcolmia maritima; identical to SEQ ID NO: 2122

SEQ ID NO: 3762 - DNA, 183 bp, Medicago truncatula; identical to SEQ ID NO: 2123

SEQ ID NO: 3763 - DNA, 62 bp, Medicago truncatula; identical to SEQ ID NO: 2124

SEQ ID NO: 3764 - DNA, 44 bp, Medicago truncatula; identical to SEQ ID NO: 2125

SEQ ID NO: 3765 - DNA, 192 bp, Nasturtium officinale; identical to SEQ ID NO: 2126

SEQ ID NO: 3766 - DNA, 274 bp, Oryza rufipogon; identical to SEQ ID NO: 2127

SEQ ID NO: 3767 - DNA, 272 bp, Oryza sativa; identical to SEQ ID NO: 2128

SEQ ID NO: 3768 - DNA, 272 bp, Oryza sativa; identical to SEQ ID NO: 2128

SEQ ID NO: 3769 - DNA, 188 bp, Oryza sativa; identical to SEQ ID NO: 2130

SEQ ID NO: 3770 - DNA, 197 bp, Oryza sativa; identical to SEQ ID NO: 2131

SEQ ID NO: 3771 - DNA, 189 bp, Oryza sativa; identical to SEQ ID NO: 2132

SEQ ID NO: 3772 - DNA, 191 bp, Oryza sativa; identical to SEQ ID NO: 187

SEQ ID NO: 3773 - DNA, 188 bp, Oryza sativa; identical to SEQ ID NO: 188

SEQ ID NO: 3774 - DNA, 249 bp, Oryza sativa; identical to SEQ ID NO: 2135

SEQ ID NO: 3775 - DNA, 226 bp, Pennisetum glaucum; identical to SEQ ID NO: 2136

SEQ ID NO: 3776 - DNA, 193 bp, Picea sitchensis; identical to SEQ ID NO: 193

SEQ ID NO: 3777 - DNA, 210 bp, Pinus taeda; identical to SEQ ID NO: 2138

SEQ ID NO: 3778 - DNA, 184 bp, Pinus taeda; identical to SEQ ID NO: 2139

SEQ ID NO: 3779 - DNA, 85 bp, Pinus taeda; identical to SEQ ID NO: 2140

SEQ ID NO: 3780 - DNA, 183 bp, Populus trichocarpa; identical to SEQ ID NO: 2141

SEQ ID NO: 3781 - DNA, 187 bp, Populus trichocarpa; identical to SEQ ID NO: 2142

SEQ ID NO: 3782 - DNA, 183 bp, Populus trichocarpa; identical to SEQ ID NO: 2143

SEQ ID NO: 3783 - DNA, 194 bp, Populus trichocarpa; identical to SEQ ID NO: 2144

SEQ ID NO: 3784 - DNA, 192 bp, Populus trichocarpa; identical to SEQ ID NO: 2145

SEQ ID NO: 3785 - DNA, 201 bp, Populus trichocarpa; identical to SEQ ID NO: 2146

SEQ ID NO: 3786 - DNA, 174 bp, Phaseolus vulgaris; identical to SEQ ID NO: 2147

SEQ ID NO: 3787 - DNA, 174 bp, Phaseolus vulgaris; identical to SEQ ID NO: 2147

SEQ ID NO: 3788 - DNA, 180 bp, Ricinus communis; identical to SEQ ID NO: 2149

SEQ ID NO: 3789 - DNA, 192 bp, Rorippa indica; identical to SEQ ID NO: 2150

SEQ ID NO: 3790 - DNA, 175 bp, Schedonorus arundinaceus; identical to SEQ ID NO: 2151

SEQ ID NO: 3791 - DNA, 226 bp, Sorghum bicolor; identical to SEQ ID NO: 196

SEQ ID NO: 3792 - DNA, 253 bp, Sorghum bicolor; identical to SEQ ID NO: 2153

SEQ ID NO: 3793 - DNA, 177 bp, Solanum lycopersicum; identical to SEQ ID NO: 2154

SEQ ID NO: 3794 - DNA, 279 bp, Selaginella moellendorffii; identical to SEQ ID NO: 2155

SEQ ID NO: 3795 - DNA, 265 bp, Saccharum officinarum; identical to SEQ ID NO: 2156

SEQ ID NO: 3796 - DNA, 266 bp, Saccharum officinarum; identical to SEQ ID NO: 2157

SEQ ID NO: 3797 - DNA, 238 bp, Saccharum officinarum; identical to SEQ ID NO: 2158

SEQ ID NO: 3798 - DNA, 265 bp, Saccharum officinarum; identical to SEQ ID NO: 2159

SEQ ID NO: 3799 - DNA, 264 bp, Saccharum officinarum; identical to SEQ ID NO: 2160

SEQ ID NO: 3800 - DNA, 392 bp, Sorghum Propinquum; identical to SEQ ID NO: 2161

SEQ ID NO: 3801 - DNA, 261 bp, Saccharum spp; identical to SEQ ID NO: 2162

SEQ ID NO: 3802 - DNA, 191 bp, Sibara virginica; identical to SEQ ID NO: 2163

SEQ ID NO: 3803 - DNA, 177 bp, Triticum aestivum; identical to SEQ ID NO: 2164

SEQ ID NO: 3804 - DNA, 255 bp, Triticum aestivum; identical to SEQ ID NO: 2165

SEQ ID NO: 3805 - DNA, 192 bp, Thlaspi arvense; identical to SEQ ID NO: 2166

SEQ ID NO: 3806 - DNA, 194 bp, Vitis vinifera; identical to SEQ ID NO: 2167

SEQ ID NO: 3807 - DNA, 185 bp, Vitis vinifera; identical to SEQ ID NO: 2168

SEQ ID NO: 3808 - DNA, 190 bp, Vitis vinifera; identical to SEQ ID NO: 2169

SEQ ID NO: 3809 - DNA, 246 bp, Zea mays; identical to SEQ ID NO: 2170

SEQ ID NO: 3810 - DNA, 221 bp, Zea mays; identical to SEQ ID NO: 2171

SEQ ID NO: 3811 - DNA, 217 bp, Zea mays; identical to SEQ ID NO: 2172

SEQ ID NO: 3812 - DNA, 217 bp, Zea mays; identical to SEQ ID NO: 2173

SEQ ID NO: 3813 - DNA, 127 bp, Zea mays; identical to SEQ ID NO: 2174

SEQ ID NO: 3814 - DNA, 215 bp, Zea mays; identical to SEQ ID NO: 2175

SEQ ID NO: 3815 - DNA, 252 bp, Zea mays; identical to SEQ ID NO: 2176

SEQ ID NO: 3816 - DNA, 200 bp, Zea mays; identical to SEQ ID NO: 2177

SEQ ID NO: 3817 - DNA, 252 bp, Zea mays; identical to SEQ ID NO: 2178

SEQ ID NO: 3818 - DNA, 252 bp, Zea mays; identical to SEQ ID NO: 2179

SEQ ID NO: 3819 - DNA, 200 bp, Zea mays; identical to SEQ ID NO: 2180

SEQ ID NO: 3820 - DNA, 457 bp, Zea mays; identical to SEQ ID NO: 2181

SEQ ID NO: 3821 - DNA, 191 bp, Arabidopsis cebennensis; identical to SEQ ID NO: 2091

SEQ ID NO: 3822 - DNA, 192 bp, Arabidopsis halleri; identical to SEQ ID NO: 2092

SEQ ID NO: 3823 - DNA, 192 bp, Arabis hirsuta; identical to SEQ ID NO: 2093

SEQ ID NO: 3824 - DNA, 197 bp, Arachis hypogaea; identical to SEQ ID NO: 2094

SEQ ID NO: 3825 - DNA, 222 bp, Arabidopsis lyrata; identical to SEQ ID NO: 2095

SEQ ID NO: 3826 - DNA, 202 bp, Arabidopsis lyrata; identical to SEQ ID NO: 2096

SEQ ID NO: 3827 - DNA, 220 bp, Arabidopsis lyrata; identical to SEQ ID NO: 2097

SEQ ID NO: 3828 - DNA, 192 bp, Alliaria petiolata; identical to SEQ ID NO: 2098

SEQ ID NO: 3829 - DNA, 71 bp, Aquilegia coerulea; identical to SEQ ID NO: 176

SEQ ID NO: 3830 - DNA, 184 bp, Arabidopsis thaliana; identical to SEQ ID NO: 2099

SEQ ID NO: 3831 - DNA, 196 bp, Arabidopsis thaliana; identical to SEQ ID NO: 178

SEQ ID NO: 3832 - DNA, 225 bp, Arabidopsis thaliana; identical to SEQ ID NO: 179

SEQ ID NO: 3833 - DNA, 234 bp, Brachypodium distachyon; identical to SEQ ID NO: 2102

SEQ ID NO: 3834 - DNA, 183 bp, Brassica napus; identical to SEQ ID NO: 2103

SEQ ID NO: 3835 - DNA, 185 bp, Brassica rapa; identical to SEQ ID NO: 2104

SEQ ID NO: 3836 - DNA, 192 bp, Barbarea vulgaris; identical to SEQ ID NO: 2098

SEQ ID NO: 3837 - DNA, 193 bp, Camelina microcarpa; identical to SEQ ID NO: 2106

SEQ ID NO: 3838 - DNA, 193 bp, Conringia orientalis; identical to SEQ ID NO: 2106

SEQ ID NO: 3839 - DNA, 194 bp, Capsella rubella; identical to SEQ ID NO: 2108

SEQ ID NO: 3840 - DNA, 216 bp, Citrus sinensis; identical to SEQ ID NO: 2109

SEQ ID NO: 3841 - DNA, 192 bp, Descurainia sophia; identical to SEQ ID NO: 2110

SEQ ID NO: 3842 - DNA, 192 bp, Erysimum cheiri; identical to SEQ ID NO: 2111

SEQ ID NO: 3843 - DNA, 192 bp, Fourraea alpina; identical to SEQ ID NO: 2112

SEQ ID NO: 3844 - DNA, 200 bp, Festuca arundinacea; identical to SEQ ID NO: 2113

SEQ ID NO: 3845 - DNA, 214 bp, Glycine max; identical to SEQ ID NO: 183

SEQ ID NO: 3846 - DNA, 186 bp, Glycine max; identical to SEQ ID NO: 2115

SEQ ID NO: 3847 - DNA, 185 bp, Glycine max; identical to SEQ ID NO: 2116

SEQ ID NO: 3848 - DNA, 178 bp, Hordeum vulgare; identical to SEQ ID NO: 2117

SEQ ID NO: 3849 - DNA, 122 bp, Hordeum vulgare; identical to SEQ ID NO: 2118

SEQ ID NO: 3850 - DNA, 303 bp, Hordeum vulgare subsp. Vulgare; identical to SEQ ID NO: 2119

SEQ ID NO: 3851 - DNA, 174 bp, Hordeum vulgare subsp. Vulgare; identical to SEQ ID NO: 2120

SEQ ID NO: 3852 - DNA, 345 bp, Liriodendron tulipifera; identical to SEQ ID NO: 2121

SEQ ID NO: 3853 - DNA, 192 bp, Malcolmia maritima; identical to SEQ ID NO: 2122

SEQ ID NO: 3854 - DNA, 183 bp, Medicago truncatula; identical to SEQ ID NO: 2123

SEQ ID NO: 3855 - DNA, 62 bp, Medicago truncatula; identical to SEQ ID NO: 2124

SEQ ID NO: 3856 - DNA, 44 bp, Medicago truncatula; identical to SEQ ID NO: 2125

SEQ ID NO: 3857 - DNA, 192 bp, Nasturtium officinale; identical to SEQ ID NO: 2126

SEQ ID NO: 3858 - DNA, 274 bp, Oryza rufipogon; identical to SEQ ID NO: 2127

SEQ ID NO: 3859 - DNA, 272 bp, Oryza sativa; identical to SEQ ID NO: 2128

SEQ ID NO: 3860 - DNA, 272 bp, Oryza sativa; identical to SEQ ID NO: 2128

SEQ ID NO: 3861 - DNA, 188 bp, Oryza sativa; identical to SEQ ID NO: 2130

SEQ ID NO: 3862 - DNA, 197 bp, Oryza sativa; identical to SEQ ID NO: 2131

SEQ ID NO: 3863 - DNA, 189 bp, Oryza sativa; identical to SEQ ID NO: 2132

SEQ ID NO: 3864 - DNA, 191 bp, Oryza sativa; identical to SEQ ID NO: 187

SEQ ID NO: 3865 - DNA, 188 bp, Oryza sativa; identical to SEQ ID NO: 188

SEQ ID NO: 3866 - DNA, 249 bp, Oryza sativa; identical to SEQ ID NO: 2135

SEQ ID NO: 3867 - DNA, 226 bp, Pennisetum glaucum; identical to SEQ ID NO: 2136

SEQ ID NO: 3868 - DNA, 193 bp, Picea sitchensis; identical to SEQ ID NO: 193

SEQ ID NO: 3869 - DNA, 210 bp, Pinus taeda; identical to SEQ ID NO: 2138

SEQ ID NO: 3870 - DNA, 184 bp, Pinus taeda; identical to SEQ ID NO: 2139

SEQ ID NO: 3871 - DNA, 85 bp, Pinus taeda; identical to SEQ ID NO: 2140

SEQ ID NO: 3872 - DNA, 183 bp, Populus trichocarpa; identical to SEQ ID NO: 2141

SEQ ID NO: 3873 - DNA, 187 bp, Populus trichocarpa; identical to SEQ ID NO: 2142

SEQ ID NO: 3874 - DNA, 183 bp, Populus trichocarpa; identical to SEQ ID NO: 2143

SEQ ID NO: 3875 - DNA, 194 bp, Populus trichocarpa; identical to SEQ ID NO: 2144

SEQ ID NO: 3876 - DNA, 192 bp, Populus trichocarpa; identical to SEQ ID NO: 2145

SEQ ID NO: 3877 - DNA, 201 bp, Populus trichocarpa; identical to SEQ ID NO: 2146

SEQ ID NO: 3878 - DNA, 174 bp, Phaseolus vulgaris; identical to SEQ ID NO: 2147

SEQ ID NO: 3879 - DNA, 174 bp, Phaseolus vulgaris; identical to SEQ ID NO: 2147

SEQ ID NO: 3880 - DNA, 180 bp, Ricinus communis; identical to SEQ ID NO: 2149

SEQ ID NO: 3881 - DNA, 192 bp, Rorippa indica; identical to SEQ ID NO: 2150

SEQ ID NO: 3882 - DNA, 175 bp, Schedonorus arundinaceus; identical to SEQ ID NO: 2151

SEQ ID NO: 3883 - DNA, 253 bp, Sorghum bicolor; identical to SEQ ID NO: 2153

SEQ ID NO: 3884 - DNA, 177 bp, Solanum lycopersicum; identical to SEQ ID NO: 2154

SEQ ID NO: 3885 - DNA, 279 bp, Selaginella moellendorffii; identical to SEQ ID NO: 2155

SEQ ID NO: 3886 - DNA, 265 bp, Saccharum officinarum; identical to SEQ ID NO: 2156

SEQ ID NO: 3887 - DNA, 266 bp, Saccharum officinarum; identical to SEQ ID NO: 2157

SEQ ID NO: 3888 - DNA, 238 bp, Saccharum officinarum; identical to SEQ ID NO: 2158

SEQ ID NO: 3889 - DNA, 265 bp, Saccharum officinarum; identical to SEQ ID NO: 2159

SEQ ID NO: 3890 - DNA, 264 bp, Saccharum officinarum; identical to SEQ ID NO: 2160

SEQ ID NO: 3891 - DNA, 392 bp, Sorghum Propinquum; identical to SEQ ID NO: 2161

SEQ ID NO: 3892 - DNA, 261 bp, Saccharum spp; identical to SEQ ID NO: 2162

SEQ ID NO: 3893 - DNA, 191 bp, Sibara virginica; identical to SEQ ID NO: 2163

SEQ ID NO: 3894 - DNA, 177 bp, Triticum aestivum; identical to SEQ ID NO: 2164

SEQ ID NO: 3895 - DNA, 255 bp, Triticum aestivum; identical to SEQ ID NO: 2165

SEQ ID NO: 3896 - DNA, 192 bp, Thlaspi arvense; identical to SEQ ID NO: 2166

SEQ ID NO: 3897 - DNA, 194 bp, Vitis vinifera; identical to SEQ ID NO: 2167

SEQ ID NO: 3898 - DNA, 185 bp, Vitis vinifera; identical to SEQ ID NO: 2168

SEQ ID NO: 3899 - DNA, 190 bp, Vitis vinifera; identical to SEQ ID NO: 2169

SEQ ID NO: 3900 - DNA, 246 bp, Zea mays; identical to SEQ ID NO: 2170

SEQ ID NO: 3901 - DNA, 221 bp, Zea mays; identical to SEQ ID NO: 2171

SEQ ID NO: 3902 - DNA, 217 bp, Zea mays; identical to SEQ ID NO: 2172

SEQ ID NO: 3903 - DNA, 217 bp, Zea mays; identical to SEQ ID NO: 2173

SEQ ID NO: 3904 - DNA, 127 bp, Zea mays; identical to SEQ ID NO: 2174

SEQ ID NO: 3905 - DNA, 215 bp, Zea mays; identical to SEQ ID NO: 2175

SEQ ID NO: 3906 - DNA, 252 bp, Zea mays; identical to SEQ ID NO: 2176

SEQ ID NO: 3907 - DNA, 200 bp, Zea mays; identical to SEQ ID NO: 2177

SEQ ID NO: 3908 - DNA, 252 bp, Zea mays; identical to SEQ ID NO: 2178

SEQ ID NO: 3909 - DNA, 252 bp, Zea mays; identical to SEQ ID NO: 2179

SEQ ID NO: 3910 - DNA, 200 bp, Zea mays; identical to SEQ ID NO: 2180

SEQ ID NO: 3911 - DNA, 457 bp, Zea mays; identical to SEQ ID NO: 2181

SEQ ID NO: 3912 - DNA, 124 bp, Glycine max
tcattttttatactttaatttcctctatactcacttttattggagaaaaaagagaatagaaaatagtggatttctcttctttttttcaatcaaaggagttgtaggggaaaagtttagaaaatgg

SEQ ID NO: 3913 - DNA, 168 bp, Medicago truncatula
tggagcttcctttagtccaaatatggatcttgctatgttgatagagctgcttagctatgggtccctcaactctacccatcttgttctttgtggtagttttgtggcttccatatctagggagccttatcacctttagtttaatctttctttggattgaagggagctcta

SEQ ID NO: 3914 - DNA, 203 bp, Zea mays
acagatgctcccttcacaccaataaacggtcgatctgatgggtggtacagctgctcgttcatggttcccactgtcccatctcatcagagagagagaagatcctgagagagcgagagatgcttgagatgggcttgtggtttgcatgaccgaggagctgcctcgtccccttcgttgaccgctgtttggagtgaagggagctctgc

SEQ ID NO: 3915 - DNA, 181 bp, Zea mays
gaagagctcccttcgatccaatccagggaggggaagtgttcggttgcagctgccggttcatggatacttctctggtgcagcaatggccgcagctcacctctgcacttgcatgggtgtgcatgacccgggagatgagcccgccatcatctttccctcgtgcttggattgaagggagctcctc

SEQ ID NO: 3916 - DNA, 180 bp, Zea mays
gaagagctcccttcgatccaatccaggaggggaagtggtcggttgcagctgccggttcatggatacctctctggtgcagcaatggccgctgctcacctctgcacttgcatgggtgtgcatgacccgggagatgagcccgccatcatctttccctcgtgcttggattgaagggagctcctc

SEQ ID NO: 3917 - DNA, 168 bp, Medicago truncatula; identical to SEQ ID NO: 3913

SEQ ID NO: 3918 - DNA, 203 bp, Zea mays; identical to SEQ ID NO: 3914

SEQ ID NO: 3919 - DNA, 181 bp, Zea mays; identical to SEQ ID NO: 3915

SEQ ID NO: 3920 - DNA, 180 bp, Zea mays; identical to SEQ ID NO: 3916

SEQ ID NO: 3921 - DNA, 168 bp, Medicago truncatula; identical to SEQ ID NO: 3913

SEQ ID NO: 3922 - DNA, 203 bp, Zea mays; identical to SEQ ID NO: 3914

SEQ ID NO: 3923 - DNA, 181 bp, Zea mays; identical to SEQ ID NO: 3915

SEQ ID NO: 3924 - DNA, 180 bp, Zea mays; identical to SEQ ID NO: 3916

SEQ ID NO: 3925 - DNA, 168 bp, Medicago truncatula; identical to SEQ ID NO: 3913

SEQ ID NO: 3926 - DNA, 203 bp, Zea mays; identical to SEQ ID NO: 3914

SEQ ID NO: 3927 - DNA, 181 bp, Zea mays; identical to SEQ ID NO: 3915

SEQ ID NO: 3928 - DNA, 180 bp, Zea mays; identical to SEQ ID NO: 3916

SEQ ID NO: 3929 - DNA, 168 bp, Medicago truncatula; identical to SEQ ID NO: 3913

SEQ ID NO: 3930 - DNA, 203 bp, Zea mays; identical to SEQ ID NO: 3914

SEQ ID NO: 3931 - DNA, 181 bp, Zea mays; identical to SEQ ID NO: 3915

SEQ ID NO: 3932 - DNA, 180 bp, Zea mays; identical to SEQ ID NO: 3916

SEQ ID NO: 3933 - DNA, 168 bp, Medicago truncatula; identical to SEQ ID NO: 3913

SEQ ID NO: 3934 - DNA, 203 bp, Zea mays; identical to SEQ ID NO: 3914

SEQ ID NO: 3935 - DNA, 181 bp, Zea mays; identical to SEQ ID NO: 3915

SEQ ID NO: 3936 - DNA, 180 bp, Zea mays; identical to SEQ ID NO: 3916

SEQ ID NO: 3937 - DNA, 267 bp, Glycine max
tgacagaagagagagagcacagctcgtgtcggtgaccccaatgtaactttcccctggaggatgtcccgggctggcgaagcttgtcccacccaccgaaccttgcaagaaaaggtcagatgatgtctctgagttgccattccagctaagtgtggaggtttgatttccaggagctagctcagatgatctaggagttggaagtgaatttctcagactaagctttgggtatgaagtcaattccatcagaaagttgctacctctgccactatt

SEQ ID NO: 3938 - DNA, 209 bp, Glycine max
ttcttcttcttcttccactgcagcatcatggtggggcacaacatgaggccagtctctatcataaacaagttgttgttgtctagtgattagggcagcacggttttctgctatcaattcacgcaatgctgcactgcatcttgtggagaaatccgcatgatgagatagccaattttcactactactcccagatgacagaagagagagagcac

SEQ ID NO: 3939 - DNA, 267 bp, Glycine max; identical to SEQ ID NO: 3937

SEQ ID NO: 3940 - DNA, 209 bp, Glycine max; identical to SEQ ID NO: 3938

SEQ ID NO: 3941 - DNA, 267 bp, Glycine max; identical to SEQ ID NO: 3937

SEQ ID NO: 3942 - DNA, 209 bp, Glycine max; identical to SEQ ID NO: 3938

SEQ ID NO: 3943 - DNA, 267 bp, Glycine max; identical to SEQ ID NO: 3937

SEQ ID NO: 3944 - DNA, 209 bp, Glycine max; identical to SEQ ID NO: 3938

SEQ ID NO: 3945 - DNA, 168 bp, Medicago truncatula; identical to SEQ ID NO: 3913

SEQ ID NO: 3946 - DNA, 203 bp, Zea mays; identical to SEQ ID NO: 3914

SEQ ID NO: 3947 - DNA, 181 bp, Zea mays; identical to SEQ ID NO: 3915

SEQ ID NO: 3948 - DNA, 180 bp, Zea mays; identical to SEQ ID NO: 3916

SEQ ID NO: 3949 - DNA, 168 bp, Medicago truncatula; identical to SEQ ID NO: 3913

SEQ ID NO: 3950 - DNA, 203 bp, Zea mays; identical to SEQ ID NO: 3914

SEQ ID NO: 3951 - DNA, 181 bp, Zea mays; identical to SEQ ID NO: 3915

SEQ ID NO: 3952 - DNA, 180 bp, Zea mays; identical to SEQ ID NO: 3916

SEQ ID NO: 3953 - DNA, 21 bp, Arabidopsis lyrata
gctcaagaaagctgtgggaaa

SEQ ID NO: 3954 - DNA, 20 bp, Citrus sinensis
ttcaagaaatctgtgggaag

SEQ ID NO: 3955 - DNA, 24 bp, Glycine max
aagaaagctgtgggagaatatggc

SEQ ID NO: 3956 - DNA, 21 bp, Oryza sativa
gttcaagaaagcccatggaaa

SEQ ID NO: 3957 - DNA, 24 bp, Oryza sativa
atggttcaagaaagcccatggaaa

SEQ ID NO: 3958 - DNA, 21 bp, Oryza sativa
gttcaagaaagtccttggaaa

SEQ ID NO: 3959 - DNA, 24 bp, Oryza sativa
atagttcaagaaagtccttggaaa

SEQ ID NO: 3960 - DNA, 21 bp, Zea mays
gttcaataaagctgtgggaaa

SEQ ID NO: 3961 - DNA, 21 bp, Zea mays
gttcaataaagctgtgggaaa

SEQ ID NO: 3962 - DNA, 21 bp, Zea mays
ggtcaagaaagccgtgggaag

SEQ ID NO: 3963 - DNA, 21 bp, Zea mays
ggtcaagaaagctgtgggaag

SEQ ID NO: 3964 - DNA, 21 bp, Zea mays
gttcaagaaagctgtggaaga

SEQ ID NO: 3965 - DNA, 21 bp, Arabidopsis lyrata
gttcaataaagctgtgggaag

SEQ ID NO: 3966 - DNA, 20 bp, Citrus sinensis
ttcaagaaatctgtgggaag

SEQ ID NO: 3967 - DNA, 24 bp, Glycine max
aagaaagctgtgggagaatatggc

SEQ ID NO: 3968 - DNA, 21 bp, Oryza sativa
gttcaagaaagcccatggaaa

SEQ ID NO: 3969 - DNA, 24 bp, Oryza sativa
atggttcaagaaagcccatggaaa

SEQ ID NO: 3970 - DNA, 21 bp, Oryza sativa
gttcaagaaagtccttggaaa

SEQ ID NO: 3971 - DNA, 24 bp, Oryza sativa
atagttcaagaaagtccttggaaa

SEQ ID NO: 3972 - DNA, 21 bp, Zea mays
gttcaataaagctgtgggaaa

SEQ ID NO: 3973 - DNA, 21 bp, Zea mays
gttcaataaagctgtgggaaa

SEQ ID NO: 3974 - DNA, 21 bp, Zea mays
ggtcaagaaagccgtgggaag

SEQ ID NO: 3975 - DNA, 21 bp, Zea mays
ggtcaagaaagctgtgggaag

SEQ ID NO: 3976 - DNA, 21 bp, Zea mays
gttcaagaaagctgtggaaga

SEQ ID NO: 3977 - DNA, 21 bp, Arabidopsis lyrata
cccgccttgcatcaactgaat

SEQ ID NO: 3978 - DNA, 21 bp, Arabidopsis lyrata
taatctgcatcctgaggttta

SEQ ID NO: 3979 - DNA, 21 bp, Arabidopsis lyrata
taatctgcatcctgaggttta

SEQ ID NO: 3980 - DNA, 21 bp, Arabidopsis thaliana
taatctgcatcctgaggttta

SEQ ID NO: 3981 - DNA, 21 bp, Arabidopsis thaliana
taatctgcatcctgaggttta

SEQ ID NO: 3982 - DNA, 21 bp, Brassica napus
taatctgcatcctgaggttta

SEQ ID NO: 3983 - DNA, 21 bp, Brassica rapa
taatctgcatcctgaggttta

SEQ ID NO: 3984 - DNA, 21 bp, Brassica rapa
taatctgcatcctgaggttta

SEQ ID NO: 3985 - DNA, 21 bp, Lotus japonicus
taatctgcatcctgaggttta

SEQ ID NO: 3986 - DNA, 21 bp, Medicago truncatula
taatctgcatcctgaggttta

SEQ ID NO: 3987 - DNA, 21 bp, Medicago truncatula
taatctgcatcctgaggttta

SEQ ID NO: 3988 - DNA, 21 bp, Medicago truncatula
taatctgcatcctgaggttta

SEQ ID NO: 3989 - DNA, 21 bp, Medicago truncatula
taatctgcatcctgaggttta

SEQ ID NO: 3990 - DNA, 21 bp, Medicago truncatula
taatctgcatcctgaggttta

SEQ ID NO: 3991 - DNA, 21 bp, Medicago truncatula
taatctgcatcctgaggttta

SEQ ID NO: 3992 - DNA, 21 bp, Medicago truncatula
taatctgcatcctgaggttta

SEQ ID NO: 3993 - DNA, 21 bp, Medicago truncatula
taatctgcatcctgaggttta

SEQ ID NO: 3994 - DNA, 21 bp, Medicago truncatula
taatctgcatcctgaggttta

SEQ ID NO: 3995 - DNA, 21 bp, Medicago truncatula
taatctgcatcctgaggttta

SEQ ID NO: 3996 - DNA, 21 bp, Medicago truncatula
taatctgcatcctgaggttta

SEQ ID NO: 3997 - DNA, 21 bp, Medicago truncatula
taatctgcatcctgaggttta

SEQ ID NO: 3998 - DNA, 21 bp, Medicago truncatula
taatctgcatcctgaggttta

SEQ ID NO: 3999 - DNA, 21 bp, Medicago truncatula
taatctgcatcctgaggttta

SEQ ID NO: 4000 - DNA, 21 bp, Medicago truncatula
taatctgcatcctgaggttta

SEQ ID NO: 4001 - DNA, 21 bp, Medicago truncatula
taatctgcatcctgaggttta

SEQ ID NO: 4002 - DNA, 21 bp, Medicago truncatula
taatctgcatcctgaggttta

SEQ ID NO: 4003 - DNA, 21 bp, Medicago truncatula
taatctgcatcctgaggttta

SEQ ID NO: 4004 - DNA, 21 bp, Theobroma cacao
taatctgcatcctgaggttta

SEQ ID NO: 4005 - DNA, 21 bp, Vitis vinifera
taatctgcatcctgaggtcta

SEQ ID NO: 4006 - DNA, 21 bp, Arabidopsis lyrata
ggaggcagcggttcatcgatc

SEQ ID NO: 4007 - DNA, 21 bp, Arabidopsis lyrata
ggaggcagcggttcatcgatc

SEQ ID NO: 4008 - DNA, 21 bp, Zea mays
gggcgcagtggtttatcgatc

SEQ ID NO: 4009 - DNA, 21 bp, Arabidopsis lyrata
gctcaagaaagctgtgggaaa

SEQ ID NO: 4010 - DNA, 21 bp, Zea mays
gttcaataaagctgtgggaaa

SEQ ID NO: 4011 - DNA, 21 bp, Zea mays
gttcaataaagctgtgggaaa

SEQ ID NO: 4012 - DNA, 21 bp, Zea mays
ggtcaagaaagctgtgggaag

SEQ ID NO: 4013 - DNA, 21 bp, Zea mays
gttcaagaaagctgtggaaga

SEQ ID NO: 4014 - DNA, 22 bp, Aquilegia coerulea
tcttgccgactcctcccatacc

SEQ ID NO: 4015 - DNA, 22 bp, Aquilegia coerulea
tcttgccgactcctcccatacc

SEQ ID NO: 4016 - DNA, 22 bp, Aquilegia coerulea
tcttgccgactcctcccatacc

SEQ ID NO: 4017 - DNA, 22 bp, Citrus sinensis
tcttccctatgcctcccattcc

SEQ ID NO: 4018 - DNA, 22 bp, Citrus sinensis
tcttgcccacccctcccattcc

SEQ ID NO: 4019 - DNA, 22 bp, Citrus sinensis
ttccctagtccccctattccta

SEQ ID NO: 4020 - DNA, 22 bp, Gossypium hirsutum
tctttcctactcctcccatacc

SEQ ID NO: 4021 - DNA, 22 bp, Gossypium hirsutum
tcttgcctactccacccatgcc

SEQ ID NO: 4022 - DNA, 24 bp, Glycine max
tcttcccaattccgcccattccta

SEQ ID NO: 4023 - DNA, 22 bp, Gossypium raimondii
tctttccaattcctcccattcc

SEQ ID NO: 4024 - DNA, 21 bp, Glycine soja
tcttccctacacctcccatac

SEQ ID NO: 4025 - DNA, 21 bp, Glycine soja
tcttccctacacctcccatac

SEQ ID NO: 4026 - DNA, 22 bp, Malus domestica
tcttcccaagcccgcccattcc

SEQ ID NO: 4027 - DNA, 22 bp, Malus x domestica
tcttcccaagcccgcccattcc

SEQ ID NO: 4028 - DNA, 22 bp, Picea abies
tcttccctactcctcccattcc

SEQ ID NO: 4029 - DNA, 22 bp, Picea abies
tcttccctattcctcccattcc

SEQ ID NO: 4030 - DNA, 22 bp, Picea abies
tctttcctactcctcccattcc

SEQ ID NO: 4031 - DNA, 22 bp, Pinus taeda
tcttccctactcctcccattcc

SEQ ID NO: 4032 - DNA, 22 bp, Pinus taeda
tcttccctactcctcccattcc

SEQ ID NO: 4033 - DNA, 20 bp, Pinus taeda
tcttccctattcctcccatt

SEQ ID NO: 4034 - DNA, 20 bp, Pinus taeda
tcctccctactcctcccatt

SEQ ID NO: 4035 - DNA, 20 bp, Populus trichocarpa
tcttgcctactcctcccatt

SEQ ID NO: 4036 - DNA, 22 bp, Phaseolus vulgaris
tcttcccaattccgcccattcc

SEQ ID NO: 4037 - DNA, 22 bp, Solanum lycopersicum
tttccaattccacccattccta

SEQ ID NO: 4038 - DNA, 22 bp, Vitis vinifera
tctttcctactcctcccattcc

SEQ ID NO: 4039 - DNA, 20 bp, Zea mays
tcttccttgttcctcccatt

SEQ ID NO: 4040 - DNA, 22 bp, Phaseolus vulgaris
ggaatgggctgattgggaagca

SEQ ID NO: 4041 - DNA, 21 bp, Arabidopsis lyrata
ggcaagttgtccttggctaca

SEQ ID NO: 4042 - DNA, 22 bp, Arabidopsis lyrata
ggcaagttgtccttcggctaca

SEQ ID NO: 4043 - DNA, 21 bp, Arabidopsis lyrata
ggcaagtcatctctggctatg

SEQ ID NO: 4044 - DNA, 21 bp, Arabidopsis lyrata
gcaagttgaccttggctctgt

SEQ ID NO: 4045 - DNA, 21 bp, Arabidopsis lyrata
gcaagttgaccttggctctgt

SEQ ID NO: 4046 - DNA, 21 bp, Arabidopsis lyrata
gcaagttgaccttggctctgc

SEQ ID NO: 4047 - DNA, 21 bp, Arabidopsis lyrata
gcaagttgaccttggctctgt

SEQ ID NO: 4048 - DNA, 21 bp, Arabidopsis lyrata
tagccaaggatgacttgcctg

SEQ ID NO: 4049 - DNA, 19 bp, Arabidopsis lyrata
ggcagtctccttggctatt

SEQ ID NO: 4050 - DNA, 21 bp, Arabidopsis lyrata
tagccaaggatgacttgcctg

SEQ ID NO: 4051 - DNA, 19 bp, Arabidopsis lyrata
ggcagtctccttggatatc

SEQ ID NO: 4052 - DNA, 21 bp, Arabidopsis lyrata
tagccaaggatgacttgcctg

SEQ ID NO: 4053 - DNA, 19 bp, Arabidopsis lyrata
ggcagtctccttggctatc

SEQ ID NO: 4054 - DNA, 21 bp, Arabidopsis lyrata
tagccaaggatgacttgcctg

SEQ ID NO: 4055 - DNA, 19 bp, Arabidopsis lyrata
ggcagtctccttggctatc

SEQ ID NO: 4056 - DNA, 21 bp, Arabidopsis lyrata
tagccaaggatgacttgcctg

SEQ ID NO: 4057 - DNA, 19 bp, Arabidopsis lyrata
ggcagtctccttggctatc

SEQ ID NO: 4058 - DNA, 21 bp, Arabidopsis lyrata
tagccaaggatgacttgcctg

SEQ ID NO: 4059 - DNA, 19 bp, Arabidopsis lyrata
ggcagtcttcttggctatc

SEQ ID NO: 4060 - DNA, 21 bp, Arabidopsis lyrata
tagccaaagatgacttgcctg

SEQ ID NO: 4061 - DNA, 19 bp, Arabidopsis lyrata
ggcagtctctttggctatc

SEQ ID NO: 4062 - DNA, 21 bp, Aquilegia coerulea
tagccaaggatgacttgccta

SEQ ID NO: 4063 - DNA, 21 bp, Aquilegia coerulea
tagccaaggatgacttgcctg

SEQ ID NO: 4064 - DNA, 21 bp, Arabidopsis thaliana
tccggcaagttgaccttggct

SEQ ID NO: 4065 - DNA, 21 bp, Arabidopsis thaliana
tagccaaggatgacttgcctg

SEQ ID NO: 4066 - DNA, 21 bp, Arabidopsis thaliana
tagccaaggatgacttgcctg

SEQ ID NO: 4067 - DNA, 21 bp, Arabidopsis thaliana
tagccaaggatgacttgcctg

SEQ ID NO: 4068 - DNA, 21 bp, Arabidopsis thaliana
tagccaaggatgacttgcctg

SEQ ID NO: 4069 - DNA, 21 bp, Arabidopsis thaliana
tagccaaggatgacttgcctg

SEQ ID NO: 4070 - DNA, 21 bp, Arabidopsis thaliana
tagccaaggatgacttgcctg

SEQ ID NO: 4071 - DNA, 21 bp, Arabidopsis thaliana
tagccaaggatgacttgcctg

SEQ ID NO: 4072 - DNA, 21 bp, Brachypodium distachyon
tagccaaggatgacttgccgg

SEQ ID NO: 4073 - DNA, 21 bp, Brachypodium distachyon
tagccaagaatgacttgccta

SEQ ID NO: 4074 - DNA, 21 bp, Brachypodium distachyon
tagccaaggatgacttgcctg

SEQ ID NO: 4075 - DNA, 21 bp, Brachypodium distachyon
tagccaaggatgacttgcctg

SEQ ID NO: 4076 - DNA, 21 bp, Brachypodium distachyon
tagccaaggatgacttgccta

SEQ ID NO: 4077 - DNA, 22 bp, Brachypodium distachyon
ccagccaagaatggcttgccta

SEQ ID NO: 4078 - DNA, 21 bp, Brachypodium distachyon
tagccaggaatggcttgccta

SEQ ID NO: 4079 - DNA, 22 bp, Brachypodium distachyon
tagccaaggatgatttgcctgt

SEQ ID NO: 4080 - DNA, 21 bp, Brassica napus
tagccaaggatgacttgccta

SEQ ID NO: 4081 - DNA, 21 bp, Brassica napus
tagccaaggatgacttgccta

SEQ ID NO: 4082 - DNA, 21 bp, Brassica napus
tagccaaggatgacttgccta

SEQ ID NO: 4083 - DNA, 21 bp, Brassica napus
tagccaaggatgacttgccta

SEQ ID NO: 4084 - DNA, 22 bp, Brassica napus
tagccaaggatgacttgcctgc

SEQ ID NO: 4085 - DNA, 22 bp, Brassica napus
tagccaaggatgacttgcctgc

SEQ ID NO: 4086 - DNA, 22 bp, Brassica napus
tagccaaggatgacttgcctgc

SEQ ID NO: 4087 - DNA, 22 bp, Brassica napus
tagccaaggatgacttgcctgc

SEQ ID NO: 4088 - DNA, 22 bp, Brassica napus
tagccaaggatgacttgcctgc

SEQ ID NO: 4089 - DNA, 22 bp, Brassica napus
tagccaaggatgacttgcctgc

SEQ ID NO: 4090 - DNA, 21 bp, Festuca arundinacea
tagccaaggatgacttgccta

SEQ ID NO: 4091 - DNA, 21 bp, Gossypium herbacium
tagccaaggatgacttgcctg

SEQ ID NO: 4092 - DNA, 21 bp, Gossypium hirsutum
acgccaaggatgtcttgcgtc

SEQ ID NO: 4093 - DNA, 21 bp, Medicago truncatula
aagccaaggatgacttgccta

SEQ ID NO: 4094 - DNA, 21 bp, Oryza sativa
tagccaaggatgacttgccgg

SEQ ID NO: 4095 - DNA, 21 bp, Oryza sativa
tagccaaggatgacttgccta

SEQ ID NO: 4096 - DNA, 21 bp, Oryza sativa
tagccaaggatgacttgccta

SEQ ID NO: 4097 - DNA, 21 bp, Oryza sativa
tagccaaggatgacttgcctg

SEQ ID NO: 4098 - DNA, 21 bp, Oryza sativa
tagccaaggatgacttgcctg

SEQ ID NO: 4099 - DNA, 21 bp, Oryza sativa
tagccaaggatgacttgcctg

SEQ ID NO: 4100 - DNA, 21 bp, Oryza sativa
tagccaaggatgacttgcctg

SEQ ID NO: 4101 - DNA, 21 bp, Oryza sativa
tagccaaggatgacttgcctg

SEQ ID NO: 4102 - DNA, 21 bp, Oryza sativa
tagccaaggatgacttgcctg

SEQ ID NO: 4103 - DNA, 21 bp, Oryza sativa
tagccaagaatgacttgccta

SEQ ID NO: 4104 - DNA, 21 bp, Oryza sativa
tagccaagaatgacttgccta

SEQ ID NO: 4105 - DNA, 21 bp, Populus trichocarpa
tagccaaggacgacttgccca

SEQ ID NO: 4106 - DNA, 21 bp, Populus trichocarpa
tagccaaggacgacttgccca

SEQ ID NO: 4107 - DNA, 21 bp, Populus trichocarpa
tagccaaggacgacttgccca

SEQ ID NO: 4108 - DNA, 21 bp, Populus trichocarpa
tagccaaggacgacttgccca

SEQ ID NO: 4109 - DNA, 21 bp, Populus trichocarpa
tagccaaggacgacttgccca

SEQ ID NO: 4110 - DNA, 21 bp, Populus trichocarpa
tagccaaggatgacttgcctg

SEQ ID NO: 4111 - DNA, 21 bp, Populus trichocarpa
tagccaaggatgacttgcctg

SEQ ID NO: 4112 - DNA, 21 bp, Populus trichocarpa
tagccaaggatgacttgcctg

SEQ ID NO: 4113 - DNA, 21 bp, Populus trichocarpa
tagccaaggatgacttgcctg

SEQ ID NO: 4114 - DNA, 21 bp, Populus trichocarpa
tagccaaggatgacttgcctg

SEQ ID NO: 4115 - DNA, 21 bp, Populus trichocarpa
aagccaaggatgacttgcctg

SEQ ID NO: 4116 - DNA, 21 bp, Populus trichocarpa
aagccaaggatgacttgcctg

SEQ ID NO: 4117 - DNA, 21 bp, Populus trichocarpa
tagccaaggacgacttgcctg

SEQ ID NO: 4118 - DNA, 21 bp, Populus trichocarpa
tagccaaggatgacttgccta

SEQ ID NO: 4119 - DNA, 21 bp, Populus trichocarpa
tcagccaaggatgacttgccg

SEQ ID NO: 4120 - DNA, 21 bp, Populus trichocarpa
tagccaaggacgacttgccta

SEQ ID NO: 4121 - DNA, 21 bp, Populus trichocarpa
tagccaaggatgacttgccca

SEQ ID NO: 4122 - DNA, 21 bp, Populus trichocarpa
tagccaaggatgacttgccca

SEQ ID NO: 4123 - DNA, 21 bp, Sorghum bicolor
tagccaaggatgacttgccta

SEQ ID NO: 4124 - DNA, 21 bp, Sorghum bicolor
tagccaaggatgacttgccta

SEQ ID NO: 4125 - DNA, 21 bp, Sorghum bicolor
tagccaaggatgacttgccgg

SEQ ID NO: 4126 - DNA, 21 bp, Sorghum bicolor
tagccaaggatgacttgcctg

SEQ ID NO: 4127 - DNA, 21 bp, Sorghum bicolor
tagccaaggatgacttgcctg

SEQ ID NO: 4128 - DNA, 21 bp, Sorghum bicolor
tagccaaggatgacttgccta

SEQ ID NO: 4129 - DNA, 21 bp, Sorghum bicolor
tagccaagaatgacttgccta

SEQ ID NO: 4130 - DNA, 21 bp, Sorghum bicolor
tagccaaggatgacttgccgg

SEQ ID NO: 4131 - DNA, 21 bp, Sorghum bicolor
tagccaaggatgacttgcctg

SEQ ID NO: 4132 - DNA, 21 bp, Sorghum bicolor
tagccaaggatgacttgccta

SEQ ID NO: 4133 - DNA, 21 bp, Sorghum bicolor
tagccaaggatgacttgccta

SEQ ID NO: 4134 - DNA, 21 bp, Sorghum bicolor
tagccaaggatgatttgcctg

SEQ ID NO: 4135 - DNA, 21 bp, Sorghum bicolor
tagccaagaatggcttgccta

SEQ ID NO: 4136 - DNA, 21 bp, Sorghum bicolor
tagccaagaatggcttgccta

SEQ ID NO: 4137 - DNA, 21 bp, Solanum lycopersicum
tagccaaggatgacttgcctg

SEQ ID NO: 4138 - DNA, 21 bp, Solanum lycopersicum
tagccaaggatgacttgccta

SEQ ID NO: 4139 - DNA, 21 bp, Saccharum officinarum
tagccaaggatgacttgccgg

SEQ ID NO: 4140 - DNA, 21 bp, Saccharum spp
tagccaaggatgacttgccgg

SEQ ID NO: 4141 - DNA, 21 bp, Theobroma cacao
tagccaaggatgacttgccta

SEQ ID NO: 4142 - DNA, 21 bp, Theobroma cacao
aagccaagaatgacttgcctg

SEQ ID NO: 4143 - DNA, 21 bp, Theobroma cacao
tagccagggatgacttgccta

SEQ ID NO: 4144 - DNA, 21 bp, Theobroma cacao
tagccaaggatgacttgcctg

SEQ ID NO: 4145 - DNA, 21 bp, Theobroma cacao
tagccaaggatgagttgcctg

SEQ ID NO: 4146 - DNA, 21 bp, Theobroma cacao
tagccaaggatgacttgcctg

SEQ ID NO: 4147 - DNA, 22 bp, Vitis vinifera
tagccaaggatgacttgcctgc

SEQ ID NO: 4148 - DNA, 21 bp, Vitis vinifera
tagccaaggatgacttgccta

SEQ ID NO: 4149 - DNA, 21 bp, Vitis vinifera
tagcgaaggatgacttgccta

SEQ ID NO: 4150 - DNA, 21 bp, Zea mays
ggcaagttgttcttggctaca

SEQ ID NO: 4151 - DNA, 21 bp, Zea mays
ggcaagttgttcttggctaca

SEQ ID NO: 4152 - DNA, 22 bp, Zea mays
ggcaagtctgtccttggctaca

SEQ ID NO: 4153 - DNA, 21 bp, Zea mays
tagccaaggatgacttgccta

SEQ ID NO: 4154 - DNA, 21 bp, Zea mays
ggcatgtcttccttggctact

SEQ ID NO: 4155 - DNA, 21 bp, Zea mays
tagccaaggatgacttgccta

SEQ ID NO: 4156 - DNA, 21 bp, Zea mays
tagccaaggatgacttgccta

SEQ ID NO: 4157 - DNA, 21 bp, Zea mays
tagccaaggatgacttgcctg

SEQ ID NO: 4158 - DNA, 18 bp, Zea mays
ggcagtctccttggctag

SEQ ID NO: 4159 - DNA, 21 bp, Zea mays
tagccaaggatgacttgcctg

SEQ ID NO: 4160 - DNA, 18 bp, Zea mays
ggcagtctccttggctag

SEQ ID NO: 4161 - DNA, 21 bp, Zea mays
tagccaaggatgacttgcctg

SEQ ID NO: 4162 - DNA, 18 bp, Zea mays
ggcagtctccttggctag

SEQ ID NO: 4163 - DNA, 21 bp, Zea mays
tagccaagaatggcttgccta

SEQ ID NO: 4164 - DNA, 21 bp, Zea mays
tagccaagaatggcttgccta

SEQ ID NO: 4165 - DNA, 20 bp, Zea mays
ggcaggccttcttggctaag

SEQ ID NO: 4166 - DNA, 21 bp, Zea mays
tagccaagaatgacttgccta

SEQ ID NO: 4167 - DNA, 20 bp, Zea mays
ggcaggtcttcttggctagc

SEQ ID NO: 4168 - DNA, 21 bp, Zea mays
tagccaaggatgacttgccgg

SEQ ID NO: 4169 - DNA, 21 bp, Zea mays
ggcaagtcatctggggctacg

SEQ ID NO: 4170 - DNA, 21 bp, Zea mays
tagccaagaatggcttgccta

SEQ ID NO: 4171 - DNA, 21 bp, Zea mays
ggcaagttgtccttggctaca

SEQ ID NO: 4172 - DNA, 21 bp, Physcomitrella patens
gagctggccaggctgtgaggg

SEQ ID NO: 4173 - DNA, 21 bp, Arabidopsis lyrata
taatctgcatcctgaggttta

SEQ ID NO: 4174 - DNA, 21 bp, Arabidopsis lyrata
taatctgcatcctgaggttta

SEQ ID NO: 4175 - DNA, 21 bp, Arabidopsis thaliana
taatctgcatcctgaggttta

SEQ ID NO: 4176 - DNA, 21 bp, Arabidopsis thaliana
taatctgcatcctgaggttta

SEQ ID NO: 4177 - DNA, 21 bp, Brassica napus
taatctgcatcctgaggttta

SEQ ID NO: 4178 - DNA, 21 bp, Brassica napus
taatctgcatcctgaggttta

SEQ ID NO: 4179 - DNA, 21 bp, Brassica rapa
taatctgcatcctgaggttta

SEQ ID NO: 4180 - DNA, 21 bp, Brassica rapa
taatctgcatcctgaggttta

SEQ ID NO: 4181 - DNA, 21 bp, Lotus japonicus
taatctgcatcctgaggttta

SEQ ID NO: 4182 - DNA, 21 bp, Medicago truncatula
taatctgcatcctgaggttta

SEQ ID NO: 4183 - DNA, 21 bp, Medicago truncatula
taatctgcatcctgaggttta

SEQ ID NO: 4184 - DNA, 21 bp, Medicago truncatula
taatctgcatcctgaggttta

SEQ ID NO: 4185 - DNA, 21 bp, Medicago truncatula
taatctgcatcctgaggttta

SEQ ID NO: 4186 - DNA, 21 bp, Medicago truncatula
taatctgcatcctgaggttta

SEQ ID NO: 4187 - DNA, 21 bp, Medicago truncatula
taatctgcatcctgaggttta

SEQ ID NO: 4188 - DNA, 21 bp, Medicago truncatula
taatctgcatcctgaggttta

SEQ ID NO: 4189 - DNA, 21 bp, Medicago truncatula
taatctgcatcctgaggttta

SEQ ID NO: 4190 - DNA, 21 bp, Medicago truncatula
taatctgcatcctgaggttta

SEQ ID NO: 4191 - DNA, 21 bp, Medicago truncatula
taatctgcatcctgaggttta

SEQ ID NO: 4192 - DNA, 21 bp, Medicago truncatula
taatctgcatcctgaggttta

SEQ ID NO: 4193 - DNA, 21 bp, Medicago truncatula
taatctgcatcctgaggttta

SEQ ID NO: 4194 - DNA, 21 bp, Medicago truncatula
taatctgcatcctgaggttta

SEQ ID NO: 4195 - DNA, 21 bp, Medicago truncatula
taatctgcatcctgaggttta

SEQ ID NO: 4196 - DNA, 21 bp, Medicago truncatula
taatctgcatcctgaggttta

SEQ ID NO: 4197 - DNA, 21 bp, Medicago truncatula
taatctgcatcctgaggttta

SEQ ID NO: 4198 - DNA, 21 bp, Medicago truncatula
taatctgcatcctgaggttta

SEQ ID NO: 4199 - DNA, 21 bp, Medicago truncatula
taatctgcatcctgaggttta

SEQ ID NO: 4200 - DNA, 21 bp, Theobroma cacao
taatctgcatcctgaggttta

SEQ ID NO: 4201 - DNA, 21 bp, Vitis vinifera
taatctgcatcctgaggtcta

SEQ ID NO: 4202 - DNA, 21 bp, Arabidopsis lyrata
taatctgcatcctgaggttta

SEQ ID NO: 4203 - DNA, 21 bp, Arabidopsis lyrata
taatctgcatcctgaggttta

SEQ ID NO: 4204 - DNA, 21 bp, Arabidopsis thaliana
taatctgcatcctgaggttta

SEQ ID NO: 4205 - DNA, 21 bp, Arabidopsis thaliana
taatctgcatcctgaggttta

SEQ ID NO: 4206 - DNA, 21 bp, Brassica napus
taatctgcatcctgaggttta

SEQ ID NO: 4207 - DNA, 21 bp, Brassica napus
taatctgcatcctgaggttta

SEQ ID NO: 4208 - DNA, 21 bp, Brassica rapa
taatctgcatcctgaggttta

SEQ ID NO: 4209 - DNA, 21 bp, Brassica rapa
taatctgcatcctgaggttta

SEQ ID NO: 4210 - DNA, 21 bp, Lotus japonicus
taatctgcatcctgaggttta

SEQ ID NO: 4211 - DNA, 21 bp, Medicago truncatula
taatctgcatcctgaggttta

SEQ ID NO: 4212 - DNA, 21 bp, Medicago truncatula
taatctgcatcctgaggttta

SEQ ID NO: 4213 - DNA, 21 bp, Medicago truncatula
taatctgcatcctgaggttta

SEQ ID NO: 4214 - DNA, 21 bp, Medicago truncatula
taatctgcatcctgaggttta

SEQ ID NO: 4215 - DNA, 21 bp, Medicago truncatula
taatctgcatcctgaggttta

SEQ ID NO: 4216 - DNA, 21 bp, Medicago truncatula
taatctgcatcctgaggttta

SEQ ID NO: 4217 - DNA, 21 bp, Medicago truncatula
taatctgcatcctgaggttta

SEQ ID NO: 4218 - DNA, 21 bp, Medicago truncatula
taatctgcatcctgaggttta

SEQ ID NO: 4219 - DNA, 21 bp, Medicago truncatula
taatctgcatcctgaggttta

SEQ ID NO: 4220 - DNA, 21 bp, Medicago truncatula
taatctgcatcctgaggttta

SEQ ID NO: 4221 - DNA, 21 bp, Medicago truncatula
taatctgcatcctgaggttta

SEQ ID NO: 4222 - DNA, 21 bp, Medicago truncatula
taatctgcatcctgaggttta

SEQ ID NO: 4223 - DNA, 21 bp, Medicago truncatula
taatctgcatcctgaggttta

SEQ ID NO: 4224 - DNA, 21 bp, Medicago truncatula
taatctgcatcctgaggttta

SEQ ID NO: 4225 - DNA, 21 bp, Medicago truncatula
taatctgcatcctgaggttta

SEQ ID NO: 4226 - DNA, 21 bp, Medicago truncatula
taatctgcatcctgaggttta

SEQ ID NO: 4227 - DNA, 21 bp, Medicago truncatula
taatctgcatcctgaggttta

SEQ ID NO: 4228 - DNA, 21 bp, Medicago truncatula
taatctgcatcctgaggttta

SEQ ID NO: 4229 - DNA, 21 bp, Theobroma cacao
taatctgcatcctgaggttta

SEQ ID NO: 4230 - DNA, 21 bp, Arabidopsis lyrata
gttcaataaagctgtgggaag

SEQ ID NO: 4231 - DNA, 21 bp, Arabidopsis lyrata
gctcaagaaagctgtgggaaa

SEQ ID NO: 4232 - DNA, 20 bp, Citrus sinensis
ttcaagaaatctgtgggaag

SEQ ID NO: 4233 - DNA, 24 bp, Glycine max
aagaaagctgtgggagaatatggc

SEQ ID NO: 4234 - DNA, 21 bp, Oryza sativa
gttcaagaaagcccatggaaa

SEQ ID NO: 4235 - DNA, 24 bp, Oryza sativa
atggttcaagaaagcccatggaaa

SEQ ID NO: 4236 - DNA, 21 bp, Oryza sativa
gttcaagaaagtccttggaaa

SEQ ID NO: 4237 - DNA, 24 bp, Oryza sativa
atagttcaagaaagtccttggaaa

SEQ ID NO: 4238 - DNA, 21 bp, Zea mays
gttcaataaagctgtgggaaa

SEQ ID NO: 4239 - DNA, 21 bp, Zea mays
ggtcaagaaagccgtgggaag

SEQ ID NO: 4240 - DNA, 21 bp, Zea mays
ggtcaagaaagctgtgggaag

SEQ ID NO: 4241 - DNA, 21 bp, Zea mays
gttcaagaaagctgtggaaga

SEQ ID NO: 4242 - DNA, 21 bp, Arabidopsis lyrata
tgattgagccgcgccaatatc

SEQ ID NO: 4243 - DNA, 21 bp, Arabidopsis lyrata
ttgagccgtgccaatatcacg

SEQ ID NO: 4244 - DNA, 21 bp, Arabidopsis lyrata
ttgagccgtgccaatatcacg

SEQ ID NO: 4245 - DNA, 21 bp, Aquilegia coerulea
tgattgagccgtgccaatatc

SEQ ID NO: 4246 - DNA, 21 bp, Aquilegia coerulea
tgattgagccgtgccaatatc

SEQ ID NO: 4247 - DNA, 21 bp, Aquilegia coerulea
taattgaaccgcactaatatc

SEQ ID NO: 4248 - DNA, 21 bp, Aquilegia coerulea
tgattgagccgtgccaatatc

SEQ ID NO: 4249 - DNA, 21 bp, Aquilegia coerulea
tgaatgaaccgagccaacatc

SEQ ID NO: 4250 - DNA, 21 bp, Aquilegia coerulea
taattgagccgtgccaatatc

SEQ ID NO: 4251 - DNA, 21 bp, Arabidopsis thaliana
tgattgagccgcgccaatatc

SEQ ID NO: 4252 - DNA, 21 bp, Arabidopsis thaliana
ttgagccgtgccaatatcacg

SEQ ID NO: 4253 - DNA, 21 bp, Arabidopsis thaliana
ttgagccgtgccaatatcacg

SEQ ID NO: 4254 - DNA, 21 bp, Brachypodium distachyon
tgattgagccgcgccaatatc

SEQ ID NO: 4255 - DNA, 21 bp, Brachypodium distachyon
tgattgagccgtgccaatatc

SEQ ID NO: 4256 - DNA, 21 bp, Brachypodium distachyon
tgattgagccgtgccaatatc

SEQ ID NO: 4257 - DNA, 21 bp, Brachypodium distachyon
tgattgagccgtgccaatatc

SEQ ID NO: 4258 - DNA, 21 bp, Brassica napus
ttgagccgtgccaatatcacg

SEQ ID NO: 4259 - DNA, 21 bp, Brassica napus
ttgagccgtgccaatatcacg

SEQ ID NO: 4260 - DNA, 21 bp, Brassica napus
ttgagccgtgccaatatcacg

SEQ ID NO: 4261 - DNA, 21 bp, Brassica napus
ttgagccgtgccaatatcacg

SEQ ID NO: 4262 - DNA, 21 bp, Brassica napus
ttgagccgtgccaatatcacg

SEQ ID NO: 4263 - DNA, 21 bp, Brassica napus
tgattgagccgcgccaatatc

SEQ ID NO: 4264 - DNA, 22 bp, Brassica napus
tgattgagccgcgccaatatct

SEQ ID NO: 4265 - DNA, 21 bp, Brassica oleracea
ttgagccgtgccaatatcacg

SEQ ID NO: 4266 - DNA, 21 bp, Brassica rapa
ttgagccgtgccaatatcacg

SEQ ID NO: 4267 - DNA, 21 bp, Brassica rapa
ttgagccgtgccaatatcacg

SEQ ID NO: 4268 - DNA, 21 bp, Brassica rapa
ttgagccgtgccaatatcacg

SEQ ID NO: 4269 - DNA, 21 bp, Brassica rapa
ttgagccgtgccaatatcacg

SEQ ID NO: 4270 - DNA, 21 bp, Brassica rapa
tgattgagccgcgccaatatc

SEQ ID NO: 4271 - DNA, 21 bp, Citrus clementine
tgattgagccgcgccaatatc

SEQ ID NO: 4272 - DNA, 21 bp, Citrus reticulata
tgattgagccgtgccaatatc

SEQ ID NO: 4273 - DNA, 20 bp, Citrus sinensis
ttgagccgcgccaatatcac

SEQ ID NO: 4274 - DNA, 21 bp, Citrus sinensis
cgagccgaatcaatatcactc

SEQ ID NO: 4275 - DNA, 21 bp, Citrus trifoliata
ttgagccgcgtcaatatctcc

SEQ ID NO: 4276 - DNA, 21 bp, Festuca arundinacea
tgattgagccgtgccaatatc

SEQ ID NO: 4277 - DNA, 21 bp, Glycine max
tgagccgtgccaatatcacga

SEQ ID NO: 4278 - DNA, 21 bp, Glycine max
cgagccgaatcaatatcactc

SEQ ID NO: 4279 - DNA, 21 bp, Hordeum vulgare
tgattgagccgtgccaatatc

SEQ ID NO: 4280 - DNA, 21 bp, Medicago truncatula
tgattgagtcgtgccaatatc

SEQ ID NO: 4281 - DNA, 21 bp, Medicago truncatula
tgattgagccgcgtcaatatc

SEQ ID NO: 4282 - DNA, 21 bp, Medicago truncatula
tgattgagccgtgccaatatt

SEQ ID NO: 4283 - DNA, 21 bp, Medicago truncatula
tgattgagccgtgccaatatc

SEQ ID NO: 4284 - DNA, 21 bp, Medicago truncatula
agattgagccgcgccaatatc

SEQ ID NO: 4285 - DNA, 21 bp, Medicago truncatula
ttgagccgtgccaatatcacg

SEQ ID NO: 4286 - DNA, 21 bp, Medicago truncatula
tgattgagccgtgccaatatc

SEQ ID NO: 4287 - DNA, 21 bp, Oryza sativa
tgattgagccgcgccaatatc

SEQ ID NO: 4288 - DNA, 21 bp, Oryza sativa
tgattgagccgtgccaatatc

SEQ ID NO: 4289 - DNA, 21 bp, Oryza sativa
tgattgagccgtgccaatatc

SEQ ID NO: 4290 - DNA, 21 bp, Oryza sativa
tgattgagccgtgccaatatc

SEQ ID NO: 4291 - DNA, 21 bp, Oryza sativa
tgattgagccgtgccaatatc

SEQ ID NO: 4292 - DNA, 21 bp, Oryza sativa
tgattgagccgtgccaatatc

SEQ ID NO: 4293 - DNA, 21 bp, Oryza sativa
gaggtgagccgagccaatatc

SEQ ID NO: 4294 - DNA, 21 bp, Oryza sativa
gtgagccgaaccaatatcact

SEQ ID NO: 4295 - DNA, 21 bp, Oryza sativa
ggattgagccgcgtcaatatc

SEQ ID NO: 4296 - DNA, 21 bp, Physcomitrella patens
tgagccgcgccaatatcacat

SEQ ID NO: 4297 - DNA, 21 bp, Physcomitrella patens
ttgagccgcgccaatatcaca

SEQ ID NO: 4298 - DNA, 21 bp, Pinus taeda
tgattgagacgagtccatatc

SEQ ID NO: 4299 - DNA, 21 bp, Populus trichocarpa
ttgagccgtgccaatatcacg

SEQ ID NO: 4300 - DNA, 21 bp, Populus trichocarpa
ttgagccgtgccaatatcacg

SEQ ID NO: 4301 - DNA, 21 bp, Populus trichocarpa
agattgagccgcgccaatatc

SEQ ID NO: 4302 - DNA, 21 bp, Populus trichocarpa
agattgagccgcgccaatatc

SEQ ID NO: 4303 - DNA, 21 bp, Populus trichocarpa
tgattgagccgtgccaatatc

SEQ ID NO: 4304 - DNA, 21 bp, Populus trichocarpa
tgattgagccgtgccaatatc

SEQ ID NO: 4305 - DNA, 21 bp, Populus trichocarpa
tgattgagccgtgccaatatc

SEQ ID NO: 4306 - DNA, 21 bp, Populus trichocarpa
tgattgagccgtgccaatatc

SEQ ID NO: 4307 - DNA, 21 bp, Populus trichocarpa
tgattgagccgtgccaatatc

SEQ ID NO: 4308 - DNA, 21 bp, Populus trichocarpa
ggattgagccgcgccaatact

SEQ ID NO: 4309 - DNA, 21 bp, Populus trichocarpa
ggattgagccgcgccaatatc

SEQ ID NO: 4310 - DNA, 20 bp, Populus trichocarpa
cgagccgaatcaatatcact

SEQ ID NO: 4311 - DNA, 20 bp, Populus trichocarpa
cgagccgaatcaatatcact

SEQ ID NO: 4312 - DNA, 20 bp, Populus trichocarpa
cgagccgaatcaatatcact

SEQ ID NO: 4313 - DNA, 21 bp, Ricinus communis
ttgagccgtgccaatatcacg

SEQ ID NO: 4314 - DNA, 21 bp, Ricinus communis
ttgagccgtgccaatatcacg

SEQ ID NO: 4315 - DNA, 21 bp, Ricinus communis
tgattgagccgtgccaatatc

SEQ ID NO: 4316 - DNA, 21 bp, Ricinus communis
tgattgagccgtgccaatatc

SEQ ID NO: 4317 - DNA, 21 bp, Ricinus communis
tgattgagccgtgccaatatc

SEQ ID NO: 4318 - DNA, 21 bp, Ricinus communis
tgattgagccgtgccaatatc

SEQ ID NO: 4319 - DNA, 21 bp, Ricinus communis
agattgagccgcgccaatatc

SEQ ID NO: 4320 - DNA, 21 bp, Sorghum bicolor
tgattgagccgtgccaatatc

SEQ ID NO: 4321 - DNA, 21 bp, Sorghum bicolor
tgattgagccgtgccaatatc

SEQ ID NO: 4322 - DNA, 21 bp, Sorghum bicolor
gaggtgagccgagccaatatc

SEQ ID NO: 4323 - DNA, 21 bp, Sorghum bicolor
tgattgagccgtgccaatatc

SEQ ID NO: 4324 - DNA, 21 bp, Sorghum bicolor
gtgagccgaaccaatatcact

SEQ ID NO: 4325 - DNA, 21 bp, Sorghum bicolor
atgagccgaaccaatatcact

SEQ ID NO: 4326 - DNA, 21 bp, Sorghum bicolor
tgattgagccgcgccaatatc

SEQ ID NO: 4327 - DNA, 21 bp, Sorghum bicolor
ggattgagccgcgtcaatatc

SEQ ID NO: 4328 - DNA, 21 bp, Sorghum bicolor
tgattgagccgtgccaatatc

SEQ ID NO: 4329 - DNA, 21 bp, Sorghum bicolor
tgattgagccgcgccaatatc

SEQ ID NO: 4330 - DNA, 21 bp, Sorghum bicolor
tgattgagccgtgccaatatc

SEQ ID NO: 4331 - DNA, 21 bp, Solanum lycopersicum
tgattgagccgtgccaatatc

SEQ ID NO: 4332 - DNA, 21 bp, Solanum lycopersicum
ttgagccgtgccaatatcacg

SEQ ID NO: 4333 - DNA, 20 bp, Solanum lycopersicum
ttgagccgcgccaatatcac

SEQ ID NO: 4334 - DNA, 21 bp, Selaginella moellendorffii
ttgagccgtgccaatatcact

SEQ ID NO: 4335 - DNA, 21 bp, Selaginella moellendorffii
tgagccgtgccaatatcacat

SEQ ID NO: 4336 - DNA, 21 bp, Selaginella moellendorffii
ttgagtcgcgccaatatcatg

SEQ ID NO: 4337 - DNA, 21 bp, Selaginella moellendorffii
tgagccgcgccaatatcacat

SEQ ID NO: 4338 - DNA, 21 bp, Triticum aestivum
tgattgagccgtgccaatatc

SEQ ID NO: 4339 - DNA, 21 bp, Triticum aestivum
ttgagccgtgccaatatcacg

SEQ ID NO: 4340 - DNA, 21 bp, Theobroma cacao
tgattgagccgcgccaatatc

SEQ ID NO: 4341 - DNA, 21 bp, Theobroma cacao
agattgagccgcgccaatatc

SEQ ID NO: 4342 - DNA, 21 bp, Theobroma cacao
agattgagccgcgccaatatc

SEQ ID NO: 4343 - DNA, 21 bp, Theobroma cacao
tgattgagccgtgccaatatc

SEQ ID NO: 4344 - DNA, 21 bp, Theobroma cacao
tgattgagccgtgccaatatc

SEQ ID NO: 4345 - DNA, 21 bp, Theobroma cacao
tgattgagccgtgccaatatc

SEQ ID NO: 4346 - DNA, 21 bp, Theobroma cacao
tgattgagccgtgccaatatc

SEQ ID NO: 4347 - DNA, 21 bp, Theobroma cacao
tgattgagccgtgccaatatc

SEQ ID NO: 4348 - DNA, 21 bp, Vitis vinifera
tgattgagccgtgccaatatc

SEQ ID NO: 4349 - DNA, 21 bp, Vitis vinifera
tgattgagccgcgtcaatatc

SEQ ID NO: 4350 - DNA, 21 bp, Vitis vinifera
tgattgagccgtgccaatatc

SEQ ID NO: 4351 - DNA, 21 bp, Vitis vinifera
tgattgagccgtgccaatatc

SEQ ID NO: 4352 - DNA, 21 bp, Vitis vinifera
tgattgagccgcgccaatatc

SEQ ID NO: 4353 - DNA, 21 bp, Vitis vinifera
ttgagccgcgccaatatcact

SEQ ID NO: 4354 - DNA, 21 bp, Vitis vinifera
ttgagccgaaccaatatcacc

SEQ ID NO: 4355 - DNA, 21 bp, Vitis vinifera
tggttgagccgcgccaatatc

SEQ ID NO: 4356 - DNA, 21 bp, Vitis vinifera
tgattgagccgtgccaatatc

SEQ ID NO: 4357 - DNA, 20 bp, Zea mays
tgattgagccgcgccaatat

SEQ ID NO: 4358 - DNA, 20 bp, Zea mays
ttgagccgtgccaatatcac

SEQ ID NO: 4359 - DNA, 21 bp, Zea mays
tgactgagccgtgccaatatc

SEQ ID NO: 4360 - DNA, 21 bp, Zea mays
tgattgagccgtgccaatatc

SEQ ID NO: 4361 - DNA, 21 bp, Zea mays
tgattgagccgtgccaatatc

SEQ ID NO: 4362 - DNA, 21 bp, Zea mays
ttgagccgtgccaatatcaca

SEQ ID NO: 4363 - DNA, 21 bp, Zea mays
gaggtgagccgagccaatatc

SEQ ID NO: 4364 - DNA, 21 bp, Zea mays
gtgagccgaaccaatatcact

SEQ ID NO: 4365 - DNA, 21 bp, Zea mays
tgattgagccgtgccaatatc

SEQ ID NO: 4366 - DNA, 21 bp, Zea mays
tgattgagccgtgccaatatc

SEQ ID NO: 4367 - DNA, 21 bp, Zea mays
gtgagccgaaccaatatcact

SEQ ID NO: 4368 - DNA, 21 bp, Zea mays
ggattgagccgcgtcaatatc

SEQ ID NO: 4369 - DNA, 21 bp, Zea mays
ggattgagccgcgtcaatatc

SEQ ID NO: 4370 - DNA, 21 bp, Zea mays
tgattgagccgcgccaatatc

SEQ ID NO: 4371 - DNA, 21 bp, Arachis hypogaea
gcatgaagggagtcacgcagg

SEQ ID NO: 4372 - DNA, 21 bp, Arabidopsis lyrata
gcgtatgaggagccatgcata

SEQ ID NO: 4373 - DNA, 22 bp, Arabidopsis lyrata
gcgtacagagtagtcaagcatg

SEQ ID NO: 4374 - DNA, 21 bp, Brassica rapa
gcgtatgaggagccatgcata

SEQ ID NO: 4375 - DNA, 21 bp, Zea mays
gcgtgcaaggggccaagcatg

SEQ ID NO: 4376 - DNA, 21 bp, Zea mays
gcgtgcaaggagccaagcatg

SEQ ID NO: 4377 - DNA, 21 bp, Zea mays
gcgtgcatggtgccaagcata

SEQ ID NO: 4378 - DNA, 21 bp, Zea mays
gcgtgcgtggagccaagcatg

SEQ ID NO: 4379 - DNA, 21 bp, Zea mays
gcgtgcgaggtgccaggcatg

SEQ ID NO: 4380 - DNA, 21 bp, Zea mays
gcgtgcaaggagccaagcatg

SEQ ID NO: 4381 - DNA, 21 bp, Arabidopsis lyrata
gcgtatgaggagccatgcata

SEQ ID NO: 4382 - DNA, 22 bp, Arabidopsis lyrata
gcgtacagagtagtcaagcatg

SEQ ID NO: 4383 - DNA, 21 bp, Arabidopsis lyrata
gcgtacaaggagccaagcatg

SEQ ID NO: 4384 - DNA, 21 bp, Zea mays
gcgtgcaaggggccaagcatg

SEQ ID NO: 4385 - DNA, 21 bp, Zea mays
gcgtgcaaggagccaagcatg

SEQ ID NO: 4386 - DNA, 21 bp, Zea mays
gcgtgcatggtgccaagcata

SEQ ID NO: 4387 - DNA, 21 bp, Zea mays
gcgtgcgtggagccaagcatg

SEQ ID NO: 4388 - DNA, 21 bp, Zea mays
gcgtgcgaggtgccaggcatg

SEQ ID NO: 4389 - DNA, 21 bp, Zea mays
gcgtgcaaggagccaagcatg

SEQ ID NO: 4390 - DNA, 21 bp, Arachis hypogaea
cctcgttccatacatcatcta

SEQ ID NO: 4391 - DNA, 21 bp, Glycine max
tctcattccatacatcgtctg

SEQ ID NO: 4392 - DNA, 22 bp, Glycine soja
tctcattccatacatcgtctga

SEQ ID NO: 4393 - DNA, 22 bp, Glycine soja
tctcattccatacatcgtctga

SEQ ID NO: 4394 - DNA, 22 bp, Medicago truncatula
cctcgttccatacatcatctag

SEQ ID NO: 4395 - DNA, 21 bp, Vigna unguiculata
tctcattccatacatcgtctg

SEQ ID NO: 4396 - DNA, 21 bp, Vigna unguiculata
tctcattccatacatcgtctg

SEQ ID NO: 4397 - DNA, 24 bp, Glycine max
aagtgatgacatgacaagcgaagt

SEQ ID NO: 4398 - DNA, 22 bp, Aquilegia coerulea
tcttgccgactcctcccatacc

SEQ ID NO: 4399 - DNA, 22 bp, Aquilegia coerulea
tcttgccgactcctcccatacc

SEQ ID NO: 4400 - DNA, 22 bp, Aquilegia coerulea
tcttgccgactcctcccatacc

SEQ ID NO: 4401 - DNA, 22 bp, Citrus sinensis
tcttccctatgcctcccattcc

SEQ ID NO: 4402 - DNA, 22 bp, Citrus sinensis
tcttgcccacccctcccattcc

SEQ ID NO: 4403 - DNA, 22 bp, Citrus sinensis
ttccctagtccccctattccta

SEQ ID NO: 4404 - DNA, 22 bp, Gossypium hirsutum
tctttcctactcctcccatacc

SEQ ID NO: 4405 - DNA, 22 bp, Gossypium hirsutum
tcttgcctactccacccatgcc

SEQ ID NO: 4406 - DNA, 24 bp, Glycine max
tcttcccaattccgcccattccta

SEQ ID NO: 4407 - DNA, 24 bp, Glycine max
tcttcccaattccgcccattccta

SEQ ID NO: 4408 - DNA, 22 bp, Gossypium raimondii
tctttccaattcctcccattcc

SEQ ID NO: 4409 - DNA, 21 bp, Glycine soja
tcttccctacacctcccatac

SEQ ID NO: 4410 - DNA, 22 bp, Malus domestica
tcttcccaagcccgcccattcc

SEQ ID NO: 4411 - DNA, 22 bp, Malus x domestica
tcttcccaagcccgcccattcc

SEQ ID NO: 4412 - DNA, 22 bp, Picea abies
tcttccctactcctcccattcc

SEQ ID NO: 4413 - DNA, 22 bp, Picea abies
tcttccctattcctcccattcc

SEQ ID NO: 4414 - DNA, 22 bp, Picea abies
tctttcctactcctcccattcc

SEQ ID NO: 4415 - DNA, 22 bp, Pinus taeda
tcttccctactcctcccattcc

SEQ ID NO: 4416 - DNA, 22 bp, Pinus taeda
tcttccctactcctcccattcc

SEQ ID NO: 4417 - DNA, 20 bp, Pinus taeda
tcttccctattcctcccatt

SEQ ID NO: 4418 - DNA, 20 bp, Pinus taeda
tcctccctactcctcccatt

SEQ ID NO: 4419 - DNA, 17 bp, Populus trichocarpa
cctactcctcccattcc

SEQ ID NO: 4420 - DNA, 20 bp, Populus trichocarpa
tcttgcctactcctcccatt

SEQ ID NO: 4421 - DNA, 22 bp, Phaseolus vulgaris
tcttcccaattccgcccattcc

SEQ ID NO: 4422 - DNA, 22 bp, Solanum lycopersicum
tttccaattccacccattccta

SEQ ID NO: 4423 - DNA, 22 bp, Vitis vinifera
tctttcctactcctcccattcc

SEQ ID NO: 4424 - DNA, 20 bp, Zea mays
tcttccttgttcctcccatt

SEQ ID NO: 4425 - DNA, 21 bp, Oryza sativa
agtgaggaggccggggccgct

SEQ ID NO: 4426 - DNA, 21 bp, Oryza sativa
agtgaggaggccggggccgct

SEQ ID NO: 4427 - DNA, 21 bp, Oryza sativa
agtgaggaggccggggccgct

SEQ ID NO: 4428 - DNA, 21 bp, Arabidopsis lyrata
tcggaccaggcttcattcccc

SEQ ID NO: 4429 - DNA, 21 bp, Arabidopsis lyrata
tcggaccaggcttcattcccc

SEQ ID NO: 4430 - DNA, 21 bp, Arabidopsis lyrata
tcggaccaggcttcattcccc

SEQ ID NO: 4431 - DNA, 21 bp, Arabidopsis lyrata
tcggaccaggcttcattcccc

SEQ ID NO: 4432 - DNA, 21 bp, Arabidopsis lyrata
tcggaccaggcttcattcccc

SEQ ID NO: 4433 - DNA, 21 bp, Arabidopsis lyrata
tcggaccaggcttcattcccc

SEQ ID NO: 4434 - DNA, 21 bp, Arabidopsis lyrata
tcggaccaggcttcattcccc

SEQ ID NO: 4435 - DNA, 21 bp, Aquilegia coerulea
tcggaccaggcttcattcctc

SEQ ID NO: 4436 - DNA, 21 bp, Aquilegia coerulea
tcggaccaggcttcattcccc

SEQ ID NO: 4437 - DNA, 20 bp, Aquilegia coerulea
tcggaccaggcttcattcct

SEQ ID NO: 4438 - DNA, 21 bp, Aquilegia coerulea
tcggaccaggcttcattcctc

SEQ ID NO: 4439 - DNA, 21 bp, Aquilegia coerulea
tcggaccaggcttcattcccc

SEQ ID NO: 4440 - DNA, 21 bp, Arabidopsis thaliana
tcggaccaggcttcattcccc

SEQ ID NO: 4441 - DNA, 21 bp, Arabidopsis thaliana
tcggaccaggcttcattcccc

SEQ ID NO: 4442 - DNA, 21 bp, Arabidopsis thaliana
tcggaccaggcttcattcccc

SEQ ID NO: 4443 - DNA, 21 bp, Arabidopsis thaliana
tcggaccaggcttcattcccc

SEQ ID NO: 4444 - DNA, 21 bp, Arabidopsis thaliana
tcggaccaggcttcattcccc

SEQ ID NO: 4445 - DNA, 21 bp, Arabidopsis thaliana
tcggaccaggcttcattcccc

SEQ ID NO: 4446 - DNA, 21 bp, Arabidopsis thaliana
tcggaccaggcttcattcccc

SEQ ID NO: 4447 - DNA, 21 bp, Brachypodium distachyon
tcggaccaggcttcattcccc

SEQ ID NO: 4448 - DNA, 21 bp, Brachypodium distachyon
tcggaccaggcttcattcccc

SEQ ID NO: 4449 - DNA, 21 bp, Brachypodium distachyon
tcggaccaggcttcattcccc

SEQ ID NO: 4450 - DNA, 21 bp, Brachypodium distachyon
tcggaccaggcttcattcccc

SEQ ID NO: 4451 - DNA, 21 bp, Brachypodium distachyon
tcggaccaggcttcattcccc

SEQ ID NO: 4452 - DNA, 21 bp, Brachypodium distachyon
ctcggaccaggcttcattccc

SEQ ID NO: 4453 - DNA, 21 bp, Brachypodium distachyon
tctcggaccaggcttcattcc

SEQ ID NO: 4454 - DNA, 21 bp, Brassica napus
tcggaccaggcttcattcccc

SEQ ID NO: 4455 - DNA, 21 bp, Brassica napus
tcggaccaggcttcattcccc

SEQ ID NO: 4456 - DNA, 21 bp, Brassica napus
tcggaccaggcttcattcccc

SEQ ID NO: 4457 - DNA, 21 bp, Brassica napus
tcggaccaggcttcattcccc

SEQ ID NO: 4458 - DNA, 20 bp, Citrus x paradisi x Poncirus trifoliata
tcggaccaggcttcattccc

SEQ ID NO: 4459 - DNA, 22 bp, Citrus reticulata
tcggaccaggcttcattcccgt

SEQ ID NO: 4460 - DNA, 22 bp, Citrus reticulata
tcggaccaggcttcattccctt

SEQ ID NO: 4461 - DNA, 21 bp, Citrus sinensis
tcggaccaggcttcattcccc

SEQ ID NO: 4462 - DNA, 22 bp, Citrus sinensis
tcggaccaggcttcattccccc

SEQ ID NO: 4463 - DNA, 22 bp, Citrus sinensis
tcggaccaggcttcattcccgt

SEQ ID NO: 4464 - DNA, 20 bp, Citrus sinensis
tcggaccaggcttcattccc

SEQ ID NO: 4465 - DNA, 21 bp, Citrus sinensis
tcggaccaggcttcattccct

SEQ ID NO: 4466 - DNA, 21 bp, Citrus sinensis
tcggaccaggcttcattcccc

SEQ ID NO: 4467 - DNA, 22 bp, Citrus trifoliata
tcggaccaggcttcattccccc

SEQ ID NO: 4468 - DNA, 21 bp, Festuca arundinacea
ccggaccaggcttcatcccag

SEQ ID NO: 4469 - DNA, 21 bp, Festuca glaucescens x Lolium multiflorum
tcggaccaggcttcatccccc

SEQ ID NO: 4470 - DNA, 21 bp, Gossypium hirsutum
tcggaccaggcttcattcccc

SEQ ID NO: 4471 - DNA, 21 bp, Gossypium hirsutum
tcggaccaggcttcattcccc

SEQ ID NO: 4472 - DNA, 21 bp, Glycine max
tcggaccaggcttcattcccc

SEQ ID NO: 4473 - DNA, 21 bp, Glycine max
tcggaccaggcttcattcccc

SEQ ID NO: 4474 - DNA, 21 bp, Glycine max
tcggaccaggcttcattcccc

SEQ ID NO: 4475 - DNA, 21 bp, Glycine max
tcggaccaggcttcattcccc

SEQ ID NO: 4476 - DNA, 21 bp, Glycine max
tcggaccaggcttcattcccg

SEQ ID NO: 4477 - DNA, 21 bp, Glycine max
tcggaccaggcttcattccct

SEQ ID NO: 4478 - DNA, 21 bp, Hordeum vulgare
tcggaccaggcttcattcccc

SEQ ID NO: 4479 - DNA, 21 bp, Hordeum vulgare
tcggaccaggcttcattcccc

SEQ ID NO: 4480 - DNA, 21 bp, Hordeum vulgare
tcggaccaggcttcattcccc

SEQ ID NO: 4481 - DNA, 21 bp, Hordeum vulgare subsp. Vulgare
tcggaccaggcttcattcccc

SEQ ID NO: 4482 - DNA, 21 bp, Ipomoea nil
tcggaccaggcttcattcctc

SEQ ID NO: 4483 - DNA, 21 bp, Medicago truncatula
tcggaccaggcttcattcccc

SEQ ID NO: 4484 - DNA, 21 bp, Medicago truncatula
tcggaccaggcttcattccta

SEQ ID NO: 4485 - DNA, 21 bp, Medicago truncatula
tcggaccaggcttcattcctc

SEQ ID NO: 4486 - DNA, 21 bp, Medicago truncatula
tcgggccaggcttcatccccc

SEQ ID NO: 4487 - DNA, 21 bp, Medicago truncatula
tcggaccaggcttcattcccc

SEQ ID NO: 4488 - DNA, 21 bp, Medicago truncatula
tcggaccaggcttcattcctc

SEQ ID NO: 4489 - DNA, 21 bp, Medicago truncatula
tcggaccaggcttcattcccc

SEQ ID NO: 4490 - DNA, 21 bp, Medicago truncatula
tcggaccaggcttcattcccc

SEQ ID NO: 4491 - DNA, 21 bp, Nicotiana sylvestris
tcggaccaggcttcattcccc

SEQ ID NO: 4492 - DNA, 21 bp, Oryza sativa
tcggaccaggcttcattcccc

SEQ ID NO: 4493 - DNA, 21 bp, Oryza sativa
tcggaccaggcttcattcccc

SEQ ID NO: 4494 - DNA, 21 bp, Oryza sativa
tcggaccaggcttcattcccc

SEQ ID NO: 4495 - DNA, 21 bp, Oryza sativa
tcggaccaggcttcattcccc

SEQ ID NO: 4496 - DNA, 21 bp, Oryza sativa
tcgaaccaggcttcattcccc

SEQ ID NO: 4497 - DNA, 21 bp, Oryza sativa
tcggaccaggcttcattcccc

SEQ ID NO: 4498 - DNA, 21 bp, Oryza sativa
tcggaccaggcttcattcctc

SEQ ID NO: 4499 - DNA, 21 bp, Oryza sativa
tcggaccaggcttcattcctc

SEQ ID NO: 4500 - DNA, 21 bp, Oryza sativa
tcggatcaggcttcattcctc

SEQ ID NO: 4501 - DNA, 21 bp, Oryza sativa
tcggatcaggcttcattcctc

SEQ ID NO: 4502 - DNA, 21 bp, Oryza sativa
tcggaccaggcttcaatccct

SEQ ID NO: 4503 - DNA, 21 bp, Oryza sativa
tcggaccaggcttcaatccct

SEQ ID NO: 4504 - DNA, 21 bp, Oryza sativa
tcggaccaggcttcattccct

SEQ ID NO: 4505 - DNA, 21 bp, Oryza sativa
tcggaccaggcttcattcccc

SEQ ID NO: 4506 - DNA, 21 bp, Picea abies
tcggaccaggcttcattcctc

SEQ ID NO: 4507 - DNA, 21 bp, Picea abies
tcggaccaggcttcattcctt

SEQ ID NO: 4508 - DNA, 21 bp, Picea glauca
tcggaccaggcttcattcctt

SEQ ID NO: 4509 - DNA, 21 bp, Physcomitrella patens
tcggaccaggcttcattcccc

SEQ ID NO: 4510 - DNA, 21 bp, Physcomitrella patens
tcggaccaggcttcattcccc

SEQ ID NO: 4511 - DNA, 21 bp, Physcomitrella patens
tcggaccaggcttcattcccc

SEQ ID NO: 4512 - DNA, 21 bp, Physcomitrella patens
tcggaccaggcttcattcccc

SEQ ID NO: 4513 - DNA, 21 bp, Physcomitrella patens
tcggaccaggcttcattcccc

SEQ ID NO: 4514 - DNA, 21 bp, Physcomitrella patens
tcggaccaggcttcattcccc

SEQ ID NO: 4515 - DNA, 21 bp, Physcomitrella patens
tcggaccaggcttcattcccc

SEQ ID NO: 4516 - DNA, 21 bp, Physcomitrella patens
tcggaccaggcttcattcccc

SEQ ID NO: 4517 - DNA, 21 bp, Physcomitrella patens
tcggaccaggcttcattcccc

SEQ ID NO: 4518 - DNA, 21 bp, Physcomitrella patens
tccggaccaggcttcattccc

SEQ ID NO: 4519 - DNA, 21 bp, Physcomitrella patens
tccggaccaggcttcattccc

SEQ ID NO: 4520 - DNA, 21 bp, Physcomitrella patens
tccggaccaggcttcattccc

SEQ ID NO: 4521 - DNA, 21 bp, Pinus taeda
tcggaccaggcttcattcccc

SEQ ID NO: 4522 - DNA, 21 bp, Pinus taeda
tcggaccaggcttcattcccc

SEQ ID NO: 4523 - DNA, 21 bp, Pinus taeda
ccggaccaggcttcatcccag

SEQ ID NO: 4524 - DNA, 21 bp, Populus trichocarpa
tcggaccaggcttcattcccc

SEQ ID NO: 4525 - DNA, 21 bp, Populus trichocarpa
tcggaccaggcttcattcccc

SEQ ID NO: 4526 - DNA, 21 bp, Populus trichocarpa
tcggaccaggcttcattcccc

SEQ ID NO: 4527 - DNA, 21 bp, Populus trichocarpa
tcggaccaggcttcattcccc

SEQ ID NO: 4528 - DNA, 21 bp, Populus trichocarpa
tcggaccaggcttcattcccc

SEQ ID NO: 4529 - DNA, 21 bp, Populus trichocarpa
tcggaccaggcttcattcccc

SEQ ID NO: 4530 - DNA, 21 bp, Populus trichocarpa
tcggaccaggcttcattcccc

SEQ ID NO: 4531 - DNA, 21 bp, Populus trichocarpa
tcggaccaggcttcattcccc

SEQ ID NO: 4532 - DNA, 21 bp, Populus trichocarpa
tcggaccaggcttcattcccc

SEQ ID NO: 4533 - DNA, 21 bp, Populus trichocarpa
tcggaccaggcttcattcccc

SEQ ID NO: 4534 - DNA, 21 bp, Populus trichocarpa
tcggaccaggcttcattcccc

SEQ ID NO: 4535 - DNA, 21 bp, Populus trichocarpa
tcggaccaggcttcattcccc

SEQ ID NO: 4536 - DNA, 21 bp, Populus trichocarpa
tcggaccaggcttcattcccc

SEQ ID NO: 4537 - DNA, 21 bp, Populus trichocarpa
tcggaccaggcttcattcctt

SEQ ID NO: 4538 - DNA, 21 bp, Populus trichocarpa
tcggaccaggcttcattcctt

SEQ ID NO: 4539 - DNA, 21 bp, Populus trichocarpa
tcggaccaggctccattcctt

SEQ ID NO: 4540 - DNA, 21 bp, Populus trichocarpa
tcggaccaggcttcattcctt

SEQ ID NO: 4541 - DNA, 21 bp, Phaseolus vulgaris
tcggaccaggcttcattcccc

SEQ ID NO: 4542 - DNA, 21 bp, Phaseolus vulgaris
tcggaccaggcttcattcccc

SEQ ID NO: 4543 - DNA, 21 bp, Ricinus communis
tcggaccaggcttcattcccc

SEQ ID NO: 4544 - DNA, 21 bp, Ricinus communis
tcggaccaggcttcattcccc

SEQ ID NO: 4545 - DNA, 21 bp, Ricinus communis
tcggaccaggcttcattcccc

SEQ ID NO: 4546 - DNA, 21 bp, Ricinus communis
tcggaccaggcttcattcccc

SEQ ID NO: 4547 - DNA, 21 bp, Ricinus communis
tcggaccaggcttcattcccc

SEQ ID NO: 4548 - DNA, 20 bp, Sorghum bicolor
tcggaccaggcttcattccc

SEQ ID NO: 4549 - DNA, 20 bp, Sorghum bicolor
tcggaccaggcttcattccc

SEQ ID NO: 4550 - DNA, 20 bp, Sorghum bicolor
tcggaccaggcttcattccc

SEQ ID NO: 4551 - DNA, 20 bp, Sorghum bicolor
tcggaccaggcttcattccc

SEQ ID NO: 4552 - DNA, 21 bp, Sorghum bicolor
tcggaccaggcttcaatccct

SEQ ID NO: 4553 - DNA, 21 bp, Sorghum bicolor
tcggaccaggcttcattcctc

SEQ ID NO: 4554 - DNA, 21 bp, Sorghum bicolor
tcggaccaggcttcaatccct

SEQ ID NO: 4555 - DNA, 20 bp, Sorghum bicolor
tcggaccaggcttcattccc

SEQ ID NO: 4556 - DNA, 20 bp, Sorghum bicolor
tcggaccaggcttcattccc

SEQ ID NO: 4557 - DNA, 20 bp, Sorghum bicolor
tcggaccaggcttcattccc

SEQ ID NO: 4558 - DNA, 20 bp, Sorghum bicolor
tcggaccaggcttcattcct

SEQ ID NO: 4559 - DNA, 21 bp, Solanum lycopersicum
tcggaccaggcttcattcccc

SEQ ID NO: 4560 - DNA, 21 bp, Solanum lycopersicum
tcggaccaggcttcattcccc

SEQ ID NO: 4561 - DNA, 21 bp, Selaginella moellendorffii
tcggaccaggcttcattcccc

SEQ ID NO: 4562 - DNA, 21 bp, Selaginella moellendorffii
tcggaccaggcttcattcccc

SEQ ID NO: 4563 - DNA, 21 bp, Selaginella moellendorffii
tcggaccaggcttcattcccc

SEQ ID NO: 4564 - DNA, 21 bp, Saccharum officinarum
tcggaccaggcttcattcccc

SEQ ID NO: 4565 - DNA, 21 bp, Triticum aestivum
ccggaccaggcttcattccca

SEQ ID NO: 4566 - DNA, 21 bp, Theobroma cacao
tcggaccaggcttcattcccc

SEQ ID NO: 4567 - DNA, 20 bp, Theobroma cacao
tcggaccaggcttcattccc

SEQ ID NO: 4568 - DNA, 21 bp, Theobroma cacao
tcggaccaggcttcattcctc

SEQ ID NO: 4569 - DNA, 21 bp, Theobroma cacao
tcggaccaggcttcattcccc

SEQ ID NO: 4570 - DNA, 19 bp, Vitis vinifera
tcggaccaggcttcattcc

SEQ ID NO: 4571 - DNA, 19 bp, Vitis vinifera
tcggaccaggcttcattcc

SEQ ID NO: 4572 - DNA, 21 bp, Vitis vinifera
tcggaccaggcttcattcccc

SEQ ID NO: 4573 - DNA, 21 bp, Vitis vinifera
tcggaccaggcttcattcccc

SEQ ID NO: 4574 - DNA, 21 bp, Vitis vinifera
tcggaccaggcttcattcccc

SEQ ID NO: 4575 - DNA, 21 bp, Vitis vinifera
tcggaccaggcttcattcccc

SEQ ID NO: 4576 - DNA, 21 bp, Vitis vinifera
tcggaccaggcttcattcccc

SEQ ID NO: 4577 - DNA, 21 bp, Vitis vinifera
tcggaccaggcttcattcccc

SEQ ID NO: 4578 - DNA, 21 bp, Zea mays
tcggaccaggcttcattcccc

SEQ ID NO: 4579 - DNA, 20 bp, Zea mays
tcggaccaggcttcattccc

SEQ ID NO: 4580 - DNA, 20 bp, Zea mays
tcggaccaggcttcattccc

SEQ ID NO: 4581 - DNA, 20 bp, Zea mays
tcggaccaggcttcattccc

SEQ ID NO: 4582 - DNA, 20 bp, Zea mays
tcggaccaggcttcattccc

SEQ ID NO: 4583 - DNA, 20 bp, Zea mays
tcggaccaggcttcattccc

SEQ ID NO: 4584 - DNA, 20 bp, Zea mays
tcggaccaggcttcattccc

SEQ ID NO: 4585 - DNA, 20 bp, Zea mays
tcggaccaggcttcattccc

SEQ ID NO: 4586 - DNA, 20 bp, Zea mays
tcggaccaggcttcattccc

SEQ ID NO: 4587 - DNA, 21 bp, Zea mays
tcggaccaggcttcaatccct

SEQ ID NO: 4588 - DNA, 21 bp, Zea mays
tcggaccaggcttcaatccct

SEQ ID NO: 4589 - DNA, 21 bp, Zea mays
tcggaccaggcttcattcctc

SEQ ID NO: 4590 - DNA, 21 bp, Zea mays
tcggaccaggcttcattcctc

SEQ ID NO: 4591 - DNA, 21 bp, Zea mays
tcggaccaggcttcaatccct

SEQ ID NO: 4592 - DNA, 21 bp, Zea mays
tcggaccaggcttcattcccc

SEQ ID NO: 4593 - DNA, 21 bp, Zea mays
tcggaccaggcttcattcccc

SEQ ID NO: 4594 - DNA, 21 bp, Zea mays
tcggaccaggcttcattcccc

SEQ ID NO: 4595 - DNA, 21 bp, Zea mays
tcggaccaggcttcattcccc

SEQ ID NO: 4596 - DNA, 21 bp, Zea mays
tcggaccaggcttcattcccc

SEQ ID NO: 4597 - DNA, 21 bp, Zea mays
tcggaccaggcttcattcccc

SEQ ID NO: 4598 - DNA, 21 bp, Zea mays
tcggaccacgcttcattcccc

SEQ ID NO: 4599 - DNA, 21 bp, Arabidopsis lyrata
tcggaccaggcttcattcccc

SEQ ID NO: 4600 - DNA, 21 bp, Arabidopsis lyrata
tcggaccaggcttcattcccc

SEQ ID NO: 4601 - DNA, 21 bp, Arabidopsis lyrata
tcggaccaggcttcattcccc

SEQ ID NO: 4602 - DNA, 21 bp, Arabidopsis lyrata
tcggaccaggcttcattcccc

SEQ ID NO: 4603 - DNA, 21 bp, Arabidopsis lyrata
tcggaccaggcttcattcccc

SEQ ID NO: 4604 - DNA, 21 bp, Arabidopsis lyrata
tcggaccaggcttcattcccc

SEQ ID NO: 4605 - DNA, 21 bp, Arabidopsis lyrata
tcggaccaggcttcattcccc

SEQ ID NO: 4606 - DNA, 21 bp, Aquilegia coerulea
tcggaccaggcttcattcctc

SEQ ID NO: 4607 - DNA, 21 bp, Aquilegia coerulea
tcggaccaggcttcattcccc

SEQ ID NO: 4608 - DNA, 20 bp, Aquilegia coerulea
tcggaccaggcttcattcct

SEQ ID NO: 4609 - DNA, 21 bp, Aquilegia coerulea
tcggaccaggcttcattcctc

SEQ ID NO: 4610 - DNA, 21 bp, Aquilegia coerulea
tcggaccaggcttcattcccc

SEQ ID NO: 4611 - DNA, 21 bp, Arabidopsis thaliana
tcggaccaggcttcattcccc

SEQ ID NO: 4612 - DNA, 21 bp, Arabidopsis thaliana
tcggaccaggcttcattcccc

SEQ ID NO: 4613 - DNA, 21 bp, Arabidopsis thaliana
tcggaccaggcttcattcccc

SEQ ID NO: 4614 - DNA, 21 bp, Arabidopsis thaliana
tcggaccaggcttcattcccc

SEQ ID NO: 4615 - DNA, 21 bp, Arabidopsis thaliana
tcggaccaggcttcattcccc

SEQ ID NO: 4616 - DNA, 21 bp, Arabidopsis thaliana
tcggaccaggcttcattcccc

SEQ ID NO: 4617 - DNA, 21 bp, Arabidopsis thaliana
tcggaccaggcttcattcccc

SEQ ID NO: 4618 - DNA, 21 bp, Brachypodium distachyon
tcggaccaggcttcattcccc

SEQ ID NO: 4619 - DNA, 21 bp, Brachypodium distachyon
tcggaccaggcttcattcccc

SEQ ID NO: 4620 - DNA, 21 bp, Brachypodium distachyon
tcggaccaggcttcattcccc

SEQ ID NO: 4621 - DNA, 21 bp, Brachypodium distachyon
tcggaccaggcttcattcccc

SEQ ID NO: 4622 - DNA, 21 bp, Brachypodium distachyon
tcggaccaggcttcattcccc

SEQ ID NO: 4623 - DNA, 21 bp, Brachypodium distachyon
ctcggaccaggcttcattccc

SEQ ID NO: 4624 - DNA, 21 bp, Brachypodium distachyon
tctcggaccaggcttcattcc

SEQ ID NO: 4625 - DNA, 21 bp, Brassica napus
tcggaccaggcttcattcccc

SEQ ID NO: 4626 - DNA, 21 bp, Brassica napus
tcggaccaggcttcattcccc

SEQ ID NO: 4627 - DNA, 21 bp, Brassica napus
tcggaccaggcttcattcccc

SEQ ID NO: 4628 - DNA, 21 bp, Brassica napus
tcggaccaggcttcattcccc

SEQ ID NO: 4629 - DNA, 20 bp, Citrus x paradisi x Poncirus trifoliata
tcggaccaggcttcattccc

SEQ ID NO: 4630 - DNA, 22 bp, Citrus reticulata
tcggaccaggcttcattcccgt

SEQ ID NO: 4631 - DNA, 22 bp, Citrus reticulata
tcggaccaggcttcattccctt

SEQ ID NO: 4632 - DNA, 21 bp, Citrus sinensis
tcggaccaggcttcattcccc

SEQ ID NO: 4633 - DNA, 22 bp, Citrus sinensis
tcggaccaggcttcattccccc

SEQ ID NO: 4634 - DNA, 22 bp, Citrus sinensis
tcggaccaggcttcattcccgt

SEQ ID NO: 4635 - DNA, 20 bp, Citrus sinensis
tcggaccaggcttcattccc

SEQ ID NO: 4636 - DNA, 21 bp, Citrus sinensis
tcggaccaggcttcattccct

SEQ ID NO: 4637 - DNA, 21 bp, Citrus sinensis
tcggaccaggcttcattcccc

SEQ ID NO: 4638 - DNA, 22 bp, Citrus trifoliata
tcggaccaggcttcattccccc

SEQ ID NO: 4639 - DNA, 21 bp, Festuca arundinacea
ccggaccaggcttcatcccag

SEQ ID NO: 4640 - DNA, 21 bp, Festuca glaucescens x Lolium multiflorum
tcggaccaggcttcatccccc

SEQ ID NO: 4641 - DNA, 21 bp, Gossypium hirsutum
tcggaccaggcttcattcccc

SEQ ID NO: 4642 - DNA, 21 bp, Gossypium hirsutum
tcggaccaggcttcattcccc

SEQ ID NO: 4643 - DNA, 21 bp, Glycine max
tcggaccaggcttcattcccc

SEQ ID NO: 4644 - DNA, 21 bp, Glycine max
tcggaccaggcttcattcccc

SEQ ID NO: 4645 - DNA, 21 bp, Glycine max
tcggaccaggcttcattcccc

SEQ ID NO: 4646 - DNA, 21 bp, Glycine max
tcggaccaggcttcattcccc

SEQ ID NO: 4647 - DNA, 21 bp, Glycine max
tcggaccaggcttcattcccg

SEQ ID NO: 4648 - DNA, 21 bp, Glycine max
tcggaccaggcttcattccct

SEQ ID NO: 4649 - DNA, 21 bp, Hordeum vulgare
tcggaccaggcttcattcccc

SEQ ID NO: 4650 - DNA, 21 bp, Hordeum vulgare
tcggaccaggcttcattcccc

SEQ ID NO: 4651 - DNA, 21 bp, Hordeum vulgare
tcggaccaggcttcattcccc

SEQ ID NO: 4652 - DNA, 21 bp, Hordeum vulgare subsp. Vulgare
tcggaccaggcttcattcccc

SEQ ID NO: 4653 - DNA, 21 bp, Ipomoea nil
tcggaccaggcttcattcctc

SEQ ID NO: 4654 - DNA, 21 bp, Medicago truncatula
tcggaccaggcttcattcccc

SEQ ID NO: 4655 - DNA, 21 bp, Medicago truncatula
tcggaccaggcttcattccta

SEQ ID NO: 4656 - DNA, 21 bp, Medicago truncatula
tcggaccaggcttcattcctc

SEQ ID NO: 4657 - DNA, 21 bp, Medicago truncatula
tcgggccaggcttcatccccc

SEQ ID NO: 4658 - DNA, 21 bp, Medicago truncatula
tcggaccaggcttcattcccc

SEQ ID NO: 4659 - DNA, 21 bp, Medicago truncatula
tcggaccaggcttcattcctc

SEQ ID NO: 4660 - DNA, 21 bp, Medicago truncatula
tcggaccaggcttcattcccc

SEQ ID NO: 4661 - DNA, 21 bp, Medicago truncatula
tcggaccaggcttcattcccc

SEQ ID NO: 4662 - DNA, 21 bp, Nicotiana sylvestris
tcggaccaggcttcattcccc

SEQ ID NO: 4663 - DNA, 21 bp, Oryza sativa
tcggaccaggcttcattcccc

SEQ ID NO: 4664 - DNA, 21 bp, Oryza sativa
tcggaccaggcttcattcccc

SEQ ID NO: 4665 - DNA, 21 bp, Oryza sativa
tcggaccaggcttcattcccc

SEQ ID NO: 4666 - DNA, 21 bp, Oryza sativa
tcggaccaggcttcattcccc

SEQ ID NO: 4667 - DNA, 21 bp, Oryza sativa
tcgaaccaggcttcattcccc

SEQ ID NO: 4668 - DNA, 21 bp, Oryza sativa
tcggaccaggcttcattcccc

SEQ ID NO: 4669 - DNA, 21 bp, Oryza sativa
tcggaccaggcttcattcctc

SEQ ID NO: 4670 - DNA, 21 bp, Oryza sativa
tcggaccaggcttcattcctc

SEQ ID NO: 4671 - DNA, 21 bp, Oryza sativa
tcggatcaggcttcattcctc

SEQ ID NO: 4672 - DNA, 21 bp, Oryza sativa
tcggatcaggcttcattcctc

SEQ ID NO: 4673 - DNA, 21 bp, Oryza sativa
tcggaccaggcttcaatccct

SEQ ID NO: 4674 - DNA, 21 bp, Oryza sativa
tcggaccaggcttcaatccct

SEQ ID NO: 4675 - DNA, 21 bp, Oryza sativa
tcggaccaggcttcattccct

SEQ ID NO: 4676 - DNA, 21 bp, Oryza sativa
tcggaccaggcttcattcccc

SEQ ID NO: 4677 - DNA, 21 bp, Picea abies
tcggaccaggcttcattcctc

SEQ ID NO: 4678 - DNA, 21 bp, Picea abies
tcggaccaggcttcattcctt

SEQ ID NO: 4679 - DNA, 21 bp, Picea glauca
tcggaccaggcttcattcctt

SEQ ID NO: 4680 - DNA, 21 bp, Physcomitrella patens
tcggaccaggcttcattcccc

SEQ ID NO: 4681 - DNA, 21 bp, Physcomitrella patens
tcggaccaggcttcattcccc

SEQ ID NO: 4682 - DNA, 21 bp, Physcomitrella patens
tcggaccaggcttcattcccc

SEQ ID NO: 4683 - DNA, 21 bp, Physcomitrella patens
tcggaccaggcttcattcccc

SEQ ID NO: 4684 - DNA, 21 bp, Physcomitrella patens
tcggaccaggcttcattcccc

SEQ ID NO: 4685 - DNA, 21 bp, Physcomitrella patens
tcggaccaggcttcattcccc

SEQ ID NO: 4686 - DNA, 21 bp, Physcomitrella patens
tcggaccaggcttcattcccc

SEQ ID NO: 4687 - DNA, 21 bp, Physcomitrella patens
tcggaccaggcttcattcccc

SEQ ID NO: 4688 - DNA, 21 bp, Physcomitrella patens
tcggaccaggcttcattcccc

SEQ ID NO: 4689 - DNA, 21 bp, Physcomitrella patens
tccggaccaggcttcattccc

SEQ ID NO: 4690 - DNA, 21 bp, Physcomitrella patens
tccggaccaggcttcattccc

SEQ ID NO: 4691 - DNA, 21 bp, Physcomitrella patens
tccggaccaggcttcattccc

SEQ ID NO: 4692 - DNA, 21 bp, Physcomitrella patens
tcggaccaggcatcattcctt

SEQ ID NO: 4693 - DNA, 21 bp, Pinus taeda
tcggaccaggcttcattcccc

SEQ ID NO: 4694 - DNA, 21 bp, Pinus taeda
tcggaccaggcttcattcccc

SEQ ID NO: 4695 - DNA, 21 bp, Populus trichocarpa
tcggaccaggcttcattcccc

SEQ ID NO: 4696 - DNA, 21 bp, Populus trichocarpa
tcggaccaggcttcattcccc

SEQ ID NO: 4697 - DNA, 21 bp, Populus trichocarpa
tcggaccaggcttcattcccc

SEQ ID NO: 4698 - DNA, 21 bp, Populus trichocarpa
tcggaccaggcttcattcccc

SEQ ID NO: 4699 - DNA, 21 bp, Populus trichocarpa
tcggaccaggcttcattcccc

SEQ ID NO: 4700 - DNA, 21 bp, Populus trichocarpa
tcggaccaggcttcattcccc

SEQ ID NO: 4701 - DNA, 21 bp, Populus trichocarpa
tcggaccaggcttcattcccc

SEQ ID NO: 4702 - DNA, 21 bp, Populus trichocarpa
tcggaccaggcttcattcccc

SEQ ID NO: 4703 - DNA, 21 bp, Populus trichocarpa
tcggaccaggcttcattcccc

SEQ ID NO: 4704 - DNA, 21 bp, Populus trichocarpa
tcggaccaggcttcattcccc

SEQ ID NO: 4705 - DNA, 21 bp, Populus trichocarpa
tcggaccaggcttcattcccc

SEQ ID NO: 4706 - DNA, 21 bp, Populus trichocarpa
tcggaccaggcttcattcccc

SEQ ID NO: 4707 - DNA, 21 bp, Populus trichocarpa
tcggaccaggcttcattcccc

SEQ ID NO: 4708 - DNA, 21 bp, Populus trichocarpa
tcggaccaggcttcattcctt

SEQ ID NO: 4709 - DNA, 21 bp, Populus trichocarpa
tcggaccaggcttcattcctt

SEQ ID NO: 4710 - DNA, 21 bp, Populus trichocarpa
tcggaccaggctccattcctt

SEQ ID NO: 4711 - DNA, 21 bp, Populus trichocarpa
tcggaccaggcttcattcctt

SEQ ID NO: 4712 - DNA, 21 bp, Phaseolus vulgaris
tcggaccaggcttcattcccc

SEQ ID NO: 4713 - DNA, 21 bp, Phaseolus vulgaris
tcggaccaggcttcattcccc

SEQ ID NO: 4714 - DNA, 21 bp, Ricinus communis
tcggaccaggcttcattcccc

SEQ ID NO: 4715 - DNA, 21 bp, Ricinus communis
tcggaccaggcttcattcccc

SEQ ID NO: 4716 - DNA, 21 bp, Ricinus communis
tcggaccaggcttcattcccc

SEQ ID NO: 4717 - DNA, 21 bp, Ricinus communis
tcggaccaggcttcattcccc

SEQ ID NO: 4718 - DNA, 21 bp, Ricinus communis
tcggaccaggcttcattcccc

SEQ ID NO: 4719 - DNA, 20 bp, Sorghum bicolor
tcggaccaggcttcattccc

SEQ ID NO: 4720 - DNA, 20 bp, Sorghum bicolor
tcggaccaggcttcattccc

SEQ ID NO: 4721 - DNA, 20 bp, Sorghum bicolor
tcggaccaggcttcattccc

SEQ ID NO: 4722 - DNA, 20 bp, Sorghum bicolor
tcggaccaggcttcattccc

SEQ ID NO: 4723 - DNA, 21 bp, Sorghum bicolor
tcggaccaggcttcaatccct

SEQ ID NO: 4724 - DNA, 21 bp, Sorghum bicolor
tcggaccaggcttcattcctc

SEQ ID NO: 4725 - DNA, 21 bp, Sorghum bicolor
tcggaccaggcttcaatccct

SEQ ID NO: 4726 - DNA, 20 bp, Sorghum bicolor
tcggaccaggcttcattccc

SEQ ID NO: 4727 - DNA, 20 bp, Sorghum bicolor
tcggaccaggcttcattccc

SEQ ID NO: 4728 - DNA, 20 bp, Sorghum bicolor
tcggaccaggcttcattccc

SEQ ID NO: 4729 - DNA, 20 bp, Sorghum bicolor
tcggaccaggcttcattcct

SEQ ID NO: 4730 - DNA, 21 bp, Solanum lycopersicum
tcggaccaggcttcattcccc

SEQ ID NO: 4731 - DNA, 21 bp, Solanum lycopersicum
tcggaccaggcttcattcccc

SEQ ID NO: 4732 - DNA, 21 bp, Selaginella moellendorffii
tcggaccaggcttcattcccc

SEQ ID NO: 4733 - DNA, 21 bp, Selaginella moellendorffii
tcggaccaggcttcattcccc

SEQ ID NO: 4734 - DNA, 21 bp, Selaginella moellendorffii
tcggaccaggcttcattcccc

SEQ ID NO: 4735 - DNA, 21 bp, Saccharum officinarum
tcggaccaggcttcattcccc

SEQ ID NO: 4736 - DNA, 21 bp, Triticum aestivum
ccggaccaggcttcattccca

SEQ ID NO: 4737 - DNA, 21 bp, Theobroma cacao
tcggaccaggcttcattcccc

SEQ ID NO: 4738 - DNA, 20 bp, Theobroma cacao
tcggaccaggcttcattccc

SEQ ID NO: 4739 - DNA, 21 bp, Theobroma cacao
tcggaccaggcttcattcctc

SEQ ID NO: 4740 - DNA, 21 bp, Theobroma cacao
tcggaccaggcttcattcccc

SEQ ID NO: 4741 - DNA, 19 bp, Vitis vinifera
tcggaccaggcttcattcc

SEQ ID NO: 4742 - DNA, 19 bp, Vitis vinifera
tcggaccaggcttcattcc

SEQ ID NO: 4743 - DNA, 21 bp, Vitis vinifera
tcggaccaggcttcattcccc

SEQ ID NO: 4744 - DNA, 21 bp, Vitis vinifera
tcggaccaggcttcattcccc

SEQ ID NO: 4745 - DNA, 21 bp, Vitis vinifera
tcggaccaggcttcattcccc

SEQ ID NO: 4746 - DNA, 21 bp, Vitis vinifera
tcggaccaggcttcattcccc

SEQ ID NO: 4747 - DNA, 21 bp, Vitis vinifera
tcggaccaggcttcattcccc

SEQ ID NO: 4748 - DNA, 21 bp, Vitis vinifera
tcggaccaggcttcattcccc

SEQ ID NO: 4749 - DNA, 21 bp, Zea mays
tcggaccaggcttcattcccc

SEQ ID NO: 4750 - DNA, 20 bp, Zea mays
tcggaccaggcttcattccc

SEQ ID NO: 4751 - DNA, 20 bp, Zea mays
tcggaccaggcttcattccc

SEQ ID NO: 4752 - DNA, 20 bp, Zea mays
tcggaccaggcttcattccc

SEQ ID NO: 4753 - DNA, 20 bp, Zea mays
tcggaccaggcttcattccc

SEQ ID NO: 4754 - DNA, 20 bp, Zea mays
tcggaccaggcttcattccc

SEQ ID NO: 4755 - DNA, 20 bp, Zea mays
tcggaccaggcttcattccc

SEQ ID NO: 4756 - DNA, 20 bp, Zea mays
tcggaccaggcttcattccc

SEQ ID NO: 4757 - DNA, 20 bp, Zea mays
tcggaccaggcttcattccc

SEQ ID NO: 4758 - DNA, 21 bp, Zea mays
tcggaccaggcttcaatccct

SEQ ID NO: 4759 - DNA, 21 bp, Zea mays
tcggaccaggcttcaatccct

SEQ ID NO: 4760 - DNA, 21 bp, Zea mays
tcggaccaggcttcattcctc

SEQ ID NO: 4761 - DNA, 21 bp, Zea mays
tcggaccaggcttcattcctc

SEQ ID NO: 4762 - DNA, 21 bp, Zea mays
tcggaccaggcttcaatccct

SEQ ID NO: 4763 - DNA, 21 bp, Zea mays
tcggaccaggcttcattcccc

SEQ ID NO: 4764 - DNA, 21 bp, Zea mays
tcggaccaggcttcattcccc

SEQ ID NO: 4765 - DNA, 21 bp, Zea mays
tcggaccaggcttcattcccc

SEQ ID NO: 4766 - DNA, 21 bp, Zea mays
tcggaccaggcttcattcccc

SEQ ID NO: 4767 - DNA, 21 bp, Zea mays
tcggaccaggcttcattcccc

SEQ ID NO: 4768 - DNA, 21 bp, Zea mays
tcggaccaggcttcattcccc

SEQ ID NO: 4769 - DNA, 21 bp, Zea mays
tcggaccacgcttcattcccc

SEQ ID NO: 4770 - DNA, 21 bp, Arabidopsis lyrata
tcggaccaggcttcattcccc

SEQ ID NO: 4771 - DNA, 21 bp, Arabidopsis lyrata
tcggaccaggcttcattcccc

SEQ ID NO: 4772 - DNA, 21 bp, Arabidopsis lyrata
tcggaccaggcttcattcccc

SEQ ID NO: 4773 - DNA, 21 bp, Arabidopsis lyrata
tcggaccaggcttcattcccc

SEQ ID NO: 4774 - DNA, 21 bp, Arabidopsis lyrata
tcggaccaggcttcattcccc

SEQ ID NO: 4775 - DNA, 21 bp, Arabidopsis lyrata
tcggaccaggcttcattcccc

SEQ ID NO: 4776 - DNA, 21 bp, Arabidopsis lyrata
tcggaccaggcttcattcccc

SEQ ID NO: 4777 - DNA, 21 bp, Aquilegia coerulea
tcggaccaggcttcattcctc

SEQ ID NO: 4778 - DNA, 21 bp, Aquilegia coerulea
tcggaccaggcttcattcccc

SEQ ID NO: 4779 - DNA, 20 bp, Aquilegia coerulea
tcggaccaggcttcattcct

SEQ ID NO: 4780 - DNA, 21 bp, Aquilegia coerulea
tcggaccaggcttcattcctc

SEQ ID NO: 4781 - DNA, 21 bp, Aquilegia coerulea
tcggaccaggcttcattcccc

SEQ ID NO: 4782 - DNA, 21 bp, Arabidopsis thaliana
tcggaccaggcttcattcccc

SEQ ID NO: 4783 - DNA, 21 bp, Arabidopsis thaliana
tcggaccaggcttcattcccc

SEQ ID NO: 4784 - DNA, 21 bp, Arabidopsis thaliana
tcggaccaggcttcattcccc

SEQ ID NO: 4785 - DNA, 21 bp, Arabidopsis thaliana
tcggaccaggcttcattcccc

SEQ ID NO: 4786 - DNA, 21 bp, Arabidopsis thaliana
tcggaccaggcttcattcccc

SEQ ID NO: 4787 - DNA, 21 bp, Arabidopsis thaliana
tcggaccaggcttcattcccc

SEQ ID NO: 4788 - DNA, 21 bp, Arabidopsis thaliana
tcggaccaggcttcattcccc

SEQ ID NO: 4789 - DNA, 21 bp, Brachypodium distachyon
tcggaccaggcttcattcccc

SEQ ID NO: 4790 - DNA, 21 bp, Brachypodium distachyon
tcggaccaggcttcattcccc

SEQ ID NO: 4791 - DNA, 21 bp, Brachypodium distachyon
tcggaccaggcttcattcccc

SEQ ID NO: 4792 - DNA, 21 bp, Brachypodium distachyon
tcggaccaggcttcattcccc

SEQ ID NO: 4793 - DNA, 21 bp, Brachypodium distachyon
tcggaccaggcttcattcccc

SEQ ID NO: 4794 - DNA, 21 bp, Brachypodium distachyon
ctcggaccaggcttcattccc

SEQ ID NO: 4795 - DNA, 21 bp, Brachypodium distachyon
tctcggaccaggcttcattcc

SEQ ID NO: 4796 - DNA, 21 bp, Brassica napus
tcggaccaggcttcattcccc

SEQ ID NO: 4797 - DNA, 21 bp, Brassica napus
tcggaccaggcttcattcccc

SEQ ID NO: 4798 - DNA, 21 bp, Brassica napus
tcggaccaggcttcattcccc

SEQ ID NO: 4799 - DNA, 21 bp, Brassica napus
tcggaccaggcttcattcccc

SEQ ID NO: 4800 - DNA, 20 bp, Citrus x paradisi x Poncirus trifoliata
tcggaccaggcttcattccc

SEQ ID NO: 4801 - DNA, 22 bp, Citrus reticulata
tcggaccaggcttcattcccgt

SEQ ID NO: 4802 - DNA, 22 bp, Citrus reticulata
tcggaccaggcttcattccctt

SEQ ID NO: 4803 - DNA, 21 bp, Citrus sinensis
tcggaccaggcttcattcccc

SEQ ID NO: 4804 - DNA, 22 bp, Citrus sinensis
tcggaccaggcttcattccccc

SEQ ID NO: 4805 - DNA, 22 bp, Citrus sinensis
tcggaccaggcttcattcccgt

SEQ ID NO: 4806 - DNA, 20 bp, Citrus sinensis
tcggaccaggcttcattccc

SEQ ID NO: 4807 - DNA, 21 bp, Citrus sinensis
tcggaccaggcttcattccct

SEQ ID NO: 4808 - DNA, 21 bp, Citrus sinensis
tcggaccaggcttcattcccc

SEQ ID NO: 4809 - DNA, 22 bp, Citrus trifoliata
tcggaccaggcttcattccccc

SEQ ID NO: 4810 - DNA, 21 bp, Festuca arundinacea
ccggaccaggcttcatcccag

SEQ ID NO: 4811 - DNA, 21 bp, Festuca glaucescens x Lolium multiflorum
tcggaccaggcttcatccccc

SEQ ID NO: 4812 - DNA, 21 bp, Gossypium hirsutum
tcggaccaggcttcattcccc

SEQ ID NO: 4813 - DNA, 21 bp, Gossypium hirsutum
tcggaccaggcttcattcccc

SEQ ID NO: 4814 - DNA, 21 bp, Glycine max
tcggaccaggcttcattcccc

SEQ ID NO: 4815 - DNA, 21 bp, Glycine max
tcggaccaggcttcattcccc

SEQ ID NO: 4816 - DNA, 21 bp, Glycine max
tcggaccaggcttcattcccc

SEQ ID NO: 4817 - DNA, 21 bp, Glycine max
tcggaccaggcttcattcccc

SEQ ID NO: 4818 - DNA, 21 bp, Glycine max
tcggaccaggcttcattcccg

SEQ ID NO: 4819 - DNA, 21 bp, Glycine max
tcggaccaggcttcattccct

SEQ ID NO: 4820 - DNA, 21 bp, Hordeum vulgare
tcggaccaggcttcattcccc

SEQ ID NO: 4821 - DNA, 21 bp, Hordeum vulgare
tcggaccaggcttcattcccc

SEQ ID NO: 4822 - DNA, 21 bp, Hordeum vulgare
tcggaccaggcttcattcccc

SEQ ID NO: 4823 - DNA, 21 bp, Hordeum vulgare subsp. Vulgare
tcggaccaggcttcattcccc

SEQ ID NO: 4824 - DNA, 21 bp, Ipomoea nil
tcggaccaggcttcattcctc

SEQ ID NO: 4825 - DNA, 21 bp, Medicago truncatula
tcggaccaggcttcattcccc

SEQ ID NO: 4826 - DNA, 21 bp, Medicago truncatula
tcggaccaggcttcattccta

SEQ ID NO: 4827 - DNA, 21 bp, Medicago truncatula
tcggaccaggcttcattcctc

SEQ ID NO: 4828 - DNA, 21 bp, Medicago truncatula
tcgggccaggcttcatccccc

SEQ ID NO: 4829 - DNA, 21 bp, Medicago truncatula
tcggaccaggcttcattcccc

SEQ ID NO: 4830 - DNA, 21 bp, Medicago truncatula
tcggaccaggcttcattcctc

SEQ ID NO: 4831 - DNA, 21 bp, Medicago truncatula
tcggaccaggcttcattcccc

SEQ ID NO: 4832 - DNA, 21 bp, Medicago truncatula
tcggaccaggcttcattcccc

SEQ ID NO: 4833 - DNA, 21 bp, Nicotiana sylvestris
tcggaccaggcttcattcccc

SEQ ID NO: 4834 - DNA, 21 bp, Oryza sativa
tcggaccaggcttcattcccc

SEQ ID NO: 4835 - DNA, 21 bp, Oryza sativa
tcggaccaggcttcattcccc

SEQ ID NO: 4836 - DNA, 21 bp, Oryza sativa
tcggaccaggcttcattcccc

SEQ ID NO: 4837 - DNA, 21 bp, Oryza sativa
tcggaccaggcttcattcccc

SEQ ID NO: 4838 - DNA, 21 bp, Oryza sativa
tcgaaccaggcttcattcccc

SEQ ID NO: 4839 - DNA, 21 bp, Oryza sativa
tcggaccaggcttcattcccc

SEQ ID NO: 4840 - DNA, 21 bp, Oryza sativa
tcggaccaggcttcattcctc

SEQ ID NO: 4841 - DNA, 21 bp, Oryza sativa
tcggaccaggcttcattcctc

SEQ ID NO: 4842 - DNA, 21 bp, Oryza sativa
tcggatcaggcttcattcctc

SEQ ID NO: 4843 - DNA, 21 bp, Oryza sativa
tcggatcaggcttcattcctc

SEQ ID NO: 4844 - DNA, 21 bp, Oryza sativa
tcggaccaggcttcaatccct

SEQ ID NO: 4845 - DNA, 21 bp, Oryza sativa
tcggaccaggcttcaatccct

SEQ ID NO: 4846 - DNA, 21 bp, Oryza sativa
tcggaccaggcttcattccct

SEQ ID NO: 4847 - DNA, 21 bp, Oryza sativa
tcggaccaggcttcattcccc

SEQ ID NO: 4848 - DNA, 21 bp, Picea abies
tcggaccaggcttcattcctc

SEQ ID NO: 4849 - DNA, 21 bp, Picea abies
tcggaccaggcttcattcctt

SEQ ID NO: 4850 - DNA, 21 bp, Picea glauca
tcggaccaggcttcattcctt

SEQ ID NO: 4851 - DNA, 21 bp, Physcomitrella patens
tcggaccaggcttcattcccc

SEQ ID NO: 4852 - DNA, 21 bp, Physcomitrella patens
tcggaccaggcttcattcccc

SEQ ID NO: 4853 - DNA, 21 bp, Physcomitrella patens
tcggaccaggcttcattcccc

SEQ ID NO: 4854 - DNA, 21 bp, Physcomitrella patens
tcggaccaggcttcattcccc

SEQ ID NO: 4855 - DNA, 21 bp, Physcomitrella patens
tcggaccaggcttcattcccc

SEQ ID NO: 4856 - DNA, 21 bp, Physcomitrella patens
tcggaccaggcttcattcccc

SEQ ID NO: 4857 - DNA, 21 bp, Physcomitrella patens
tcggaccaggcttcattcccc

SEQ ID NO: 4858 - DNA, 21 bp, Physcomitrella patens
tcggaccaggcttcattcccc

SEQ ID NO: 4859 - DNA, 21 bp, Physcomitrella patens
tcggaccaggcttcattcccc

SEQ ID NO: 4860 - DNA, 21 bp, Physcomitrella patens
tccggaccaggcttcattccc

SEQ ID NO: 4861 - DNA, 21 bp, Physcomitrella patens
tccggaccaggcttcattccc

SEQ ID NO: 4862 - DNA, 21 bp, Physcomitrella patens
tccggaccaggcttcattccc

SEQ ID NO: 4863 - DNA, 21 bp, Physcomitrella patens
tcggaccaggcatcattcctt

SEQ ID NO: 4864 - DNA, 21 bp, Pinus taeda
tcggaccaggcttcattcccc

SEQ ID NO: 4865 - DNA, 21 bp, Pinus taeda
tcggaccaggcttcattcccc

SEQ ID NO: 4866 - DNA, 21 bp, Pinus taeda
ccggaccaggcttcatcccag

SEQ ID NO: 4867 - DNA, 21 bp, Populus trichocarpa
tcggaccaggcttcattcccc

SEQ ID NO: 4868 - DNA, 21 bp, Populus trichocarpa
tcggaccaggcttcattcccc

SEQ ID NO: 4869 - DNA, 21 bp, Populus trichocarpa
tcggaccaggcttcattcccc

SEQ ID NO: 4870 - DNA, 21 bp, Populus trichocarpa
tcggaccaggcttcattcccc

SEQ ID NO: 4871 - DNA, 21 bp, Populus trichocarpa
tcggaccaggcttcattcccc

SEQ ID NO: 4872 - DNA, 21 bp, Populus trichocarpa
tcggaccaggcttcattcccc

SEQ ID NO: 4873 - DNA, 21 bp, Populus trichocarpa
tcggaccaggcttcattcccc

SEQ ID NO: 4874 - DNA, 21 bp, Populus trichocarpa
tcggaccaggcttcattcccc

SEQ ID NO: 4875 - DNA, 21 bp, Populus trichocarpa
tcggaccaggcttcattcccc

SEQ ID NO: 4876 - DNA, 21 bp, Populus trichocarpa
tcggaccaggcttcattcccc

SEQ ID NO: 4877 - DNA, 21 bp, Populus trichocarpa
tcggaccaggcttcattcccc

SEQ ID NO: 4878 - DNA, 21 bp, Populus trichocarpa
tcggaccaggcttcattcccc

SEQ ID NO: 4879 - DNA, 21 bp, Populus trichocarpa
tcggaccaggcttcattcccc

SEQ ID NO: 4880 - DNA, 21 bp, Populus trichocarpa
tcggaccaggcttcattcctt

SEQ ID NO: 4881 - DNA, 21 bp, Populus trichocarpa
tcggaccaggcttcattcctt

SEQ ID NO: 4882 - DNA, 21 bp, Populus trichocarpa
tcggaccaggcttcattcctt

SEQ ID NO: 4883 - DNA, 21 bp, Phaseolus vulgaris
tcggaccaggcttcattcccc

SEQ ID NO: 4884 - DNA, 21 bp, Phaseolus vulgaris
tcggaccaggcttcattcccc

SEQ ID NO: 4885 - DNA, 21 bp, Ricinus communis
tcggaccaggcttcattcccc

SEQ ID NO: 4886 - DNA, 21 bp, Ricinus communis
tcggaccaggcttcattcccc

SEQ ID NO: 4887 - DNA, 21 bp, Ricinus communis
tcggaccaggcttcattcccc

SEQ ID NO: 4888 - DNA, 21 bp, Ricinus communis
tcggaccaggcttcattcccc

SEQ ID NO: 4889 - DNA, 21 bp, Ricinus communis
tcggaccaggcttcattcccc

SEQ ID NO: 4890 - DNA, 20 bp, Sorghum bicolor
tcggaccaggcttcattccc

SEQ ID NO: 4891 - DNA, 20 bp, Sorghum bicolor
tcggaccaggcttcattccc

SEQ ID NO: 4892 - DNA, 20 bp, Sorghum bicolor
tcggaccaggcttcattccc

SEQ ID NO: 4893 - DNA, 20 bp, Sorghum bicolor
tcggaccaggcttcattccc

SEQ ID NO: 4894 - DNA, 21 bp, Sorghum bicolor
tcggaccaggcttcaatccct

SEQ ID NO: 4895 - DNA, 21 bp, Sorghum bicolor
tcggaccaggcttcattcctc

SEQ ID NO: 4896 - DNA, 21 bp, Sorghum bicolor
tcggaccaggcttcaatccct

SEQ ID NO: 4897 - DNA, 20 bp, Sorghum bicolor
tcggaccaggcttcattccc

SEQ ID NO: 4898 - DNA, 20 bp, Sorghum bicolor
tcggaccaggcttcattccc

SEQ ID NO: 4899 - DNA, 20 bp, Sorghum bicolor
tcggaccaggcttcattccc

SEQ ID NO: 4900 - DNA, 20 bp, Sorghum bicolor
tcggaccaggcttcattcct

SEQ ID NO: 4901 - DNA, 21 bp, Solanum lycopersicum
tcggaccaggcttcattcccc

SEQ ID NO: 4902 - DNA, 21 bp, Solanum lycopersicum
tcggaccaggcttcattcccc

SEQ ID NO: 4903 - DNA, 21 bp, Selaginella moellendorffii
tcggaccaggcttcattcccc

SEQ ID NO: 4904 - DNA, 21 bp, Selaginella moellendorffii
tcggaccaggcttcattcccc

SEQ ID NO: 4905 - DNA, 21 bp, Selaginella moellendorffii
tcggaccaggcttcattcccc

SEQ ID NO: 4906 - DNA, 21 bp, Saccharum officinarum
tcggaccaggcttcattcccc

SEQ ID NO: 4907 - DNA, 21 bp, Triticum aestivum
ccggaccaggcttcattccca

SEQ ID NO: 4908 - DNA, 21 bp, Theobroma cacao
tcggaccaggcttcattcccc

SEQ ID NO: 4909 - DNA, 20 bp, Theobroma cacao
tcggaccaggcttcattccc

SEQ ID NO: 4910 - DNA, 21 bp, Theobroma cacao
tcggaccaggcttcattcctc

SEQ ID NO: 4911 - DNA, 21 bp, Theobroma cacao
tcggaccaggcttcattcccc

SEQ ID NO: 4912 - DNA, 19 bp, Vitis vinifera
tcggaccaggcttcattcc

SEQ ID NO: 4913 - DNA, 19 bp, Vitis vinifera
tcggaccaggcttcattcc

SEQ ID NO: 4914 - DNA, 21 bp, Vitis vinifera
tcggaccaggcttcattcccc

SEQ ID NO: 4915 - DNA, 21 bp, Vitis vinifera
tcggaccaggcttcattcccc

SEQ ID NO: 4916 - DNA, 21 bp, Vitis vinifera
tcggaccaggcttcattcccc

SEQ ID NO: 4917 - DNA, 21 bp, Vitis vinifera
tcggaccaggcttcattcccc

SEQ ID NO: 4918 - DNA, 21 bp, Vitis vinifera
tcggaccaggcttcattcccc

SEQ ID NO: 4919 - DNA, 21 bp, Vitis vinifera
tcggaccaggcttcattcccc

SEQ ID NO: 4920 - DNA, 21 bp, Zea mays
tcggaccaggcttcattcccc

SEQ ID NO: 4921 - DNA, 20 bp, Zea mays
tcggaccaggcttcattccc

SEQ ID NO: 4922 - DNA, 20 bp, Zea mays
tcggaccaggcttcattccc

SEQ ID NO: 4923 - DNA, 20 bp, Zea mays
tcggaccaggcttcattccc

SEQ ID NO: 4924 - DNA, 20 bp, Zea mays
tcggaccaggcttcattccc

SEQ ID NO: 4925 - DNA, 20 bp, Zea mays
tcggaccaggcttcattccc

SEQ ID NO: 4926 - DNA, 20 bp, Zea mays
tcggaccaggcttcattccc

SEQ ID NO: 4927 - DNA, 20 bp, Zea mays
tcggaccaggcttcattccc

SEQ ID NO: 4928 - DNA, 20 bp, Zea mays
tcggaccaggcttcattccc

SEQ ID NO: 4929 - DNA, 21 bp, Zea mays
tcggaccaggcttcaatccct

SEQ ID NO: 4930 - DNA, 21 bp, Zea mays
tcggaccaggcttcaatccct

SEQ ID NO: 4931 - DNA, 21 bp, Zea mays
tcggaccaggcttcattcctc

SEQ ID NO: 4932 - DNA, 21 bp, Zea mays
tcggaccaggcttcattcctc

SEQ ID NO: 4933 - DNA, 21 bp, Zea mays
tcggaccaggcttcaatccct

SEQ ID NO: 4934 - DNA, 21 bp, Zea mays
tcggaccaggcttcattcccc

SEQ ID NO: 4935 - DNA, 21 bp, Zea mays
tcggaccaggcttcattcccc

SEQ ID NO: 4936 - DNA, 21 bp, Zea mays
tcggaccaggcttcattcccc

SEQ ID NO: 4937 - DNA, 21 bp, Zea mays
tcggaccaggcttcattcccc

SEQ ID NO: 4938 - DNA, 21 bp, Zea mays
tcggaccaggcttcattcccc

SEQ ID NO: 4939 - DNA, 21 bp, Zea mays
tcggaccaggcttcattcccc

SEQ ID NO: 4940 - DNA, 21 bp, Zea mays
tcggaccacgcttcattcccc

SEQ ID NO: 4941 - DNA, 20 bp, Arachis hypogaea
ttggcattctgtccacctcc

SEQ ID NO: 4942 - DNA, 20 bp, Arabidopsis lyrata
ttggcattctgtccacctcc

SEQ ID NO: 4943 - DNA, 20 bp, Arabidopsis lyrata
ttggcattctgtccacctcc

SEQ ID NO: 4944 - DNA, 20 bp, Arabidopsis thaliana
ttggcattctgtccacctcc

SEQ ID NO: 4945 - DNA, 20 bp, Arabidopsis thaliana
ttggcattctgtccacctcc

SEQ ID NO: 4946 - DNA, 20 bp, Brachypodium distachyon
ttggcattctgtccacctcc

SEQ ID NO: 4947 - DNA, 20 bp, Citrus sinensis
ttggcattctgtccacctcc

SEQ ID NO: 4948 - DNA, 20 bp, Gossypium hirsutum
ttggcattctgtccacctcc

SEQ ID NO: 4949 - DNA, 20 bp, Gossypium hirsutum
ttggcattctgtccacctcc

SEQ ID NO: 4950 - DNA, 20 bp, Gossypium hirsutum
ttggcattctgtccacctcc

SEQ ID NO: 4951 - DNA, 20 bp, Glycine max
aggtgggcatactgtcaact

SEQ ID NO: 4952 - DNA, 20 bp, Oryza sativa
ttggcattctgtccacctcc

SEQ ID NO: 4953 - DNA, 20 bp, Populus trichocarpa
ttggcattctgtccacctcc

SEQ ID NO: 4954 - DNA, 20 bp, Populus trichocarpa
ttggcattctgtccacctcc

SEQ ID NO: 4955 - DNA, 20 bp, Sorghum bicolor
ttggcattctgtccacctcc

SEQ ID NO: 4956 - DNA, 20 bp, Sorghum bicolor
ttggcattctgtccacctcc

SEQ ID NO: 4957 - DNA, 20 bp, Theobroma cacao
ttggcattctgtccacctcc

SEQ ID NO: 4958 - DNA, 20 bp, Theobroma cacao
ttggcattctgtccacctcc

SEQ ID NO: 4959 - DNA, 22 bp, Vitis vinifera
ttggcattctgtccacctccat

SEQ ID NO: 4960 - DNA, 22 bp, Vitis vinifera
ttggcattctgtccacctccat

SEQ ID NO: 4961 - DNA, 20 bp, Zea mays
ttggcattctgtccacctcc

SEQ ID NO: 4962 - DNA, 20 bp, Zea mays
ttggcattctgtccacctcc

SEQ ID NO: 4963 - DNA, 21 bp, Arachis hypogaea
tgaagctgccagcatgatctt

SEQ ID NO: 4964 - DNA, 21 bp, Arabidopsis lyrata
tgaagctgccagcatgatcta

SEQ ID NO: 4965 - DNA, 21 bp, Arabidopsis lyrata
tgaagctgccagcatgatcta

SEQ ID NO: 4966 - DNA, 23 bp, Arabidopsis lyrata
ggtcatgctctgacagcctcact

SEQ ID NO: 4967 - DNA, 21 bp, Arabidopsis lyrata
taagctgccagcatgatcttg

SEQ ID NO: 4968 - DNA, 22 bp, Arabidopsis lyrata
tgaagctgccagcatgatctgg

SEQ ID NO: 4969 - DNA, 21 bp, Aquilegia coerulea
tcaagctgccagcatgatcta

SEQ ID NO: 4970 - DNA, 21 bp, Arabidopsis thaliana
tgaagctgccagcatgatcta

SEQ ID NO: 4971 - DNA, 21 bp, Arabidopsis thaliana
tgaagctgccagcatgatcta

SEQ ID NO: 4972 - DNA, 21 bp, Arabidopsis thaliana
taagctgccagcatgatcttg

SEQ ID NO: 4973 - DNA, 22 bp, Arabidopsis thaliana
tgaagctgccagcatgatctgg

SEQ ID NO: 4974 - DNA, 21 bp, Arabidopsis thaliana
tgaagctgccagcatgatctg

SEQ ID NO: 4975 - DNA, 21 bp, Brachypodium distachyon
tgaagctgccagcatgatcta

SEQ ID NO: 4976 - DNA, 21 bp, Brachypodium distachyon
tgaagctgccagcatgatcta

SEQ ID NO: 4977 - DNA, 21 bp, Brachypodium distachyon
tgaagctgccagcatgatcta

SEQ ID NO: 4978 - DNA, 22 bp, Brachypodium distachyon
tgaagctgccagcatgatctga

SEQ ID NO: 4979 - DNA, 22 bp, Brachypodium distachyon
tgaagctgccagcatgatctga

SEQ ID NO: 4980 - DNA, 22 bp, Brassica napus
tgaagctgccagcatgatctaa

SEQ ID NO: 4981 - DNA, 22 bp, Brassica napus
tgaagctgccagcatgatctaa

SEQ ID NO: 4982 - DNA, 21 bp, Brassica napus
tgaagctgccagcatgatcta

SEQ ID NO: 4983 - DNA, 21 bp, Brassica rapa
tgaagctgccagcatgatcta

SEQ ID NO: 4984 - DNA, 21 bp, Brassica rapa
tgaagctgccagcatgatcta

SEQ ID NO: 4985 - DNA, 21 bp, Brassica rapa
tgaagctgccagcatgatcta

SEQ ID NO: 4986 - DNA, 21 bp, Brassica rapa
tgaagctgccagcatgatcta

SEQ ID NO: 4987 - DNA, 22 bp, Citrus clementine
tgaagctgccagcatgatctga

SEQ ID NO: 4988 - DNA, 22 bp, Citrus clementine
tgaagctgccagcatgatctga

SEQ ID NO: 4989 - DNA, 21 bp, Citrus clementina
tgaagctgccagcatgatctg

SEQ ID NO: 4990 - DNA, 21 bp, Citrus sinensis
tgaagctgccagcatgatctg

SEQ ID NO: 4991 - DNA, 21 bp, Citrus sinensis
tgaagctgccagcatgatctt

SEQ ID NO: 4992 - DNA, 21 bp, Citrus sinensis
tgaagctgccagcatgatctg

SEQ ID NO: 4993 - DNA, 22 bp, Citrus trifoliata
tgaagctgccagcatgatctga

SEQ ID NO: 4994 - DNA, 21 bp, Gossypium hirsutum
tgaagctgccagcatgatcta

SEQ ID NO: 4995 - DNA, 21 bp, Glycine max
tgaagctgccagcatgatcta

SEQ ID NO: 4996 - DNA, 21 bp, Glycine max
tgaagctgccagcatgatcta

SEQ ID NO: 4997 - DNA, 21 bp, Glycine max
tgaagctgccagcatgatctg

SEQ ID NO: 4998 - DNA, 21 bp, Glycine max
tgaagctgccagcatgatcta

SEQ ID NO: 4999 - DNA, 21 bp, Glycine max
tgaagctgccagcatgatctt

SEQ ID NO: 5000 - DNA, 21 bp, Glycine max
tgaagctgccagcatgatctt

SEQ ID NO: 5001 - DNA, 22 bp, Glycine max
tgaagctgccagcatgatctga

SEQ ID NO: 5002 - DNA, 20 bp, Glycine max
tgaagctgccagcatgatct

SEQ ID NO: 5003 - DNA, 21 bp, Glycine max
tgaagctgccagcatgatctg

SEQ ID NO: 5004 - DNA, 21 bp, Glycine soja
tgaagctgccagcatgatctg

SEQ ID NO: 5005 - DNA, 21 bp, Ipomoea nil
tgaagctgccagcatgatctg

SEQ ID NO: 5006 - DNA, 21 bp, Lotus japonicus
tgaagctgccagcatgatctg

SEQ ID NO: 5007 - DNA, 21 bp, Medicago truncatula
tgaagctgccagcatgatcta

SEQ ID NO: 5008 - DNA, 21 bp, Oryza sativa
tgaagctgccagcatgatcta

SEQ ID NO: 5009 - DNA, 22 bp, Oryza sativa
atcatgcatgacagcctcattt

SEQ ID NO: 5010 - DNA, 21 bp, Oryza sativa
tgaagctgccagcatgatcta

SEQ ID NO: 5011 - DNA, 21 bp, Oryza sativa
tgaagctgccagcatgatcta

SEQ ID NO: 5012 - DNA, 21 bp, Oryza sativa
tgaagctgccagcatgatctg

SEQ ID NO: 5013 - DNA, 21 bp, Oryza sativa
tgaagctgccagcatgatctg

SEQ ID NO: 5014 - DNA, 21 bp, Oryza sativa
tgaagctgccagcatgatctg

SEQ ID NO: 5015 - DNA, 21 bp, Oryza sativa
tgaagctgccagcatgatctg

SEQ ID NO: 5016 - DNA, 21 bp, Oryza sativa
tgaagctgccagcatgatctg

SEQ ID NO: 5017 - DNA, 21 bp, Oryza sativa
tgaagctgccagcatgatctg

SEQ ID NO: 5018 - DNA, 21 bp, Oryza sativa
tgaagctgccagcatgatctg

SEQ ID NO: 5019 - DNA, 21 bp, Oryza sativa
tgaagctgccagcatgatctg

SEQ ID NO: 5020 - DNA, 21 bp, Oryza sativa
tgaagctgccagcatgatctg

SEQ ID NO: 5021 - DNA, 21 bp, Phaseolus coccineus
tgaagctgccagcatgatctt

SEQ ID NO: 5022 - DNA, 21 bp, Populus tremula x Populus tremuloides
tgaagctgccagcatgatcta

SEQ ID NO: 5023 - DNA, 21 bp, Populus tremula x Populus tremuloides
tgaagctgccagcatgatctg

SEQ ID NO: 5024 - DNA, 21 bp, Physcomitrella patens
ggaagctgccagcatgatcct

SEQ ID NO: 5025 - DNA, 21 bp, Populus trichocarpa
tgaagctgccagcatgatcta

SEQ ID NO: 5026 - DNA, 21 bp, Populus trichocarpa
tgaagctgccagcatgatcta

SEQ ID NO: 5027 - DNA, 21 bp, Populus trichocarpa
tgaagctgccagcatgatcta

SEQ ID NO: 5028 - DNA, 21 bp, Populus trichocarpa
tgaagctgccagcatgatcta

SEQ ID NO: 5029 - DNA, 21 bp, Populus trichocarpa
tgaagctgccagcatgatctg

SEQ ID NO: 5030 - DNA, 21 bp, Populus trichocarpa
tgaagctgccagcatgatctt

SEQ ID NO: 5031 - DNA, 21 bp, Populus trichocarpa
tgaagctgccagcatgatctt

SEQ ID NO: 5032 - DNA, 21 bp, Populus trichocarpa
tgaagctgccaacatgatctg

SEQ ID NO: 5033 - DNA, 21 bp, Populus tremuloides
tgaagctgccagcatgatctg

SEQ ID NO: 5034 - DNA, 21 bp, Ricinus communis
tgaagctgccagcatgatcta

SEQ ID NO: 5035 - DNA, 21 bp, Ricinus communis
tgaagctgccagcatgatcta

SEQ ID NO: 5036 - DNA, 22 bp, Ricinus communis
tgaagctgccagcatgatctgg

SEQ ID NO: 5037 - DNA, 21 bp, Sorghum bicolor
tgaagctgccagcatgatcta

SEQ ID NO: 5038 - DNA, 21 bp, Sorghum bicolor
tgaagctgccagcatgatcta

SEQ ID NO: 5039 - DNA, 21 bp, Sorghum bicolor
tgaagctgccagcatgatctg

SEQ ID NO: 5040 - DNA, 21 bp, Sorghum bicolor
tgaagctgccagcatgatctg

SEQ ID NO: 5041 - DNA, 21 bp, Sorghum bicolor
tgaagctgccagcatgatctg

SEQ ID NO: 5042 - DNA, 21 bp, Sorghum bicolor
tgaagctgccagcatgatctg

SEQ ID NO: 5043 - DNA, 21 bp, Sorghum bicolor
tgaagctgccagcatgatctg

SEQ ID NO: 5044 - DNA, 21 bp, Sorghum bicolor
tgaagctgccagcatgatctg

SEQ ID NO: 5045 - DNA, 21 bp, Sorghum bicolor
tgaagctgccagcatgatcta

SEQ ID NO: 5046 - DNA, 21 bp, Solanum lycopersicum
tgaagctgccagcatgatcta

SEQ ID NO: 5047 - DNA, 21 bp, Saccharum officinarum
tgaagctgccagcatgatctg

SEQ ID NO: 5048 - DNA, 21 bp, Saccharum officinarum
tgaagctgccagcatgatctg

SEQ ID NO: 5049 - DNA, 21 bp, Saccharum spp
tgaagctgccagcatgatctg

SEQ ID NO: 5050 - DNA, 21 bp, Saccharum spp
tgaagctgccagcatgatctg

SEQ ID NO: 5051 - DNA, 21 bp, Triticum aestivum
tgaagctgccagcatgatcta

SEQ ID NO: 5052 - DNA, 21 bp, Triticum aestivum
tgaagctgacagcatgatcta

SEQ ID NO: 5053 - DNA, 21 bp, Theobroma cacao
tgaagctgccagcatgatcta

SEQ ID NO: 5054 - DNA, 21 bp, Theobroma cacao
tgaagctgccagcatgatcta

SEQ ID NO: 5055 - DNA, 21 bp, Theobroma cacao
tgaagctgccagcatgatctt

SEQ ID NO: 5056 - DNA, 21 bp, Vitis vinifera
tgaagctgccagcatgatctg

SEQ ID NO: 5057 - DNA, 21 bp, Vitis vinifera
tgaagctgccagcatgatcta

SEQ ID NO: 5058 - DNA, 21 bp, Vitis vinifera
tgaagctgccagcatgatctc

SEQ ID NO: 5059 - DNA, 21 bp, Vitis vinifera
tgaagctgccagcatgatcta

SEQ ID NO: 5060 - DNA, 21 bp, Vitis vinifera
tgaagctgccagcatgatcta

SEQ ID NO: 5061 - DNA, 21 bp, Zea mays
tgaagctgccagcatgatcta

SEQ ID NO: 5062 - DNA, 21 bp, Zea mays
tgaagctgccagcatgatcta

SEQ ID NO: 5063 - DNA, 23 bp, Zea mays
gatcatgctgtgacagtttcact

SEQ ID NO: 5064 - DNA, 21 bp, Zea mays
tgaagctgccagcatgatcta

SEQ ID NO: 5065 - DNA, 21 bp, Zea mays
tgaagctgccagcatgatcta

SEQ ID NO: 5066 - DNA, 21 bp, Zea mays
tgaagctgccagcatgatctg

SEQ ID NO: 5067 - DNA, 21 bp, Zea mays
tgaagctgccagcatgatctg

SEQ ID NO: 5068 - DNA, 21 bp, Zea mays
tgaagctgccagcatgatctg

SEQ ID NO: 5069 - DNA, 21 bp, Zea mays
tgaagctgccagcatgatctg

SEQ ID NO: 5070 - DNA, 21 bp, Zea mays
tgaagctgccagcatgatctg

SEQ ID NO: 5071 - DNA, 21 bp, Zea mays
tgaagctgccagcatgatctg

SEQ ID NO: 5072 - DNA, 21 bp, Zea mays
tgaagctgccagcatgatctg

SEQ ID NO: 5073 - DNA, 21 bp, Zea mays
tgaagctgccagcatgatctg

SEQ ID NO: 5074 - DNA, 21 bp, Zea mays
tgaagctgccagcatgatctg

SEQ ID NO: 5075 - DNA, 21 bp, Zea mays
tgaagctgccagcatgatcta

SEQ ID NO: 5076 - DNA, 21 bp, Zea mays
tgaagctgccagcatgatcta

SEQ ID NO: 5077 - DNA, 21 bp, Zea mays
tgaagctgccagcatgatcta

SEQ ID NO: 5078 - DNA, 21 bp, Zea mays
tgaagctgccagcatgatcta

SEQ ID NO: 5079 - DNA, 21 bp, Zea mays
tgaagctgccagcatgatcta

SEQ ID NO: 5080 - DNA, 21 bp, Zea mays
tgaagctgccagcatgatcta

SEQ ID NO: 5081 - DNA, 21 bp, Zea mays
tgaagctgccagcatgatcta

SEQ ID NO: 5082 - DNA, 21 bp, Medicago truncatula
tcaaagggaggtgtggagtag

SEQ ID NO: 5083 - DNA, 21 bp, Phaseolus vulgaris
tcaaagggagttgtaggggaa

SEQ ID NO: 5084 - DNA, 21 bp, Arabidopsis lyrata
tcgataaacctctgcatccag

SEQ ID NO: 5085 - DNA, 21 bp, Arabidopsis lyrata
tcgataaacctctgcatccag

SEQ ID NO: 5086 - DNA, 21 bp, Arabidopsis thaliana
tcgataaacctctgcatccag

SEQ ID NO: 5087 - DNA, 21 bp, Arabidopsis thaliana
tcgataaacctctgcatccag

SEQ ID NO: 5088 - DNA, 21 bp, Brachypodium distachyon
tcgataaacctctgcatccgg

SEQ ID NO: 5089 - DNA, 21 bp, Carica papaya
tcgataaacctctgcatccag

SEQ ID NO: 5090 - DNA, 21 bp, Citrus sinensis
tcgataaacctctgcatccag

SEQ ID NO: 5091 - DNA, 21 bp, Citrus sinensis
tcgataaacctctgcatccag

SEQ ID NO: 5092 - DNA, 21 bp, Gossypium hirsutum
tcgataaacctctgcatccag

SEQ ID NO: 5093 - DNA, 20 bp, Glycine max
tcgataaacctctgcatcca

SEQ ID NO: 5094 - DNA, 21 bp, Glycine max
tcgataaacctctgcatccag

SEQ ID NO: 5095 - DNA, 21 bp, Glycine max
tcgataaacctctgcatccag

SEQ ID NO: 5096 - DNA, 21 bp, Lupinus luteus
tcgataaacctctgcatccag

SEQ ID NO: 5097 - DNA, 21 bp, Lactuca sativa
tcgataaacctctgcatccag

SEQ ID NO: 5098 - DNA, 21 bp, Malus x domestica
tcgataaacctttgcatccag

SEQ ID NO: 5099 - DNA, 21 bp, Medicago truncatula
tcgataaacctctgcatccag

SEQ ID NO: 5100 - DNA, 20 bp, Medicago truncatula
tcgataaacctctgcatcca

SEQ ID NO: 5101 - DNA, 21 bp, Medicago truncatula
tcgatgaaccgctgcatccag

SEQ ID NO: 5102 - DNA, 21 bp, Medicago truncatula
tcgataaacctctgcatccag

SEQ ID NO: 5103 - DNA, 21 bp, Oryza sativa
tcgataagcctctgcatccag

SEQ ID NO: 5104 - DNA, 21 bp, Oryza sativa
tcgataagcctctgcatccag

SEQ ID NO: 5105 - DNA, 21 bp, Populus trichocarpa
tcgataaacctctgcatccag

SEQ ID NO: 5106 - DNA, 21 bp, Populus trichocarpa
tcgataaacctctgcatccag

SEQ ID NO: 5107 - DNA, 21 bp, Populus trichocarpa
tcgataaacctctgcatccag

SEQ ID NO: 5108 - DNA, 21 bp, Ricinus communis
tcgataaacctctgcatccag

SEQ ID NO: 5109 - DNA, 21 bp, Sorghum bicolor
tcgataaacctctgcatccag

SEQ ID NO: 5110 - DNA, 21 bp, Solanum lycopersicum
tcgataaacctctgcatccag

SEQ ID NO: 5111 - DNA, 21 bp, Theobroma cacao
tcgataaacctctgcatccag

SEQ ID NO: 5112 - DNA, 21 bp, Vitis vinifera
tcgataaacctctgcatccag

SEQ ID NO: 5113 - DNA, 20 bp, Zea mays
tcgataaacctctgcatcca

SEQ ID NO: 5114 - DNA, 21 bp, Zea mays
tcgataaacctctgcatccag

SEQ ID NO: 5115 - DNA, 21 bp, Medicago truncatula
tcggaccaggcttcattcccc

SEQ ID NO: 5116 - DNA, 21 bp, Medicago truncatula
tcggaccaggcttcattcccc

SEQ ID NO: 5117 - DNA, 188 bp, Arabidopsis lyrata; identical to SEQ ID NO: 203

SEQ ID NO: 5118 - DNA, 178 bp, Citrus sinensis
cctgtcatgtttttccacagctttcttgaacttctttctttcttcttcttcttcttcttcttcttcttcttcttcttcttcttcttcttcttcttcttcctctaataataggctacgatttgatgtggctagctgcagctattagaagttcaagaaatctgtgggaagaaatggcaaa

SEQ ID NO: 5119 - DNA, 108 bp, Glycine max; identical to SEQ ID NO: 208

SEQ ID NO: 5120 - DNA, 184 bp, Oryza sativa
gcgggcatgctttccacaggctttcttgaactgtgaactcgtgggggtgtatgtgctcatgttgggattgtggtcggtggcctccaattctctgaaaagaaagctgaattgtcgagctccccgttctgtctttggtcgtctctacctgttgatggttcaagaaagcccatggaaaccatgccgc

SEQ ID NO: 5121 - DNA, 184 bp, Oryza sativa; identical to SEQ ID NO: 5120

SEQ ID NO: 5122 - DNA, 176 bp, Oryza sativa
gccatgctctccacaggctttcttgaactgtgaactcgtgtgtgcatgctcctcatatattgttctagatcccatgcatgatgcatatcgatcgatctgatctgaattaggtcatcgatgcgcatctggatccccatcttgttgatagttcaagaaagtccttggaaaacatggtg

SEQ ID NO: 5123 - DNA, 176 bp, Oryza sativa; identical to SEQ ID NO: 5122

SEQ ID NO: 5124 - DNA, 137 bp, Zea mays
acatggccctccttgccgtcttccacagctttcttgaactgcatgccgccggctggtggatgctgcgcgcttgaattccggtcgatcccaagaggcgcagttcaataaagctgtgggaaactgcagagagaggccac

SEQ ID NO: 5125 - DNA, 136 bp, Zea mays; identical to SEQ ID NO: 219

SEQ ID NO: 5126 - DNA, 166 bp, Zea mays
tttccacagctttcttgaacttcttcttcttctctctcttagaagggccgtatagcttctttgaacctctctctctctctctctcaaaagtgtacacgaacactttcttcattctctgcctctcgctctctgatctccgaagaaggtcaagaaagccgtgggaaga

SEQ ID NO: 5127 - DNA, 117 bp, Zea mays
tttccacagctttcttgaacttcttcttcttcttctctcttggaacggcagctttcttcgaatctgtctctctctctctcatctccgaagacgaaggtcaagaaagctgtgggaaga

SEQ ID NO: 5128 - DNA, 114 bp, Zea mays
ttcccacagctttattgaactgccctcttgcttgcttggatcaattgaaactcgatcaggtccacagcacagcctgctgcatgcatgatgcagttcaagaaagctgtggaagat

SEQ ID NO: 5129 - DNA, 172 bp, Arabidopsis lyrata; identical to SEQ ID NO: 202

SEQ ID NO: 5130 - DNA, 178 bp, Citrus sinensis; identical to SEQ ID NO: 5118

SEQ ID NO: 5131 - DNA, 108 bp, Glycine max; identical to SEQ ID NO: 208

SEQ ID NO: 5132 - DNA, 184 bp, Oryza sativa; identical to SEQ ID NO: 5120

SEQ ID NO: 5133 - DNA, 184 bp, Oryza sativa; identical to SEQ ID NO: 5120

SEQ ID NO: 5134 - DNA, 176 bp, Oryza sativa; identical to SEQ ID NO: 5122

SEQ ID NO: 5135 - DNA, 176 bp, Oryza sativa; identical to SEQ ID NO: 5122

SEQ ID NO: 5136 - DNA, 137 bp, Zea mays; identical to SEQ ID NO: 5124

SEQ ID NO: 5137 - DNA, 136 bp, Zea mays; identical to SEQ ID NO: 219

SEQ ID NO: 5138 - DNA, 166 bp, Zea mays; identical to SEQ ID NO: 5126

SEQ ID NO: 5139 - DNA, 117 bp, Zea mays; identical to SEQ ID NO: 5127

SEQ ID NO: 5140 - DNA, 114 bp, Zea mays; identical to SEQ ID NO: 5128

SEQ ID NO: 5141 - DNA, 155 bp, Arabidopsis lyrata
gagtctcaccgtcgggctcggattcgcttggtgcaggtcgggaaccaattcggctgacacagcctcgtgactttaaaacctttattggtttgtgagcagggattggatcccgccttgcatcaactgaatcggatccccgaggtgtaagaaaactc

SEQ ID NO: 5142 - DNA, 141 bp, Arabidopsis lyrata
gtattggtgaggatcgggtaatctgcatcctgaggtttaaagcttaatttaagcagaaaatttgtatacgcatatacgtatgtgtgttggtatagcttttagtcctcgggatgcggattacctcttccttacttacaatac

SEQ ID NO: 5143 - DNA, 123 bp, Arabidopsis lyrata
gtacttggtgatgaacgggtaatctgcatcctgaggtttaaaactttataagcatttacgtatgtgactatatagtttttttaatcctcgggatacagattacctcttccttactcgaagtac

SEQ ID NO: 5144 - DNA, 159 bp, Arabidopsis thaliana
cgatgatgagtattggtgaggaccgggtaatctgcatcctgaggtttaaagcttaatttacgcaggaaatttgtatacgcatatacgtatgtgtattagtataccttttagtcctcgggatgcggattacctcgttcttacttacaatacacgtactcg

SEQ ID NO: 5145 - DNA, 167 bp, Arabidopsis thaliana
caacaacacgaagaagaagatgaaggtacttgatgatgaacgggtaatctgcatcctgaggtttaaaaccaattaagcatatacatatgcgaatgtatagtttttaatcctcgggatacagtttacctcttccttactcaagaaaacacttagctttaacggttttg

SEQ ID NO: 5146 - DNA, 151 bp, Brassica napus
gatgacaagtattggtgaggaccgggtaatctgcatcctgaggtttaaagcttgattatacgcataacatgccgacgcatataactatgtgttttagaatagcttttagtcctcgggatgcggattacctcttccttactatacgtacacg

SEQ ID NO: 5147 - DNA, 161 bp, Brassica rapa
cagatgacaagtattggtgaggaccgggtaatctgcatcctgaggtttaaagcttgattatacgcataacatgccgacgcatataactatgtgttttagaatagcttttagtcctcgggatgcggattacctcttccttactatacgtacacggttacatg

SEQ ID NO: 5148 - DNA, 113 bp, Brassica rapa
ggtgaagaactggtaatctgcatcctgaggtttaaaaatttataggcaattaaaacatgcaaatgtgtgtatggttttttaatcctcgggatacggattacctcttccttact

SEQ ID NO: 5149 - DNA, 153 bp, Lotus japonicus
tcaaacctacttggatgagtcagtataggtttaggatcaggtaatctgcatcctgaggtttaaaacaataggtttattgtgtctagtccttaggatgcagattaccgcttcctaatgttatcaccaatagatggagcatttaaatcagtttga

SEQ ID NO: 5150 - DNA, 310 bp, Medicago truncatula
atacttttcaggaaagcggtcaagttaagaatcctaaaaaaatgattggcaatccaatcttaatggaatatatttgaagcacaatataaactcctatgatgatgcagatgactctcaatcaagcctaactcaagtattctttcttagattatttgctcatgctctttcttggactcccatttgcttaatactacttgcaattggagtccttgggattcaaattacatcttccttagtaccaacactaaacacaattgttgaatgaggatatattgggatcagatgagataatctgcatcctgaggtttag

SEQ ID NO: 5151 - DNA, 166 bp, Medicago truncatula
ctgtgtctaagccttggaatgcagattatctcttccttatcaccaatgcaaaactgaaatcaacttgatagtttccattttctattagagctatatgtcgtcatgatggagtcggtagaaatattgggtaaggattagataatctgcatcctgaggtttatagcaa

SEQ ID NO: 5152 - DNA, 106 bp, Medicago truncatula
atattgggatttgatgggataatctgcatcctgaggtttagaacaacaaatgcgtaattatatctaagccttggaatgcagattatctcttccttatcaccaatgc

SEQ ID NO: 5153 - DNA, 152 bp, Medicago truncatula
ggattacaacaatacttgcattgtatctagtccttgggattcaaattacattttccttaataccaatactaaacacacttatttaatgtggatatattgagtttggataggataatctgcatcctgaggtttagaataacagctgcgtaatt

SEQ ID NO: 5154 - DNA, 102 bp, Medicago truncatula
ttattgggtaaggattagataatctgcatcctgaggtttataacaatattttagctgtctttaaccttagaatgcagattatcctttccttattgccaatgc

SEQ ID NO: 5155 - DNA, 134 bp, Medicago truncatula
atattgggtggggatgggataatctgcatcctgaggtttagaacaatagtttcttcatttccttaaaaagaaaatagttgcgtaattgtttctaagccttggattgtagattattttttccttaacatcaatgc

SEQ ID NO: 5156 - DNA, 107 bp, Medicago truncatula
agattgggatcagatgagataatctgcatcctgaggtttagaacaatcgatgcgtaactgtatctaagccttagaatgcagattatctcttccttatcaccaatgca

SEQ ID NO: 5157 - DNA, 166 bp, Medicago truncatula
ctgtatctaagccttagaatgcagattatctcttccttatcaccaatgcagaactgaaataatcttgatagtttccattttccaatagagcaataggtcgccattatgtagtcggtataaatattgggtaaggattagataatctgcatcctgaggtttatagcaa

SEQ ID NO: 5158 - DNA, 103 bp, Medicago truncatula
atattgggtaaggattagataatctgcatcctgaggtttatagcaatattttagttgtctttaatccttagaatgcagattatcctttccttaatgccaatgg

SEQ ID NO: 5159 - DNA, 106 bp, Medicago truncatula
atattgggattcgattggataatctgcatcctgaggtttagaacaacagatgcgtaattctatctaagccttgggatgctgattatctcttccttatcaccaatgc

SEQ ID NO: 5160 - DNA, 199 bp, Medicago truncatula
aacaacagatgcgtaattctatctaagccttgggatgctgattatctcttccttatcaccaatgcaaaactatgaaatcaatttgatatagtttccattttacattagagcaatatgtcgtcatgatagaattggtagaaatattgggtaaggattagataatctgcatcctgaggtttaaagcaatattgtagttgtc

SEQ ID NO: 5161 - DNA, 132 bp, Medicago truncatula
atattgggtgaggatgggataatctgcatcctgaggtttaagacaatatttgcgtaatttccaaaaaataaataaattgcgtaatcgtttctaagcctcggagtgcggattatcttttcctatcaccaatgc

SEQ ID NO: 5162 - DNA, 393 bp, Medicago truncatula
taacagctgcgtaattgtatctaagccttggagtgcagattatctcttccttaaccccaataggcgtagaactatgaaattgttgggtttcaaatgtgagtgattaagtctcacatcaatttgaaatgaagaaaatgtttgatataaagtgatgcgacacatatacttaatatcttaaggaattgggtgaagatatggtgtcaaagtctcttagagatcctcgatgtatagcctattaccgctcccgccgctcccaagactacacaacacatatcaacatgacggtttccattttcctttagagcaataagtcttcttgatggagtcggtataattattgggtaaggattagataatctgcatcctgaggtttatagcaatattgtagttgtt

SEQ ID NO: 5163 - DNA, 106 bp, Medicago truncatula
atattgagtttggataggataatctgcatcctgaggtttagaataacagctgcgtaattgtatctaagccttggagtgcagattatctcttccttaacaccaatgg

SEQ ID NO: 5164 - DNA, 107 bp, Medicago truncatula
ttaattggttaaggatagggtaatctgcatcctgaggtttagagcaacatttgtgttgtatctagtcctcgggatacagattacttttttcttaataccaatgtgaa

SEQ ID NO: 5165 - DNA, 127 bp, Medicago truncatula
gtgttgtatctagtcctcgggatacagattacttttttcttaataccaatgtgaaatagggacttgttcggtgagaatatattgggtgaggatgggataatctgcatcctgaggtttaaaacaatag

SEQ ID NO: 5166 - DNA, 134 bp, Medicago truncatula
tatattgggtgaggatgggataatctgcatcctgaggtttaaaacaatagttacgtaattacccctaaaaaaattagttacataatcgtttctaagccttggagtgcagattatcttttccttatcacctatgc

SEQ ID NO: 5167 - DNA, 107 bp, Medicago truncatula
agtattggttaaggatccggtaatctgcatcctgaggtttaaaacaataaatttattgtatctagtcctcgggatgctgattaccttttccttatgaccaatgtaca

SEQ ID NO: 5168 - DNA, 111 bp, Theobroma cacao
aaatattggtaaggaccgggtaatctgcatcctgaggtttagatctacatgtaatacttgttgcatctagccctcgggagtgcagattacctcttcctcactggcaataca

SEQ ID NO: 5169 - DNA, 108 bp, Vitis vinifera; identical to SEQ ID NO: 253

SEQ ID NO: 5170 - DNA, 228 bp, Arabidopsis lyrata
gattcgggaaattttatgtttctttgccattttttttggagtttagttggaaaaagagtgagagtcgctggaggcagcggttcatcgatctcttcctgggaacgaatatataaatattgaaaaagcatgaatagatcgataaacctctgcatccagcgtttgcctctttatctttgttattggcttcaatttttttggtttttgaaaaaagtgagggaaaacagagtc

SEQ ID NO: 5171 - DNA, 184 bp, Arabidopsis lyrata
tttttttagttctctcctcatttttatgtttggatttagagtgaagtcgctggaggcagcggttcatcgatcaattcctgtgaatatttttgttttcaaaagcatgaatcgatcgataaacctctgcatccagcgcttactcttcctcatctgtttaataatctatttgagaatgctcaaaaga

SEQ ID NO: 5172 - DNA, 130 bp, Zea mays
ctgggcgcagtggtttatcgatctcttccttgccttgtgctggtccggccgggagtggtggttcaagcgttttattgttgcagcagctcgcaaacaacgcgggaatcggtcgataaacctctgcatccag

SEQ ID NO: 5173 - DNA, 188 bp, Arabidopsis lyrata; identical to SEQ ID NO: 203

SEQ ID NO: 5174 - DNA, 137 bp, Zea mays; identical to SEQ ID NO: 5124

SEQ ID NO: 5175 - DNA, 136 bp, Zea mays; identical to SEQ ID NO: 219

SEQ ID NO: 5176 - DNA, 117 bp, Zea mays; identical to SEQ ID NO: 5127

SEQ ID NO: 5177 - DNA, 114 bp, Zea mays; identical to SEQ ID NO: 5128

SEQ ID NO: 5178 - DNA, 179 bp, Aquilegia coerulea
ggggatggtggaaagtgattgagttatgagaagccttgggtatgagagggtcggcatggtatgatgatgatgatgatgatgatgatgatgattcttctttcattttctctatttaatcttgccgactcctcccataccaatggtttctcatttctcttccctttcctttttatccccct

SEQ ID NO: 5179 - DNA, 147 bp, Aquilegia coerulea
ggattgagttatgagaagccttgggtatgagagggtcggcatggtatgatgatgatgatgatgatgatgatgatgattcttctttcattttctctatttaatcttgccgactcctcccataccaatggtttctcatttctcttccct

SEQ ID NO: 5180 - DNA, 177 bp, Aquilegia coerulea
ggggatggtggaaagggattgagttatgagaagccttgggtatgagagggtcggcatggtatgatgatgatgatgatgatgatgatgatgattcttctttcattttctctatttaatcttgccgactcctcccataccaatggtttctcatttctctccccttccttttttccccct

SEQ ID NO: 5181 - DNA, 129 bp, Citrus sinensis
aggaagttttgggagtgggagcgtggggtaagaagagaagaaagcgtataatttttcttttctttttcaattgagaaagaaaattacaaattcaatttcttccctatgcctcccattcctatgatttcc

SEQ ID NO: 5182 - DNA, 109 bp, Citrus sinensis
aggaaatttctggaatgggaggcttggcaagaagcgatctatttttcttgttcaataaaaaagaaaaagaaaatttttcttgcccacccctcccattccttggatttcc

SEQ ID NO: 5183 - DNA, 96 bp, Citrus sinensis
taaaatttttggaattgggtgctagggaaggttttgtttgacttgtctgtcataactaaattaattttccctagtccccctattcctatgattttc

SEQ ID NO: 5184 - DNA, 171 bp, Gossypium hirsutum
attgttaaagagggaaagggagaaagagttgccgggagtttatggaagtgggatgggtggaaagatttgtattttctctcttgagtttctaagaatgtaaagcaaatctttcctactcctcccataccacttatttccagttcttcctctccacttcttacttttctcgat

SEQ ID NO: 5185 - DNA, 177 bp, Gossypium hirsutum
agagacgatggagaaggagcttaggattctagaaagctcgtgggatgggtgagggggtaagacaatggactgtttcagtcttttggaaacagaaataaagaagaaggctggtttatgtcttgcctactccacccatgccactggtttcctggtgttcctcctcctcctaaagtctct

SEQ ID NO: 5186 - DNA, 95 bp, Glycine max; identical to SEQ ID NO: 212

SEQ ID NO: 5187 - DNA, 152 bp, Gossypium raimondii
gaaggaggaaaaggagagaccgtttctggaaattttcggaatggaggagttggaaagattttgaattttctctgtattttaataatgaaaaatctttccaattcctcccattccactgatttccagcacttcctctccattttcttaccttt

SEQ ID NO: 5188 - DNA, 93 bp, Glycine soja; identical to SEQ ID NO: 214

SEQ ID NO: 5189 - DNA, 93 bp, Glycine soja
ggggaagacatgggtatggggggattgggaaggaatattcataagcaaaatatgttatttcttccctacacctcccataccactgtttttcct

SEQ ID NO: 5190 - DNA, 152 bp, Malus domestica; identical to SEQ ID NO: 185

SEQ ID NO: 5191 - DNA, 152 bp, Malus x domestica; identical to SEQ ID NO: 185

SEQ ID NO: 5192 - DNA, 118 bp, Picea abies
ttggaggagtggaaggatagggtaagactgcggttaagtgagtctgcttcaataattctttgctctaatctcaccagtcttccctactcctcccattcctgttgccttcatcacagtt

SEQ ID NO: 5193 - DNA, 121 bp, Picea abies
atgtggatggaagtcttgaggattgggaggataggagaaggctgtttgcttaattctcagttgaaacctgattagtcttccctattcctcccattcctattgcctccatcacacatccctt

SEQ ID NO: 5194 - DNA, 137 bp, Picea abies
tgagaagggaatggatgtgttttgtggatggaagtcttgaggagtgggagcagaggataagactgctgctttgaatattatcagtctttcctactcctcccattcctattggcttcaccacacatcccttcccaacg

SEQ ID NO: 5195 - DNA, 92 bp, Pinus taeda
gaggtgtggaaggatagggtaagactaaggttaaggagaaactctgcttcattaattctctgctccagtcttccctactcctcccattcctt

SEQ ID NO: 5196 - DNA, 92 bp, Pinus taeda
gaggtgtggaaggatagggtaagactagggttaagcagaaactctgcttcattaattctctgctccagtcttccctactcctcccattcctt

SEQ ID NO: 5197 - DNA, 80 bp, Pinus taeda
aggagtgggagggtaggagaaggctctgtggtgaggtctcagtcataatctcatcagtcttccctattcctcccattcct

SEQ ID NO: 5198 - DNA, 92 bp, Pinus taeda
gaggtgtggaaggatagggtaagactaaggttaaggagaaactctgcttcattaattctctgctccagtcctccctactcctcccattcctt

SEQ ID NO: 5199 - DNA, 107 bp, Populus trichocarpa
gagtcctagcaagtctttggagatgggagagtatgcaagaaggaaaaattcatgatttaatattctttcttgcctactcctcccattccatctgctttctgcgactc

SEQ ID NO: 5200 - DNA, 133 bp, Phaseolus vulgaris; identical to SEQ ID NO: 2602

SEQ ID NO: 5201 - DNA, 92 bp, Solanum lycopersicum
cgaaaatctatggggattggtgagttggaaagcttttctttttcttctcttgtgattagctttccaattccacccattcctatggtttttcg

SEQ ID NO: 5202 - DNA, 117 bp, Vitis vinifera
aatgtttgggaattggagagtaggaaagcttagccatctattcccttcatggtttcctctccatggattgggggtctagagctagtctttcctactcctcccattcctattgttttc

SEQ ID NO: 5203 - DNA, 122 bp, Zea mays; identical to SEQ ID NO: 200

SEQ ID NO: 5204 - DNA, 133 bp, Phaseolus vulgaris; identical to SEQ ID NO: 2602

SEQ ID NO: 5205 - DNA, 263 bp, Arabidopsis lyrata
aacgcgtatgtgacgaaagtagtgtgcagccaaggatgacttgccgatttaaatgatctttctttatactctattaagacattttaagtttcaaatttctttggttcttcaaggattaaggaagaaagtaggctatatatgtagatatatatattatgctgtattaaatatatgtacaagataagaccaaaaaagaaaaagtaacaatcatgatcggcaagttgtccttggctacacgttactttgtgtcgcgcataggtgtt

SEQ ID NO: 5206 - DNA, 173 bp, Arabidopsis lyrata
gtgcccaacggagtagaattgcatgaagtggagtagagtataatgcagccaaggatgacttgccggaacgttgttaatcatacgtataaattatgtgatgaacatatttctggcaagttgtccttcggctacattttgctctcttcttctcatgcaaactctctttgggatat

SEQ ID NO: 5207 - DNA, 292 bp, Arabidopsis lyrata
gtctcatctaaagccttgaatgtgggaaaaaggccattgttgttcagccaaggatgacttgccggtagctttgtatatttactctatattcggtttatattatggagattatgctttatatatatatatacatagttttaattgattttttttcgtacgtacgtaatctaatacgaaaaagtatttacttatttatatgtgtgttggtgagatgtgtaaacaaagcaagcccggcaagtcatctctggctatgcaactgcctcttcctctcattctaggcttacgatgacac

SEQ ID NO: 5208 - DNA, 155 bp, Arabidopsis lyrata
gtatctttgagtcttacatggaaaaaatagagaatgagattgagccaaggatgacttgccgatttttatcaacaaatcttaactgattatggtgcccggcaagttgaccttggctctgtttccttctcttcttttcgatgtcaaactctagatat

SEQ ID NO: 5209 - DNA, 174 bp, Arabidopsis lyrata
gtcactaattgtatcatagagtcttgcatggaaaaaatagagaatgagattgagccaaggatgacttgccgaatttattaacaaatctcaaatgattatggtgcccggcaagttgaccttggctctgtttccttctcttcttttcgatgtcaaactctagatatatcaatcgat

SEQ ID NO: 5210 - DNA, 184 bp, Arabidopsis lyrata
tgtatcagagggtcttgcatgaaggaataaagaatggaattgagccaaggatgacttgccggtttaaacacaaccggattatgaccattgatttggtctcattcacaatctgttgattcgtgtctggcaagttgaccttggctctgcttcgttctctattcttccatgttagattccagatata

SEQ ID NO: 5211 - DNA, 202 bp, Arabidopsis lyrata
atgatgatgatgagtctctagttgtatcagagggtcttgcatggaagagtagagaatgaggttgagccaaggatgacttgccgggttttttaccaatgaatcttaactgattttggtgtccggcaagttgaccttggctctgtttccttctcttcttttcgatgtcagactccgcgatatatatctatttcatcatcgtcat

SEQ ID NO: 5212 - DNA, 205 bp, Arabidopsis lyrata
tagaaaatcatataagagaaaatggtgacatgaagaatgagaacttgtgtggtagccaaggatgacttgcctgcgttttaacaatacaatatcaaagactactcgatcgatcgatagtcttagagttggttagtcgtcaggcagtctccttggctattcaaacaattcttgttctcctcatttcacatctctctttcgttttttg

SEQ ID NO: 5213 - DNA, 205 bp, Arabidopsis lyrata; identical to SEQ ID NO: 5212

SEQ ID NO: 5214 - DNA, 210 bp, Arabidopsis lyrata
gaaggagatgtcaaagatgagtaggagaatcatatttggtagccaaggatgacttgcctgattcctttgcgtaaaatggttagtgtcatgtttgacaaagtgactatcaattacatcaagcgatgaccattttgcttataaaaaagatgtcaggcagtctccttggatatccttatatgttcttctctttcatctcagacattcatcttc

SEQ ID NO: 5215 - DNA, 210 bp, Arabidopsis lyrata; identical to SEQ ID NO: 5214

SEQ ID NO: 5216 - DNA, 300 bp, Arabidopsis lyrata
gaatgaggcaaaacatattgagtaatggagtgtataatgaggaagagaggtctaacatggcgaaaagagtcatgtttaatagccaaggatgacttgcctgatctttttcacctccatgattcaatttgaagttcatgcgttttggattattatgcatctaaaaggtataataattcgaaaatcatgttgaatcatgcgggttaggtttcaggcagtctccttggctatcttgacatgcttttttcatccatgttatacctgtttttctttctgtctctaaagtcactattaagtctcttc

SEQ ID NO: 5217 - DNA, 300 bp, Arabidopsis lyrata; identical to SEQ ID NO: 5216

SEQ ID NO: 5218 - DNA, 203 bp, Arabidopsis lyrata
gaaggagatgtcaaagatgaataagagaaccacatttggtagccaaggatgacttgcctgtttctttgaacaaaatggttggtgtcatgtttgatgtgactacaagttatatcaagaatgacattttgcttataaaaagacatcaggcagtctccttggctatccttatatgttcttctttctcatctcagacatttaccttc

SEQ ID NO: 5219 - DNA, 203 bp, Arabidopsis lyrata; identical to SEQ ID NO: 5218

SEQ ID NO: 5220 - DNA, 272 bp, Arabidopsis lyrata
gttaagaaatgtatgatgaagatgagaggtctaacatggcgaaaagagtcatgtttaatagccaaggatgacttgcctgatctttttcacctccatgattcaatttgaatttcatgggttttggattattatgcatctaaaaggtgtaataattcgaaaatcaagttgaatcttgcgggttaggtttcaggcagtctccttggctatcttgacatactcttttcatccatgttatacctaattttctttttttattgaggatatttgaggat

SEQ ID NO: 5221 - DNA, 272 bp, Arabidopsis lyrata; identical to SEQ ID NO: 5220

SEQ ID NO: 5222 - DNA, 230 bp, Arabidopsis lyrata
tcattatttagaaggaaatgtcaaagatgaataggagaatcatatttggtagccaaggatgacttgcctgtttctttgagtaaaatggttattgtcatgtttgacaagtgactataagttatatcaagtaacgaccattttactcatcaaaagacatgaggcagtcttcttggctatccttatatgttcttctgtctcatctcagacgttaaccttcatctaaaataaga

SEQ ID NO: 5223 - DNA, 230 bp, Arabidopsis lyrata; identical to SEQ ID NO: 5222

SEQ ID NO: 5224 - DNA, 252 bp, Arabidopsis lyrata
gaagtgtataacgaggaaaagaggtctaacatggcgaaaagagtcatgtttagtagccaaagatgacttgcctgatctttttcacctccatgattcaatttgaattccatgggttttggattattatgcattttaaaagcataatagttcgaaaatcatgttgaatcttgcgggttaggtttcaggcagtctctttggctatcttgacatgcttttttcattcatgttatacctatttttctttctgtcttc

SEQ ID NO: 5225 - DNA, 252 bp, Arabidopsis lyrata; identical to SEQ ID NO: 5224

SEQ ID NO: 5226 - DNA, 158 bp, Aquilegia coerulea
gcatgaaagtaggaggcgtgtttagtagccaaggatgacttgcctaccaagggtctcattttaaggcattatcttccttggataatgcgtctggaatcctcgactggttaataggcagtctccttggccaacttgactgcctcctattactcatgcta

SEQ ID NO: 5227 - DNA, 180 bp, Aquilegia coerulea
tagccaaggatgacttgcctgtatcctcttagaggccggcctgcgcgcctgtctctatattatcatacattggaatatatcatccttgtgtggttaataggcgggcctgcctgtctctatattatcatacattggaatatatcatccttgtgtggttaataggcagtctccttggctaac

SEQ ID NO: 5228 - DNA, 379 bp, Arabidopsis thaliana
tgcctataaataccttcatcacgagtatgacaagatcacaagacaagaaaagaaaggtagagaaaacatgataatgatgattacgatgatgagagtctctagttgtatcagagggtcttgcatggaagaatagagaatgaggttgagccaaggatgacttgccgggtttttttaccaatgaatctaattaactgattctggtgtccggcaagttgaccttggctctgtttccttctcttcttttggatgtcagactccaagatatctatcatcatgaatcgtgatcaaactttgtaatttcattgaaatgtgtttttcttgatgcgaattttttggcttacggtttttcgatttgaatgatcagatttttgtttttgca

SEQ ID NO: 5229 - DNA, 190 bp, Arabidopsis thaliana
tcatataagagaaaatggtgacatgaagaatgagaacttgtgtggtagccaaggatgacttgcctgcgttttagaccatatatatcaaagactcactcgatcgatagtcttagagttggttggtcgtcaggcagtctccttggctattcaaacaattctcattctcttcattcacatttctcttttttgg

SEQ ID NO: 5230 - DNA, 206 bp, Arabidopsis thaliana
gaaggagatgtcaaagatgaatagaagaatcatatttggtagccaaggatgacttgcctgactctttgtgtaaaatgtttagtgtcttgtttgaagtcactataagttgtatcaagcaatgaccattttgcttataaaaaagatatcaggcagtctccttggctatccttatatgttcttctctttcatctcagacattcaccttc

SEQ ID NO: 5231 - DNA, 221 bp, Arabidopsis thaliana
gagtataatgaggaagagaggtctaacatggcgaaaagagtcatgtttagtagccaaggatgacttgcctgatctttttcacctccatgattcaatttgtaattcatgggttttggattattatacattcaaaagtataataatttgaaatcatgttgaatcttgcgggttaggtttcaggcagtctccttggctatcttgacatgcttttttcattcacg

SEQ ID NO: 5232 - DNA, 213 bp, Arabidopsis thaliana
ttagaaggagatgtcaaagatgaataggagaacaatatttggtagccaaggatgacttgcctgcttctctgaacaaaatggtcgatgtcatgttttgaagtgactataagttataccaagaaatgaccattttgtttataaatagacatcaggcagtctccttggctatccttatatgttcttctttctcaactcagatatttaccttcatcc

SEQ ID NO: 5233 - DNA, 211 bp, Arabidopsis thaliana
atgaagaagagaggtctaatatggcgaaaagagtcatgtttaatagccaaggatgacttgcctgatctttttcacctccatgattcaattttaagttcgtggattttggattattatgcgtttaaaaggtataataatttgagatcatgttgaatcttgcgggttaggtttcaggcagtctctttggctatcttgacatgctttcttcatc

SEQ ID NO: 5234 - DNA, 212 bp, Arabidopsis thaliana
tagaaggagaagtcaaagatgaatagaagaatcatatttggtagccaaggatgacttgcctgtttctttgagtaaaatgggttagtgtcatgtttgacaagtgactataagttatatcaagcaatgaccattttactcatcaaaagacatcaggcagtctccttggctatccttatatgttcttctctctcatctcagacgtttaccttcat

SEQ ID NO: 5235 - DNA, 215 bp, Arabidopsis thaliana
gatgaagaagagaggtctaacatggcggaaagcgtcatgtttagtagccaaggatgacttgcctgatctttttcgcctccacgattcaatttcaaattcatgcattttggattattataccttttaaagtataataggtcaaatatcatgttgaatcttgcgggttaggtttcaggcagtctctttggctatcttgacatgctttttccatccat

SEQ ID NO: 5236 - DNA, 106 bp, Brachypodium distachyon
gagatagagagtggaatgtagccaaggatgacttgccgggtatgtgcatgtacgcttcagggaattatatgcatccctggtctgaatccatgctgatatttcccgg

SEQ ID NO: 5237 - DNA, 187 bp, Brachypodium distachyon
atggagatggagagcctcccttgattttggtagccaagaatgacttgcctatgcttgccctctgctaaccagctagccatgcatggtaaccaatggacaaatttcttgtggttggcgtggttagtgtggttgcatgggtgggtcttcttggctagccagagcggctctcatccaccatgccaggcca

SEQ ID NO: 5238 - DNA, 164 bp, Brachypodium distachyon
ccttacatggtgataaggggtttggccctgatagccaaggatgacttgcctgtgcatgtcctcccttgatcgcttgcataatttcatatatgcatgtgatctcgatttatcacaggcagtctccttggctagcctgggtgcctcttatcctccatgctaggcct

SEQ ID NO: 5239 - DNA, 181 bp, Brachypodium distachyon
ggtgttgcgtgggcagagaagaagccttacatggcagcaaggggcttatctctgatagccaaggatgacttgcctgtgtcatacttcaaggcttggcaacatgatgcatgagcctttgttgtagtctcataggcagtctccttggctagcctgagtggctcttgcggctcatgccaggctg

SEQ ID NO: 5240 - DNA, 164 bp, Brachypodium distachyon
cttgcatgagggccagagcctgcttcctccggtagccaaggatgacttgcctatatttgctccttcagaagtcctggttaattacatgccaggtttcagatgagtttggcgataggcagtcaccttggctagcctgagtggctcttgcctcttatggaaggcct

SEQ ID NO: 5241 - DNA, 175 bp, Brachypodium distachyon
tggagacgaggagcccctttgcaggctctaccagccaagaatggcttgcctatgcccacgttctgtttcatcaccactgggcttaatcttggagccctggtgatggatgagatgtgattgtatggtcaagccatcttggctagaagagagatcctcgtcccccatgctaggctgc

SEQ ID NO: 5242 - DNA, 183 bp, Brachypodium distachyon
cttacatggagataaggagcctacctctgttagccaggaatggcttgcctacgcacacatttttcggttcatcacaggggcaaaactaacttggagatagcccctagtatgatggacggagtgtggctgcatggtcaagccttcctgactaggagagtgctcctcatcccccatgctaggctg

SEQ ID NO: 5243 - DNA, 174 bp, Brachypodium distachyon
tctttgcatggaagtaggaggccatctttgatagccaaggatgatttgcctgtaaaaccgattgtcgtcgcctctcggtgccgttccaggcactcgaagggagggcggcagcaacaggttctatgggcaagtcagcctggctacccgagtacctcttacccatattccatgcca

SEQ ID NO: 5244 - DNA, 176 bp, Brassica napus
agatgaatagaagaatcatatttggtagccaaggatgacttgcctatttcttgagagtaaaatgggcatggtgtcatgttaaaagttactgtaggtagtttcaatttgaccattttccttacaaatgatattaggcagtctccttggctatccttatatgttcttctctctcatct

SEQ ID NO: 5245 - DNA, 220 bp, Brassica napus
gaaggagatgtcaaagatgaataggagatttctatttggtagccaaggatgacttgcctacttctttgcgaaggaaaatggtcacggtgtcatgtttgaaagtgaatatacatttttaagagtatatcaattagtgaccattttgcgtataaaaagatattaggcagtctccttggctatccttatatgttcttctttctcatctcagacatttaccttc

SEQ ID NO: 5246 - DNA, 277 bp, Brassica napus
gtttcaggcagtctccttggctatcttgacatgcttttttcttccatgttataccttctttctttgtatttttcgaatccaaataatatttttttctataaatttactacgaaaatcctttaaacaatctctaacaaagtatgttattagaaaactaccactttttgcatttattacaaatgcatgtacgtggtgagtgtatgcattctttagaaggaaatgtcaaaggtgaatagaagaatcatatttggtagccaaggatgacttgcctatttct

SEQ ID NO: 5247 - DNA, 201 bp, Brassica napus
gtcaaagatgaataggagaattctatttggtagccaaggatgacttgcctacttctttgcgaaggaaaatggtcacggtgtcatgtttgaaagtgaatatatatttataagagtatatcaattagtgaccattttgcgtataaaaagatattaggcagtctccttggctatccttatatgttcttctttctcatctcagac

SEQ ID NO: 5248 - DNA, 168 bp, Brassica napus
gagaaacggtgacatgaagaatgagaagttgtgtggtagccaaggatgacttgcctgcgtctttaacaccatatcaaagactttatcgatagtctctgagttggttaggctgtaggcagtctccttggctattcagacactcctctttctcctcatttcacatttctc

SEQ ID NO: 5249 - DNA, 176 bp, Brassica napus
gagaaatggtgacatgaagaatgagaagttgtgtggtagccaaggatgacttgcctgcgtcttagaccatatctatcaaagactaaaagattgatagtcttcgatgaattggttaatcggtaggcagtctcctcggctattcagacagttctctttctcctcatttcacatttctc

SEQ ID NO: 5250 - DNA, 174 bp, Brassica napus
agagtcatgtttagtagccaaggatgacttgcctgctctttttcacctccatgattcaattttatgtacagttttggattactatgcttctaaagagtatagtaattcaaaatcttgttgaatctttgagggtaacagtttcaggcagtctccttggctatcttgacatgcttt

SEQ ID NO: 5251 - DNA, 167 bp, Brassica napus
gtgtttagtagccaaggatgacttgcctgctcttgttcacctccacgattcaactttatacgttgaagggttttggattattgtgcattcaacatgtataataatttgaaatcatgttgaatctttgtgggttaggtttcaggcagtctccttggctattttgacat

SEQ ID NO: 5252 - DNA, 155 bp, Brassica napus
aaacggtgacatgaagaatgagaagttgtgtggtagccaaggatgacttgcctgcgtcttaacaccatatcacagactttatcgatagtctctgagttggttaggctgtaggcagtctcctcggctattcagacactcctctttctcctcatttc

SEQ ID NO: 5253 - DNA, 199 bp, Brassica napus
catggcgaaaagagtcgtgtttagtagccaaggatgacttgcctgctcttgttcacctccacgattcaactttatacgttgaagggttttggattattgtgcattcaacatgtataataatttgaaatcatgttgaatctttgtgggttaggtttcaggcagtctccttggctattttgacatacttttttcatccatg

SEQ ID NO: 5254 - DNA, 150 bp, Festuca arundinacea
ggcacgagggcaaagccttacatggctgcaagggccttacctctgatagccaaggatgacttgcctatgtcttcttcctccctcagatgcctaattagccttggaggtgtggggtctcatgggcagtcaccttggctagcctgagtggct

SEQ ID NO: 5255 - DNA, 189 bp, Gossypium herbacium
tatagagaggaagaaaaggtctaacatgaagataaagagtcttgtttggtagccaaggatgacttgcctgcacctaatgtccacgaggttttaatacatcaaaaaccctggttgggtcccaggcagtcaccttggctaactagacaggctgttttcattcatgctaggcctcatcttccgccccattgg

SEQ ID NO: 5256 - DNA, 49 bp, Gossypium hirsutum
gacgacaacgtcttccaccgtctcgtcgacgccaaggatgtcttgcgtc

SEQ ID NO: 5257 - DNA, 139 bp, Medicago truncatula
tttataagccaaggatgacttgcctagctaaaaaccatttacattaattggggacttaatttgtatatgttatgtctgatcgatgatgagtatgtcccttgtttagtttattagcaggcaggtatcctaggctttttga

SEQ ID NO: 5258 - DNA, 132 bp, Oryza sativa
gctggttgtgtagccaaggatgacttgccggcctggtttgtgttcatcagcaatccagcatatgctgtattgccgtgtgtgatcgatcgatgcatggaccggcaagttattttctttggctacattacaacc

SEQ ID NO: 5259 - DNA, 170 bp, Oryza sativa
gctgattcggtagccaaggatgacttgcctaatgcctatgtgcatgtgtttatacgctgctcatctgcattttgattatcccctgatcagtcctgtcgtcaattatatgtgtgtgtagtactctgtactcatacatatataggcatgtcttccttggctattcggagcgg

SEQ ID NO: 5260 - DNA, 126 bp, Oryza sativa
ctgcctctggtagccaaggatgacttgcctattgtgctcttctgaatgatgcagtgccatgatcagtgtggcctggctggttcagatgagccgagataggcagtctccttggctagcctgagtggc

SEQ ID NO: 5261 - DNA, 122 bp, Oryza sativa
ttagctctggtagccaaggatgacttgcctgtgtccttgtgtgtaaggatcattaattattattcagaaaatgatcctttcagcaggtttcatgggcagtctccttggctagcctgagtgat

SEQ ID NO: 5262 - DNA, 108 bp, Oryza sativa
gtagctctggtagccaaggatgacttgcctgtgtccttgtgtagaggatcattcagaaaatgagccttgaactggttcataggcagtctccttggctagtctgagtcg

SEQ ID NO: 5263 - DNA, 125 bp, Oryza sativa
tcgcatctggtagccaaggatgacttgcctgtgtctctgctcatgtgcagtagaagaagatgcatttctagctgctttctgcatatgtgatctcacaggcagtctccttggctagcctgagcggc

SEQ ID NO: 5264 - DNA, 156 bp, Oryza sativa
tctgtctagatagccaaggatgacttgcctgtggcctcttggagagagaggtgtagcttaattagcagcatggtttgagcattgcttgatcggttgatcgcttcgcttgctctgcatgagatcttacaggcagtctccttggctagtctgggcggc

SEQ ID NO: 5265 - DNA, 108 bp, Oryza sativa
ttatctctgatagccaaggatgacttgcctgtgtcctccctgaaggattagcaatttaatgatcctttaagctggttcatgggcagtctccttggctagcctgagtgg

SEQ ID NO: 5266 - DNA, 138 bp, Oryza sativa
tgagtcctggtagccaaggatgacttgcctgtatatttatatatatatgtgtgtgtgatcaatggatggattgatcaagctgcttgcaggctcatgcatatatatgtacaggcagtctccttggctagcccggctacc

SEQ ID NO: 5267 - DNA, 177 bp, Oryza sativa
ctccctttggtagccaagaatgacttgcctatgtgttttgccttgtgttggctcatccatccatctatcagccgttgcagatttgcagtggcagattaaagggtttcagaaagaaattcttgtgatggatgtgcaatgtggctgcatgggccggtcttcttggctagccagagtggc

SEQ ID NO: 5268 - DNA, 173 bp, Oryza sativa
ctccctttggtagccaagaatgacttgcctacgcttttgccctctgttggctcatccatccgtctatctatctgccatggcagatggcagattaagggtttctgaaagaaattcttgtgataggatgtgcaatgaggctgcatgggccggtcttcttggctagccagagtggc

SEQ ID NO: 5269 - DNA, 107 bp, Populus trichocarpa
cttgtttggtagccaaggacgacttgcccaccaccatctcagttgggtccaatatattactgggcaccttccatttggttttgggcaagcaccttggctagctgaca

SEQ ID NO: 5270 - DNA, 107 bp, Populus trichocarpa
tcttgtttgtagccaaggacgacttgcccacaatatgtatcgtgagcgtttccaatttgcaacctcatacttggtttgttttgggcagtctccttggctatgcagat

SEQ ID NO: 5271 - DNA, 101 bp, Populus trichocarpa
gatgttcggtagccaaggacgacttgcccacactatgagacaagtggttagaattagcaacttcttaattggttatgggaagtctccttggctatgctgac

SEQ ID NO: 5272 - DNA, 107 bp, Populus trichocarpa
cttgtttggtagccaaggacgacttgcccaccaccatcttagttgggtccaatatattactgggcaccttccatttggttttgggcaagcaccttggctagctgaca

SEQ ID NO: 5273 - DNA, 107 bp, Populus trichocarpa
cctgtttggtagccaaggacgacttgcccaccaccatcttagttgggtccagtatattactgggcaccttccatttggttttgggcaagcaccttggctagctgaca

SEQ ID NO: 5274 - DNA, 123 bp, Populus trichocarpa
tcttgtttggtagccaaggatgacttgcctgctccattgtaggaggtttccgaaaaaatgcagacatgtataatttcgaaacccctgtttcgtttcaggcagtctccttggctaacttgactg

SEQ ID NO: 5275 - DNA, 137 bp, Populus trichocarpa
tcttgtttgatagccaaggatgacttgcctgctacttgcaagagtttctgcaaagagatcagaaccaaatatgcatggaattatatgtaatgaaactcttgtttgattgccaggcagtctccttggctagcctgaca

SEQ ID NO: 5276 - DNA, 203 bp, Populus trichocarpa
tcttgtttggtagccaaggatgacttgcctgtagcctccctcggattcatgaacacgagcatttatgtggtgctcaaaagaaaaggagagaatgatcccagctggcagcgacaaggtcaatccattgaagtagcgagaagcaggtgatttatagctagaatccacaagaggttcccagcaagtgtccttggctaacgagacgg

SEQ ID NO: 5277 - DNA, 143 bp, Populus trichocarpa
tcttgtttgatagccaaggatgacttgcctgctacatacaagagatcattatgcataaatagaacgaaatatgtacatggtattaattaatgcagtgaaaactcttgtttggttgccaggcagtctccttggctaagctgaca

SEQ ID NO: 5278 - DNA, 119 bp, Populus trichocarpa
tcttgtttggtagccaaggatgacttgcctgctcccttcaaggaggtttcatgaaatgcagacatgatctctcgaaacccctgttgggtttcaggcggtctccttggctaacttgacag

SEQ ID NO: 5279 - DNA, 104 bp, Populus trichocarpa
ccttgcgtggaagccaaggatgacttgcctgagaattttaggaaggtttctatatgaaagctttttattagttttgcaggaagtcaaccttggctttcctatag

SEQ ID NO: 5280 - DNA, 104 bp, Populus trichocarpa; identical to SEQ ID NO: 5279

SEQ ID NO: 5281 - DNA, 115 bp, Populus trichocarpa
tcttgttagttagccaaggacgacttgcctgttcctagcaatttgggatttgccctggactaagaggcaggaccctcattccgggtttcaggcagtctccttggctaggttgaca

SEQ ID NO: 5282 - DNA, 119 bp, Populus trichocarpa
gagggtttggtagccaaggatgacttgcctatttcctccataaggctttaaaaagcatgaaatgtggtttagagctcaattgaagggttcataggcagtctactttggttatcctagct

SEQ ID NO: 5283 - DNA, 120 bp, Populus trichocarpa
agagtgtgattcagccaaggatgacttgccggcagcaggtaagagcaaagctccgtttttggaagttcaaggatatcttaacttttccggccggcaagctgtccttggctacattgtact

SEQ ID NO: 5284 - DNA, 122 bp, Populus trichocarpa
gagggttgggtagccaaggacgacttgcctatttcctccatggggtcctgaaaagaatgaaatactgtcgttcagagctcattggtagggttcataggcagtctcctttggctatcctaact

SEQ ID NO: 5285 - DNA, 110 bp, Populus trichocarpa
cgtgtttggtagccaaggatgacttgcccactccattgaaagagtttttcaagcatatggtagtgtagaacttttctttggttctgggcagtcatcttggctatgctgac

SEQ ID NO: 5286 - DNA, 109 bp, Populus trichocarpa
cgtgtttggtagccaaggatgacttgcccactctatggaaagagttctcaagcacacggcagagaggacccttacttcggctctgggcagtcaccttggctatgctgac

SEQ ID NO: 5287 - DNA, 126 bp, Sorghum bicolor
tggcgagagcctgcctttggtagccaaggatgacttgcctacacggccttgcgagttccggttgcatggccagttcagttgggtttgtgggcggtcaccttggctagcctgagtggctcttgcctg

SEQ ID NO: 5288 - DNA, 103 bp, Sorghum bicolor
tggcgagagcctgcctttggtagccaaggatgacttgcctacatggcattgcgagttccggttgcatggccagttcagctgagtttgtgggcggtcaccttgg

SEQ ID NO: 5289 - DNA, 109 bp, Sorghum bicolor
tagccaaggatgacttgccggcatttcttgggtcggatgactgagttgttgagcctggggatgaacagacccggatcgacggccggccggcaagtcatctgtggctacg

SEQ ID NO: 5290 - DNA, 148 bp, Sorghum bicolor
cgatgagagcactgctctggtagccaaggatgacttgcctgtggcctccactccacctgcggcaggaggctcttcttctgcgcgcgcgtgtgtgtgtggttgtcgatcgcaggcagtctccttggctagcctcagcggctctcatcct

SEQ ID NO: 5291 - DNA, 152 bp, Sorghum bicolor
gcgataagagtctgcccagatagccaaggatgacttgcctgtggcctcttggcttggcttgagagcttattaactctgtgcacgtttaatttgctcttcttgtggcctcgatcacaggcagtctccttggctagtccgggcggctcttatct

SEQ ID NO: 5292 - DNA, 98 bp, Sorghum bicolor
tagccaaggatgacttgcctagctatatgcctgagagcctgtctcttggtggtaaatttgtatgtgctgagcatataggcatgtcttccttggctact

SEQ ID NO: 5293 - DNA, 169 bp, Sorghum bicolor
gatggagagcccccttttgctagccaagaatgacttgcctatgcatgccctctgttggcaattcctccagccatggagattgcacaaggtgaatttttgcggcatagatgatggatgcaatgtggctgcatgggcaggtcttcttggctagccagagtgctctcatcca

SEQ ID NO: 5294 - DNA, 123 bp, Sorghum bicolor
tgtagccaaggatgacttgccggccgatcgatgcctcatccctgtccgggaacgtcatgcatgtgatgcaaactgtgaggccgcatcgtcgatcgaccggcaggttcttctctttggctacac

SEQ ID NO: 5295 - DNA, 97 bp, Sorghum bicolor
tgatagccaaggatgacttgcctgtgtcctttgtgccgaaggatcagaaatgtgagcctttgagatagatggttcataggcagtctccttggctagc

SEQ ID NO: 5296 - DNA, 92 bp, Sorghum bicolor
tagccaaggatgacttgcctatatcctctctaaaggatcagcaaatattgaggcttctagtggtctcatatgggcagtctccttggctagcc

SEQ ID NO: 5297 - DNA, 93 bp, Sorghum bicolor
ggtagccaaggatgacttgcctatatcctctatgaaggatcagcaaatatcgaggctttgagtggtctcatgggcagtctccttggctagcct

SEQ ID NO: 5298 - DNA, 103 bp, Sorghum bicolor
atagccaaggatgatttgcctgtagcaacctctgagtgctcctgctgccatggcagtcaggagcgccaagtgggtgcttctccgggcaaatcatctgggctag

SEQ ID NO: 5299 - DNA, 105 bp, Sorghum bicolor
ttagccaagaatggcttgcctatctccattatttggttcatcagagggacctctgatccctcatgatggatgaaatgtggatgatggcagcccttctggctaagt

SEQ ID NO: 5300 - DNA, 104 bp, Sorghum bicolor
ttagccaagaatggcttgcctatctccattattttgttcatcgatgcaggcctagggatcgtcatggatgaaatgtggatgatggcatccattcttggctaagt

SEQ ID NO: 5301 - DNA, 205 bp, Solanum lycopersicum
ttttaatttggtttcaggcagtctccttggctaccttgacatgctcttttcttttatgcaagatatcttttcaaaatagaagttttagtcatcgttaaaatatcgagacggggttacaagtcttatttaaaagaagagaagtctagcatgatgagaagagtcttatttggtagccaaggatgacttgcctgcaccgtacttgaaa

SEQ ID NO: 5302 - DNA, 176 bp, Solanum lycopersicum
gaagaggggttttatatgaagttgagagtattatttagtagccaaggatgacttgcctacttcatttgatatatagtttaaaataataatattgacaatatttgtcatttggtcgtaggcaagttatcctggctatcttgacatgctcgtaatttttcatgtaagaccttatcttc

SEQ ID NO: 5303 - DNA, 143 bp, Saccharum officinarum
tagccaaggatgacttgccggcaatgcttcgatggatccctaatccccgtccggccgggaacgtcgcacgtatgtatgtatgcgtgcatatgctgcgaactgtgaggcatccatatcgaccggcaggttcttctcttgggcta

SEQ ID NO: 5304 - DNA, 146 bp, Saccharum spp
gtagccaaggatgacttgccggccgatgcttcgatggatccctcatccccgtccggccgggaacgtcgcacgtatgtatgtatgcgtgcatatgctgcgaactgtgaggcatccatatcgaccggcaggttcttctctttggctac

SEQ ID NO: 5305 - DNA, 152 bp, Theobroma cacao
agattaagagtcttgttgggtagccaaggatgacttgcctatatccaaaaaggattttgaggaaagaaaagctgaatctgataaatctcatcagagtccttttaatggtttctgggcagtctcctttggctatcctgactggctcttatctt

SEQ ID NO: 5306 - DNA, 141 bp, Theobroma cacao
aagaagagagcctcgctggaaagccaagaatgacttgcctgcttcctccttgaggtttcaaaatttcaatgaaacttttaaaacccgccattctggctcgcgggcagtcttcttcgctttcttgacaggctattcttttcc

SEQ ID NO: 5307 - DNA, 144 bp, Theobroma cacao
gataaagagtctttgtttggtagccagggatgacttgcctacggcttttcaggtggttaatattgatgctatgattatgaatgtaaaacccctggctctggtctgcaggcagtcaccttggctatgctaacaggctcttttctc

SEQ ID NO: 5308 - DNA, 139 bp, Theobroma cacao
aggtaaagagtcatgcttggtagccaaggatgacttgcctgcacctttccccaaggattcaagtaaatggctaagaaacctgaaactcctttcaggttgccaggcagtcacctaggctaatctagcaggttcttttccc

SEQ ID NO: 5309 - DNA, 115 bp, Theobroma cacao
aagataagagttctgtttggtagccaaggatgagttgcctgctccttccaagaggtttcaaatcttgttgggttgccaggcattcaccttggctaacttgactggctcttttctt

SEQ ID NO: 5310 - DNA, 141 bp, Theobroma cacao
agataaagagtcttgtttgatagccaaggatgacttgcctgtacctcacagcaggtttctcttaggttaaaagttcttccttggaagcccctgtctagtttcaggcaattatccttggctaacctgacaggctcttctcta

SEQ ID NO: 5311 - DNA, 149 bp, Vitis vinifera
gtcttgtctgatagccaaggatgacttgcctgccctatcccaagtgggtcaatttctttcttttttccaagtagtgtttgatatttgatatatcatgaatccggttgtttgggttccaggcagtcaccttggctaattttacaggctct

SEQ ID NO: 5312 - DNA, 125 bp, Vitis vinifera
gtctcgtctggtagccaaggatgacttgcctaaatccaccaggtttcaaaacactgaatgtaattatccacaaagcgattccgtggtctttaggcagtcattccttcggctaaactgaccggctc

SEQ ID NO: 5313 - DNA, 248 bp, Vitis vinifera
cgttgtttggtagcgaaggatgacttgcctacagcctccttaaggtttcaaaataccgagcttgtctacctttgatcaaatgattcaagaaacaaaagaaaagaaaggccatggcagccatccatcagagtcaacatgagaatcatgttctatagaaattggagtcattcttgagaatgaacacgacactattagcttggaatctataatgtggtttatggcaagtctccttggcacctgatggcctc

SEQ ID NO: 5314 - DNA, 130 bp, Zea mays
taggctcggggactatggtgcagccaaggatgacttgccgatcgatgtgacgcctcttgatctcgtcgtcgtcagatcgtcgccgatcatcggcaagttgttcttggctacaccgtggctcctgctcctg

SEQ ID NO: 5315 - DNA, 156 bp, Zea mays
taggctcggggactacggtgcagccaaggatgacttgccgatctatcgtcgatcaacgagcgacgcctctgatgtctgatctcgacatctatcgtcgtcagaccatcatcatctatcggcaagttgttcttggctacaccgtggctcctgctcctg

SEQ ID NO: 5316 - DNA, 134 bp, Zea mays
atgaggtagagaacgggatgcagccaaggatgacttgccggctcctggaacctggaggcgtctcagcttgctgtgctgtggcttagaacttagtcggcaagtctgtccttggctacacctagttctcttcctct

SEQ ID NO: 5317 - DNA, 150 bp, Zea mays
accagagctgattcgttcagtagccaaggatgacttgcctaggtatatatgcatgggctatggctacatgcctgagagccagtctcttgtgacgctgagcatgtatagtgtaggcatgtcttccttggctactcggagcggctctagtca

SEQ ID NO: 5318 - DNA, 150 bp, Zea mays; identical to SEQ ID NO: 5317

SEQ ID NO: 5319 - DNA, 140 bp, Zea mays
cagagctagcctgcctctggtagccaaggatgacttgcctacatggtctcgctagttccggttgttgcatgcatgccactatgccagtcctgctgggtttgtgggcggtctccttggctagcctgagtggctcttgcctg

SEQ ID NO: 5320 - DNA, 128 bp, Zea mays
caataagggcctgcctctgatagccaaggatgacttgcctatgtcctttgtttacaaaggatcagaattgtggacctttgtgttggttcgtaggcagtctccttggctagcctgagtggcccctattg

SEQ ID NO: 5321 - DNA, 191 bp, Zea mays
gatgagagtggtagctctggtagccaaggatgacttgcctgtgtgctggccacgctcccctcatgcaaggaccatctcgtgtcgaccgacgagcgagcgagcgatcgatcgatgagaggatgacgaagcttggggtgtacgttggtctctcacgggcagtctccttggctagccctgactcactcttaccg

SEQ ID NO: 5322 - DNA, 191 bp, Zea mays; identical to SEQ ID NO: 5321

SEQ ID NO: 5323 - DNA, 151 bp, Zea mays
gcgataagagtctgtccagatagccaaggatgacttgcctgtggcttcttggcttggcttggctcgggcaaaaccttgtgcacgttttattgctcgcctcgtggcctcgatcacaggcagtctccttggctagtccgggcgggccccttat

SEQ ID NO: 5324 - DNA, 151 bp, Zea mays; identical to SEQ ID NO: 5323

SEQ ID NO: 5325 - DNA, 133 bp, Zea mays
cgatgagagcactgctctggtagccaaggatgacttgcctgtggcctccatcagtcgcagaggacgctgttcttctgcttgtggttgtcgatcgcaggcagtctccttggctagcccgagcggctctcatcca

SEQ ID NO: 5326 - DNA, 133 bp, Zea mays; identical to SEQ ID NO: 5325

SEQ ID NO: 5327 - DNA, 101 bp, Zea mays
ttagccaagaatggcttgcctatctccattattttgttcatcgcaggaagcccttccgtgatggatgaaatgtggatgatggcatccattcttggctaagt

SEQ ID NO: 5328 - DNA, 104 bp, Zea mays
ttagccaagaatggcttgcctatctccactgtttggttcgtcttgggagaccaccctgatgatgggtgtactgtgtggatgatggcaggccttcttggctaagc

SEQ ID NO: 5329 - DNA, 104 bp, Zea mays; identical to SEQ ID NO: 5328

SEQ ID NO: 5330 - DNA, 138 bp, Zea mays
gtagccaagaatgacttgcctatgcacgccctctgttggcagttccgtccggcagccatggcgacggttgcacaaggtgagtttttgcggcgtggatgatgcaatgtggctgcatcggcaggtcttcttggctagcca

SEQ ID NO: 5331 - DNA, 138 bp, Zea mays; identical to SEQ ID NO: 5330

SEQ ID NO: 5332 - DNA, 65 bp, Zea mays
gtagccaaggatgacttgccggcattatatttcttggcccgccggcaagtcatctggggctacgc

SEQ ID NO: 5333 - DNA, 65 bp, Zea mays; identical to SEQ ID NO: 5332

SEQ ID NO: 5334 - DNA, 106 bp, Zea mays
ttagccaagaatggcttgcctatctccattatttggtccatcttcttgggagacctccctcatggtgtggatggaatgtggatggtggcaggccttctggctaagt

SEQ ID NO: 5335 - DNA, 126 bp, Zea mays
gcagccaaggatgacttgccgggtattttgagcatgcatgttacaggggagcatatgcaatctgtttggaattttgagcccataccgtgcggtgcctgtcttccggcaagttgtccttggctacat

SEQ ID NO: 5336 - DNA, 102 bp, Physcomitrella patens
atggggagctggccaggctgtgagggacggagcagagttggcttgtggctccttgtggccccctccagcagcttcctcctcacagtctgcacagctctccgt

SEQ ID NO: 5337 - DNA, 141 bp, Arabidopsis lyrata; identical to SEQ ID NO: 5142

SEQ ID NO: 5338 - DNA, 123 bp, Arabidopsis lyrata; identical to SEQ ID NO: 5143

SEQ ID NO: 5339 - DNA, 159 bp, Arabidopsis thaliana; identical to SEQ ID NO: 5144

SEQ ID NO: 5340 - DNA, 167 bp, Arabidopsis thaliana; identical to SEQ ID NO: 5145

SEQ ID NO: 5341 - DNA, 151 bp, Brassica napus; identical to SEQ ID NO: 5146

SEQ ID NO: 5342 - DNA, 119 bp, Brassica napus; identical to SEQ ID NO: 239

SEQ ID NO: 5343 - DNA, 161 bp, Brassica rapa; identical to SEQ ID NO: 5147

SEQ ID NO: 5344 - DNA, 113 bp, Brassica rapa; identical to SEQ ID NO: 5148

SEQ ID NO: 5345 - DNA, 153 bp, Lotus japonicus; identical to SEQ ID NO: 5149

SEQ ID NO: 5346 - DNA, 310 bp, Medicago truncatula; identical to SEQ ID NO: 5150

SEQ ID NO: 5347 - DNA, 166 bp, Medicago truncatula; identical to SEQ ID NO: 5151

SEQ ID NO: 5348 - DNA, 106 bp, Medicago truncatula; identical to SEQ ID NO: 5152

SEQ ID NO: 5349 - DNA, 152 bp, Medicago truncatula; identical to SEQ ID NO: 5153

SEQ ID NO: 5350 - DNA, 102 bp, Medicago truncatula; identical to SEQ ID NO: 5154

SEQ ID NO: 5351 - DNA, 134 bp, Medicago truncatula; identical to SEQ ID NO: 5155

SEQ ID NO: 5352 - DNA, 107 bp, Medicago truncatula; identical to SEQ ID NO: 5156

SEQ ID NO: 5353 - DNA, 166 bp, Medicago truncatula; identical to SEQ ID NO: 5157

SEQ ID NO: 5354 - DNA, 103 bp, Medicago truncatula; identical to SEQ ID NO: 5158

SEQ ID NO: 5355 - DNA, 106 bp, Medicago truncatula; identical to SEQ ID NO: 5159

SEQ ID NO: 5356 - DNA, 199 bp, Medicago truncatula; identical to SEQ ID NO: 5160

SEQ ID NO: 5357 - DNA, 132 bp, Medicago truncatula; identical to SEQ ID NO: 5161

SEQ ID NO: 5358 - DNA, 393 bp, Medicago truncatula; identical to SEQ ID NO: 5162

SEQ ID NO: 5359 - DNA, 106 bp, Medicago truncatula; identical to SEQ ID NO: 5163

SEQ ID NO: 5360 - DNA, 107 bp, Medicago truncatula; identical to SEQ ID NO: 5164

SEQ ID NO: 5361 - DNA, 127 bp, Medicago truncatula; identical to SEQ ID NO: 5165

SEQ ID NO: 5362 - DNA, 134 bp, Medicago truncatula; identical to SEQ ID NO: 5166

SEQ ID NO: 5363 - DNA, 107 bp, Medicago truncatula; identical to SEQ ID NO: 5167

SEQ ID NO: 5364 - DNA, 111 bp, Theobroma cacao; identical to SEQ ID NO: 5168

SEQ ID NO: 5365 - DNA, 108 bp, Vitis vinifera; identical to SEQ ID NO: 253

SEQ ID NO: 5366 - DNA, 141 bp, Arabidopsis lyrata; identical to SEQ ID NO: 5142

SEQ ID NO: 5367 - DNA, 123 bp, Arabidopsis lyrata; identical to SEQ ID NO: 5143

SEQ ID NO: 5368 - DNA, 159 bp, Arabidopsis thaliana; identical to SEQ ID NO: 5144

SEQ ID NO: 5369 - DNA, 167 bp, Arabidopsis thaliana; identical to SEQ ID NO: 5145

SEQ ID NO: 5370 - DNA, 151 bp, Brassica napus; identical to SEQ ID NO: 5146

SEQ ID NO: 5371 - DNA, 119 bp, Brassica napus; identical to SEQ ID NO: 239

SEQ ID NO: 5372 - DNA, 161 bp, Brassica rapa; identical to SEQ ID NO: 5147

SEQ ID NO: 5373 - DNA, 113 bp, Brassica rapa; identical to SEQ ID NO: 5148

SEQ ID NO: 5374 - DNA, 153 bp, Lotus japonicus; identical to SEQ ID NO: 5149

SEQ ID NO: 5375 - DNA, 310 bp, Medicago truncatula; identical to SEQ ID NO: 5150

SEQ ID NO: 5376 - DNA, 166 bp, Medicago truncatula; identical to SEQ ID NO: 5151

SEQ ID NO: 5377 - DNA, 106 bp, Medicago truncatula; identical to SEQ ID NO: 5152

SEQ ID NO: 5378 - DNA, 152 bp, Medicago truncatula; identical to SEQ ID NO: 5153

SEQ ID NO: 5379 - DNA, 102 bp, Medicago truncatula; identical to SEQ ID NO: 5154

SEQ ID NO: 5380 - DNA, 134 bp, Medicago truncatula; identical to SEQ ID NO: 5155

SEQ ID NO: 5381 - DNA, 107 bp, Medicago truncatula; identical to SEQ ID NO: 5156

SEQ ID NO: 5382 - DNA, 166 bp, Medicago truncatula; identical to SEQ ID NO: 5157

SEQ ID NO: 5383 - DNA, 103 bp, Medicago truncatula; identical to SEQ ID NO: 5158

SEQ ID NO: 5384 - DNA, 106 bp, Medicago truncatula; identical to SEQ ID NO: 5159

SEQ ID NO: 5385 - DNA, 199 bp, Medicago truncatula; identical to SEQ ID NO: 5160

SEQ ID NO: 5386 - DNA, 132 bp, Medicago truncatula; identical to SEQ ID NO: 5161

SEQ ID NO: 5387 - DNA, 393 bp, Medicago truncatula; identical to SEQ ID NO: 5162

SEQ ID NO: 5388 - DNA, 106 bp, Medicago truncatula; identical to SEQ ID NO: 5163

SEQ ID NO: 5389 - DNA, 107 bp, Medicago truncatula; identical to SEQ ID NO: 5164

SEQ ID NO: 5390 - DNA, 127 bp, Medicago truncatula; identical to SEQ ID NO: 5165

SEQ ID NO: 5391 - DNA, 134 bp, Medicago truncatula; identical to SEQ ID NO: 5166

SEQ ID NO: 5392 - DNA, 107 bp, Medicago truncatula; identical to SEQ ID NO: 5167

SEQ ID NO: 5393 - DNA, 111 bp, Theobroma cacao; identical to SEQ ID NO: 5168

SEQ ID NO: 5394 - DNA, 172 bp, Arabidopsis lyrata; identical to SEQ ID NO: 202

SEQ ID NO: 5395 - DNA, 188 bp, Arabidopsis lyrata; identical to SEQ ID NO: 203

SEQ ID NO: 5396 - DNA, 178 bp, Citrus sinensis; identical to SEQ ID NO: 5118

SEQ ID NO: 5397 - DNA, 108 bp, Glycine max; identical to SEQ ID NO: 208

SEQ ID NO: 5398 - DNA, 184 bp, Oryza sativa; identical to SEQ ID NO: 5120

SEQ ID NO: 5399 - DNA, 184 bp, Oryza sativa; identical to SEQ ID NO: 5120

SEQ ID NO: 5400 - DNA, 176 bp, Oryza sativa; identical to SEQ ID NO: 5122

SEQ ID NO: 5401 - DNA, 176 bp, Oryza sativa; identical to SEQ ID NO: 5122

SEQ ID NO: 5402 - DNA, 137 bp, Zea mays; identical to SEQ ID NO: 5124

SEQ ID NO: 5403 - DNA, 166 bp, Zea mays; identical to SEQ ID NO: 5126

SEQ ID NO: 5404 - DNA, 117 bp, Zea mays; identical to SEQ ID NO: 5127

SEQ ID NO: 5405 - DNA, 114 bp, Zea mays; identical to SEQ ID NO: 5128

SEQ ID NO: 5406 - DNA, 198 bp, Arabidopsis lyrata
tcgttttttatattgttttcctttgatctatcacttaagcacgagagagtccctttgatattggcctggttcactcagatcttccctgaccacactcacgtcgtacatatgcattctctctagattatctgattgagccgcgccaatatctcagtactctctcgtctctattttggactttgtgatcttgtaaatcga

SEQ ID NO: 5407 - DNA, 137 bp, Arabidopsis lyrata
gagtgattttatgtaaggtaacgcgagatattagtgcggttcaatcaaatagtcgtcctcttaactcatggagatcggtgttgttcgattgagccgtgccaatatcacgcggtaaaccaaaatggcaaagatcgatc

SEQ ID NO: 5408 - DNA, 111 bp, Arabidopsis lyrata
ggacatcgaatacgagatattggtgcggttcaatcagaaaactgtactcttttgttttaaagatcggtttgtttgattgagccgtgccaatatcacgtgtttaaatagttt

SEQ ID NO: 5409 - DNA, 102 bp, Aquilegia coerulea
gatgttggctcggttcattcagacttatatatataccaccaatgtttacagagatgtaaataaaagtggtgcagttgtttgattgagccgtgccaatatctt

SEQ ID NO: 5410 - DNA, 77 bp, Aquilegia coerulea
ggtgttggaatggctcaatcaaatgaaagctctcaaagattgggtcctttaatctgattgagccgtgccaatatcac

SEQ ID NO: 5411 - DNA, 80 bp, Aquilegia coerulea
gatattggcacggctcaattaaataacaaagctcaaaacttatgagcaactgttttctaattgaaccgcactaatatctc

SEQ ID NO: 5412 - DNA, 106 bp, Aquilegia coerulea
gatgttggtcgggttcaatcagaaacaagcatttgtaaaagaatgctatagatttctacagagccatattactggtgtacttttgattgagccgtgccaatatctt

SEQ ID NO: 5413 - DNA, 102 bp, Aquilegia coerulea
gatattggcacggctcaatcaaacaactgcaccacttttatttacatctctgtaaacattggtggtatatatataagtctgaatgaaccgagccaacatcac

SEQ ID NO: 5414 - DNA, 88 bp, Aquilegia coerulea
acgagatattagtgcggttcaattagaaaacagttgctcataagttttgagctttgttatttaattgagccgtgccaatatcacgttg

SEQ ID NO: 5415 - DNA, 123 bp, Arabidopsis thaliana
atgagagagtccctttgatattggcctggttcactcagatcttacctgaccacacacgtagatatacattattctctctagattatctgattgagccgcgccaatatctcagtactctctcgt

SEQ ID NO: 5416 - DNA, 117 bp, Arabidopsis thaliana
tgcaaggtaacgcgagatattagtgcggttcaatcaaatagtcgtcctcttaactcatggagaacggtgttgttcgattgagccgtgccaatatcacgcggtaaaccaaaaatggca

SEQ ID NO: 5417 - DNA, 116 bp, Arabidopsis thaliana
tgagcgcactatcggacatcaaatacgagatattggtgcggttcaatcagaaaaccgtactcttttgttttaaagatcggtttatttgattgagccgtgccaatatcacgcgttta

SEQ ID NO: 5418 - DNA, 120 bp, Brachypodium distachyon
gaggtaggaggcggagcggaggaaaggcttcccgaccgggggaagctggtgattgagccgcgccaatatctctcgcgcgccagtggaattgccggcttcagctgctttcgccgccgcagc

SEQ ID NO: 5419 - DNA, 164 bp, Brachypodium distachyon
ccaaggattactatactggctgggagagtgcgatgttggcacggttcaatcaaatcgggtggtctctgcatgcactggcttgcgagcaagctgcgatgatgtttcgctccatctgattgagccgtgccaatatcgcaagcttctttgcctagcaacctgtaccg

SEQ ID NO: 5420 - DNA, 86 bp, Brachypodium distachyon
cgcggtattggtgcggttcaatcagaaagctggcgctccggacgcaaaaggggttcctctctttgattgagccgtgccaatatcac

SEQ ID NO: 5421 - DNA, 156 bp, Brachypodium distachyon
gctgaggcaagggaatgatgaaatggccactatgatgttggctcgactcactcagacgacaccggccggagcgatgcgtgcgtgctagctcgacggcgtgtttctgattgagccgtgccaatatcttagtgctctttcatgcatagaagctatctt

SEQ ID NO: 5422 - DNA, 104 bp, Brassica napus
tggtcaagcgagatattagtgcggttcaatcaaatagtctcactcttagttgatagagattgattttgttcgattgagccgtgccaatatcacgcatataacca

SEQ ID NO: 5423 - DNA, 101 bp, Brassica napus
ggtaacgcgagatattagtgcggttcaatcaaatagtcgtgttctcacttgatagagatcggttttgttcgattgagccgtgccaatatcacgcgtcaacc

SEQ ID NO: 5424 - DNA, 88 bp, Brassica napus
gcgagatattagtgcggttcaatcaaatagtcgtactcttagctattagagatcggttttgttcgattgagccgtgccaatatcacgc

SEQ ID NO: 5425 - DNA, 96 bp, Brassica napus
acaatgcgagatattggtgcggttcaatcagaaatccacactcttttgttgtagagatcggtttgtttgattgagccgtgccaatatcacgagtgt

SEQ ID NO: 5426 - DNA, 92 bp, Brassica napus
caatacgagatattggtgtggttcaatcagaaaaccacactcttttgttgtagagatcggtttgtttgattgagccgtgccaatatcacgag

SEQ ID NO: 5427 - DNA, 119 bp, Brassica napus
acgaaagagtcctctttgatattggcctggttcactcagatcttccagattacacacgtactatatacattctctcagttatctgattgagccgcgccaatatctcagtgctctctcgt

SEQ ID NO: 5428 - DNA, 80 bp, Brassica napus
gatattggcctggttcactcagattacacacgtactatatgcattctcttagttatctgattgagccgcgccaatatctc

SEQ ID NO: 5429 - DNA, 96 bp, Brassica oleracea; identical to SEQ ID NO: 5425

SEQ ID NO: 5430 - DNA, 85 bp, Brassica rapa
cgagatattggtgtggttcaatcagaaaaccacactcttttgttgtagagatcggtttgtttgattgagccgtgccaatatcacg

SEQ ID NO: 5431 - DNA, 104 bp, Brassica rapa; identical to SEQ ID NO: 5422

SEQ ID NO: 5432 - DNA, 88 bp, Brassica rapa; identical to SEQ ID NO: 5424

SEQ ID NO: 5433 - DNA, 101 bp, Brassica rapa; identical to SEQ ID NO: 5423

SEQ ID NO: 5434 - DNA, 119 bp, Brassica rapa; identical to SEQ ID NO: 5427

SEQ ID NO: 5435 - DNA, 321 bp, Citrus clementine
gatctcttgggggttaaaatgaagattgtggtgaccattttggaggatggatgggtactcacgggatattggtgcggttcaataagaaaacggtgctcaatactttttgagctccgctttttgattgagccgcgccaatatcacgtgccactcgctctctaattgctttcttttaagcacaggggagcgcgtaattatgttgaggtcaggtaagtaggggtttaaattaaaattctagcttattgcttctgtttaaattttactgttcaattggctccatttagatgcatcattgtttttatgttatgaccctttcgaatt

SEQ ID NO: 5436 - DNA, 201 bp, Citrus reticulata
aatatgacaggaatatgcaggatgctggaatcttgtttcctatcttttgggggttaaaatgaagattgtggtgaccattttggaggatggatgggtacaacgggatattggtgcggttcaataagaaaacggtgctcaatactttttgagctccgctttttgattgagccgtgccaatatcacgtgccactcgctctctaa

SEQ ID NO: 5437 - DNA, 97 bp, Citrus sinensis
tactcacgggatattggtgcggttcaataagaaaacggtgctcaatactttttgagctccgctttttgattgagccgcgccaatatcacgtgccact

SEQ ID NO: 5438 - DNA, 165 bp, Citrus sinensis
caggcagagaaagcacttcttggcgattggagaagtagacatggtgtgatattggttcggctcatcttaattaatagattcatatttcagcccttaaggttcttacatgtatatatctagacgagccgaatcaatatcactcttgtatgcttctttcttttgatt

SEQ ID NO: 5439 - DNA, 371 bp, Citrus trifoliata; identical to SEQ ID NO: 205

SEQ ID NO: 5440 - DNA, 130 bp, Festuca arundinacea
gagtgcgatgttggcatggttcaatcaacaatcgagtggtctctgcatagcttccttgctagcgtggtggcatgctgctttgcttgatctgattgagccgtgccaatatcgcaagcttcctgcctagccc

SEQ ID NO: 5441 - DNA, 102 bp, Glycine max
gttcaacgggatattggtccggttcaataagaaagcaatgctcaaaatgtttttgggtcctgttttttcattgagccgtgccaatatcacgaaccactgctc

SEQ ID NO: 5442 - DNA, 92 bp, Glycine max
tagacacggcgtgatattggtacggctcatcttaattcaaccattatatcaacaattgagacgagccgaatcaatatcactcttgtttgctt

SEQ ID NO: 5443 - DNA, 173 bp, Hordeum vulgare
gcgggttgatggccaggaactccgacaagaggaggatgctgaaacggtcactatgatgttggctcgactcactcagaccacgccggagggagccatctgcggcggcggttctgattgagccgtgccaatatcttagtgctctttcatgctcgtcccttgtcgccatcacccac

SEQ ID NO: 5444 - DNA, 114 bp, Medicago truncatula
tgaattcccctccgctttttgatgttggcttgtctcaatcaaatcaaagttcttgaaatttgagttctttagtctgattgagtcgtgccaatatcatattaagcgataaaagtc

SEQ ID NO: 5445 - DNA, 94 bp, Medicago truncatula
agcaaggtattggcgcgcctcaatttgaatacatggctataaaaatgcatcatatcagccatgtagtttgattgagccgcgtcaatatcttgtt

SEQ ID NO: 5446 - DNA, 105 bp, Medicago truncatula
attgagatattggcttggttcactcagaagaaacaaaaaataacactacttgtgaatgttttgattttgattttgattttgattgagccgtgccaatatttcaaa

SEQ ID NO: 5447 - DNA, 105 bp, Medicago truncatula
aatgagatattggcctggttcactcagaccaagtgataaaccactaagatacagtattgtacttgtgtggttttgggtttgattgagccgtgccaatatctcact

SEQ ID NO: 5448 - DNA, 93 bp, Medicago truncatula
aaagcgatgttggtgaggttcaatccgaagacggatttacatgtatagagttgtaaaatacgatctcagattgagccgcgccaatatcacttt

SEQ ID NO: 5449 - DNA, 95 bp, Medicago truncatula
gatgagatattggtgcggttcaatcagaaggcagtgcttttataattcaaaaagctctgtgttatttgattgagccgtgccaatatcacgtgtta

SEQ ID NO: 5450 - DNA, 105 bp, Medicago truncatula; identical to SEQ ID NO: 5447

SEQ ID NO: 5451 - DNA, 96 bp, Oryza sativa
ggaaagagcgatattggtgaggttcaatccgatgattggttttacagcagtggtaaaatcagtatctgattgagccgcgccaatatctcttcctct

SEQ ID NO: 5452 - DNA, 100 bp, Oryza sativa
gcgacgacgggatattggggcggttcaatcagaaagcttgtgctccggaagcgaggagctctactcttttgattgagccgtgccaatatcacgtcgcatc

SEQ ID NO: 5453 - DNA, 99 bp, Oryza sativa
gtgggaacgggatattggtgcggttcaatcagaaagcttgtgctccgaaggcgaggggctccactctttgattgagccgtgccaatatcacgtcgcctt

SEQ ID NO: 5454 - DNA, 135 bp, Oryza sativa
ttgtagctatgatgttggcccggctcactcagatggatcatcggtgcagaagagtgcatgaatctgatgcagtctcagtgtagtatgctccatgctggaacttctgattgagccgtgccaatatctcagcaccat

SEQ ID NO: 5455 - DNA, 119 bp, Oryza sativa
tggtagctatgatgttggctcggctcactcagacggcattggcgtgatgcaaagcatgcatgcgtgcttgctagctcacttgtgtttctgattgagccgtgccaatatcttagtgctct

SEQ ID NO: 5456 - DNA, 127 bp, Oryza sativa
gggagagtgcgatgttggcatggttcaatcaaaccgggcaaacttatgcactagctaagcaagatgcagggatatgcagtatggttttgtttggtctgattgagccgtgccaatatcacaagcttgc

SEQ ID NO: 5457 - DNA, 89 bp, Oryza sativa
gacatggcatggtattgacttggctcatctcagcaacagcaaactgcatgcagcgctggaggtgagccgagccaatatcacttcatgtc

SEQ ID NO: 5458 - DNA, 101 bp, Oryza sativa
agaagaagaggacatggtttggtattgtttcggctcatgtcgttcacacagatgtgagccgaaccaatatcactcatgtattcttcattcagagaacttct

SEQ ID NO: 5459 - DNA, 120 bp, Oryza sativa
taaaaagaggtattggcgtgcctcaatccgaaggcatggctgattacaggcacctcgaccgatctagcgcatgcagccatgtttcttggattgagccgcgtcaatatctctccttgcttc

SEQ ID NO: 5460 - DNA, 91 bp, Physcomitrella patens
aggcatgtgatattggtggcgctcaatcagatgaccatgcctgtgatgctggcgttgccatcagattgagccgcgccaatatcacatcctt

SEQ ID NO: 5461 - DNA, 92 bp, Physcomitrella patens
aggcatgtgttattgggcccgctcaatcagatgtcttttccagcaacggctggtattgtcctcagattgagccgcgccaatatcacatcctt

SEQ ID NO: 5462 - DNA, 179 bp, Pinus taeda
tgtgattgagacgagtccatatcttcttcaggcgaagcctccaccactccaaaagaactgaatgcaggtttccgatgcatcaatctcagtgcactagacaatatcatgttggagggtacagacagtgccgccatgtttggatggaggagacccaggtctgttattgttctcgatacaca

SEQ ID NO: 5463 - DNA, 104 bp, Populus trichocarpa
tcagagaaaacgggatattggtacggttcaatcagaaagtaatgctcccaaaagtatagagtactattgtttgattgagccgtgccaatatcacgtacactcat

SEQ ID NO: 5464 - DNA, 103 bp, Populus trichocarpa
ttatatataacgagatattggtgcggttcaatcagatagtaatgctccataagcatagagctctattgtttgattgagccgtgccaatatcacgtatatgttg

SEQ ID NO: 5465 - DNA, 104 bp, Populus trichocarpa
aaaagaaagcgatgttggtgaggttcaatccgaagacggatttacacgtgaaagtaattgtaaaatacgatctcagattgagccgcgccaatatcactttctca

SEQ ID NO: 5466 - DNA, 100 bp, Populus trichocarpa
aaaagaaagcgatgttggtgaggttcaatccgaagacagatttacacgagtgaaagtaaaatccgatctcagattgagccgcgccaatatcacttttcag

SEQ ID NO: 5467 - DNA, 94 bp, Populus trichocarpa
gtggaaatttgatgttggcagagctcaatcaaatcaaagcactcaatggttgggttctttcatctgattgagccgtgccaatatcgcattaaat

SEQ ID NO: 5468 - DNA, 130 bp, Populus trichocarpa
gtgtcattgcgatgttggcccggttcactcagagaaaagacaccattttttttcaagaagatcatcaaagcttgaaagaataatggtggtcggtcgtctctgattgagccgtgccaatatcttagtgctc

SEQ ID NO: 5469 - DNA, 100 bp, Populus trichocarpa
gaaagtgggggatgttgggatggctcaatcatgtcaaatctcccaaattatgatgttgggtcttttaatctgattgagccgtgccaatatcacacttctt

SEQ ID NO: 5470 - DNA, 100 bp, Populus trichocarpa
gaaagtgggggatgttgggatggctcaatcatatcaaatctcccaaactatgatgttgggtcgtttaatctgattgagccgtgccaatatcacactaact

SEQ ID NO: 5471 - DNA, 129 bp, Populus trichocarpa
gagtgactatgatattggcctggttcactcagatcacgacttcagagcaaagtgtctttcttcttcttcttcttcttcttgttttatgttcgtttgatttgattgagccgtgccaatatctcagtactc

SEQ ID NO: 5472 - DNA, 95 bp, Populus trichocarpa
ctaactcaagatattggcacagttcatcctcacagtggccttgatgaatgattcaaatctatggttggattgagccgcgccaatactgtgtgcca

SEQ ID NO: 5473 - DNA, 78 bp, Populus trichocarpa
gatactggctcggttcaacctcatcgtagtcttgatgaatgattcaaatctatggttggattgagccgcgccaatatc

SEQ ID NO: 5474 - DNA, 112 bp, Populus trichocarpa
ggagaagtagacacggtgtgatattggtccggctcatcttctgtgcataagcatctgaagttcttcactcatgaagacgagccgaatcaatatcactcttgtatgcttcttc

SEQ ID NO: 5475 - DNA, 101 bp, Populus trichocarpa
gaagcagacatggcgtggtattgatccggctcatcttctgtatttgcatcagaagttcttcgctgaagacgagccgaatcaatatcactcttgtacgcttc

SEQ ID NO: 5476 - DNA, 101 bp, Populus trichocarpa
gaagcagacatggcgtggtattgatccggctcttcttctgtatttgcatcagaagtttttcgctgaagacgagccgaatcaatatcactcttgtacgcttc

SEQ ID NO: 5477 - DNA, 92 bp, Ricinus communis
aaacgggatattggtccggttcaataagaaaacagtgctcaaaatgttatgggccctgctttttgattgagccgtgccaatatcacgtgcac

SEQ ID NO: 5478 - DNA, 91 bp, Ricinus communis
gtacgagatattggtgcggttcaatcagagatcattgctctatatatagagcttttgttgtttgattgagccgtgccaatatcacgtgcat

SEQ ID NO: 5479 - DNA, 87 bp, Ricinus communis
tctgatgttggcatggttcaatcaaatcgaagcactcagctgcctgctgagttctttaatctgattgagccgtgccaatatcgccat

SEQ ID NO: 5480 - DNA, 124 bp, Ricinus communis
tgtgatgttggcccggttcactcagacaaaaacgatgtgttttctcaagcatttgtttttcgaaacgcttgatatgttaacacaagcataatggcctttgattgagccgtgccaatatcttagt

SEQ ID NO: 5481 - DNA, 84 bp, Ricinus communis
ggggatgttggaatggctcaatcaaatcaaatctcccaaagttttgggtcctttaatctgattgagccgtgccaatatccccca

SEQ ID NO: 5482 - DNA, 111 bp, Ricinus communis
tgtgatattggcctggttcactcagacatgaaacctatcccttctcctgcttattgcctgaatagggtgttgttgctatatgttttgattgagccgtgccaatatctcagt

SEQ ID NO: 5483 - DNA, 89 bp, Ricinus communis
agcgatgttggtgaggttcaatccgaagacggatttacacattctgttgtaaaggacgatctcagattgagccgcgccaatatcacttt

SEQ ID NO: 5484 - DNA, 161 bp, Sorghum bicolor
ttggttggctgagagagtgcgatgttggcatggttcaatcaaatcatcgcccggcaaggtgacttaaattttgcgctttcgatcgatcgaggtgcagggaggtgtttccaggcaccgtgtttgattgagccgtgccaatatcacaaccttctctagcctat

SEQ ID NO: 5485 - DNA, 132 bp, Sorghum bicolor
atggccgccgcgcgcgacggggtattggcgcggttcaattcgagagctcgagccctagactagacgccagggagagagggggctctgctctctgattgagccgtgccaatatcacgtcccgcttgaatggct

SEQ ID NO: 5486 - DNA, 109 bp, Sorghum bicolor
agaacgagacgacatggcatggtattgacttggctcatctctcatccacagcaaacttcacaagtgcctgaggtgagccgagccaatatcacttcatgtcatctagcgt

SEQ ID NO: 5487 - DNA, 153 bp, Sorghum bicolor
ataatggaatagtagctatgatgttggctcggctcactcagaccacctctccgatcctcagctcgtgtccattgcgacatcgatcatgtatatatgtcgctggtcgtggtttctgattgagccgtgccaatatctcagtactcttccatatat

SEQ ID NO: 5488 - DNA, 124 bp, Sorghum bicolor
aggaggaagaagacgacatggcgtggtattgtttcggctcatgtccttcttgcttcgagtctgtcgtcggattttggatgtgatgtgagccgaaccaatatcactcatgtattcttcattctga

SEQ ID NO: 5489 - DNA, 119 bp, Sorghum bicolor
tgagagaataagacgacatggcgtgatgttgtttcggctcatgcatatccttcttgagtgtatcatcaggaaagaggcgatgagccgaaccaatatcactcatgtattcttcattcata

SEQ ID NO: 5490 - DNA, 77 bp, Sorghum bicolor
tattggtgaggttcaatccgatgataggttttacaaacagctgtaaaatcagtatctgattgagccgcgccaatatc

SEQ ID NO: 5491 - DNA, 81 bp, Sorghum bicolor
ggtattggcgcgcctcaatccgaaggcgtggctgatttggcatggcagccatgttcttggattgagccgcgtcaatatctc

SEQ ID NO: 5492 - DNA, 90 bp, Sorghum bicolor
gtgttggctcggctcactcagaagctgaaatagtagtgatgaatctaaatggtagctatggcgtttctgattgagccgtgccaatatctt

SEQ ID NO: 5493 - DNA, 108 bp, Sorghum bicolor
gcgagcgatattggtgaggttcaatcagatcatcagatgatgtattttaaatttacatgcatgaaggtgaatccccagggactgattgagccgcgccaatatcacttc

SEQ ID NO: 5494 - DNA, 87 bp, Sorghum bicolor
cgggatattggcgcggttcaatcagaaagcttgcgctccaaagcccaggggctccactctttgattgagccgtgccaatatcacgtc

SEQ ID NO: 5495 - DNA, 122 bp, Solanum lycopersicum
tgaaacagtaactttgatattggcctggttcactcagacaacaaaatgtaaactatatttgaatggttgagttttcgtttttcgtttgattgagccgtgccaatatctcagtttctctttca

SEQ ID NO: 5496 - DNA, 86 bp, Solanum lycopersicum
acgagatattggtgcggttcaattagaaagcgcacttctttatatatagaacttcgttatttaattgagccgtgccaatatcacgt

SEQ ID NO: 5497 - DNA, 112 bp, Solanum lycopersicum
atggaagaagcgatgttggtgaggttcaatccgaagacgaatttatgcttattttcgtaaagaacgatctcagattgagccgcgccaatatcacttcttattttcattccgt

SEQ ID NO: 5498 - DNA, 135 bp, Selaginella moellendorffii
cgagcgagagcgatattggctctgctcaatcgcatgacgctgctgcatcgcacgaaaaatttgcgatgggaatggatcgatggagtcgcagcagaggcatgagattgagccgtgccaatatcactggtgtttttc

SEQ ID NO: 5499 - DNA, 103 bp, Selaginella moellendorffii
tgtgtctgtgatattgacaaggctcaatcaggctgcaatgctactcgagctaattagtgatgctgccagcttgagccgtgccaatatcacatagatagctagc

SEQ ID NO: 5500 - DNA, 215 bp, Selaginella moellendorffii
acggatcatcgaaatcgatgtgtgctttgatattggcatgattcaatcccatgacaccatctacaaacaccgaaaagagaagctttacgatggtctagcaaagttcttctcgcgaaagagaagccttacgaagatctagccaaaatttcgtggcatggacgagcaaagggtgctggcattggattgagtcgcgccaatatcatgtgattgcgttg

SEQ ID NO: 5501 - DNA, 103 bp, Selaginella moellendorffii
tgcgaggtatgtgatattgggatggctcaatcagatggcgttcgctgcaatgctcagccagcgctctcaaattgagccgcgccaatatcacatccttggaaaa

SEQ ID NO: 5502 - DNA, 130 bp, Triticum aestivum
tggaatggtcactatgatgttggctcgactcactcagaccacgcctgccggccggccgtagccatgcatctgcatgcggtggtggctctgattgagccgtgccaatatctcagtgctctttcatgcatgc

SEQ ID NO: 5503 - DNA, 138 bp, Triticum aestivum
tgagttaatcctgcgaggggagtgaacgcggtattggtgcggttcaatcagagagctggcgccccaggaggcaaggggttcctcccttcgattgagccgtgccaatatcacgcggtttctcatgaatcgcatcctcct

SEQ ID NO: 5504 - DNA, 119 bp, Theobroma cacao
ttaggcacctacctacactaggtattgacacggttcaacctcaccgtaatgtcaatgaactaactcgactttatggtttgattgagccgcgccaatatcttgtgctttttaccttaatt

SEQ ID NO: 5505 - DNA, 120 bp, Theobroma cacao
atttggattaagatgaaggcgatgttggtgaggttcaatctgaagatgggcgtatgcgagaagcataggaattcatttcagattgagccgcgccaatatcactttctttacaatgggttt

SEQ ID NO: 5506 - DNA, 123 bp, Theobroma cacao
gggaagcaaaaagaaagcgatgttggtgaggttcaatccgaagacggatttacgcatgcattcagtcgtaaaatacgatctcagattgagccgcgccaatatcactttccaaaaatatatgcc

SEQ ID NO: 5507 - DNA, 117 bp, Theobroma cacao
acacaggagtttgccatcgagatattggtgcggttcaatcggagagcatcactctaaagggtagagttctgttatttgattgagccgtgccaatatcacgtacaactgctcatgatt

SEQ ID NO: 5508 - DNA, 161 bp, Theobroma cacao
ttggttgcaatagtcactacgatgttggctcggttcactcagacaaaatcaaccctacgcttctcaagcacacacacacaaaaaaaagagctttagattttgcgtatcttccatgtgttttgattgagccgtgccaatatcctagtgccttttcaattcac

SEQ ID NO: 5509 - DNA, 117 bp, Theobroma cacao
gcacaaagagaaaacggggatgttggaatggctcaatcaaatcaaatctcccaagctttttatgggtgttttaatttgattgagccgtgccaatatcacgttaattacttatcttca

SEQ ID NO: 5510 - DNA, 115 bp, Theobroma cacao
gatttcttagttgaaaatttgatgttggcacggttcaatcggatcaaatctctcagtggctgagtcctttagtctgattgagccgtgccaatatcacattcagtcactgcatcgg

SEQ ID NO: 5511 - DNA, 135 bp, Theobroma cacao
ctacatgaaatagtaactgtgatattggcctggttcactcagacattcaatgacagcactttctgaagagtaaagcattttgctggttttggtctgattgagccgtgccaatatcttagaactctttcatatctc

SEQ ID NO: 5512 - DNA, 99 bp, Vitis vinifera
tggtgggaagcgtgatgttgggacggctcaatcaaaccaaagatctcaatggttgagtcctttaatctgattgagccgtgccaatatcatgttcaatac

SEQ ID NO: 5513 - DNA, 99 bp, Vitis vinifera
tggggggaggtattggcgtgcctcaatttaaagacatggttagatgaagagatattagccatgtgatttgattgagccgcgtcaatatctccttttgca

SEQ ID NO: 5514 - DNA, 103 bp, Vitis vinifera
tggtattacgggatattggtgcggttcaataagaaagcagtgctcgcaatctttttgagttctggtttttgattgagccgtgccaatatcacgtgtcattgct

SEQ ID NO: 5515 - DNA, 100 bp, Vitis vinifera
tagatacacgagatattgatacggttcaattagaaagctgtgttctaagttaagaactctgttgtttgattgagccgtgccaatatcacgtcctacttct

SEQ ID NO: 5516 - DNA, 103 bp, Vitis vinifera
ggaaagtaagcgatgttggtgaggttcaatccgaagacggatttacgaagagccgtaaagaacgatctctgattgagccgcgccaatatcactttctgctaag

SEQ ID NO: 5517 - DNA, 103 bp, Vitis vinifera
ttgaagaaagcgatgttggtgaggttcaatctgaagattgatttatgcttgaatgtaaaaactgatctcagattgagccgcgccaatatcacttttctgtggc

SEQ ID NO: 5518 - DNA, 76 bp, Vitis vinifera
gccagcctctccatgttggttccatcggtgggggacaccaactccttgagccgaaccaatatcacccgagccaaat

SEQ ID NO: 5519 - DNA, 96 bp, Vitis vinifera
tttcacgagatgttggtgcggttcaacctaactgtagtgtccatgaatgtatcgactctgatgtttggttgagccgcgccaatatcccgtctatct

SEQ ID NO: 5520 - DNA, 103 bp, Vitis vinifera
gaagaaggtggggatgttggaatggctcaatcaaatcaaatctcccaagggttttgggtcctttaatctgattgagccgtgccaatatcatcatgttcacttc

SEQ ID NO: 5521 - DNA, 99 bp, Zea mays
gatattggcgaggttcaatcagatgatgtatttttcttatatataaatttgcatgcatgaaggtgtgaatccagtgtctgattgagccgcgccaatatc

SEQ ID NO: 5522 - DNA, 85 bp, Zea mays
cgggatattggcgcggttcaatcagaaagcttgcgctccaggcccgaggggctccactctttgattgagccgtgccaatatcacg

SEQ ID NO: 5523 - DNA, 118 bp, Zea mays
ggggaatcgaaaacctacgggatattggtgcggttcaatcagaaagcttgcgctccaaagcccaggggctccactctttgactgagccgtgccaatatcacgtcctcgctttgcttgc

SEQ ID NO: 5524 - DNA, 121 bp, Zea mays
agaaatggaagtgtaactatggtgttggctcggctcactcagaagttgaagccgaatccaaatggtagctgccggcgtttctgattgagccgtgccaatatctcagtactctttcatgctg

SEQ ID NO: 5525 - DNA, 126 bp, Zea mays
agaaatggaatagtagctatgatgttggctcggctcactcagacgacgtacgcgcgcgagatcatgtgctatgccgctgctgtttctgattgagccgtgccaatatcttagtactcttccatgcat

SEQ ID NO: 5526 - DNA, 155 bp, Zea mays
ttggttgttggctgagagagtgcgatgttggcatggctcaatcaactcgccggccgcgggtggcttatagcttaattctgcgcattcgatcgaggtgcgggcgcagtgtttaattgattgagccgtgccaatatcacaaccttctctagcctata

SEQ ID NO: 5527 - DNA, 112 bp, Zea mays
agaacgaggcgacatggcatggtattgacttggctcatctctcgcccacaccagaatccacaagtgccggaggaggtgagccgagccaatatcacttcatgtcatctagcgt

SEQ ID NO: 5528 - DNA, 124 bp, Zea mays
gggaggaaggagacgacatggcgtggtattgtttcggctcatgtccttcttcgatcgagtcttgccgttggatttggatgtgatgtgagccgaaccaatatcactcatgtactcttcattccca

SEQ ID NO: 5529 - DNA, 104 bp, Zea mays
ctggttggctgagagagtgcgatgttggcacggttcaatcaaatcgccggccgggttgacttgttgattgagccgtgccaatatcacaaccttctctagcctag

SEQ ID NO: 5530 - DNA, 129 bp, Zea mays
aatggccgcgagctagacggggtattgacgcggttcaattcgagagctcgagccctagcagaggccagggggggtggggctctgctctctgattgagccgtgccaatatcacgtcccactcgccctcgc

SEQ ID NO: 5531 - DNA, 104 bp, Zea mays
gggaggaagaagacgacatggcgtggtattgtttcggctcatgtccttcttgactggatgtgatgtgagccgaaccaatatcactcatgtattcttcattctga

SEQ ID NO: 5532 - DNA, 78 bp, Zea mays
gtattggcgtgcctcaatccgaaggcgtggctgactggcgcggcagccatgttcttggattgagccgcgtcaatatct

SEQ ID NO: 5533 - DNA, 82 bp, Zea mays
gtattggcgcgcctcaatccgaaggcgtggctgatagattggcgcggcagccatgttcttggattgagccgcgtcaatatct

SEQ ID NO: 5534 - DNA, 78 bp, Zea mays
atattggtgaggttcaatccgatgttaggttttacaaaagctgtaaaatcagtatctgattgagccgcgccaatatct

SEQ ID NO: 5535 - DNA, 126 bp, Arachis hypogaea
aaatattcgaattatgtgtctgcctggctccctgaatgccatgtaagttagtttgttaagaaaagattaacaaacgtcttatatggcatgaagggagtcacgcaggcgattcattttgaaacatat

SEQ ID NO: 5536 - DNA, 158 bp, Arabidopsis lyrata
cgcctatacatgtatatagatgtatatgtattatatatgtatgcctggctccctgtatgccatatgctgagctcatcgagtatcgatgacctccgtggatggcgtatgaggagccatgcatatcctcatacatatatatacataattatgtgatggtg

SEQ ID NO: 5537 - DNA, 125 bp, Arabidopsis lyrata
tatatatagatttaaggtcgtgcctggctccctgtatgccacaagaaaacatcgatttagttacaaaatcgatcactagtggcgtacagagtagtcaagcatgaccaaagctttcttgatatata

SEQ ID NO: 5538 - DNA, 127 bp, Brassica rapa; identical to SEQ ID NO: 240

SEQ ID NO: 5539 - DNA, 104 bp, Zea mays
ttgtgtgcgtgcctggctccctgtatgccacacatgtagcgcccaacccagatgytaaggttgcctgctgtgggtggcgtgcaaggggccaagcatgcatccat

SEQ ID NO: 5540 - DNA, 121 bp, Zea mays
cgatcggctcgtgtcgtgtgtgcctggctccctgtatgccacacatgtagccaacccgtggcgtgattggatgctgtgggtggcgtgcaaggagccaagcatgcataacaggccatgatca

SEQ ID NO: 5541 - DNA, 100 bp, Zea mays
aggatgtgcctggctccctgtatgccactcatctagagcaacgacagcttggtagggttgcctataagatggatggcgtgcatggtgccaagcatatctc

SEQ ID NO: 5542 - DNA, 142 bp, Zea mays
ggccaggggcgggatcgatatgcctggctccctgtatgccactcgcatggctgccaactcatcatgcatacactgctagctagtcgttggctccactgcggatggcgtgcgtggagccaagcatgaccgatcatctcctcct

SEQ ID NO: 5543 - DNA, 116 bp, Zea mays
gaggtgaaagatagggaatatgcctggctccctgtatgccgctcgcatggctaccaccgcctgtggtcgttgcggctggcgtgcgaggtgccaggcatgttttaataattatctcc

SEQ ID NO: 5544 - DNA, 86 bp, Zea mays
atgcctggctccctgtatgccacacatgtagcccaacccgtgatgtgattggatgctgtgggtggcgtgcaaggagccaagcatgt

SEQ ID NO: 5545 - DNA, 158 bp, Arabidopsis lyrata; identical to SEQ ID NO: 5536

SEQ ID NO: 5546 - DNA, 125 bp, Arabidopsis lyrata; identical to SEQ ID NO: 5537

SEQ ID NO: 5547 - DNA, 119 bp, Arabidopsis lyrata; identical to SEQ ID NO: 236

SEQ ID NO: 5548 - DNA, 104 bp, Zea mays; identical to SEQ ID NO: 5539

SEQ ID NO: 5549 - DNA, 121 bp, Zea mays; identical to SEQ ID NO: 5540

SEQ ID NO: 5550 - DNA, 100 bp, Zea mays; identical to SEQ ID NO: 5541

SEQ ID NO: 5551 - DNA, 142 bp, Zea mays; identical to SEQ ID NO: 5542

SEQ ID NO: 5552 - DNA, 116 bp, Zea mays; identical to SEQ ID NO: 5543

SEQ ID NO: 5553 - DNA, 86 bp, Zea mays; identical to SEQ ID NO: 5544

SEQ ID NO: 5554 - DNA, 135 bp, Arachis hypogaea
ctctgttgacgcgctgtttggtagagatgtatggaacgagagatgggaacggtgggtggtggttttttccaccgagttcctttacttccctccctcgttccatacatcatctaacaaacacggtgttaattaata

SEQ ID NO: 5555 - DNA, 98 bp, Glycine max
gtttgacagagatgtatggagtgagagaagggaaatgatattttccgatcccatcgttactctcttccctctctcattccatacatcgtctgacgaac

SEQ ID NO: 5556 - DNA, 98 bp, Glycine soja
gtttgtcagaggtgtatggagtgagagaagggaaagggtattttccgattctgtcgttactctcttccctctctcattccatacatcgtctgacgaac

SEQ ID NO: 5557 - DNA, 98 bp, Glycine soja; identical to SEQ ID NO: 5555

SEQ ID NO: 5558 - DNA, 144 bp, Medicago truncatula
accataaactccaattaatgtggtgttgagtagagttgtatggaacgaaagatgggaatttcttgttgaattctattcattcaattttccctccctcgttccatacatcatctagccaatactgtgttaacaattgtctttggt

SEQ ID NO: 5559 - DNA, 109 bp, Vigna unguiculata
gtagtatttggcagaggtgtatggagtgagagaagggaaaaacgcctttgccgatctcatcggttctttttttcctctctcattccatacatcgtctgacgaacgtagc

SEQ ID NO: 5560 - DNA, 109 bp, Vigna unguiculata
gtagtatttggcagaggtgtatggagtgagagaagggaaaaacgcctttcccgatctcatcggttctttctttcctctctcattccatacatcgtctgacgaacgtagc

SEQ ID NO: 5561 - DNA, 128 bp, Glycine max
gttaagtgatgacatgacaagcgaagtatcacgttatcaccctcttgtcatattatcacctttaatgacatacgtgtcaatgattgaacgtgatgatgtgatattctgtttgtcatgttatcacctaa

SEQ ID NO: 5562 - DNA, 179 bp, Aquilegia coerulea; identical to SEQ ID NO: 5178

SEQ ID NO: 5563 - DNA, 147 bp, Aquilegia coerulea; identical to SEQ ID NO: 5179

SEQ ID NO: 5564 - DNA, 177 bp, Aquilegia coerulea; identical to SEQ ID NO: 5180

SEQ ID NO: 5565 - DNA, 129 bp, Citrus sinensis; identical to SEQ ID NO: 5181

SEQ ID NO: 5566 - DNA, 109 bp, Citrus sinensis; identical to SEQ ID NO: 5182

SEQ ID NO: 5567 - DNA, 96 bp, Citrus sinensis; identical to SEQ ID NO: 5183

SEQ ID NO: 5568 - DNA, 171 bp, Gossypium hirsutum; identical to SEQ ID NO: 5184

SEQ ID NO: 5569 - DNA, 177 bp, Gossypium hirsutum; identical to SEQ ID NO: 5185

SEQ ID NO: 5570 - DNA, 95 bp, Glycine max; identical to SEQ ID NO: 212

SEQ ID NO: 5571 - DNA, 95 bp, Glycine max; identical to SEQ ID NO: 212

SEQ ID NO: 5572 - DNA, 152 bp, Gossypium raimondii; identical to SEQ ID NO: 5187

SEQ ID NO: 5573 - DNA, 93 bp, Glycine soja; identical to SEQ ID NO: 5189

SEQ ID NO: 5574 - DNA, 152 bp, Malus domestica; identical to SEQ ID NO: 185

SEQ ID NO: 5575 - DNA, 152 bp, Malus x domestica; identical to SEQ ID NO: 185

SEQ ID NO: 5576 - DNA, 118 bp, Picea abies; identical to SEQ ID NO: 5192

SEQ ID NO: 5577 - DNA, 121 bp, Picea abies; identical to SEQ ID NO: 5193

SEQ ID NO: 5578 - DNA, 137 bp, Picea abies; identical to SEQ ID NO: 5194

SEQ ID NO: 5579 - DNA, 92 bp, Pinus taeda; identical to SEQ ID NO: 5195

SEQ ID NO: 5580 - DNA, 92 bp, Pinus taeda; identical to SEQ ID NO: 5196

SEQ ID NO: 5581 - DNA, 80 bp, Pinus taeda; identical to SEQ ID NO: 5197

SEQ ID NO: 5582 - DNA, 92 bp, Pinus taeda; identical to SEQ ID NO: 5198

SEQ ID NO: 5583 - DNA, 107 bp, Populus trichocarpa; identical to SEQ ID NO: 5199

SEQ ID NO: 5584 - DNA, 107 bp, Populus trichocarpa; identical to SEQ ID NO: 5199

SEQ ID NO: 5585 - DNA, 133 bp, Phaseolus vulgaris; identical to SEQ ID NO: 2602

SEQ ID NO: 5586 - DNA, 92 bp, Solanum lycopersicum; identical to SEQ ID NO: 5201

SEQ ID NO: 5587 - DNA, 117 bp, Vitis vinifera; identical to SEQ ID NO: 5202

SEQ ID NO: 5588 - DNA, 122 bp, Zea mays; identical to SEQ ID NO: 200

SEQ ID NO: 5589 - DNA, 112 bp, Oryza sativa
ccgctccctaccaatgagccgccggatctcccagtgaggaggccggggccgctggatccggtgaccccgttctcctcgccggcggatccggcgctccagagaaaggaacgag

SEQ ID NO: 5590 - DNA, 112 bp, Oryza sativa
ccgctccctaccaatgagccgccggatctcccagtgaggaggccggggccgctggatccagtgaccccgttctcctcgccggcggatccggagctccagagaaaggaacgag

SEQ ID NO: 5591 - DNA, 86 bp, Oryza sativa
atgagccgccggatctcccagtgaggaggccggggccgctgaatccggtgaccccggtctgctcgctggcggatccggcgcaaaga

SEQ ID NO: 5592 - DNA, 167 bp, Arabidopsis lyrata
ggggttttctcttttgaggggaatgttgtctggctcgaggactctggctcgctctattcatgttggatctttttcgatctaataatcgaattgaacctccagatttcagatctgactagggttttagcgtcgtcggaccaggcttcattccccccaattgttgctcc

SEQ ID NO: 5593 - DNA, 148 bp, Arabidopsis lyrata
agagggatttttcttttgaggggactgttgtctggctcgaggtctcttattctaatacaatctcatttcaatagtctcagatctgatgattgattagggttttagcatctcggaccaggcttcattccccccaattattactccctct

SEQ ID NO: 5594 - DNA, 121 bp, Arabidopsis lyrata
ggttgagaggaatgttgtctggctcgaggtcatgaaggagaggatatcactccaattaatttggaagaacgaattaagaaaccctaaatgattctcggaccaggcttcattccccctaacc

SEQ ID NO: 5595 - DNA, 113 bp, Arabidopsis lyrata
ggttgagaggaatgttgtctggctcgaggtcatgaagaagatcattagattgattcatcttaaagaatgaaaaccctaaatgattctcggaccaggcttcattccccccaacc

SEQ ID NO: 5596 - DNA, 200 bp, Arabidopsis lyrata
gagtccatgttcttcagtgaagctttttcttttgaggggaatgttgtctggcacgaggcccttaacttagatctatatttgattttatgtctcttctttatttattagtctatatatacatgaatgatcgattttaacggttaatgacgtcggaccaggcttcattcccctcaattatatcgcttcttcgatcttggctt

SEQ ID NO: 5597 - DNA, 105 bp, Arabidopsis lyrata
aagttcaggtgaatgatgcctggctcgagaccattccatctcatgatcatgatgatgatataatgatgatgatgatgtcggaccaggcttcattcccctcaactt

SEQ ID NO: 5598 - DNA, 131 bp, Arabidopsis lyrata
ggaagcgatttagggtttagaggaatgttgtttggctcgaggtcatggagagtaattcgttaccaaaacacaaaactctaaatgattctcggaccaggcttcattcccctcaacctattttatcgcatttt

SEQ ID NO: 5599 - DNA, 111 bp, Aquilegia coerulea
tgaggggggatgttgtctgtttcgaggtcatttagagatttgattcttctaaatggagtgtatttttattgaattctaaatgacctcggaccaggcttcattcctctcagc

SEQ ID NO: 5600 - DNA, 94 bp, Aquilegia coerulea
ttgtggggagtgttgtctggttcgagaccattcatttgatacatatttagctgtcaactgtatgatttcggaccaggcttcattccccccaatt

SEQ ID NO: 5601 - DNA, 116 bp, Aquilegia coerulea
ggtgtttggaatgaggtttgagccaagatccttccagtcatccaaaatgtttaatttctttcattgtatgtagttccatggatggatctcggaccaggcttcattccttacaccag

SEQ ID NO: 5602 - DNA, 129 bp, Aquilegia coerulea
gagtggaatggagttggtgtgtgtggctagctacctgctggtagagatgttaggaggaatgttgtttggctcgaagctttagaaccttttgtgttcaatgcatatcggaccaggcttcattcctctcaa

SEQ ID NO: 5603 - DNA, 147 bp, Aquilegia coerulea
ttgagaggaatgttgtctggttcgaggccactaacttaacaactcttaattgaaactcaatctataaccggttagcaagtgaaagcgcttgcgctcgctggtgtttgtttgtttgtgtcgtcggaccaggcttcattcccctcaatt

SEQ ID NO: 5604 - DNA, 170 bp, Arabidopsis thaliana
aggggctttctcttttgaggggactgttgtctggctcgaggactctggctcgctctattcatgttggatctctttcgatctaacaatcgaattgaaccttcagatttcagatttgattagggttttagcgtcttcggaccaggcttcattccccccaattgttgctccct

SEQ ID NO: 5605 - DNA, 120 bp, Arabidopsis thaliana
ttgaggggactgttgtctggctcgaggactcttattctaatacaatctcatttgaatacattcagatctgatgattgattagggttttagtgtcgtcggaccaggcttcattccccccaa

SEQ ID NO: 5606 - DNA, 139 bp, Arabidopsis thaliana
gcgatttagtgttgagaggattgttgtctggctcgaggtcatgaagaagagaatcactcgaattaatttggaagaacaaattaagaaaaccctagatgattctcggaccaggcttcattccccctaacctacttatcgc

SEQ ID NO: 5607 - DNA, 113 bp, Arabidopsis thaliana
ggttgagaggaatattgtctggctcgaggtcatgaagaagatcggtagattgattcattttaaagagtgaaatccctaaatgattctcggaccaggcttcattccccccaacc

SEQ ID NO: 5608 - DNA, 143 bp, Arabidopsis thaliana
ttgaggggaatgttgtctggcacgaggcccttaacttagatctatatttgattatatatatatgtctcttctttattcattagtctatacatgaatgatcattttacggttaatgacgtcggaccaggcttcattcccctcaa

SEQ ID NO: 5609 - DNA, 105 bp, Arabidopsis thaliana
aagttcaggtgaatgatgcctggctcgagaccattcaatctcatgatctcatgattataacgatgatgatgatgatgtcggaccaggcttcattcccctcaactt

SEQ ID NO: 5610 - DNA, 122 bp, Arabidopsis thaliana
gcgatttagggtttagaggaatgttgtttggctcgaggtcatggagagtaattcgttaacccaactcaaaactctaaatgattctcggaccaggcttcattcccctcaacctattttatcgc

SEQ ID NO: 5611 - DNA, 120 bp, Brachypodium distachyon
ttttcatggttgtcgaggggaatgacgccgggtctgaaagaaagaagggggcacgccgggaatgacagcggttccctagctctttcggaccaggcttcattccccatgactcgaccatgg

SEQ ID NO: 5612 - DNA, 120 bp, Brachypodium distachyon; identical to SEQ ID NO: 5611

SEQ ID NO: 5613 - DNA, 244 bp, Brachypodium distachyon
gctagagagggagcctttttcgttttgaggggaatgttgtctggctcggggttctctttatttctatgcctctctctatccccccctcctcaatctctctagctttgattggatcgagagaagatcgatcgatcgatccaagaagagttctgagaagggggatgaagagagtagacgtatgtgtgtagatctcggaccaggcttcattccccccaaatacaagggctcccatgatctctgcctc

SEQ ID NO: 5614 - DNA, 172 bp, Brachypodium distachyon
tgaagatgtgaagctattttgcttctgggtggaatgttgtctggttcaaggtcttgccatgtgatttgaggatgaacggtttgtgcatgcataactttcatttctcttgtttgcgggatctcggaccaggcttcattcccctcagagatagcttcaaactcgagatctagcc

SEQ ID NO: 5615 - DNA, 165 bp, Brachypodium distachyon
tcgctggtgcatgtatggcgcagttgaggggaatgttgtctggttggagacctagctagcagctagcacggatcatccatagatcgattcgacgctgcatatgcgcgcggtttcggaccaggcttcattccccccaactctcaactcgatcgatcttcttcgctc

SEQ ID NO: 5616 - DNA, 151 bp, Brachypodium distachyon
gggatagcaaagggggagcttttttactttgaggggaatgttgtctggctcgaggtgctgagatcgagagaacttgaaattcgatctctagattgatctcggaccaggcttcattcccctcaagtaaagctcccgtgtggcctgcgattct

SEQ ID NO: 5617 - DNA, 145 bp, Brachypodium distachyon
aggggaagagagggaagcatggtgtctggaatggaggctgatccaagatccttggtccgaaatattgtgtttctgtgtttgttgccaaggatctcggaccaggcttcattcctcacaccgagcttccgctgcgagattgtgtttc

SEQ ID NO: 5618 - DNA, 135 bp, Brassica napus
ttgagggaatgttgtttggctcgaagactctagcttatcatgttagatcttcttcgatttaatcgaatcaaacctccatgtttgagatctgatttaggattttagggtcgtcggaccaggcttcattccccccaa

SEQ ID NO: 5619 - DNA, 118 bp, Brassica napus
aagttcaggtggatgatgcttggctcgagaccattcaatatgatcattgtgatgatgatgatgatgatgataatgataatgataatgatgtcggaccaggcttcattcccctcaactt

SEQ ID NO: 5620 - DNA, 128 bp, Brassica napus
gagccaaaagttcaggtggatgatgcttggctcgagaccattaaatatgatcattgtgatgttgatgatgatgatgataatgataatgatagtcggaccaggcttcattcccctcaacttacacgttt

SEQ ID NO: 5621 - DNA, 128 bp, Brassica napus
gtggtgcggtttagggctgagaggactgttgtctggctcgaggtcatgaagaatgaaacctaaacctaaatgattctcggaccaggcttcattccccccagccgttttatcgccatatatatgcccac

SEQ ID NO: 5622 - DNA, 160 bp, Citrus x paradisi x Poncirus trifoliata
ttgttttgaggggaatgttgtctggctcgaggacactacttgttgatccattaattttacgtattctctcatagatctagcatctgaatggtggataacaatatacggattcagcttatttggcgtcgtcggaccaggcttcattccccccaatatattg

SEQ ID NO: 5623 - DNA, 202 bp, Citrus reticulata
ttcccttcagaatcaaattcattgtttgattttttttgagaggttatggttgatgggaatgttgtttggctcgagggtcatctaggttttcaaaattttctcggactttctttcttgcttttatttttccaggaaaattatgttatttgcctatgtgatctcggaccaggcttcattcccgtcaaccgacggtttctctctt

SEQ ID NO: 5624 - DNA, 202 bp, Citrus reticulata
tatatgttctcatctgggttagcttagggttttgagagcaggaagccatgaaagtcgatggatgggagaaaaatgattgtttctgaggggactgttgtctggctcgatgcattaataataattataattatataattataattatcatgaaaaaagggtatcggaccaggcttcattcccttcagaatcaaattcattgttt

SEQ ID NO: 5625 - DNA, 177 bp, Citrus sinensis
ggggagctttttgttttgaggggaatgttgtctggctcgaggacactacttgttgatccattaattttacgtattctctcatagatctagcatctgaatggtggataacaatatacggattcagcttatttggcgtcgtcggaccaggcttcattccccccaatatattgcttctat

SEQ ID NO: 5626 - DNA, 202 bp, Citrus sinensis
gaagctttttcttttgaggggaatgttgtctggctcgaggccactaactagatctttgatttaatctcagttgatcatatatttgtttcatttttcttccataaaatttaattatattgagatacccatcattgatcttaagataattaagttagtgacgtcggaccaggcttcattccccccaataattgcttctatctgc

SEQ ID NO: 5627 - DNA, 192 bp, Citrus sinensis
cacgcgtccgattgtttgattttttttgagaggttatggttgatgggaatgttgtttggctcgagggtcatctaggttttcaaaattttctcggactttctttcttgcttttatttttccaggaaaattatgttatttgcctatgtgatctcggaccaggcttcattcccgtcaaccgacggtttctctctt

SEQ ID NO: 5628 - DNA, 138 bp, Citrus sinensis
ttcctcctcgatcatacatgaacggttgaggggaatgttgtctggttcgagatcactcgtggacgaattaattaataacttattgtcttttgaatgatttcggaccaggcttcattccccccaactcagtttaattgc

SEQ ID NO: 5629 - DNA, 126 bp, Citrus sinensis
ttataatgaaaaaagggtatcggaccaggcttcattcccttcagaatcaaattcattatttgatctttttgagaggttatggttgatgggaatgttgtttggctcgagggtcatctaggttttcaa

SEQ ID NO: 5630 - DNA, 177 bp, Citrus sinensis; identical to SEQ ID NO: 5625

SEQ ID NO: 5631 - DNA, 414 bp, Citrus trifoliata
ggtttgtctgaaggatctagggttaattgggaagctttttcttttgaggggaatgttgtctggctcgaggccactaactagatctttgatttaatctcagttgatcatatatttgtttcatttttcttccataaaatttaattatattgagatacccatcattgatcttaagataattaagttagtgacgtcggaccaggcttcattccccccaataattgcttctatctgctatgatatcatcttcatttcttggaggtgctgtgatcagttctcaaactttagttgattttttcacaatttttctttttgtttaatttattgatcttgtgttgtgtatatttgtatggtcaacggagagatcttggtcattggccatgagcagattggtgtaatgatgaaagattttgactg

SEQ ID NO: 5632 - DNA, 134 bp, Festuca arundinacea
tttcggcaactttggcaggctccatgcctacgaggccgcaagctcgcgcagctatacccgcgcaaccatgcgagatggcaatgattccaatggaatccggaccaggcttcatcccaggcatttggcctcgtgcc

SEQ ID NO: 5633 - DNA, 108 bp, Festuca glaucescens x Lolium multiflorum
gttgaggggtgtgttgtctggttggagacctagcacgcaggtatgacgtccggatggatcgacacgccgtgcgtgcgcggtttcggaccaggcttcatcccccccaac

SEQ ID NO: 5634 - DNA, 147 bp, Gossypium hirsutum
ggggaatgttgtctggaccggggacacttgtgtttctaatccgttttccctgcaatattgttctgattaacgtggggatctttatattgcccatttttgtaatggattaaggttgtactagtttcgtcggaccaggcttcattcccc

SEQ ID NO: 5635 - DNA, 154 bp, Gossypium hirsutum
tgaggggaatgttgtctggaccggggacacttgtgtttctaatccgttttccctgcaatattgttctgattaacgtggggatctttatattgcttatttttgtaatggattaaggttgtactagtgtcgtcggaccaggcttcattccccccaa

SEQ ID NO: 5636 - DNA, 146 bp, Glycine max
acggaagctttgtcttttgaggggaatgttgtctggctcgaggacccttcttcatcttgatcttgtgtagactactatgcttgtggtcaaggaatacatagtgttgtcggaccaggcttcattccccccaattatatgcttccaaa

SEQ ID NO: 5637 - DNA, 167 bp, Glycine max
gcttgcaaaggtgaggttgagaggaatgttgtctggctcgaggtcatggaggaggaggaggagtagagtactgagatcagtgaaagtttccaatggaaatttaccctcttacacaaaaaaatgattctcggaccaggcttcattccccccacccaacttttgctttt

SEQ ID NO: 5638 - DNA, 409 bp, Glycine max
tcggaccaggcttcattcccctcagcaaccaagcagacactattttcttcctttagtacatacacaattaacacaatcttttctttaagcattctccttgtgatgttgtgctcttgaacaagtcctcaggcaattgaaaaccaaaggaggattgccaaaaaaaaaaagagcaatgcaggactaattggttattgtataagcttccaggtggttatgactcataatttcaaagttcttacatttcatctatagcttatttttttcatattcatatgaatagatgtgttggtttggtttgttgataaactcttgtggagttttttttttttcttttttggacctgaacaacatattgagtttgttcttgcttgtgttctgttggggaacaatctcttcagtctgctccaga

SEQ ID NO: 5639 - DNA, 86 bp, Glycine max
ggggaatgttggctggctcgaggcttttcaaagaggaggttctcactggcaagaactataaggcttcggaccaggcttcattcccc

SEQ ID NO: 5640 - DNA, 156 bp, Glycine max
tgggaatgttgtttggctcgaggtaactatgcatggtcttaattttgttcatctttgaagctttaatttatgggtttcgatctctttgatcccttgaaacaaagaaagctttaaaggttggattttgaggctttctcggaccaggcttcattcccg

SEQ ID NO: 5641 - DNA, 136 bp, Glycine max
ggggaatgcagtgtggtccaaggagatgatatatcacttcaccatactcatatcttcacaaactcatcagattcagatgtaataataatttgtaatatatgcatattatgtctcctcggaccaggcttcattccct

SEQ ID NO: 5642 - DNA, 100 bp, Hordeum vulgare
  misc_feature (23)..(23): n is a, c, g, or t
  misc_feature (32)..(32): n is a, c, g, or t
  misc_feature (43)..(43): n is a, c, g, or t
catggttgtcgaggggaatgacnccgggtccnaaagagagacnctcgcatggcgtgcgcgtggtgcgtttcggaccaggcttcattccccatgactccat

SEQ ID NO: 5643 - DNA, 102 bp, Hordeum vulgare
ggggaatgttgtctggtccgagacctaacaccgggcggaatggcggattcagctgcagctaagcaagctaggtggggggtttcggaccaggcttcattcccc

SEQ ID NO: 5644 - DNA, 78 bp, Hordeum vulgare
  misc_feature (11)..(11): n is a, c, g, or t
  misc_feature (20)..(20): n is a, c, g, or t
  misc_feature (31)..(31): n is a, c, g, or t
ggggaatgacnccgggtccnaaagagagacnctcgcatggcgtgcgcgtggtgcgtttcggaccaggcttcattcccc

SEQ ID NO: 5645 - DNA, 78 bp, Hordeum vulgare subsp. Vulgare; identical to SEQ ID NO: 5644
  misc_feature (11)..(11): n is a, c, g, or t
  misc_feature (20)..(20): n is a, c, g, or t
  misc_feature (31)..(31): n is a, c, g, or t

SEQ ID NO: 5646 - DNA, 169 bp, Ipomoea nil
ggggatgttggctggctcgatgcacttacttatcatcttcctcaaaaacatgcgacatatacatacatatggaagatcatatatctataaatatatatttgtcttccatatcccatatatatatgttgatgatggtggagtgatggcatcggaccaggcttcattcctc

SEQ ID NO: 5647 - DNA, 121 bp, Medicago truncatula
cagacatacgaaggagttcaggggaatggtgtctgattcgagaccattcgtcacaagtaaacagtagccttgagaatgatctcggaccaggcttcattccccctagctcatagtatcatgc

SEQ ID NO: 5648 - DNA, 170 bp, Medicago truncatula
gttgatgggaatgttgtttggctcgaggtaataactaactcaatttctttgtctttgaaagcttttctttgtttcactctttttgattcttagaaagttgaaactaagtgagctttaaaggtttgattttgatgtgtgattatctcggaccaggcttcattcctaccaac

SEQ ID NO: 5649 - DNA, 105 bp, Medicago truncatula
gctgagaggaacgcagtctggctcgaggaatgctcagatctgttttgatctgatcgatatgttcatatctaattaattctcggaccaggcttcattcctcccatc

SEQ ID NO: 5650 - DNA, 91 bp, Medicago truncatula
gttgaggggaatgttgcctggctcaaggcttttcatagtttgatctatctactatgattaaggcttcgggccaggcttcatccccctcaaa

SEQ ID NO: 5651 - DNA, 106 bp, Medicago truncatula
tttgaggggaatgttggctggctcgaggcttttcagtttcacaaaggaagttcagtcttaattgtatgaactataaggcttcggaccaggcttcattcccctcaaa

SEQ ID NO: 5652 - DNA, 179 bp, Medicago truncatula
tgtttggaatgaggtttgttccaagatcatcacacatcatgtttcttcttccctttcaataattcttgattaatttatgttcatacatctatatatatatctatatatattatcaagtcattacatgcatgggatgagatattgagagtgatctcggaccaggcttcattcctcacacc

SEQ ID NO: 5653 - DNA, 107 bp, Medicago truncatula
tttgaggggaatgttgtctggctcgaggacgctttcttctcgatctaatgcaaatttgtggtcatggattgtaaagtattctcggaccaggcttcattccccccaat

SEQ ID NO: 5654 - DNA, 92 bp, Medicago truncatula
gttcaggggaatggtgtctgattcgagaccattcgtcacaagtaaacagtagccttgagaatgatctcggaccaggcttcattccccctagc

SEQ ID NO: 5655 - DNA, 187 bp, Nicotiana sylvestris
tgaggggaatgttgtctggctcgaggtcaccaactagatccataaactccatattatgcttttttgaatataaagattagtttttcttttcttttcactaggaaaatttaaagattagttgattatattaaaaagggtttatggatcatgagttagtgttgtcggaccaggcttcattccccccaat

SEQ ID NO: 5656 - DNA, 145 bp, Oryza sativa
tgaagctatttgcttctgagtggaatgttgtctggttcaaggtctcatgcaccttgcggttttgaggatgatttgtgcaaggtttttcattcctctcatccgtgggatctcggaccaggcttcattcccctcagagatagcttca

SEQ ID NO: 5657 - DNA, 206 bp, Oryza sativa
gggagccttttcattttgaggggaatgttgtctggctcggggctacttttaatttctctctcttttgatatcttcttttctcgatctcctagcttgatcttttgatctctcaaatcgatcttaagaaaaagatcagtcaaagagatgagagtagatgtctgtagatctcggaccaggcttcattccccccaaacagaagggctccc

SEQ ID NO: 5658 - DNA, 125 bp, Oryza sativa
ggcagttgaggggaatgttgtctggtccgagacctaacaccgggcggaatggcggattcagctgcagctaagcaagctaggtggggggtttcggaccaggcttcattccccccaactcaactgtt

SEQ ID NO: 5659 - DNA, 125 bp, Oryza sativa
gaagctttttcactttgaggggaatgttgtctggctcgaggtgcatggagaaacctctgatcgatcaggtttgatctgtagagactgatctcggaccaggcttcattcccctcaagtaaagctcc

SEQ ID NO: 5660 - DNA, 137 bp, Oryza sativa
tgtttctgggtggaatgttgtctggttcaaggccccttaggatgtgtgatttttgatggtttatgcattcatcttgatgcgaacatctatctcggatctttgggttctcgaaccaggcttcattcccctcagagata

SEQ ID NO: 5661 - DNA, 107 bp, Oryza sativa
cgatcatcttgttgagaggaatgtcgtctggcctgagatcgtaccacagtggtgggtacacgtggacggtctcggaccaggcttcattcccctcaacaactcgtcgg

SEQ ID NO: 5662 - DNA, 145 bp, Oryza sativa
agcatggtgtctggaatggaggctgatccaagatcattgcttggtgcaaaatactagggcattgttgtaagtgccattagttcttttttgtttccgagtttgttatcgaggatctcggaccaggcttcattcctcacaccgtgct

SEQ ID NO: 5663 - DNA, 119 bp, Oryza sativa
ggtggcttgtggggaatgttggctggctcgaggtatccacatcttaattcctctccggcgatcgagccggctcgggcgtgtggaagcgtcggaccaggcttcattcctcgcaagccgat

SEQ ID NO: 5664 - DNA, 145 bp, Oryza sativa
agataggtgtttggaatgcagtttgatccaagatctgcctatatatatggtgtgtatatcatatcttgtgatatgggggatatgcaacaggtgtgtgacaggggtaggtagatctcggatcaggcttcattcctcacaccaatac

SEQ ID NO: 5665 - DNA, 140 bp, Oryza sativa
agataggtgtttggaatgcagtttgatccaagatctgcctatatatatggtgtgtatatcatatcttgtgatatgggggatatgcaacaggtgtgtgacaggggtaggtagatctcggatcaggcttcattcctcacacc

SEQ ID NO: 5666 - DNA, 127 bp, Oryza sativa
attaggttaaggggtttgttgtctggctcgaggcatccgggactccggtttctcctttcctactggaggcgcctaatttccggcgagctcggagcctcggaccaggcttcaatccctttaaccatgc

SEQ ID NO: 5667 - DNA, 117 bp, Oryza sativa
gttaggttaaggggattgttgtctggttcaaggtctccacattgtgcaaaatgttcattcatggaggcacaggatgcttggtgatctcggaccaggcttcaatccctttaaccagca

SEQ ID NO: 5668 - DNA, 200 bp, Oryza sativa
ctctgctttggtggttggctgatgttctcggttaaggggtttgttgtctggttcaaggcctcctgctgtcctacatcacatttttttttctttgttctgaatttctgatggatgtgtgtgtgcatgatgcatggctggtggtgacctcggaccaggcttcattccctttaaccagcatttgcgttaataccatcaggcat

SEQ ID NO: 5669 - DNA, 100 bp, Oryza sativa
tgatccatggctgttgagaggaatgacgtccggtctgaagatcgccgtccccaggcggtggcttcggaccaggcttcattccccatgactcatggaaccc

SEQ ID NO: 5670 - DNA, 90 bp, Picea abies
ggagatcttggttgaggggaatgctatctggctcgaggtcgccttccttcgtcgtcggaccaggcttcattcctctctacttggacttcc

SEQ ID NO: 5671 - DNA, 129 bp, Picea abies
tttcagagttgggatatcgggaatgaaacctgggtcaagatgatttgaaggcaggctgttgaagattatctcggaccaggcttcattccttgcatccaaactctttaagtactgctgctcaattgaaaa

SEQ ID NO: 5672 - DNA, 74 bp, Picea glauca
atgatttgaaggcaggctgttgaagattatctcggaccaggcttcattccttgcatccaaactctttaagtact

SEQ ID NO: 5673 - DNA, 102 bp, Physcomitrella patens
tctgctgtgaggaatgccccctggcccgaagccatgtgccttttcatgtccacgtggggtaaacattaaagcttcggaccaggcttcattcccctcagcaca

SEQ ID NO: 5674 - DNA, 103 bp, Physcomitrella patens
ctttgttgtgaggaatgccgcatggaccgaagccatgcgctccacatctagacggtgatttggacgctatgcttcggaccaggcttcattcccctcagcacag

SEQ ID NO: 5675 - DNA, 123 bp, Physcomitrella patens
acttggtgcaacatgggactttatcgtggggaatgccgtctggaccggagctgtgtgtccactctgcatcaaagcttcggaccaggcttcattcccctcgagggagtttcatagcagtgctat

SEQ ID NO: 5676 - DNA, 128 bp, Physcomitrella patens
catattagtcatatgcggcttgtccttggggaatgatgattggaccgaagttttttagcgttggtttgcccaattaaagcttcggaccaggcttcattcccctcgtagaagttgcatgatgatgcaat

SEQ ID NO: 5677 - DNA, 146 bp, Physcomitrella patens
aatgtgcttttggagttgtgaaccttgctgtgaggaatgccgcatggaccgaagctatgtgctccatcttaacgtggtggtattgatactacgtttcggaccaggcttcattcccctcagcgcagtttcatcatggtgatggacgg

SEQ ID NO: 5678 - DNA, 123 bp, Physcomitrella patens
atgaccagcataccagtggtgctgtgctgggaggaatgctgcatggtctgatgcttttgctgcgacacaagcctcggaccaggcttcattcccctcagctcagtctcatattgacggttcaag

SEQ ID NO: 5679 - DNA, 146 bp, Physcomitrella patens
gtgcggaggtgtttaggtgaaactctgctgcgaggaatgccccctggcccgaaggcatgtacttctccctcttcgaatggtgtgagcatcaagcttcggaccaggcttcattcccctcagcgcagttacatttcgatattcacgtc

SEQ ID NO: 5680 - DNA, 126 bp, Physcomitrella patens
agttcgacaagactatgagactttgtcatgaggaatgacgagtggcccagattcgtttctggtctagaaattgaatttcggaccaggcttcattccccttggcacggttccatggaggtactgtca

SEQ ID NO: 5681 - DNA, 120 bp, Physcomitrella patens
cttggagattggatgggactttgtcgtggggattgacgcatggcacgaagctaacatcctgagatcagttgcttcggaccaggcttcattccccttgcctaagttgcatcatgtagtgct

SEQ ID NO: 5682 - DNA, 131 bp, Physcomitrella patens
gaagatgttatatatatgtgacattgccgtgaggaatgacgtgtggcccgaagccatatcttgggttgccttgatgaagctccggaccaggcttcattcccctcggcagagttgcaacaagtgggaaaggg

SEQ ID NO: 5683 - DNA, 123 bp, Physcomitrella patens
gaagatgctggatgtgcctttgccgtgaggaatgacgtatggcccgaagctatctcttggatggccttgatgaagctccggaccaggcttcattcccctcggcggagttgcaaatgtggacac

SEQ ID NO: 5684 - DNA, 133 bp, Physcomitrella patens
aatttgtgaagctgaatgaaacgttttcgtggggaatgacgtgtggcccgtagccatgtatcttggcatgccagaattatgctccggaccaggcttcattcccctcggcaacgttgcatgatggtaattatgt

SEQ ID NO: 5685 - DNA, 94 bp, Pinus taeda
ttgattgaggggaatgttgtctggctcgacttcatccggatttgggctccaatgttcggatgccgtcggaccaggcttcattccccccaatcgg

SEQ ID NO: 5686 - DNA, 125 bp, Pinus taeda
ggcagagttggggtgaggggactgcagcctggcacgagacctgaaaacttttctgacaagcagccgggcgggcagagtcacgcatggtgtcggaccaggcttcattcccctcacaacactcttcc

SEQ ID NO: 5687 - DNA, 164 bp, Pinus taeda; identical to SEQ ID NO: 216

SEQ ID NO: 5688 - DNA, 164 bp, Populus trichocarpa
tttcttttgaggggaatgttgtctggctcgaggtcactaatgggatctatgattttatctcaattgattgattttcttttaaattctagtaaattgaattgagagatatcatgatcaacttatatttaatgatgtcggaccaggcttcattccccccaattgtt

SEQ ID NO: 5689 - DNA, 106 bp, Populus trichocarpa
taactgttgaggggattgctgtctggttcgatgtcattcatgtgaagctttaacattaatgtagtattgagtgatttcggaccaggcttcattccccccaactata

SEQ ID NO: 5690 - DNA, 134 bp, Populus trichocarpa
ctttttttgaggggaatgttgtctggctcgaggactctttcttgatcagtctgatcaagtgttctatctttagatctaatatcttagatcatgtgttagggtcgtcggaccaggcttcattccccccaattatt

SEQ ID NO: 5691 - DNA, 105 bp, Populus trichocarpa
cgtgagttgaggggaatgttggctggctcgaagcttaagcaaagagttttctctcaagaaacaactgttaaggcttcggaccaggcttcattcccctcaaccaat

SEQ ID NO: 5692 - DNA, 106 bp, Populus trichocarpa
taactgttgaggggattgtcgtctggttcgatgtcattcatgagaagctcaaacataaacgtaatattgaatgatttcggaccaggcttcattccccccaacaatg

SEQ ID NO: 5693 - DNA, 105 bp, Populus trichocarpa
ggtgtgttgaggggaatgttggctggctcgaagcttaagcaaagagtttcctaacatgaaacaactgttaaggcttcggaccaggcttcattcccctcaaacata

SEQ ID NO: 5694 - DNA, 103 bp, Populus trichocarpa
acacagttgaggggaatgctgtctggttcgagaccattcacctgaagagcacgcattcatcttttgagtgatctcggaccaggcttcattccccccaactcaa

SEQ ID NO: 5695 - DNA, 101 bp, Populus trichocarpa
acacagttgaggggaatgctgtctgattcgagaccattcactttaagcacacattcatctttcgaatgatctcggaccaggcttcattccccccaactcaa

SEQ ID NO: 5696 - DNA, 103 bp, Populus trichocarpa
tgtcttttgaggggaatgttgtttggttcaaggcctggccaccccatgtcttggaatttaaaatatcatgtcctcggaccaggcttcattcccctcaattact

SEQ ID NO: 5697 - DNA, 143 bp, Populus trichocarpa
tcttttttgaggggaatgttgtctggctcgaggactttttgttcatcaatctaatcgaactttctacctgtagatctagtatcttatttaagattgatcacgtattagggttgtcggaccaggcttcattccccccaatcatt

SEQ ID NO: 5698 - DNA, 143 bp, Populus trichocarpa; identical to SEQ ID NO: 5697

SEQ ID NO: 5699 - DNA, 97 bp, Populus trichocarpa
taacttttgtggtgaatgttgtctggttcaaggcatggccaccacatctcttggtgaatatatgtcctcggaccaggcttcattcccctcaattaat

SEQ ID NO: 5700 - DNA, 105 bp, Populus trichocarpa
tgaggatgtgggggaatgtcgtctgactcgagacaacaggtaaactgaaggaatggccggagtttaagagttctctcggaccaggcttcattcccctcatccaca

SEQ ID NO: 5701 - DNA, 331 bp, Populus trichocarpa
aaggggtgtttggaatgaagtttgatccaagatccttgtctctcccgttaacttagtctctgttactgttaggttttcattactgagtgtatttgcagcccccttgtctgattttagcatcatgagagtaggaagtgctggtgatcatagggtttggttcaagatccatttgactcttctctttatatctctcctgtgtcctagctggtaatctgtagtagtcttaattatcccttacttcttgttaatttttaggtttgatcttgcaagtaattatatttggaaaatatcataaaatgatctcggaccaggcttcattccttacaccttg

SEQ ID NO: 5702 - DNA, 324 bp, Populus trichocarpa
aaggggtgtttggaatgaagtttgatccaagatccttgtctctcccgttcatttagtaatgttactgctaggtttcgctatgtattgatcagtgtatacacagcagctacgagctaggccttgtgtttcagattttagcttcaatatagagtgagcactagtgatagagtttgattcaagatccatctcatgtgtgctagctagcttttaaatttttaatcagatccctacttcctgttaattcttaggttttatcttgcaagttattatatttagtaaacatcatgaactgatctcggaccaggcttcattccttacaccgaa

SEQ ID NO: 5703 - DNA, 146 bp, Populus trichocarpa; identical to SEQ ID NO: 217

SEQ ID NO: 5704 - DNA, 151 bp, Populus trichocarpa
ttaggttgagaggaatgttgtctggctcgaggtcattgaggccatgattatacagacatggcattacctgatgacagccgagaaaattcaaagtctgtgtgtatcttgtacctcgatgattctcggaccaggcttcattccttccaacaaa

SEQ ID NO: 5705 - DNA, 144 bp, Phaseolus vulgaris
gaggttgagaggaatgttgtctggctcgaggtcatggaggaggagagttctcagataaactctttcacccaaagtttccaatggaaatttaccctctaacaccaaaatgattctcggaccaggcttcattccccccacccaact

SEQ ID NO: 5706 - DNA, 670 bp, Phaseolus vulgaris
atcagtttctactttctaatcatcaacttcttcaaacacatcatatgaatatagctacctaggtgctgttttcttttccaacttcctcatatcttgttcattccttgcaaaggtgaggttgagaggaatgttgtctggctcgaggtcatggaggaggagagttctcagataaactctttcacccaaagtttccaatggaaatttaccctctaacaccaaaatgattctcggaccaggcttcattccccccacccaacttttgctattttctttctcgtaatcttcatattttgcatgcccccatgcttgtttttgcaggatcagaattttcaactcactacccatcttcttttgttttacctgtaaatatctttataaaggccggtgaaaattatagggaaggcaacttcataatttacttgggaaaaaggcttgccatcattttcatcaacatctgaatgaatgtacttcagtgaaatgacagtgacgagtgttgaaggcatgcactcactagccgctgaaagttgctgagaagcatatgctaaatgtgaaagagtaatgaatgaaagaagagaagagaagagaagtgctggaacagttaacgagaagaagtgagaatcaggagaagctagcaagctagggattctatgtgtctgagtctgtgactctt

SEQ ID NO: 5707 - DNA, 149 bp, Ricinus communis
taaggggaatgttgtctggttcaaggcctacctattgatctgtttcagtttcattcaatatactgaaaaatctgtatatgggaaactatcctgtggtcgatttgatcatttcttaggatctcctcggaccaggcttcattccccttaat

SEQ ID NO: 5708 - DNA, 119 bp, Ricinus communis
tgaggggaatgttgtctggctcgaggtcactaattagatctatgattttatttttgcttttaagatagatcgttgatcgtattgttagtgacgtcggaccaggcttcattccccccaat

SEQ ID NO: 5709 - DNA, 91 bp, Ricinus communis
tgaggtgaatgttgtctggttcgatgtcattcattttgtgaagctgaaacattaactgaatgatttcggaccaggcttcattccccccaac

SEQ ID NO: 5710 - DNA, 92 bp, Ricinus communis
tgaggggaatgctgtctggttcgagaccattcgcttgatgccacccatcacagcttctgaatgatctcggaccaggcttcattccccccaac

SEQ ID NO: 5711 - DNA, 131 bp, Ricinus communis
tgaggggaatgttgtctggctcgaggactctcttttgatccctttcaattttctccatagatccaatacggatattgggagtgggtagatcatttgacagtgtcgtcggaccaggcttcattccccccaat

SEQ ID NO: 5712 - DNA, 108 bp, Sorghum bicolor
gtggaatgttgtctggttcaaggtctcgcttgtgatttaaggatgatttgtgcatgcgtaatttttattccttgaatctatgagatctcggaccaggcttcattcccc

SEQ ID NO: 5713 - DNA, 72 bp, Sorghum bicolor
ggggaatgatgtccggtccgaagacgctgtgcggcgaaagcggcggcggcttcggaccaggcttcattcccc

SEQ ID NO: 5714 - DNA, 94 bp, Sorghum bicolor
ggggaatgttgtctggtcggagacctaacaccgcgaatcatccatggagcagcatgcatggtggtggatggtttcggaccaggcttcattcccc

SEQ ID NO: 5715 - DNA, 87 bp, Sorghum bicolor
ggggaatgttgtctggctcgaggtgcaggaacatgcagatctcatcggtctagattgttgttgatctcggaccaggcttcattcccc

SEQ ID NO: 5716 - DNA, 151 bp, Sorghum bicolor
caagttgaaggttaggttaatggggttgttgtctggttcaaggtcgccacagcagacaaagcccattttgcttagcatgcagcatgggtttatctctattgatgatcgatctcggaccaggcttcaatccctttaactagcatctgcatat

SEQ ID NO: 5717 - DNA, 139 bp, Sorghum bicolor
ccttggtcatgggggtttgtggggaatgttggctggctcgaggcatccgcgtcctggcttgcagatcgttttgcctgctaccggaaagatcgagaggcgtcggaccaggcttcattcctcgcaaaccggtgcatccatg

SEQ ID NO: 5718 - DNA, 134 bp, Sorghum bicolor
tcatgctcggattaggttagggggattgttgtctggctcggggtctccggtcgagaatccttggccttgccggagttgtcgttgaccggagatttcggaccaggcttcaatccctttaaccatgcggcatttag

SEQ ID NO: 5719 - DNA, 185 bp, Sorghum bicolor
aggggaatgttgtctggctcgggggcgccgccgctccgctccgctccttccttctctggtctctctctctcccctagtcttcgcgcgcttcctcaatctccatcgtctcttcctccttctcttggagaccagcaggaggacggaggcgggtggtgtagatctcggaccaggcttcattcccccca

SEQ ID NO: 5720 - DNA, 86 bp, Sorghum bicolor
ggaatgtcgtctggcgcgagaccggccggacagtcggccggcggcgtcctctggatcggacggtctcggaccaggcttcattcccc

SEQ ID NO: 5721 - DNA, 108 bp, Sorghum bicolor
tgtggaatgttgtctggttctaggcctctctctacatgcaagcatggatgtagtagcagcctactgcaattgcttgctgggacctcggaccaggcttcattcccctca

SEQ ID NO: 5722 - DNA, 103 bp, Sorghum bicolor
gaatggaggctgatccaagatcctcctcgagtgcgaaacaaatgccgtttttttggttttgtgtttgctctcttggggggtctcggaccaggcttcattcctc

SEQ ID NO: 5723 - DNA, 111 bp, Solanum lycopersicum
gttgaggagaatgtcgtctggttcgagatctttcataagaaaggtaaatgaatgacaagttttcatatatgtatcgtgaatgatttcggaccaggcttcattcccctcaac

SEQ ID NO: 5724 - DNA, 201 bp, Solanum lycopersicum
tcccatagatcatatggaggaagttctctcagttgaggggaatgttgtctggctcgaggtcaccaattagatccataatccctatatataccatgcttttcaaaaaaaagatttataatatgaaaaggggttatgaatcatgtgttagtgttgtcggaccaggcttcattccccccaattgttactcctctagctagggga

SEQ ID NO: 5725 - DNA, 145 bp, Selaginella moellendorffii
agcaagtcctggatgtggggattgttgcctggctcgagggaggcattcctttgatcttttctctcctgggaagtactccagaagaactgtgccagaaatgtgcgctctcggaccaggcttcattcccctcatctgagattgcacc

SEQ ID NO: 5726 - DNA, 136 bp, Selaginella moellendorffii
ttcctcagtgagaaccaggatgtggggagtgtagcctagctcgagagattgatttgatactaaggctacgcacacaaggttgtgatcacagctttgtctcggaccaggcttcattcccctcagtgtggtgctcact

SEQ ID NO: 5727 - DNA, 138 bp, Selaginella moellendorffii
tatgttgcggggagtgctgcctggctcgagacagcatcgccgagatctgatcaaatcgcaaagttgagaaacaagcatcacagtttgatctggagatcgtgttgtgtcggaccaggcttcattcccctcagctacaaa

SEQ ID NO: 5728 - DNA, 127 bp, Saccharum officinarum
tcggaccaggcttcattccccccaaaagcaagggctccccatgatcttgatttgccgcgcgcctcgcctccatcagatgagctccatccgctagcttgcttgctggggtacatgcaaatctgaaccg

SEQ ID NO: 5729 - DNA, 111 bp, Triticum aestivum
ccggaccaggcttcattcccatcatttgcacccattcgacagcagttccggtcgccttggacaggaacgctgtcacggacgcgtgggtcgacgatatcccgggaattccgg

SEQ ID NO: 5730 - DNA, 118 bp, Theobroma cacao
tataacatcaactgttgaggggaatgttgtctggttcgaagtcattcatatgaatcttaaatgtcttctgaatgatttcggaccaggcttcattccccccaacttgttttaatagcta

SEQ ID NO: 5731 - DNA, 178 bp, Theobroma cacao
aaaggagaaacggttgatgggaatgttgtttggctcgaggtcatctaggttgatctttatttccatgaaattttcttggattaatttcattttttttttccgggaaagtttctgcaatacatatagccctatatgatctcggaccaggcttcattcccgtcaaccaaaacaacttcct

SEQ ID NO: 5732 - DNA, 141 bp, Theobroma cacao
tgaagaagaaaagagggtgtatggaatgaagtttgatccaagatccctccttctccataagttcttatctgataattacttaagggattgatcattgatctcggaccaggcttcattcctcacaccatgcttttccttgct

SEQ ID NO: 5733 - DNA, 119 bp, Theobroma cacao
gaagtcttgaacagttgaggggaatgctgtctggttcgagaccgttcatttgaagctctagacttcatcagaatgatctcggaccaggcttcattccccccaacttatggaatatatac

SEQ ID NO: 5734 - DNA, 130 bp, Vitis vinifera
gcgggtgtttggaatgaggtttgatccaagatccttcctttttctccattaattccttcagtactggtcatgatttagttacttcataatcggttgatctcggaccaggcttcattcctgacaccaagct

SEQ ID NO: 5735 - DNA, 99 bp, Vitis vinifera
gttttttgaggggaatgttggctggctcgaggcattcacataagaagaagatatataagtgaaggtgtcggaccaggcttcattcctctcaaatataca

SEQ ID NO: 5736 - DNA, 160 bp, Vitis vinifera
ctattttgaggggaatgttgtctggctcgaggacacttaccttaactttgatccgtttctctagatccatatcacctatatatatgtattattgtatttttatttgtactgagcatgtgttggtgtcgtcggaccaggcttcattccccccaattatcgc

SEQ ID NO: 5737 - DNA, 160 bp, Vitis vinifera
ctgctttgaggggattgttgtctggctcgaggccaccaaccatctttgattgattcaaatactttgatcagcttcaacccatcttctccttcaattcaattccaccctctgattatgtgttagtgccctcggaccaggcttcattcccctcaatcactgc

SEQ ID NO: 5738 - DNA, 166 bp, Vitis vinifera
gtgttttgaggggaatgttgtctggctcgaggacaccaactagatctatgatctgcgtgtaattgtgaatgggtgatcgtctctcagttttgaaggagagattttgagtgatctttgatcatgggttggtgtcgtcggaccaggcttcattccccccaatttattg

SEQ ID NO: 5739 - DNA, 100 bp, Vitis vinifera
tgtagttgtggggaatgttggctggctcgaggctttcttgagtgattttatgtatacctcaaaaagcttcggaccaggcttcattcccctcaacacactt

SEQ ID NO: 5740 - DNA, 100 bp, Vitis vinifera
aacagttgaggggaatgttgtctggttcgagatccttcgtatgaagctcaagcagcgtttgaatgatttcggaccaggcttcattcccctcaacccaaaa

SEQ ID NO: 5741 - DNA, 100 bp, Vitis vinifera
aacagttgaggggaacgctgtctggttcgagaccactcgcttcaagtacagacataatctgaatgatctcggaccaggcttcattccccccaactcaaca

SEQ ID NO: 5742 - DNA, 213 bp, Zea mays
tgaggggaatgttgtctggctcggggccgccgccgccgctccttccttctctagtctctcttctctcctagcagctactcttcgcttcctactcctatctcgatccctctcttcttcttcttcttcttcttcctcttcccccctctcttggatcgagaccgagcggacggagacgagtggtgtagatctcggaccaggcttcattccccccaa

SEQ ID NO: 5743 - DNA, 116 bp, Zea mays
gtggaatgttgtctggttcaaggtcttgctwtccgatttgaggatgatccatgcttgcatgtgtagttttttttgttcctcagatctacaagatctcggaccaggcttcattcccc

SEQ ID NO: 5744 - DNA, 92 bp, Zea mays
ggggaatgttgtctggctcgaggtgcagaaacacgcagatctcatcgaggtcgtcttggttgttgttgatctcggaccaggcttcattcccc

SEQ ID NO: 5745 - DNA, 104 bp, Zea mays
gtggaatgttgtctggttcaaggtcttttgctttgtgatccatctgtgtagagcttctaagtattccttggatctgcaagatctcggaccaggcttcattcccc

SEQ ID NO: 5746 - DNA, 87 bp, Zea mays
ggggaatgttgtctggctcgaggtgcagaaacatacagatctcatcggtctaggttcttgtcgatctcggaccaggcttcattcccc

SEQ ID NO: 5747 - DNA, 78 bp, Zea mays
ggggaatgacgtccggtccgaacaagccacggctgctgctgcgctaccgccgcggcttcggaccaggcttcattcccc

SEQ ID NO: 5748 - DNA, 126 bp, Zea mays
ggggaatgttgtctggttggagacctaacaccrcgaattaatcatccatgccatggaagcagcatatgcccgcctgcatctatccatgcatgatggtggaaggtttcggaccaggcttcattcccc

SEQ ID NO: 5749 - DNA, 76 bp, Zea mays
ggggaatgacgtccggtccgaacgagccacggctgctgctgcgccgccgcgggcttcggaccaggcttcattcccc

SEQ ID NO: 5750 - DNA, 83 bp, Zea mays
ggggaatgtcgtctggcgcgagaccgtaccagacgacgtgctctctcggtcgtcggacggtctcggaccaggcttcattcccc

SEQ ID NO: 5751 - DNA, 154 bp, Zea mays
caagttgaagattaggttaaggggtttgtttgtctggttcaaggtcgccacacagcagggaaaacccatttcgccttgaagcatgcaccatgatgggtgtacctgttggtgatctcggaccaggcttcaatccctttaactagcgtctgcatat

SEQ ID NO: 5752 - DNA, 168 bp, Zea mays
gcatgctcgggttaggtcagggggattgttgtctggctcggggtctccggtcgagatcgattcataacatatacgtacgtgcttctagccttgccggcggagctagtcgttgtcgtcgaccggagatttcggaccaggcttcaatccctttgaccatgcggcattagg

SEQ ID NO: 5753 - DNA, 137 bp, Zea mays
aaagaacgggaggagggtttctggaatggaggctggtccaagatccttaggtgttaaagcattatattgccttgtttctggttttgtgtttgagatctcggaccaggcttcattcctcaaacccacgctcccgacac

SEQ ID NO: 5754 - DNA, 156 bp, Zea mays
tccttggtctgggggtttgtggggaatgttggctggctcgaggcatccgcgtcctggctcgcagtcgcagcgcagatcgtgttttgcctgctaccggccggacagatcgagaggcgtcggaccaggcttcattcctcgcaaaccggtgcatcccca

SEQ ID NO: 5755 - DNA, 96 bp, Zea mays
gggattgttgtctggctcggtgtctccggtcgagayggccttgccggcgccggagctgtcgtcgaccggagatctcggaccaggcttcaatccctt

SEQ ID NO: 5756 - DNA, 95 bp, Zea mays
tgttgaggggaatgtcgtctggcgcgagaccgtaccagacgacgtgcactctcggtcgtcggacggtctcggaccaggcttcattccccccaaca

SEQ ID NO: 5757 - DNA, 95 bp, Zea mays
ttgaggggaatgttgtctggctcgaggtgcagaaacatacagatctcatcggtctaggttcttgtcgatctcggaccaggcttcattcccctcaa

SEQ ID NO: 5758 - DNA, 91 bp, Zea mays
gaggagaatgttgtctggctcgaggtgcagaaacatacagatctcatcggtctaggttcttgtcgatctcggaccaggcttcattcccctc

SEQ ID NO: 5759 - DNA, 83 bp, Zea mays; identical to SEQ ID NO: 5750

SEQ ID NO: 5760 - DNA, 78 bp, Zea mays; identical to SEQ ID NO: 5747

SEQ ID NO: 5761 - DNA, 76 bp, Zea mays; identical to SEQ ID NO: 5749

SEQ ID NO: 5762 - DNA, 126 bp, Zea mays
gtggaatgttgtctggttggagacctaacaccgcgaatcccttatccatgccatggaagcagcatatgcccgcctgcatctatccatgcatgatggtggaaggtttcggaccacgcttcattcccc

SEQ ID NO: 5763 - DNA, 167 bp, Arabidopsis lyrata; identical to SEQ ID NO: 5592

SEQ ID NO: 5764 - DNA, 148 bp, Arabidopsis lyrata; identical to SEQ ID NO: 5593

SEQ ID NO: 5765 - DNA, 121 bp, Arabidopsis lyrata; identical to SEQ ID NO: 5594

SEQ ID NO: 5766 - DNA, 113 bp, Arabidopsis lyrata; identical to SEQ ID NO: 5595

SEQ ID NO: 5767 - DNA, 200 bp, Arabidopsis lyrata; identical to SEQ ID NO: 5596

SEQ ID NO: 5768 - DNA, 105 bp, Arabidopsis lyrata; identical to SEQ ID NO: 5597

SEQ ID NO: 5769 - DNA, 131 bp, Arabidopsis lyrata; identical to SEQ ID NO: 5598

SEQ ID NO: 5770 - DNA, 111 bp, Aquilegia coerulea; identical to SEQ ID NO: 5599

SEQ ID NO: 5771 - DNA, 94 bp, Aquilegia coerulea; identical to SEQ ID NO: 5600

SEQ ID NO: 5772 - DNA, 116 bp, Aquilegia coerulea; identical to SEQ ID NO: 5601

SEQ ID NO: 5773 - DNA, 129 bp, Aquilegia coerulea; identical to SEQ ID NO: 5602

SEQ ID NO: 5774 - DNA, 147 bp, Aquilegia coerulea; identical to SEQ ID NO: 5603

SEQ ID NO: 5775 - DNA, 170 bp, Arabidopsis thaliana; identical to SEQ ID NO: 5604

SEQ ID NO: 5776 - DNA, 120 bp, Arabidopsis thaliana; identical to SEQ ID NO: 5605

SEQ ID NO: 5777 - DNA, 139 bp, Arabidopsis thaliana; identical to SEQ ID NO: 5606

SEQ ID NO: 5778 - DNA, 113 bp, Arabidopsis thaliana; identical to SEQ ID NO: 5607

SEQ ID NO: 5779 - DNA, 143 bp, Arabidopsis thaliana; identical to SEQ ID NO: 5608

SEQ ID NO: 5780 - DNA, 105 bp, Arabidopsis thaliana; identical to SEQ ID NO: 5609

SEQ ID NO: 5781 - DNA, 122 bp, Arabidopsis thaliana; identical to SEQ ID NO: 5610

SEQ ID NO: 5782 - DNA, 120 bp, Brachypodium distachyon; identical to SEQ ID NO: 5611

SEQ ID NO: 5783 - DNA, 120 bp, Brachypodium distachyon; identical to SEQ ID NO: 5611

SEQ ID NO: 5784 - DNA, 244 bp, Brachypodium distachyon; identical to SEQ ID NO: 5613

SEQ ID NO: 5785 - DNA, 172 bp, Brachypodium distachyon; identical to SEQ ID NO: 5614

SEQ ID NO: 5786 - DNA, 165 bp, Brachypodium distachyon; identical to SEQ ID NO: 5615

SEQ ID NO: 5787 - DNA, 151 bp, Brachypodium distachyon; identical to SEQ ID NO: 5616

SEQ ID NO: 5788 - DNA, 145 bp, Brachypodium distachyon; identical to SEQ ID NO: 5617

SEQ ID NO: 5789 - DNA, 135 bp, Brassica napus; identical to SEQ ID NO: 5618

SEQ ID NO: 5790 - DNA, 118 bp, Brassica napus; identical to SEQ ID NO: 5619

SEQ ID NO: 5791 - DNA, 128 bp, Brassica napus; identical to SEQ ID NO: 5620

SEQ ID NO: 5792 - DNA, 128 bp, Brassica napus; identical to SEQ ID NO: 5621

SEQ ID NO: 5793 - DNA, 160 bp, Citrus x paradisi x Poncirus trifoliata; identical to SEQ ID NO: 5622

SEQ ID NO: 5794 - DNA, 202 bp, Citrus reticulata; identical to SEQ ID NO: 5623

SEQ ID NO: 5795 - DNA, 202 bp, Citrus reticulata; identical to SEQ ID NO: 5624

SEQ ID NO: 5796 - DNA, 177 bp, Citrus sinensis; identical to SEQ ID NO: 5625

SEQ ID NO: 5797 - DNA, 202 bp, Citrus sinensis; identical to SEQ ID NO: 5626

SEQ ID NO: 5798 - DNA, 192 bp, Citrus sinensis; identical to SEQ ID NO: 5627

SEQ ID NO: 5799 - DNA, 138 bp, Citrus sinensis; identical to SEQ ID NO: 5628

SEQ ID NO: 5800 - DNA, 126 bp, Citrus sinensis; identical to SEQ ID NO: 5629

SEQ ID NO: 5801 - DNA, 177 bp, Citrus sinensis; identical to SEQ ID NO: 5625

SEQ ID NO: 5802 - DNA, 414 bp, Citrus trifoliata; identical to SEQ ID NO: 5631

SEQ ID NO: 5803 - DNA, 134 bp, Festuca arundinacea; identical to SEQ ID NO: 5632

SEQ ID NO: 5804 - DNA, 108 bp, Festuca glaucescens x Lolium multiflorum; identical to SEQ ID NO: 5633

SEQ ID NO: 5805 - DNA, 147 bp, Gossypium hirsutum; identical to SEQ ID NO: 5634

SEQ ID NO: 5806 - DNA, 154 bp, Gossypium hirsutum; identical to SEQ ID NO: 5635

SEQ ID NO: 5807 - DNA, 146 bp, Glycine max; identical to SEQ ID NO: 5636

SEQ ID NO: 5808 - DNA, 167 bp, Glycine max; identical to SEQ ID NO: 5637

SEQ ID NO: 5809 - DNA, 409 bp, Glycine max; identical to SEQ ID NO: 5638

SEQ ID NO: 5810 - DNA, 86 bp, Glycine max; identical to SEQ ID NO: 5639

SEQ ID NO: 5811 - DNA, 156 bp, Glycine max; identical to SEQ ID NO: 5640

SEQ ID NO: 5812 - DNA, 136 bp, Glycine max; identical to SEQ ID NO: 5641

SEQ ID NO: 5813 - DNA, 100 bp, Hordeum vulgare; identical to SEQ ID NO: 5642
  misc_feature (23)..(23): n is a, c, g, or t
  misc_feature (32)..(32): n is a, c, g, or t
  misc_feature (43)..(43): n is a, c, g, or t

SEQ ID NO: 5814 - DNA, 102 bp, Hordeum vulgare; identical to SEQ ID NO: 5643

SEQ ID NO: 5815 - DNA, 78 bp, Hordeum vulgare; identical to SEQ ID NO: 5644
  misc_feature (11)..(11): n is a, c, g, or t
  misc_feature (20)..(20): n is a, c, g, or t
  misc_feature (31)..(31): n is a, c, g, or t

SEQ ID NO: 5816 - DNA, 78 bp, Hordeum vulgare subsp. Vulgare; identical to SEQ ID NO: 5644
  misc_feature (11)..(11): n is a, c, g, or t
  misc_feature (20)..(20): n is a, c, g, or t
  misc_feature (31)..(31): n is a, c, g, or t

SEQ ID NO: 5817 - DNA, 169 bp, Ipomoea nil; identical to SEQ ID NO: 5646

SEQ ID NO: 5818 - DNA, 121 bp, Medicago truncatula; identical to SEQ ID NO: 5647

SEQ ID NO: 5819 - DNA, 170 bp, Medicago truncatula; identical to SEQ ID NO: 5648

SEQ ID NO: 5820 - DNA, 105 bp, Medicago truncatula; identical to SEQ ID NO: 5649

SEQ ID NO: 5821 - DNA, 91 bp, Medicago truncatula; identical to SEQ ID NO: 5650

SEQ ID NO: 5822 - DNA, 106 bp, Medicago truncatula; identical to SEQ ID NO: 5651

SEQ ID NO: 5823 - DNA, 179 bp, Medicago truncatula; identical to SEQ ID NO: 5652

SEQ ID NO: 5824 - DNA, 107 bp, Medicago truncatula; identical to SEQ ID NO: 5653

SEQ ID NO: 5825 - DNA, 92 bp, Medicago truncatula; identical to SEQ ID NO: 5654

SEQ ID NO: 5826 - DNA, 187 bp, Nicotiana sylvestris; identical to SEQ ID NO: 5655

SEQ ID NO: 5827 - DNA, 145 bp, Oryza sativa; identical to SEQ ID NO: 5656

SEQ ID NO: 5828 - DNA, 206 bp, Oryza sativa; identical to SEQ ID NO: 5657

SEQ ID NO: 5829 - DNA, 125 bp, Oryza sativa; identical to SEQ ID NO: 5658

SEQ ID NO: 5830 - DNA, 125 bp, Oryza sativa; identical to SEQ ID NO: 5659

SEQ ID NO: 5831 - DNA, 137 bp, Oryza sativa; identical to SEQ ID NO: 5660

SEQ ID NO: 5832 - DNA, 107 bp, Oryza sativa; identical to SEQ ID NO: 5661

SEQ ID NO: 5833 - DNA, 145 bp, Oryza sativa; identical to SEQ ID NO: 5662

SEQ ID NO: 5834 - DNA, 119 bp, Oryza sativa; identical to SEQ ID NO: 5663

SEQ ID NO: 5835 - DNA, 145 bp, Oryza sativa; identical to SEQ ID NO: 5664

SEQ ID NO: 5836 - DNA, 140 bp, Oryza sativa; identical to SEQ ID NO: 5665

SEQ ID NO: 5837 - DNA, 127 bp, Oryza sativa; identical to SEQ ID NO: 5666

SEQ ID NO: 5838 - DNA, 117 bp, Oryza sativa; identical to SEQ ID NO: 5667

SEQ ID NO: 5839 - DNA, 200 bp, Oryza sativa; identical to SEQ ID NO: 5668

SEQ ID NO: 5840 - DNA, 100 bp, Oryza sativa; identical to SEQ ID NO: 5669

SEQ ID NO: 5841 - DNA, 90 bp, Picea abies; identical to SEQ ID NO: 5670

SEQ ID NO: 5842 - DNA, 129 bp, Picea abies; identical to SEQ ID NO: 5671

SEQ ID NO: 5843 - DNA, 74 bp, Picea glauca; identical to SEQ ID NO: 5672

SEQ ID NO: 5844 - DNA, 102 bp, Physcomitrella patens; identical to SEQ ID NO: 5673

SEQ ID NO: 5845 - DNA, 103 bp, Physcomitrella patens; identical to SEQ ID NO: 5674

SEQ ID NO: 5846 - DNA, 123 bp, Physcomitrella patens; identical to SEQ ID NO: 5675

SEQ ID NO: 5847 - DNA, 128 bp, Physcomitrella patens; identical to SEQ ID NO: 5676

SEQ ID NO: 5848 - DNA, 146 bp, Physcomitrella patens; identical to SEQ ID NO: 5677

SEQ ID NO: 5849 - DNA, 123 bp, Physcomitrella patens; identical to SEQ ID NO: 5678

SEQ ID NO: 5850 - DNA, 146 bp, Physcomitrella patens; identical to SEQ ID NO: 5679

SEQ ID NO: 5851 - DNA, 126 bp, Physcomitrella patens; identical to SEQ ID NO: 5680

SEQ ID NO: 5852 - DNA, 120 bp, Physcomitrella patens; identical to SEQ ID NO: 5681

SEQ ID NO: 5853 - DNA, 131 bp, Physcomitrella patens; identical to SEQ ID NO: 5682

SEQ ID NO: 5854 - DNA, 123 bp, Physcomitrella patens; identical to SEQ ID NO: 5683

SEQ ID NO: 5855 - DNA, 133 bp, Physcomitrella patens; identical to SEQ ID NO: 5684

SEQ ID NO: 5856 - DNA, 130 bp, Physcomitrella patens; identical to SEQ ID NO: 215

SEQ ID NO: 5857 - DNA, 94 bp, Pinus taeda; identical to SEQ ID NO: 5685

SEQ ID NO: 5858 - DNA, 125 bp, Pinus taeda; identical to SEQ ID NO: 5686

SEQ ID NO: 5859 - DNA, 164 bp, Populus trichocarpa; identical to SEQ ID NO: 5688

SEQ ID NO: 5860 - DNA, 106 bp, Populus trichocarpa; identical to SEQ ID NO: 5689

SEQ ID NO: 5861 - DNA, 134 bp, Populus trichocarpa; identical to SEQ ID NO: 5690

SEQ ID NO: 5862 - DNA, 105 bp, Populus trichocarpa; identical to SEQ ID NO: 5691

SEQ ID NO: 5863 - DNA, 106 bp, Populus trichocarpa; identical to SEQ ID NO: 5692

SEQ ID NO: 5864 - DNA, 105 bp, Populus trichocarpa; identical to SEQ ID NO: 5693

SEQ ID NO: 5865 - DNA, 103 bp, Populus trichocarpa; identical to SEQ ID NO: 5694

SEQ ID NO: 5866 - DNA, 101 bp, Populus trichocarpa; identical to SEQ ID NO: 5695

SEQ ID NO: 5867 - DNA, 103 bp, Populus trichocarpa; identical to SEQ ID NO: 5696

SEQ ID NO: 5868 - DNA, 143 bp, Populus trichocarpa; identical to SEQ ID NO: 5697

SEQ ID NO: 5869 - DNA, 143 bp, Populus trichocarpa; identical to SEQ ID NO: 5697

SEQ ID NO: 5870 - DNA, 97 bp, Populus trichocarpa; identical to SEQ ID NO: 5699

SEQ ID NO: 5871 - DNA, 105 bp, Populus trichocarpa; identical to SEQ ID NO: 5700

SEQ ID NO: 5872 - DNA, 331 bp, Populus trichocarpa; identical to SEQ ID NO: 5701

SEQ ID NO: 5873 - DNA, 324 bp, Populus trichocarpa; identical to SEQ ID NO: 5702

SEQ ID NO: 5874 - DNA, 146 bp, Populus trichocarpa; identical to SEQ ID NO: 217

SEQ ID NO: 5875 - DNA, 151 bp, Populus trichocarpa; identical to SEQ ID NO: 5704

SEQ ID NO: 5876 - DNA, 144 bp, Phaseolus vulgaris; identical to SEQ ID NO: 5705

SEQ ID NO: 5877 - DNA, 670 bp, Phaseolus vulgaris; identical to SEQ ID NO: 5706

SEQ ID NO: 5878 - DNA, 149 bp, Ricinus communis; identical to SEQ ID NO: 5707

SEQ ID NO: 5879 - DNA, 119 bp, Ricinus communis; identical to SEQ ID NO: 5708

SEQ ID NO: 5880 - DNA, 91 bp, Ricinus communis; identical to SEQ ID NO: 5709

SEQ ID NO: 5881 - DNA, 92 bp, Ricinus communis; identical to SEQ ID NO: 5710

SEQ ID NO: 5882 - DNA, 131 bp, Ricinus communis; identical to SEQ ID NO: 5711

SEQ ID NO: 5883 - DNA, 108 bp, Sorghum bicolor; identical to SEQ ID NO: 5712

SEQ ID NO: 5884 - DNA, 72 bp, Sorghum bicolor; identical to SEQ ID NO: 5713

SEQ ID NO: 5885 - DNA, 94 bp, Sorghum bicolor; identical to SEQ ID NO: 5714

SEQ ID NO: 5886 - DNA, 87 bp, Sorghum bicolor; identical to SEQ ID NO: 5715

SEQ ID NO: 5887 - DNA, 151 bp, Sorghum bicolor; identical to SEQ ID NO: 5716

SEQ ID NO: 5888 - DNA, 139 bp, Sorghum bicolor; identical to SEQ ID NO: 5717

SEQ ID NO: 5889 - DNA, 134 bp, Sorghum bicolor; identical to SEQ ID NO: 5718

SEQ ID NO: 5890 - DNA, 185 bp, Sorghum bicolor; identical to SEQ ID NO: 5719

SEQ ID NO: 5891 - DNA, 86 bp, Sorghum bicolor; identical to SEQ ID NO: 5720

SEQ ID NO: 5892 - DNA, 108 bp, Sorghum bicolor; identical to SEQ ID NO: 5721

SEQ ID NO: 5893 - DNA, 103 bp, Sorghum bicolor; identical to SEQ ID NO: 5722

SEQ ID NO: 5894 - DNA, 111 bp, Solanum lycopersicum; identical to SEQ ID NO: 5723

SEQ ID NO: 5895 - DNA, 201 bp, Solanum lycopersicum; identical to SEQ ID NO: 5724

SEQ ID NO: 5896 - DNA, 145 bp, Selaginella moellendorffii; identical to SEQ ID NO: 5725

SEQ ID NO: 5897 - DNA, 136 bp, Selaginella moellendorffii; identical to SEQ ID NO: 5726

SEQ ID NO: 5898 - DNA, 138 bp, Selaginella moellendorffii; identical to SEQ ID NO: 5727

SEQ ID NO: 5899 - DNA, 127 bp, Saccharum officinarum; identical to SEQ ID NO: 5728

SEQ ID NO: 5900 - DNA, 111 bp, Triticum aestivum; identical to SEQ ID NO: 5729

SEQ ID NO: 5901 - DNA, 118 bp, Theobroma cacao; identical to SEQ ID NO: 5730

SEQ ID NO: 5902 - DNA, 178 bp, Theobroma cacao; identical to SEQ ID NO: 5731

SEQ ID NO: 5903 - DNA, 141 bp, Theobroma cacao; identical to SEQ ID NO: 5732

SEQ ID NO: 5904 - DNA, 119 bp, Theobroma cacao; identical to SEQ ID NO: 5733

SEQ ID NO: 5905 - DNA, 130 bp, Vitis vinifera; identical to SEQ ID NO: 5734

SEQ ID NO: 5906 - DNA, 99 bp, Vitis vinifera; identical to SEQ ID NO: 5735

SEQ ID NO: 5907 - DNA, 160 bp, Vitis vinifera; identical to SEQ ID NO: 5736

SEQ ID NO: 5908 - DNA, 160 bp, Vitis vinifera; identical to SEQ ID NO: 5737

SEQ ID NO: 5909 - DNA, 166 bp, Vitis vinifera; identical to SEQ ID NO: 5738

SEQ ID NO: 5910 - DNA, 100 bp, Vitis vinifera; identical to SEQ ID NO: 5739

SEQ ID NO: 5911 - DNA, 100 bp, Vitis vinifera; identical to SEQ ID NO: 5740

SEQ ID NO: 5912 - DNA, 100 bp, Vitis vinifera; identical to SEQ ID NO: 5741

SEQ ID NO: 5913 - DNA, 213 bp, Zea mays; identical to SEQ ID NO: 5742

SEQ ID NO: 5914 - DNA, 116 bp, Zea mays; identical to SEQ ID NO: 5743

SEQ ID NO: 5915 - DNA, 92 bp, Zea mays; identical to SEQ ID NO: 5744

SEQ ID NO: 5916 - DNA, 104 bp, Zea mays; identical to SEQ ID NO: 5745

SEQ ID NO: 5917 - DNA, 87 bp, Zea mays; identical to SEQ ID NO: 5746

SEQ ID NO: 5918 - DNA, 78 bp, Zea mays; identical to SEQ ID NO: 5747

SEQ ID NO: 5919 - DNA, 126 bp, Zea mays; identical to SEQ ID NO: 5748

SEQ ID NO: 5920 - DNA, 76 bp, Zea mays; identical to SEQ ID NO: 5749

SEQ ID NO: 5921 - DNA, 83 bp, Zea mays; identical to SEQ ID NO: 5750

SEQ ID NO: 5922 - DNA, 154 bp, Zea mays; identical to SEQ ID NO: 5751

SEQ ID NO: 5923 - DNA, 168 bp, Zea mays; identical to SEQ ID NO: 5752

SEQ ID NO: 5924 - DNA, 137 bp, Zea mays; identical to SEQ ID NO: 5753

SEQ ID NO: 5925 - DNA, 156 bp, Zea mays; identical to SEQ ID NO: 5754

SEQ ID NO: 5926 - DNA, 96 bp, Zea mays; identical to SEQ ID NO: 5755

SEQ ID NO: 5927 - DNA, 95 bp, Zea mays; identical to SEQ ID NO: 5756

SEQ ID NO: 5928 - DNA, 95 bp, Zea mays; identical to SEQ ID NO: 5757

SEQ ID NO: 5929 - DNA, 91 bp, Zea mays; identical to SEQ ID NO: 5758

SEQ ID NO: 5930 - DNA, 83 bp, Zea mays; identical to SEQ ID NO: 5750

SEQ ID NO: 5931 - DNA, 78 bp, Zea mays; identical to SEQ ID NO: 5747

SEQ ID NO: 5932 - DNA, 76 bp, Zea mays; identical to SEQ ID NO: 5749

SEQ ID NO: 5933 - DNA, 126 bp, Zea mays; identical to SEQ ID NO: 5762

SEQ ID NO: 5934 - DNA, 167 bp, Arabidopsis lyrata; identical to SEQ ID NO: 5592

SEQ ID NO: 5935 - DNA, 148 bp, Arabidopsis lyrata; identical to SEQ ID NO: 5593

SEQ ID NO: 5936 - DNA, 121 bp, Arabidopsis lyrata; identical to SEQ ID NO: 5594

SEQ ID NO: 5937 - DNA, 113 bp, Arabidopsis lyrata; identical to SEQ ID NO: 5595

SEQ ID NO: 5938 - DNA, 200 bp, Arabidopsis lyrata; identical to SEQ ID NO: 5596

SEQ ID NO: 5939 - DNA, 105 bp, Arabidopsis lyrata; identical to SEQ ID NO: 5597

SEQ ID NO: 5940 - DNA, 131 bp, Arabidopsis lyrata; identical to SEQ ID NO: 5598

SEQ ID NO: 5941 - DNA, 111 bp, Aquilegia coerulea; identical to SEQ ID NO: 5599

SEQ ID NO: 5942 - DNA, 94 bp, Aquilegia coerulea; identical to SEQ ID NO: 5600

SEQ ID NO: 5943 - DNA, 116 bp, Aquilegia coerulea; identical to SEQ ID NO: 5601

SEQ ID NO: 5944 - DNA, 129 bp, Aquilegia coerulea; identical to SEQ ID NO: 5602

SEQ ID NO: 5945 - DNA, 147 bp, Aquilegia coerulea; identical to SEQ ID NO: 5603

SEQ ID NO: 5946 - DNA, 170 bp, Arabidopsis thaliana; identical to SEQ ID NO: 5604

SEQ ID NO: 5947 - DNA, 120 bp, Arabidopsis thaliana; identical to SEQ ID NO: 5605

SEQ ID NO: 5948 - DNA, 139 bp, Arabidopsis thaliana; identical to SEQ ID NO: 5606

SEQ ID NO: 5949 - DNA, 113 bp, Arabidopsis thaliana; identical to SEQ ID NO: 5607

SEQ ID NO: 5950 - DNA, 143 bp, Arabidopsis thaliana; identical to SEQ ID NO: 5608

SEQ ID NO: 5951 - DNA, 105 bp, Arabidopsis thaliana; identical to SEQ ID NO: 5609

SEQ ID NO: 5952 - DNA, 122 bp, Arabidopsis thaliana; identical to SEQ ID NO: 5610

SEQ ID NO: 5953 - DNA, 120 bp, Brachypodium distachyon; identical to SEQ ID NO: 5611

SEQ ID NO: 5954 - DNA, 120 bp, Brachypodium distachyon; identical to SEQ ID NO: 5611

SEQ ID NO: 5955 - DNA, 244 bp, Brachypodium distachyon; identical to SEQ ID NO: 5613

SEQ ID NO: 5956 - DNA, 172 bp, Brachypodium distachyon; identical to SEQ ID NO: 5614

SEQ ID NO: 5957 - DNA, 165 bp, Brachypodium distachyon; identical to SEQ ID NO: 5615

SEQ ID NO: 5958 - DNA, 151 bp, Brachypodium distachyon; identical to SEQ ID NO: 5616

SEQ ID NO: 5959 - DNA, 145 bp, Brachypodium distachyon; identical to SEQ ID NO: 5617

SEQ ID NO: 5960 - DNA, 135 bp, Brassica napus; identical to SEQ ID NO: 5618

SEQ ID NO: 5961 - DNA, 118 bp, Brassica napus; identical to SEQ ID NO: 5619

SEQ ID NO: 5962 - DNA, 128 bp, Brassica napus; identical to SEQ ID NO: 5620

SEQ ID NO: 5963 - DNA, 128 bp, Brassica napus; identical to SEQ ID NO: 5621

SEQ ID NO: 5964 - DNA, 160 bp, Citrus x paradisi x Poncirus trifoliata; identical to SEQ ID NO: 5622

SEQ ID NO: 5965 - DNA, 202 bp, Citrus reticulata; identical to SEQ ID NO: 5623

SEQ ID NO: 5966 - DNA, 202 bp, Citrus reticulata; identical to SEQ ID NO: 5624

SEQ ID NO: 5967 - DNA, 177 bp, Citrus sinensis; identical to SEQ ID NO: 5625

SEQ ID NO: 5968 - DNA, 202 bp, Citrus sinensis; identical to SEQ ID NO: 5626

SEQ ID NO: 5969 - DNA, 192 bp, Citrus sinensis; identical to SEQ ID NO: 5627

SEQ ID NO: 5970 - DNA, 138 bp, Citrus sinensis; identical to SEQ ID NO: 5628

SEQ ID NO: 5971 - DNA, 126 bp, Citrus sinensis; identical to SEQ ID NO: 5629

SEQ ID NO: 5972 - DNA, 177 bp, Citrus sinensis; identical to SEQ ID NO: 5625

SEQ ID NO: 5973 - DNA, 414 bp, Citrus trifoliata; identical to SEQ ID NO: 5631

SEQ ID NO: 5974 - DNA, 134 bp, Festuca arundinacea; identical to SEQ ID NO: 5632

SEQ ID NO: 5975 - DNA, 108 bp, Festuca glaucescens x Lolium multiflorum; identical to SEQ ID NO: 5633

SEQ ID NO: 5976 - DNA, 147 bp, Gossypium hirsutum; identical to SEQ ID NO: 5634

SEQ ID NO: 5977 - DNA, 154 bp, Gossypium hirsutum; identical to SEQ ID NO: 5635

SEQ ID NO: 5978 - DNA, 146 bp, Glycine max; identical to SEQ ID NO: 5636

SEQ ID NO: 5979 - DNA, 167 bp, Glycine max; identical to SEQ ID NO: 5637

SEQ ID NO: 5980 - DNA, 409 bp, Glycine max; identical to SEQ ID NO: 5638

SEQ ID NO: 5981 - DNA, 86 bp, Glycine max; identical to SEQ ID NO: 5639

SEQ ID NO: 5982 - DNA, 156 bp, Glycine max; identical to SEQ ID NO: 5640

SEQ ID NO: 5983 - DNA, 136 bp, Glycine max; identical to SEQ ID NO: 5641

SEQ ID NO: 5984 - DNA, 100 bp, Hordeum vulgare; identical to SEQ ID NO: 5642
  misc_feature (23)..(23): n is a, c, g, or t
  misc_feature (32)..(32): n is a, c, g, or t
  misc_feature (43)..(43): n is a, c, g, or t

SEQ ID NO: 5985 - DNA, 102 bp, Hordeum vulgare; identical to SEQ ID NO: 5643

SEQ ID NO: 5986 - DNA, 78 bp, Hordeum vulgare; identical to SEQ ID NO: 5644
  misc_feature (11)..(11): n is a, c, g, or t
  misc_feature (20)..(20): n is a, c, g, or t
  misc_feature (31)..(31): n is a, c, g, or t

SEQ ID NO: 5987 - DNA, 78 bp, Hordeum vulgare subsp. Vulgare; identical to SEQ ID NO: 5644
  misc_feature (11)..(11): n is a, c, g, or t
  misc_feature (20)..(20): n is a, c, g, or t
  misc_feature (31)..(31): n is a, c, g, or t

SEQ ID NO: 5988 - DNA, 169 bp, Ipomoea nil; identical to SEQ ID NO: 5646

SEQ ID NO: 5989 - DNA, 121 bp, Medicago truncatula; identical to SEQ ID NO: 5647

SEQ ID NO: 5990 - DNA, 170 bp, Medicago truncatula; identical to SEQ ID NO: 5648

SEQ ID NO: 5991 - DNA, 105 bp, Medicago truncatula; identical to SEQ ID NO: 5649

SEQ ID NO: 5992 - DNA, 91 bp, Medicago truncatula; identical to SEQ ID NO: 5650

SEQ ID NO: 5993 - DNA, 106 bp, Medicago truncatula; identical to SEQ ID NO: 5651

SEQ ID NO: 5994 - DNA, 179 bp, Medicago truncatula; identical to SEQ ID NO: 5652

SEQ ID NO: 5995 - DNA, 107 bp, Medicago truncatula; identical to SEQ ID NO: 5653

SEQ ID NO: 5996 - DNA, 92 bp, Medicago truncatula; identical to SEQ ID NO: 5654

SEQ ID NO: 5997 - DNA, 187 bp, Nicotiana sylvestris; identical to SEQ ID NO: 5655

SEQ ID NO: 5998 - DNA, 145 bp, Oryza sativa; identical to SEQ ID NO: 5656

SEQ ID NO: 5999 - DNA, 206 bp, Oryza sativa; identical to SEQ ID NO: 5657

SEQ ID NO: 6000 - DNA, 125 bp, Oryza sativa; identical to SEQ ID NO: 5658

SEQ ID NO: 6001 - DNA, 125 bp, Oryza sativa; identical to SEQ ID NO: 5659

SEQ ID NO: 6002 - DNA, 137 bp, Oryza sativa; identical to SEQ ID NO: 5660

SEQ ID NO: 6003 - DNA, 107 bp, Oryza sativa; identical to SEQ ID NO: 5661

SEQ ID NO: 6004 - DNA, 145 bp, Oryza sativa; identical to SEQ ID NO: 5662

SEQ ID NO: 6005 - DNA, 119 bp, Oryza sativa; identical to SEQ ID NO: 5663

SEQ ID NO: 6006 - DNA, 145 bp, Oryza sativa; identical to SEQ ID NO: 5664

SEQ ID NO: 6007 - DNA, 140 bp, Oryza sativa; identical to SEQ ID NO: 5665

SEQ ID NO: 6008 - DNA, 127 bp, Oryza sativa; identical to SEQ ID NO: 5666

SEQ ID NO: 6009 - DNA, 117 bp, Oryza sativa; identical to SEQ ID NO: 5667

SEQ ID NO: 6010 - DNA, 200 bp, Oryza sativa; identical to SEQ ID NO: 5668

SEQ ID NO: 6011 - DNA, 100 bp, Oryza sativa; identical to SEQ ID NO: 5669

SEQ ID NO: 6012 - DNA, 90 bp, Picea abies; identical to SEQ ID NO: 5670

SEQ ID NO: 6013 - DNA, 129 bp, Picea abies; identical to SEQ ID NO: 5671

SEQ ID NO: 6014 - DNA, 74 bp, Picea glauca; identical to SEQ ID NO: 5672

SEQ ID NO: 6015 - DNA, 102 bp, Physcomitrella patens; identical to SEQ ID NO: 5673

SEQ ID NO: 6016 - DNA, 103 bp, Physcomitrella patens; identical to SEQ ID NO: 5674

SEQ ID NO: 6017 - DNA, 123 bp, Physcomitrella patens; identical to SEQ ID NO: 5675

SEQ ID NO: 6018 - DNA, 128 bp, Physcomitrella patens; identical to SEQ ID NO: 5676

SEQ ID NO: 6019 - DNA, 146 bp, Physcomitrella patens; identical to SEQ ID NO: 5677

SEQ ID NO: 6020 - DNA, 123 bp, Physcomitrella patens; identical to SEQ ID NO: 5678

SEQ ID NO: 6021 - DNA, 146 bp, Physcomitrella patens; identical to SEQ ID NO: 5679

SEQ ID NO: 6022 - DNA, 126 bp, Physcomitrella patens; identical to SEQ ID NO: 5680

SEQ ID NO: 6023 - DNA, 120 bp, Physcomitrella patens; identical to SEQ ID NO: 5681

SEQ ID NO: 6024 - DNA, 131 bp, Physcomitrella patens; identical to SEQ ID NO: 5682

SEQ ID NO: 6025 - DNA, 123 bp, Physcomitrella patens; identical to SEQ ID NO: 5683

SEQ ID NO: 6026 - DNA, 133 bp, Physcomitrella patens; identical to SEQ ID NO: 5684

SEQ ID NO: 6027 - DNA, 130 bp, Physcomitrella patens; identical to SEQ ID NO: 215

SEQ ID NO: 6028 - DNA, 94 bp, Pinus taeda; identical to SEQ ID NO: 5685

SEQ ID NO: 6029 - DNA, 125 bp, Pinus taeda; identical to SEQ ID NO: 5686

SEQ ID NO: 6030 - DNA, 164 bp, Pinus taeda; identical to SEQ ID NO: 216

SEQ ID NO: 6031 - DNA, 164 bp, Populus trichocarpa; identical to SEQ ID NO: 5688

SEQ ID NO: 6032 - DNA, 106 bp, Populus trichocarpa; identical to SEQ ID NO: 5689

SEQ ID NO: 6033 - DNA, 134 bp, Populus trichocarpa; identical to SEQ ID NO: 5690

SEQ ID NO: 6034 - DNA, 105 bp, Populus trichocarpa; identical to SEQ ID NO: 5691

SEQ ID NO: 6035 - DNA, 106 bp, Populus trichocarpa; identical to SEQ ID NO: 5692

SEQ ID NO: 6036 - DNA, 105 bp, Populus trichocarpa; identical to SEQ ID NO: 5693

SEQ ID NO: 6037 - DNA, 103 bp, Populus trichocarpa; identical to SEQ ID NO: 5694

SEQ ID NO: 6038 - DNA, 101 bp, Populus trichocarpa; identical to SEQ ID NO: 5695

SEQ ID NO: 6039 - DNA, 103 bp, Populus trichocarpa; identical to SEQ ID NO: 5696

SEQ ID NO: 6040 - DNA, 143 bp, Populus trichocarpa; identical to SEQ ID NO: 5697

SEQ ID NO: 6041 - DNA, 143 bp, Populus trichocarpa; identical to SEQ ID NO: 5697

SEQ ID NO: 6042 - DNA, 97 bp, Populus trichocarpa; identical to SEQ ID NO: 5699

SEQ ID NO: 6043 - DNA, 105 bp, Populus trichocarpa; identical to SEQ ID NO: 5700

SEQ ID NO: 6044 - DNA, 331 bp, Populus trichocarpa; identical to SEQ ID NO: 5701

SEQ ID NO: 6045 - DNA, 324 bp, Populus trichocarpa; identical to SEQ ID NO: 5702

SEQ ID NO: 6046 - DNA, 151 bp, Populus trichocarpa; identical to SEQ ID NO: 5704

SEQ ID NO: 6047 - DNA, 144 bp, Phaseolus vulgaris; identical to SEQ ID NO: 5705

SEQ ID NO: 6048 - DNA, 670 bp, Phaseolus vulgaris; identical to SEQ ID NO: 5706

SEQ ID NO: 6049 - DNA, 149 bp, Ricinus communis; identical to SEQ ID NO: 5707

SEQ ID NO: 6050 - DNA, 119 bp, Ricinus communis; identical to SEQ ID NO: 5708

SEQ ID NO: 6051 - DNA, 91 bp, Ricinus communis; identical to SEQ ID NO: 5709

SEQ ID NO: 6052 - DNA, 92 bp, Ricinus communis; identical to SEQ ID NO: 5710

SEQ ID NO: 6053 - DNA, 131 bp, Ricinus communis; identical to SEQ ID NO: 5711

SEQ ID NO: 6054 - DNA, 108 bp, Sorghum bicolor; identical to SEQ ID NO: 5712

SEQ ID NO: 6055 - DNA, 72 bp, Sorghum bicolor; identical to SEQ ID NO: 5713

SEQ ID NO: 6056 - DNA, 94 bp, Sorghum bicolor; identical to SEQ ID NO: 5714

SEQ ID NO: 6057 - DNA, 87 bp, Sorghum bicolor; identical to SEQ ID NO: 5715

SEQ ID NO: 6058 - DNA, 151 bp, Sorghum bicolor; identical to SEQ ID NO: 5716

SEQ ID NO: 6059 - DNA, 139 bp, Sorghum bicolor; identical to SEQ ID NO: 5717

SEQ ID NO: 6060 - DNA, 134 bp, Sorghum bicolor; identical to SEQ ID NO: 5718

SEQ ID NO: 6061 - DNA, 185 bp, Sorghum bicolor; identical to SEQ ID NO: 5719

SEQ ID NO: 6062 - DNA, 86 bp, Sorghum bicolor; identical to SEQ ID NO: 5720

SEQ ID NO: 6063 - DNA, 108 bp, Sorghum bicolor; identical to SEQ ID NO: 5721

SEQ ID NO: 6064 - DNA, 103 bp, Sorghum bicolor; identical to SEQ ID NO: 5722

SEQ ID NO: 6065 - DNA, 111 bp, Solanum lycopersicum; identical to SEQ ID NO: 5723

SEQ ID NO: 6066 - DNA, 201 bp, Solanum lycopersicum; identical to SEQ ID NO: 5724

SEQ ID NO: 6067 - DNA, 145 bp, Selaginella moellendorffii; identical to SEQ ID NO: 5725

SEQ ID NO: 6068 - DNA, 136 bp, Selaginella moellendorffii; identical to SEQ ID NO: 5726

SEQ ID NO: 6069 - DNA, 138 bp, Selaginella moellendorffii; identical to SEQ ID NO: 5727

SEQ ID NO: 6070 - DNA, 127 bp, Saccharum officinarum; identical to SEQ ID NO: 5728

SEQ ID NO: 6071 - DNA, 111 bp, Triticum aestivum; identical to SEQ ID NO: 5729

SEQ ID NO: 6072 - DNA, 118 bp, Theobroma cacao; identical to SEQ ID NO: 5730

SEQ ID NO: 6073 - DNA, 178 bp, Theobroma cacao; identical to SEQ ID NO: 5731

SEQ ID NO: 6074 - DNA, 141 bp, Theobroma cacao; identical to SEQ ID NO: 5732

SEQ ID NO: 6075 - DNA, 119 bp, Theobroma cacao; identical to SEQ ID NO: 5733

SEQ ID NO: 6076 - DNA, 130 bp, Vitis vinifera; identical to SEQ ID NO: 5734

SEQ ID NO: 6077 - DNA, 99 bp, Vitis vinifera; identical to SEQ ID NO: 5735

SEQ ID NO: 6078 - DNA, 160 bp, Vitis vinifera; identical to SEQ ID NO: 5736

SEQ ID NO: 6079 - DNA, 160 bp, Vitis vinifera; identical to SEQ ID NO: 5737

SEQ ID NO: 6080 - DNA, 166 bp, Vitis vinifera; identical to SEQ ID NO: 5738

SEQ ID NO: 6081 - DNA, 100 bp, Vitis vinifera; identical to SEQ ID NO: 5739

SEQ ID NO: 6082 - DNA, 100 bp, Vitis vinifera; identical to SEQ ID NO: 5740

SEQ ID NO: 6083 - DNA, 100 bp, Vitis vinifera; identical to SEQ ID NO: 5741

SEQ ID NO: 6084 - DNA, 213 bp, Zea mays; identical to SEQ ID NO: 5742

SEQ ID NO: 6085 - DNA, 116 bp, Zea mays; identical to SEQ ID NO: 5743

SEQ ID NO: 6086 - DNA, 92 bp, Zea mays; identical to SEQ ID NO: 5744

SEQ ID NO: 6087 - DNA, 104 bp, Zea mays; identical to SEQ ID NO: 5745

SEQ ID NO: 6088 - DNA, 87 bp, Zea mays; identical to SEQ ID NO: 5746

SEQ ID NO: 6089 - DNA, 78 bp, Zea mays; identical to SEQ ID NO: 5747

SEQ ID NO: 6090 - DNA, 126 bp, Zea mays; identical to SEQ ID NO: 5748

SEQ ID NO: 6091 - DNA, 76 bp, Zea mays; identical to SEQ ID NO: 5749

SEQ ID NO: 6092 - DNA, 83 bp, Zea mays; identical to SEQ ID NO: 5750

SEQ ID NO: 6093 - DNA, 154 bp, Zea mays; identical to SEQ ID NO: 5751

SEQ ID NO: 6094 - DNA, 168 bp, Zea mays; identical to SEQ ID NO: 5752

SEQ ID NO: 6095 - DNA, 137 bp, Zea mays; identical to SEQ ID NO: 5753

SEQ ID NO: 6096 - DNA, 156 bp, Zea mays; identical to SEQ ID NO: 5754

SEQ ID NO: 6097 - DNA, 96 bp, Zea mays; identical to SEQ ID NO: 5755

SEQ ID NO: 6098 - DNA, 95 bp, Zea mays; identical to SEQ ID NO: 5756

SEQ ID NO: 6099 - DNA, 95 bp, Zea mays; identical to SEQ ID NO: 5757

SEQ ID NO: 6100 - DNA, 91 bp, Zea mays; identical to SEQ ID NO: 5758

SEQ ID NO: 6101 - DNA, 83 bp, Zea mays; identical to SEQ ID NO: 5750

SEQ ID NO: 6102 - DNA, 78 bp, Zea mays; identical to SEQ ID NO: 5747

SEQ ID NO: 6103 - DNA, 76 bp, Zea mays; identical to SEQ ID NO: 5749

SEQ ID NO: 6104 - DNA, 126 bp, Zea mays; identical to SEQ ID NO: 5762

SEQ ID NO: 6105 - DNA, 96 bp, Arachis hypogaea
aggcattgttccatagccattttggcattctgtccacctccgatccgatccgattcgggaggtggccagtaggccaaacgggttctgtgaatatgt

SEQ ID NO: 6106 - DNA, 220 bp, Arabidopsis lyrata
tagattggatctttaaacttttgttccttttcatgagggtttgacaaagagtttcttacagacatctttggcattctgtccacctcctcctgtacatgtgtgtatatatatgtgttttgtgtggaagaaggaggtgggtatactgccaatagagatctgttagggtttcttcgtaaaaccctcttgatctatatacaactttatcaatgtcttgaatctg

SEQ ID NO: 6107 - DNA, 160 bp, Arabidopsis lyrata
gatcatgcgggtttgacaaaagagtctcttacagagatctttggcattctgtccacctcctctctctatatgtatatgtatgagcgctgtcttgtgaggggaggtggacatattgccaacagagatctgttagggtttctttgtaaaacccctcatgatt

SEQ ID NO: 6108 - DNA, 117 bp, Arabidopsis thaliana
cttacagtcatctttggcattctgtccacctccttctatacatatatgcatgtgtatatatatatgcgtttcgtgtgaaagaaggaggtgggtatactgccaatagagatctgttag

SEQ ID NO: 6109 - DNA, 121 bp, Arabidopsis thaliana
cttacagagatctttggcattctgtccacctcctctctctatatttatgtgtaataagtgtacgtatctacggtgtgtttcgtaagaggaggtgggcatactgccaatagagatctgttag

SEQ ID NO: 6110 - DNA, 200 bp, Brachypodium distachyon
gcagtagtaatagtcatgtgggtttgccaaaggggcgcttaccgagagctctttggcattctgtccacctccttgcgagtctcgcgggagatctcatgatctgttgttgagcttgcagatagcttggaggtgggcatactgccaatggagctgtgtaggcttccctttgtaaaacccatatggcgaagatcaaaccagct

SEQ ID NO: 6111 - DNA, 147 bp, Citrus sinensis
cttcttacagagtttattggcattctgtccacctccgttccccatcgattgaatctgaaagcctttttcttttcttgtttttgtgcttctctctttcatgctcatggaggtgggcatactgccaactgagctctgttggcttctctt

SEQ ID NO: 6112 - DNA, 97 bp, Gossypium hirsutum
ttggcattctgtccacctccattgatgtacttcttcttacctagccaacttataaaatgatttgtctttgaagtaatggaggcggccagtatgtcaa

SEQ ID NO: 6113 - DNA, 167 bp, Gossypium hirsutum
tgctttcatgggggtttagcaaagggcttcttacagagtttattggcattctgtccacctccccatcatggaaaaagtccgtatttttcccctctggtttttcatggaggtgggcatactgccaactgtgctctgttggcttctctttgtaaaatccttgtgatgca

SEQ ID NO: 6114 - DNA, 165 bp, Gossypium hirsutum
taggggttcttagaggctttgttgcagagccaatttggcattctgtccacctccattgatgtacttcttcttacctacccaacttataaaatgatttgtctttgaagtaatggaggcggccagtatgtcaaatagactctgtaaatttctctctgagaaacccta

SEQ ID NO: 6115 - DNA, 104 bp, Glycine max
taacagagtttattggcattctgtccacctccacttcctactctctctctgagccacatgttcgtgaagttggaggtgggcatactgtcaactgagttctgttg

SEQ ID NO: 6116 - DNA, 110 bp, Oryza sativa
tactgagagttctttggcattctgtccacctccttgtcgaatcctcagagacagaaatctcatatctgttgatcttggaggtgggcatactgccaatggagctgtgtagg

SEQ ID NO: 6117 - DNA, 147 bp, Populus trichocarpa
tcatgtgggttttgcaaagggtttcttacagagttttttggcattctgtccacctccatctgtagaaactacaagttgttctactttctggaggtgggcatactgccaactgagctctgttggtctctctttgtaaaaccctcgtga

SEQ ID NO: 6118 - DNA, 147 bp, Populus trichocarpa
tcatgtggatttagcaaagggtttcttacagagtttattggcattctgtccacctcctatctttagaaattagaatatctctttcatatggaggtgggcatactgccaaccgagctctgttggtctctctttgtaaaaccctcgtga

SEQ ID NO: 6119 - DNA, 110 bp, Sorghum bicolor
ctttacatactgagagttccttggcattctgtccacctccttgcccatcgtcagatatatgtgttgcttttggaggtggacatactgccaatggagctgtgtaggcctct

SEQ ID NO: 6120 - DNA, 77 bp, Sorghum bicolor
cttggcattctgtccacctccttgccgatcgatcttgcagaaagtttttttttggaggtgggcatactgccaatgga

SEQ ID NO: 6121 - DNA, 120 bp, Theobroma cacao
agggcttcttacagagtttattggcattctgtccacctcccatcacagaaaatccctttcctttcccctctctttcatggaggtgggcatactgccaactgggctctgttggcttctctt

SEQ ID NO: 6122 - DNA, 125 bp, Theobroma cacao
ggccttgttgcagagccaatttggcattctgtccacctccatgaatgcttcatgcatgataccccagttcaaagtcatagatcttggaggcggccagtatgtcaaacaggctctgtaaatttctc

SEQ ID NO: 6123 - DNA, 89 bp, Vitis vinifera
cagagccattttggcattctgtccacctccatgcacatcatgggtctatattcttttggaggtggccagcatgccaaagtggctctgta

SEQ ID NO: 6124 - DNA, 102 bp, Vitis vinifera
cagagccattttggcattctgtccacctccatatataccaattcttctgaattggcgcccacaagcgtttggaggcggccaggatgccaaattggctctgta

SEQ ID NO: 6125 - DNA, 126 bp, Zea mays
ggcgcttactgaagagttccttggcattctgtccacctcctctcgccgatcttgcagaaagtttaccagttctgttgcattttttttggaggtgggcatactgccaatggagctgtgtaggcctcc

SEQ ID NO: 6126 - DNA, 122 bp, Zea mays
tggcgcttactgagagttccttggcattctgtccacctcccttcttgacgatcttgcagaaagtttgctttttttgtttgtttggaggtgggcatactgccaatggagctgcgtaggcctcc

SEQ ID NO: 6127 - DNA, 118 bp, Arachis hypogaea
gatcatgcaccactacaagttgaagctgccagcatgatcttaactttccctctcctatgatttgttggggtgagatcagatcatgtggcagtttcacctagttgttggaagcatgaat

SEQ ID NO: 6128 - DNA, 138 bp, Arabidopsis lyrata
ggtgcaccggcatctgatgaagctgccagcatgatctaattagctttctttatatctgttgttgtgtttcataacgatggttaagagatgagtctcgattagatcatgttcgcagtttcacccgttgactgtcgcacc

SEQ ID NO: 6129 - DNA, 195 bp, Arabidopsis lyrata
atctgcacaacttgttgctcaggtattttgaagacaagtccacaagggaacaagtgaagctgccagcatgatctatctttggttaagagatgaatgtgtaaacatattgcttaaacccaagctaggtcatgctctgacagcctcactccttcctggtttaggaccattcactgataaagcattccacatgccgat

SEQ ID NO: 6130 - DNA, 195 bp, Arabidopsis lyrata; identical to SEQ ID NO: 6129

SEQ ID NO: 6131 - DNA, 159 bp, Arabidopsis lyrata
cagtagcagttaagctgccagcatgatcttgtcttcctctcttaagtttcatatataatcaagttaatataaagattttgtacaattcttgttcttattatatgatcatagcttagagagagagagactaggtcatgctggtagtttcacctgctaatg

SEQ ID NO: 6132 - DNA, 327 bp, Arabidopsis lyrata
gatctatatctatgctggtttttagaggctgaagctgccagcatgatctggtaattgctacatacgacatacacacatatactagttaatttccacacctataaaagtttttttcctacaacttaaagcttttttccttcctctttttaataattagtgatctctagttctttgcctacttgtaatatatatttacggtggattcatgcatgtgtgtatatatatacatagtttacatgcatgcattttgtgtatgtgtgtgtgtatagatagtagtactaggtcatcctgcagcttcagtcactaaatcaccaacaatatcaaatc

SEQ ID NO: 6133 - DNA, 68 bp, Aquilegia coerulea
tcaagctgccagcatgatctaaaaatctctgcatgtggggattatcagatcatgctgcagtttaacct

SEQ ID NO: 6134 - DNA, 138 bp, Arabidopsis thaliana
tggtgcaccggcatctgatgaagctgccagcatgatctaattagctttctttatcctttgttgtgtttcatgacgatggttaagagatcagtctcgattagatcatgttcgcagtttcacccgttgactgtcgcaccc

SEQ ID NO: 6135 - DNA, 109 bp, Arabidopsis thaliana
gggaacaagtgaagctgccagcatgatctatctttggttaagagatgaatgtggaaacatattgcttaaacccaagctaggtcatgctctgacagcctcactccttcct

SEQ ID NO: 6136 - DNA, 160 bp, Arabidopsis thaliana
ccagtagcagttaagctgccagcatgatcttgtcttcctctcttaggtttcatatatagttaataaatattttatatatttcttgttcttacaagattatatgatcatagcttagagagagagagagactaggtcatgctggtagtttcacctgctaatg

SEQ ID NO: 6137 - DNA, 377 bp, Arabidopsis thaliana
tgttggtttttagaagctgaagctgccagcatgatctggtaatcgctacatacgacatacacacatcactaaacttctttataatttatgcacacacatacagctcttaatggccacaactcaaagttataattagtgcatgatctctagttatttgactgcttttaatatatgtttatggattcacgcatgtgtgtgtatgtacataatttacatgcatgcactttgtgtatggtacacatcaatttgaacccgttcaaaattctgtttttattagtatatatatagatgtatgtggtgtgtgtgtcagtgtgtgtgtgtgtttatagatagtagtactaggtcatcctgcagcttcagtcactaaatcaccaaca

SEQ ID NO: 6138 - DNA, 342 bp, Arabidopsis thaliana
tgaagctgccagcatgatctggtaatcgctacatacgacatacacacatcactaaacttctttataatttatgcacacacatacagctcttaatggccacaactcaaagttataattagtgcatgatctctagttatttgactgcttttaatatatgtttatggattcacgcatgtgtgtgtatgtacataatttacatgcatgcactttgtgtatggtacacatcaatttgaacccgttcaaaattctgtttttattagtatatatatagatgtatgtggtgtgtgtgtcagtgtgtgtgtgtgtttatagatagtagtactaggtcatcctgcagcttca

SEQ ID NO: 6139 - DNA, 91 bp, Brachypodium distachyon
agagaaagcgtgaagctgccagcatgatctatctgacttgtggtggcaagtgccacagcaaattcagcaacgccgtggcttcggggccggc

SEQ ID NO: 6140 - DNA, 91 bp, Brachypodium distachyon; identical to SEQ ID NO: 6139

SEQ ID NO: 6141 - DNA, 190 bp, Brachypodium distachyon
gtgctacttacttactgcccgagggaacgagtgaagctgccagcatgatctagctcagcgtgatcaagcaagattcacacatacacgtgtggtttttttgagctatagctcgattgatcttgaggtcatgccttgctaggtcatgctgcggcagcctcacttcttcccgccgtttgggcatgcacagctg

SEQ ID NO: 6142 - DNA, 159 bp, Brachypodium distachyon
ttcacttgctgtggtgcatcttctaggagctgaagctgccagcatgatctgacgagagttcctcgtctgatagcaatgtttaattctcttgtcatgactaatgatcagatcatgctgtgcagtttcatctgcttgtggatgcacaagatactgttcata

SEQ ID NO: 6143 - DNA, 204 bp, Brachypodium distachyon
tggacggctcaatttgatggtgtgagaggttgaagctgccagcatgatctgatcaccgtccaacgtaaccgaacacatgtcgatcgacttccgattgcgccggttatcttggtaggaatatatatatatgagcttccattgcaagggttcttcagatcatgttgcagcttcactctctcatcaccaccgaaagatccaaattaa

SEQ ID NO: 6144 - DNA, 132 bp, Brassica napus
ggtgtacaggcatctgatgaagctgccagcatgatctaattaactttctttctctgttgattttatgacaatggaaaagagatgagtgtcgattagatcatgttcgcagtttcacccattgactgtcgcacc

SEQ ID NO: 6145 - DNA, 124 bp, Brassica napus
ggcgcaccggcatctgatgaagctgccagcatgatctaattatctttctttctctgttgacgatggaaaagacatgagtgttgattagatcatgttcgcagtttcacccgttgactgtctcgcc

SEQ ID NO: 6146 - DNA, 134 bp, Brassica napus
ggtgcaccggcatctgatgaagctgccagcatgatctagttaactttatttctccgttgtttatccatgacaatggaaaagggataagtgtcgattagatcatgttcgtagtttcacccgttgactgtcgcatc

SEQ ID NO: 6147 - DNA, 134 bp, Brassica rapa; identical to SEQ ID NO: 6146

SEQ ID NO: 6148 - DNA, 132 bp, Brassica rapa; identical to SEQ ID NO: 6144

SEQ ID NO: 6149 - DNA, 132 bp, Brassica rapa; identical to SEQ ID NO: 6144

SEQ ID NO: 6150 - DNA, 124 bp, Brassica rapa; identical to SEQ ID NO: 6145

SEQ ID NO: 6151 - DNA, 121 bp, Citrus clementine
catattcgtgcactagtagtagttgaagctgccagcatgatctgaactttccttgacctccatctctagggaaaggccagatcatctggcagtttcacctattgatggtagcatggccaga

SEQ ID NO: 6152 - DNA, 202 bp, Citrus clementine
attcgtgcactagtagtagttgaagctgccagcatgatctgaactttccttgacctccatctctagggaaaggccagatcatctggcagtttcacctattgatggtagcatggccagaaaccctaatttcttctcctccaccagatcgttctcaacaaacccagtaggttttggcagatgaaaaaccctagaaacaggtatc

SEQ ID NO: 6153 - DNA, 96 bp, Citrus clementina
tagtagtagttgaagctgccagcatgatctgaactttccttgacctccatctctagggaaaggccagatcatctggcagtttcacctattgatggt

SEQ ID NO: 6154 - DNA, 103 bp, Citrus sinensis
gcactagtagtagttgaagctgccagcatgatctgaactttccttgacctccatctctagggaaaggccagatcatctggcagtttcacctattgatggtagc

SEQ ID NO: 6155 - DNA, 123 bp, Citrus sinensis
atcgggcaccactatcagatgaagctgccagcatgatcttaactttcctcctttgctcgaggaatgatacagatcatgcggcagtttcacctgttcgttggttgcacgaaattacgagtccag

SEQ ID NO: 6156 - DNA, 341 bp, Citrus sinensis
  misc_feature (269)..(269): n is a, c, g, or t
tttgagagattgaagctgccagcatgatctggtaatcaacctttttgtatatatatatatatattaattccttatagtttttagatttaatttcttttaattagatccatggtttcaattctattgaataaatggtggggttttatattttcgtgcaattattaagaggatagatggaatagcgcctttaaatccaatcacttttttagttttattttgatcttttttgccccctaaaattaagggtaaaggttaatatgtgagagagntttagggtgtgatttattagcttcgtagatgaatggttccatcaggtcatcttgcagcttcaattactcatt

SEQ ID NO: 6157 - DNA, 121 bp, Citrus trifoliata; identical to SEQ ID NO: 6151

SEQ ID NO: 6158 - DNA, 105 bp, Gossypium hirsutum
gggaaaaagtgaagctgccagcatgatctatcttccgttagtaagatgcggatgctatattgctaaccctagctaggtcatgctgcgacagcctcactccttcct

SEQ ID NO: 6159 - DNA, 119 bp, Glycine max
gaagttcgcaaaggaaaaagtgaagctgccagcatgatctacctttggttagagagctcaagagtgctaaccctgactaggtcatgctgtgacagcctcactccttcctatttggggac

SEQ ID NO: 6160 - DNA, 121 bp, Glycine max
aagggtcacaaaggaaaaagtgaagctgccagcatgatctagctttggttagtgggagcgagagagtgctaaccctcactaggtcatgctgtgctagcctcactccttcctatttggagac

SEQ ID NO: 6161 - DNA, 375 bp, Glycine max
tttgagaggttgaagctgccagcatgatctggtaaatcacatacttttttttttctcacctctcatgcctaatttttaagcaccagtcattagagaaaataatggtgaaaaatccatctattcaattttttttttcaaattcaaggtttccagtatgtatcactaatggtgaaaaaagtgatggaattttgtagaacatgggttaaatttactttttttttttttgagttttcattttcttcaagtttctgagccaagaaataaaagagacttataaattggaattaatacttaaaggaaacccaccagaagggcaatttggttatcataagatgtggtttccatcaggtcatcttgcagcttcaatcactcaat

SEQ ID NO: 6162 - DNA, 121 bp, Glycine max
aagggtcacaagggaaaaagtgaagctgccagcatgatctagctttggttagtgggagccagagagtgctaaccctcactaggtcatgctgtgctagcctcactccttcctatttggagac

SEQ ID NO: 6163 - DNA, 109 bp, Glycine max
tcatgcaccactaccagttgaagctgccagcatgatcttaacttccctcacttgccgtggaaagatcagatcatgtggcagtttcacctagtagttgctggccgcatga

SEQ ID NO: 6164 - DNA, 109 bp, Glycine max
tcatgcaccactaccagttgaagctgccagcatgatcttaacttccctcacttgctgtggaaagatcagatcatgtggcagtttcacctagtagttgttggccgcatga

SEQ ID NO: 6165 - DNA, 78 bp, Glycine max
cagcagttgaagctgccagcatgatctgagtttaccttctattggtaagaacagatcatgtggctgcttcacctgttg

SEQ ID NO: 6166 - DNA, 64 bp, Glycine max
tgaagctgccagcatgatctgagtttaccttctattggtaagaacagatcatgtggctgcttca

SEQ ID NO: 6167 - DNA, 109 bp, Glycine max
caagatgttgttgttggtaccctctcacaggatttgcttcaatgaaaggggttcatcactcttttcatcacatgttggtttgagaggttgaagctgccagcatgatctg

SEQ ID NO: 6168 - DNA, 80 bp, Glycine soja
gcagcagttgaagctgccagcatgatctgagtttaccttctattggtaagaacagatcatgtggctgcttcacctgttga

SEQ ID NO: 6169 - DNA, 271 bp, Ipomoea nil
tgaagctgccagcatgatctggtaagatagaacaaaatcttgggttttctttttcccactttttcttttatggggttttcatctttctgcagaaatagaattcactgtaccaaaagaacacatctttggggtttttttctgttcttcattctccccccttctgtttcaattcttttttttggttggttggtatgggttctgtacatagtttaaagattggagagtgaattatgcctaaagtagacagatctcttgtgcgcaccggtattta

SEQ ID NO: 6170 - DNA, 108 bp, Lotus japonicus
gttcgtgcacctgcaatagttgaagctgccagcatgatctgagcttaccttcttgtaataatggtaagaacagatcatatggcagcttcacctgttgaatggaagcat

SEQ ID NO: 6171 - DNA, 320 bp, Medicago truncatula
aaaagtgaagctgccagcatgatctaggtttggttatacaatagtagtattgagaaggaactatatacgttttttttttactataccacaaaaaaagattactctctttcacaaaataggtattaaagtgccatgatttttgcattactaatgggaaaataaattttggacaccgaatttctcactttttttttatatagataggaaataggttttggtggtatttttttgtggtacagtaaaaaatagccgctatatccatacaagtagtactgctagcataaccctgactaggtcatgctgtgctagcctcactcctt

SEQ ID NO: 6172 - DNA, 141 bp, Oryza sativa
tagtgtgaatgagtgaagctgccagcatgatctagctctgattaatcggcactgttggcgtacagtcgattgactaatcgtcagatctgtgtgtgtaaatcactgttagatcatgcatgacagcctcatttcttcacactg

SEQ ID NO: 6173 - DNA, 141 bp, Oryza sativa; identical to SEQ ID NO: 6172

SEQ ID NO: 6174 - DNA, 163 bp, Oryza sativa
gtgcccaagagaaagcgtgaagctgccagcatgatctaacttgcagacaagaaatcagctcagctcgctggtttcgaacaggaaggcggctagctgaggcttcttctgagtacgtgatggttagatcatgctgtgacagtttcactccttccctgttgggcac

SEQ ID NO: 6175 - DNA, 163 bp, Oryza sativa
tgtccaagggaacgagtgaagctgccagcatgatctagctctgaatgatcaacaagatgtgctcccacactgccttcctgtggatcttgagctgttgctagtcttgtggtcatgccttgctaggtcatgctgcggcagcctcacttcttcccattgttgggca

SEQ ID NO: 6176 - DNA, 110 bp, Oryza sativa
cattaggagctgaagctgccagcatgatctgatgagtgcttattaggtgagggcagaattgactgccaaaacaaagatcagatcatgctgtgcagtttcatctgcttgtg

SEQ ID NO: 6177 - DNA, 273 bp, Oryza sativa
tgtgagagaatgaagctgccagcatgatctggttgtcaggcatgagccaaatctatccatggtgttggtggtactgaaattaccgcgttttcgaggtttttcgtcgtgtcaacttgcgaagggaattacgggttcttgatgagcattggtgataggaggtgtgggcttggttagtagaggtagaattatgattgttcttgtgagtttcagtaagaggtgggagtgattggaatttggctccatcagatcatgttgcagcttcactctctcacc

SEQ ID NO: 6178 - DNA, 113 bp, Oryza sativa
cacaagtggatgaagctgccagcatgatctgatcacagtagttctctagctgatgatgatttacaaaacctagagacatgcatcagatcatctggcagtttcatcttctcatg

SEQ ID NO: 6179 - DNA, 82 bp, Oryza sativa
cataagcaggtgaagctgccagcatgatctgaaagcatctcaaaccagcgatcagatcatccggcagcttcatcttctcatg

SEQ ID NO: 6180 - DNA, 120 bp, Oryza sativa
cacaagttggtgaagctgccagcatgatctgatgatgatgatgatccacctctctcatctgtgttcttgattaattacggatcaatcgatcaggtcatgctgtagtttcatctgctggtt

SEQ ID NO: 6181 - DNA, 201 bp, Oryza sativa
tgtgagaggctgaagctgccagcatgatctggtccatgagttgcactgctgaatatattgaattcagccaggagctgctactgcagttctgatctcgatctgcattcgttgttctgagctatgtatggatttgatcggtttgaaggcatccatgtctttaatttcatcgatcagatcatgttgcagcttcactctctcact

SEQ ID NO: 6182 - DNA, 160 bp, Oryza sativa
ttgtgatgtgtgcaccttaagcagctgaagctgccagcatgatctgatcttttgcgatctctttttttatctgaataagttgatggaaatattgggttcctaagattcagatcgtgctgcgcagtttcatctgctaatcgatgcactacactgtgaattt

SEQ ID NO: 6183 - DNA, 100 bp, Oryza sativa
tgaagctgccagcatgatctgatgatgatgatgatccacctctctcatctgtgttcttgattaattacggatcaatcgatcaggtcatgctgtagtttca

SEQ ID NO: 6184 - DNA, 90 bp, Oryza sativa
tgaagctgccagcatgatctgatgagtgcttattaggtgagggcagaattgactgccaaaacaaagatcagatcatgctgtgcagtttca

SEQ ID NO: 6185 - DNA, 69 bp, Phaseolus coccineus
tgaagctgccagcatgatcttaacttccctcacttggttgaggagagatcagatcatgtggcagtttca

SEQ ID NO: 6186 - DNA, 108 bp, Populus tremula x Populus tremuloides
agggaaaaggtgaagctgccagcatgatctatctttggttagagaagtatagaagcgaagaactaaccctagctaggtcatgctctgacagcctcactccttcctgtt

SEQ ID NO: 6187 - DNA, 431 bp, Populus tremula x Populus tremuloides
  misc_feature (327)..(327): n is a, c, g, or t
  misc_feature (355)..(355): n is a, c, g, or t
tttgagaggttgaagctgccagcatgatctggtaatgaacgtgttactctcatttatatatatattaacattaatcttatagcagtatctgtaggtagaaaaaatttaatgttgtcaaagatatatactgaatcgtggttgctaggtttgtattactagtttaggatgcatgtttttgatcttatgatgatcaattgcttgtgagttcctaggcaatgaaaacagaatatatactggtgatttttcccagtaaaattgtcgagaaaagggaattgcactaatagggaagacgcataggtaaacttgtatctaaatggtatatgtatnttccaggcaaaagggtagaaacctaatnagaaactagcttgaactcagagctataaaagtatatggttccatcaggtcatctagcagcttcaatcactcactca

SEQ ID NO: 6188 - DNA, 82 bp, Physcomitrella patens
accaaaagttggaagctgccagcatgatcctttaacttttctagagggaaagatcagatcatctggctgctttcatcctgtt

SEQ ID NO: 6189 - DNA, 89 bp, Populus trichocarpa
cactagcagttgaagctgccagcatgatctaacttccttgcttctttatcaaggatggatttagatcatgtggtggtttcacctgttga

SEQ ID NO: 6190 - DNA, 96 bp, Populus trichocarpa
agggaaaaagtgaagctgccagcatgatctatctttggttagagaaagaaaggactaaccctagctaggtcatgctgtgacagcctcactccttcc

SEQ ID NO: 6191 - DNA, 89 bp, Populus trichocarpa
cactagcagttgaagctgccagcatgatctaaattaacctccttctttatcaaggatggattagatcatgtggtagtttcacctgctga

SEQ ID NO: 6192 - DNA, 105 bp, Populus trichocarpa
agggaaaaggtgaagctgccagcatgatctatctttggttagagaaggatagaagcgaaagaactaaccctagctaggtcatgctctgacagcctcactccttcc

SEQ ID NO: 6193 - DNA, 91 bp, Populus trichocarpa
cactagtagttgaagctgccagcatgatctgaactttccttaattttcctatacgggaaagactagatcatgtggtagtttcatctattga

SEQ ID NO: 6194 - DNA, 87 bp, Populus trichocarpa
ctctatcagttgaagctgccagcatgatcttagccttcctcctttgttgaggaaagaaacagatcatgtggcagtttcacctgttgt

SEQ ID NO: 6195 - DNA, 86 bp, Populus trichocarpa
cactatcagttgaagctgccagcatgatcttaacctccctcctttgtcgaggaaagaacagatcatgtggcagtttcacctgaagt

SEQ ID NO: 6196 - DNA, 91 bp, Populus trichocarpa
cgctattagttgaagctgccaacatgatctgagctttccttaattttcctatacaggaaagactagatcatgtggcagtttcacctattga

SEQ ID NO: 6197 - DNA, 409 bp, Populus tremuloides
  misc_feature (317)..(317): n is a, c, g, or t
  misc_feature (345)..(345): n is a, c, g, or t
tgaagctgccagcatgatctggtaatgaacgtgttactctcatttatatatatattaacattaatcttatagcagtatctgtaggtagaaaaaatttaatgttgtcaaagatatatactgaatcgtggttgctaggtttgtattactagtttaggatgcatgtttttgatcttatgatgatcaattgcttgtgagttcctaggcaatgaaaacagaatatatactggtgatttttcccagtaaaattgtcgagaaaagggaattgcactaatagggaagacgcataggtaaacttgtatctaaatggtatatgtatnttccaggcaaaagggtagaaacctaatnagaaactagcttgaactcagagctataaaagtatatggttccatcaggtcatctagcagcttca

SEQ ID NO: 6198 - DNA, 130 bp, Ricinus communis
aaaggtgaagctgccagcatgatctagctttggttagtgagacagctgaaagaaagatacagataacacatggtatctaagcaatagtgctaaccctagctaggtcatgctctgacagcctcactccttc

SEQ ID NO: 6199 - DNA, 80 bp, Ricinus communis
tcagttgaagctgccagcatgatctaaatcttcctccctcgttgaggagagatcagatcatgtggcagtttcacccgttg

SEQ ID NO: 6200 - DNA, 76 bp, Ricinus communis
atagttgaagctgccagcatgatctggagcttttctatccaggagagactagatcatgtggcagtttcacctgttg

SEQ ID NO: 6201 - DNA, 96 bp, Sorghum bicolor
tgaagctgccagcatgatctagctctgagtgatcacccgagaagaacaatagttcgaggtggtctcgccttgctaggtcatgctgcggcagcctca

SEQ ID NO: 6202 - DNA, 198 bp, Sorghum bicolor
tgaagctgccagcatgatctaacaacggcattgctcctccgtgtagcgccctgtgcttgcttttgcttgtctccatggagaagacagcggcaaagcttagctttgcttcgcttagcttgctggcttttcgtatgggctggcggcgggttgctgcgtgaagcttgcaagtgatggttagatcatgctgtgacagtttca

SEQ ID NO: 6203 - DNA, 131 bp, Sorghum bicolor
ctttgctggtgtgagaggttgaagctgccagcatgatctggtggccggccggccggcgtctctcaagtgcgctcggatcggagacgcgtcgccagatcatgttgcagcttcactctctcgcaaccaccaaa

SEQ ID NO: 6204 - DNA, 148 bp, Sorghum bicolor
gtggtgcatcctctagtagctgaagctgccagcatgatctgatgaggtgaggtttatttgctagttggtcacaggctaacagcatgatggcccaacaaatcaacgatcagatcatgctgtgcagtttcatctgctcgtggatgcacat

SEQ ID NO: 6205 - DNA, 179 bp, Sorghum bicolor
agtggtgcaccacaagttggtgaagctgccagcatgatctgatgtctttatatatattaattacctctgatttctccctgactgttatggatcgatgaattcagatatgaggggaaggaagaaagaggaataatgagcatcaggtcatgctgtagtttcatccgctggtgggagcacat

SEQ ID NO: 6206 - DNA, 179 bp, Sorghum bicolor
tccggtgcactagaggtggatgaagctgccagcatgatctgagaaactagtgcttgatccttttactgatttccatctagcctgcatctatatatataccttgatgcatgaatcatggtctgatgatagttaagcgagatcagatcgtctggcagtttcatcttcttatggcagcacaa

SEQ ID NO: 6207 - DNA, 123 bp, Sorghum bicolor
atttgtgcaccttaagcagctgaagctgccagcatgatctgatcttaatttcttttactggcaaacttcggatgcctaagatcagatcgtgctgcgcagtttcacctgctaattggagcacag

SEQ ID NO: 6208 - DNA, 90 bp, Sorghum bicolor
tgaagctgccagcatgatctgaaagcatacgagtccttcgttatcatctgatgaaagaaatagatgatcagatcatctggcagtttcatt

SEQ ID NO: 6209 - DNA, 132 bp, Sorghum bicolor
agtgaagctgccagcatgatctagctttggttggcaccattggcaggcgcccacacagtggcctcttccgtgtgtgtagtgccgctctgtacctgcaaatcattgttagatcatgcatgacagcctcatttc

SEQ ID NO: 6210 - DNA, 116 bp, Solanum lycopersicum
tcgtgcagcactagcagttgaagctgccagcatgatctaaactttccttttagttcaaatataattcgaggaaagatcagatcatgtggcagccttacctgtcaatgccatcacga

SEQ ID NO: 6211 - DNA, 188 bp, Saccharum officinarum
agtggtgcaccacaagttggtgaagctgccagcatgatctgatggtggtatatatgaatatatgatgtctttacctctgatctctccctgactgtcaccgatccatgaatccaggatgaggggagggaagaaagagggataatgagcatcaggtcatgctgtagtttcatctgctggtgggagcacat

SEQ ID NO: 6212 - DNA, 188 bp, Saccharum officinarum
agtggtgcaccacaagttggtgaagctgccagcatgatctgatggtggtatatatgaatatatgatgtctttacctctgatctctccctgactgtcacggatccatgaatccaggatgaggggagggaagaaagagggataatgagcatcaggtcatgctgtagtttcatctgctggtgggagcacat

SEQ ID NO: 6213 - DNA, 139 bp, Saccharum spp
tgaagctgccagcatgatctgatggtggtatatatgaatatatgatgtctttacctctgatctctccctgactgtcacggatcgatgaatccaggatgaggggagggaataatgagcatcaggtcatgctgtagtttca

SEQ ID NO: 6214 - DNA, 143 bp, Saccharum spp
ggtgaagctgccagcatgatctgatggtggtatatatgaatatatgatgtctttacctctgatctctccctgactgtcacggatcgatgaatccaggatgaggggagggaataatgagcatcaggtcatgctgtagtttcatc

SEQ ID NO: 6215 - DNA, 108 bp, Triticum aestivum
ctgcccaagggaacgagtgaagctgccagcatgatctagctccgagtgatcaaacaagaaacgctgcggcagcctcacttcttcccgccgttgggcacaactacttct

SEQ ID NO: 6216 - DNA, 90 bp, Triticum aestivum
ctgcccaagggaacgagtgaagctgacagcatgatctatctccgagtgatcaaacaagaaacgctgcggcagcctcacttcttcccggcg

SEQ ID NO: 6217 - DNA, 111 bp, Theobroma cacao
gccgtgcacccactagcagttgaagctgccagcatgatctaaacttccttctctgtcgagaggatagattggatcatgtggtagcttcacctgttgttgggatcacgaaga

SEQ ID NO: 6218 - DNA, 138 bp, Theobroma cacao
gaattctgcagtggaaaaagtgaagctgccagcatgatctatctttggttagtgagtgaaagggggtgctaaggctatgttgctaaccctagctaggtcatgctctgacagcctcactccttcctacttggggaccca

SEQ ID NO: 6219 - DNA, 112 bp, Theobroma cacao
tatggtgctccaccatcagttgaagctgccagcatgatcttaattttccttctttttatcaaggaaagatcagatcatatggcagtttcacctgttgctgcttgcacaatcc

SEQ ID NO: 6220 - DNA, 351 bp, Vitis vinifera
tttgagaggttgaagctgccagcatgatctggtgaaacaaacaccatctctttcttctctaaccccatgtctggattcgtccaccgatccattattatagaccaggccgcccgtttcccatgtagtgatcgataattaggctcggggttttcactttttagtgggatctaatccttaggatggatgtttgtatgggtggtatatatcatggtgaggtctgttttctattttaattctaacggggttttgatttagctgagggggtataattcatagcctaattccaaaacctaactccatagagatagggttccatgatcaggtcatcttgcagcttcaatcactcactca

SEQ ID NO: 6221 - DNA, 99 bp, Vitis vinifera
caatagcagttgaagctgccagcatgatctaagcttttctgttgcccaccctttctccaggaaagactagatcatgtggcagtttcacctgttgatgga

SEQ ID NO: 6222 - DNA, 91 bp, Vitis vinifera
cagtagcagttgaagctgccagcatgatctcaacttccctatacaagtcaaggaaagatcagatcatgtggtagcctcacctgttgatggg

SEQ ID NO: 6223 - DNA, 115 bp, Vitis vinifera
agggaataagtgaagctgccagcatgatctagctttggctagggatacagagaaagagagagatcagagctaaccctagctaggtcatgccctgacagcctcactccttccttct

SEQ ID NO: 6224 - DNA, 90 bp, Vitis vinifera
cactatcagttgaagctgccagcatgatctaaacttgcttccctttgtgaacagagatcagatcatgtggcagtttcacctgttgttggt

SEQ ID NO: 6225 - DNA, 190 bp, Zea mays
tgctcttgcgaatgagtgaagctgccagcatgatctagctctgatttggttggcaccatattagcaggcgtccacgcacagctagactagagtggcctcgcgcgctctcgtctggtctgtgtctcgctttgtgcctgcaaatcgttgttagatcatgcatgacagcctcattccttcacaattctggggc

SEQ ID NO: 6226 - DNA, 127 bp, Zea mays
agtgcccaagataaagggtgaagctgccagcatgatctaacgacggcattgctctgctgctgcagtgaggcttgcgagtgatggttagatcatgctgtgacagtttcactctttccctttgggcaca

SEQ ID NO: 6227 - DNA, 127 bp, Zea mays; identical to SEQ ID NO: 6226

SEQ ID NO: 6228 - DNA, 132 bp, Zea mays
tgcccaagggaacgagtgaagctgccagcatgatctagctcggagtgatcacgcgaggagaacaatagctcgaggtggtcatgccttgctagatcatgctgtggcagcctcacttcttcccgtccttgggca

SEQ ID NO: 6229 - DNA, 133 bp, Zea mays
tgcccaagggaacgagtgaagctgccagcatgatctagctctgagtgatcacccgaaaaagaacaatagttctaggtggtcatgccttgctaggtcatgctgctgcagcctcacttcttcccgtcgttgggca

SEQ ID NO: 6230 - DNA, 119 bp, Zea mays
ttggtgtgtcctctagtagctgaagctgccagcatgatctgaggtgtccacagcatatatatggaagcagctagcgatcagatcatgctgtgcagtttcatctgctcgtggacgcacac

SEQ ID NO: 6231 - DNA, 119 bp, Zea mays
cgtgcaccttattaagcagctgaagctgccagcatgatctgatctttcgtttactggcaactttggatacctaagatccagatcgtgctgcgcagtttcacctgctaattggagcacag

SEQ ID NO: 6232 - DNA, 243 bp, Zea mays
agtggtgcaccacgagttggtgaagctgccagcatgatctggttatgatggtggtggtatatgtaagatggatgtaatctatactactaccggcccctgtcactctctctctctcccccgtccctgactgtcatatatggatcgacgaatccaagatgagaggggaagggagagagagagagggtaattaatgagcaccaggaccaggtcatgctgtagtttcatctgctggtggccgcacat

SEQ ID NO: 6233 - DNA, 143 bp, Zea mays
actttgctgctgtgagaggttgaagctgccagcatgatctggctgctcagacgccggcgggcgtctcgagtgctcgctcgatcgtcggtgacgcttggattcaccagatcatgttgcagcttcactctctcgcagccagcaaa

SEQ ID NO: 6234 - DNA, 130 bp, Zea mays
acttcgctggtgtgagagcttgaagctgccagcatgatctggctrctcaaacgccgccggcctcccaagtgctcgatcggtggcgcttcaccagatcatgttgcagcttcactctctcgcaaccagcgaa

SEQ ID NO: 6235 - DNA, 109 bp, Zea mays
atgaagctgccagcatgatctgaaaccatacgtgttctttgattcccatctgaagaaagagttggctttcatggagaaccgacggtcagatcatgtggcagtttcattt

SEQ ID NO: 6236 - DNA, 91 bp, Zea mays
tgaagctgccagcatgatctggctgctcaaacgccgccggcctcccaagtgctcgatcggtggcgcttcaccagatcatgttgcagcttca

SEQ ID NO: 6237 - DNA, 80 bp, Zea mays
tgaagctgccagcatgatctgatctttcgtttactggcaactttggatacctaagatccagatcgtgctgcgcagtttca

SEQ ID NO: 6238 - DNA, 80 bp, Zea mays
tgaagctgccagcatgatctgaggtgtccacagcatatatatggaagcagctagcgatcagatcatgctgtgcagtttca

SEQ ID NO: 6239 - DNA, 221 bp, Zea mays
gagtttgcagatctcagtttggtagcttcttctattccactggccatcacttgctttgatttcttccgtttcttataggttgtacaactttctgttctttggatctgagattgaataatcactcatctacacctagtcatggtattttatgcaacatgttctagctagcctggaactgcctgctcaagggaacgagtgaagctgccagcatgatctagctc

SEQ ID NO: 6240 - DNA, 160 bp, Zea mays
gagtgaagctgccagcatgatctagctctgatttggttggcaccatattagcaggcgtccacgcacagctagactagagtggcctcgcgcgctctcgtctggtctgtgtctcgctttgtgcctgcaaatcgttgttagatcatgcatgacagcctcattc

SEQ ID NO: 6241 - DNA, 103 bp, Zea mays
gagtgaagctgccagcatgatctagctctgagtgatcacccgaaaaagaacaatagttctaggtggtcatgccttgctaggtcatgctgctgcagcctcactt

SEQ ID NO: 6242 - DNA, 102 bp, Zea mays
gagtgaagctgccagcatgatctagctcggagtgatcacgcgaggagaacaatagctcgaggtggtcatgccttgctagatcatgctgtggcagcctcactt

SEQ ID NO: 6243 - DNA, 102 bp, Zea mays
aaagggtgaagctgccagcatgatctaacgacggcattgctctgctgctgcagtgaggcttgcgagtgatggttagatcatgctgtgacagtttcactcttt

SEQ ID NO: 6244 - DNA, 99 bp, Zea mays
gagtgaagctgccagcatgatctagctcggagtgatcacgcgaggagacatagctcgaggtggtcatgccttgctagatcatgctgtggcagctcactt

SEQ ID NO: 6245 - DNA, 92 bp, Zea mays
gtgaagctgccagcatgatctaacgacggcattgctctgctgctgcagtgaggcttgcgagtgatggttagatcatgctgtgacagtttcac

SEQ ID NO: 6246 - DNA, 129 bp, Medicago truncatula; identical to SEQ ID NO: 186

SEQ ID NO: 6247 - DNA, 148 bp, Phaseolus vulgaris; identical to SEQ ID NO: 2089

SEQ ID NO: 6248 - DNA, 228 bp, Arabidopsis lyrata; identical to SEQ ID NO: 5170

SEQ ID NO: 6249 - DNA, 184 bp, Arabidopsis lyrata; identical to SEQ ID NO: 5171

SEQ ID NO: 6250 - DNA, 140 bp, Arabidopsis thaliana
tagttggaagaagagtgagagtcgctggaggcagcggttcatcgatctcttcctgtgaacacattaaaaatgtaaaagcatgaatagatcgataaacctctgcatccagcgtttgcctcttgtatctttcttattgactt

SEQ ID NO: 6251 - DNA, 111 bp, Arabidopsis thaliana
gagtgaagtcgctggaggcagcggttcatcgatcaattcctgtgaatatttatttttgtttacaaaagcaagaatcgatcgataaacctctgcatccagcgctgcttgctc

SEQ ID NO: 6252 - DNA, 133 bp, Brachypodium distachyon
gcctgggcgcagtggtttatcgatcctttccctgccttgtgctactgatcctgggccgggcggcgattggatactttttttcttcttgtcacagcttatgcgggaatcgatcgataaacctctgcatccggtt

SEQ ID NO: 6253 - DNA, 109 bp, Carica papaya
agggtaaagtcactggaggcagcggttcatcgatctcttcctgggaatttggtgtgaaaaatcacagaacatgaatcgatcgataaacctctgcatccagcgttacccc

SEQ ID NO: 6254 - DNA, 201 bp, Citrus sinensis; identical to SEQ ID NO: 241

SEQ ID NO: 6255 - DNA, 201 bp, Citrus sinensis; identical to SEQ ID NO: 241

SEQ ID NO: 6256 - DNA, 148 bp, Gossypium hirsutum
tttttagcgttggggtaaagacactggaggcagcggttcatcgatctcttcctgagaattttgttgtgagaataacacaaatacatgaatcgatcgataaacctctgcatccagcgccttaactctccatgaagttttatgttagtta

SEQ ID NO: 6257 - DNA, 102 bp, Glycine max
gtgaagtcactggatgcagcggttcatcgatctcttcctgaatcgttgtttaacatcagaaccatgaatcgatcgataaacctctgcatccagcgctcactc

SEQ ID NO: 6258 - DNA, 102 bp, Glycine max; identical to SEQ ID NO: 6257

SEQ ID NO: 6259 - DNA, 367 bp, Glycine max
tcgataaacctctgcatccagcgctcactttgcctctctttaccagcaatttctttttctctttcttctaaataataacactgtttttattcttcctcttgctttcatatggaaaaattagttagcgttgacgaattctctgtatcagcatttctcttaaaagtatttttcttcttcttcttggtagcgagttattaaatctagatgcctctggtgtggtttgaaataattttatattacttcgtttgcgctttcttccgagataatgcctatagtgttacagctgctaatgttccgatttgtgttgattttgctatgaaaggagggagaaaataaatctaatatctgcttgcattattgtttgttg

SEQ ID NO: 6260 - DNA, 80 bp, Lupinus luteus
ctggaagcagcggtttatcgatctcttcctgaatttgattaacacaaaccatgaatcgatcgataaacctctgcatccag

SEQ ID NO: 6261 - DNA, 89 bp, Lactuca sativa
tcgataaacctctgcatccagcgctcaccaccactccctgttccgtttctgtttactgtatgtgtgtgttactgtgtgtggatattcga

SEQ ID NO: 6262 - DNA, 88 bp, Malus x domestica
ctggaggcatcggttcatcgatctgtttatgagattttgttgtgagtaaacacagttcatgaatcggtcgataaacctttgcatccag

SEQ ID NO: 6263 - DNA, 124 bp, Medicago truncatula
agatgaggtgaagttcgtcactggatgcagcggttcatcgatctgttcctgaattttgtttgtctcgtaaaacaaacatgaatcggtcgataaacctctgcatccagcgctcactttcccctct

SEQ ID NO: 6264 - DNA, 85 bp, Medicago truncatula
tggatgcagcggttcatcgatctgttcctgaattttgtttgtctcgtaaaacaaacatgaatcggtcgataaacctctgcatcca

SEQ ID NO: 6265 - DNA, 86 bp, Medicago truncatula
tggatgcagaggtttatcgaccgattcatgtttgttttacgagacaaacaaaattcaggaacagatcgatgaaccgctgcatccag

SEQ ID NO: 6266 - DNA, 87 bp, Medicago truncatula
ctggatgcagcggttcatcgatctgttcctgaattttgtttgtctcgtaaaacaaacatgaatcggtcgataaacctctgcatccag

SEQ ID NO: 6267 - DNA, 134 bp, Oryza sativa
tgggtgatgcctgggcgcagtggtttatcgatctcttccctgccttgtgctgctccgatcgatgcccgtgctgattcttgataatatacaacgcaggaatcgatcgataagcctctgcatccagatctcacttt

SEQ ID NO: 6268 - DNA, 114 bp, Oryza sativa
ctgggcgcagtggtttatcgatctcttccctgccttgtgctgctccgatcgatgcccgtgctgattcttgataatatacaacgcaggaatcgatcgataagcctctgcatccag

SEQ ID NO: 6269 - DNA, 107 bp, Populus trichocarpa
tgggaagacactggaggcagcggttcatcgatctcttcctggccaattttttgtttagcacgaaaaacatgaaccgatcgataaacctctgcatccagcgcttcctt

SEQ ID NO: 6270 - DNA, 107 bp, Populus trichocarpa
tgagaagacactggaggcagcggttcatcgatcttttcctgaagatttttttgttttacacgaacaacacgaaccgatcgataaacctctgcatccagtgcttccct

SEQ ID NO: 6271 - DNA, 107 bp, Populus trichocarpa; identical to SEQ ID NO: 6270

SEQ ID NO: 6272 - DNA, 101 bp, Ricinus communis
tcactggaggcagcggttcatcgatctcttcctggaagattttgttgtgaaacaaaaataaaacgcatgaatcgatcgataaacctctgcatccagcgctt

SEQ ID NO: 6273 - DNA, 127 bp, Sorghum bicolor
gggcgcagtggtttatcgatctcttccttgccttgtgctagtccagaagtagtggtggttcaagcgtttattgctgcaataacttgcaaaacaacgcgggaatcgatcgataaacctctgcatccag

SEQ ID NO: 6274 - DNA, 99 bp, Solanum lycopersicum
caggaggcagcggtaccattgatccgttccctggaagctgaatatatatatacgcaacattacagcaaaaggaatcggtcgataaacctctgcatccag

SEQ ID NO: 6275 - DNA, 131 bp, Theobroma cacao
aggaaaaagggttaaagacactggaggcagcggttcatcgatctcttcctgggaattttgttgtgagaataacacaaatacatgattcgatcgataaacctctgcatccagagccttacctctctctttaa

SEQ ID NO: 6276 - DNA, 103 bp, Vitis vinifera
tgaagtcactggatgcagcggttcatcgatctcttcctgaaattgttgtgaaaaaagcagatcaagaatcggtcgataaacctctgcatccagcgttcactcc

SEQ ID NO: 6277 - DNA, 130 bp, Zea mays; identical to SEQ ID NO: 5172

SEQ ID NO: 6278 - DNA, 130 bp, Zea mays; identical to SEQ ID NO: 5172

SEQ ID NO: 6279 - DNA, 85 bp, Gossypium hirsutum
ggaagtgggatgggtggaaagatttgtattttctctcttgagtttctaagaatgtaaagcaaatctttcctactcctcccatacc

SEQ ID NO: 6280 - DNA, 106 bp, Gossypium hirsutum
ccttctcctcccattcaaagtggaggaaatgcccctggctatactggtgggagtgctggttttggaagtgccgatgacaactatggtttgggtgggggaggatatg

SEQ ID NO: 6281 - DNA, 276 bp, Brassica napus
gtttcaggcagtctccttggctatcttgacatgcttttttcttccatgttataccttctttctttgtatttttcgaatccaaataatatttttttctataaatttactacgaaaatcctttaaacaatctctaacaaagtatgttattagaaaactaccactttttgcatttattacaaatgcatgtacgtggtgagtgtatgcattctttagaaggaaatgtcaaaggtgaatagaagatcatatttggtagccaaggatgacttgcctatttct

SEQ ID NO: 6282 - DNA, 125 bp, Sorghum bicolor
tggcgagagcctgcctttggtagccaaggatgacttgcctacatggcattgcgagttccggttgcatggccagttcagctgagtttgtgggcggtcaccttgggacggtatcgataagcttgata

SEQ ID NO: 6283 - DNA, 240 bp, Sorghum bicolor
  misc_feature (205)..(205): n is a, c, g, or t
agagtggttggtagctctggtagccaaggatgacttgcctgtgtgccggcctcgatcgatctcccggccctctcaaggatcgatcatcgtgcgtgcgtgtcgatcgatcgtcgtcgtcgtcgtcacctctggcagagagcgagacgatgatcgatcgattagccgcgcgccttgggttgttggggtgtggtcgcggtctcacagncagtctccttggctagccctgactcactcttatca

SEQ ID NO: 6284 - DNA, 155 bp, Sorghum bicolor
gcgataagagtctgcccagatagccaaggatgacttgcctgtggcctcttggcttggcttgagagcttattaactctgtgcacgtttaatttggctcttcttggggcctcgatcacagggcagtctcccttggctagtccggggcgggctcctta

SEQ ID NO: 6285 - DNA, 97 bp, Sorghum bicolor
gctagccaaggagactgcctatgaaccatctatctcaaaggctcacatttctgatccttcggcacaaaggacacaggcaagtcatccttggctatca

SEQ ID NO: 6286 - DNA, 89 bp, Zea mays
tagccaaggatgacttgcctatgtcctttgtttacaaaggacctgaatgtgtggaccattgagaggttcataggcagtctccttggcta

SEQ ID NO: 6287 - DNA, 191 bp, Zea mays
gtagccaaggatgacttgccggccgacatatgcctctctcgttcgtccctgaccggccgggaaacacatcacgccgcatgcatgcatgcatgcatatgtgtgtacgtactacgtgtgcatgcatgcatgtgctgccgcgcgcagcaaactgcgaggaatcgtccgtccggcaggttcttctctttggctac

SEQ ID NO: 6288 - DNA, 145 bp, Zea mays
cccggcagctcgatcgtgtgctagctcatcagcttacacttagcaagcaaatgaagcatgcagttctcgccatgagtataaattatcatctgaggccttgcatgtggggatgaggctgttatgtagccaaggatgacttgccggg

SEQ ID NO: 6289 - DNA, 131 bp, Zea mays
tgtagccaaggatgacttgccggccgatgcctcctcgatatacaatcgtcgcacatccctgggcggccgggaacgtcgcatgcatgcaaactgttggggcatcggccggcaggttcttctctttggctaca

SEQ ID NO: 6290 - DNA, 69 bp, Zea mays
cgcgtagccaaggatgacttgccggcattatatttcttggcccgccggcaagtcatctggggctacgcg

SEQ ID NO: 6291 - DNA, 85 bp, Gossypium hirsutum; identical to SEQ ID NO: 6279

SEQ ID NO: 6292 - DNA, 106 bp, Gossypium hirsutum; identical to SEQ ID NO: 6280

SEQ ID NO: 6293 - DNA, 96 bp, Medicago truncatula
ggggaatgttggctggctcgaggcttttcagtttcacaaaggaagttcagtcttaattgtatgaactataaggcttcggaccaggcttcattcccc

SEQ ID NO: 6294 - DNA, 171 bp, Medicago truncatula
ttggaatgaggtttgttccaagatcatcacacatcatgtttcttcttccctttcaataattcttgattaatttatgttcatacatctatatatatatctatatatattatcaagtcattacatgcatgggatgagatattgagagtgatctcggaccaggcttcattcctc

SEQ ID NO: 6295 - DNA, 97 bp, Medicago truncatula
ggggaatgttgtctggctcgaggactctttcttctcgatctaatgcaaatttgtggtcatggattgtaaagtattctcggaccaggcttcattcccc

SEQ ID NO: 6296 - DNA, 116 bp, Zea mays; identical to SEQ ID NO: 5743

SEQ ID NO: 6297 - DNA, 126 bp, Zea mays; identical to SEQ ID NO: 5748

SEQ ID NO: 6298 - DNA, 96 bp, Zea mays
gaggggaatgttgtctggctcgaggtgcagaaacacgcagatctcatcgaggtcgtcttggttgttgttgatctcggaccaggcttcattcccctc

SEQ ID NO: 6299 - DNA, 96 bp, Medicago truncatula; identical to SEQ ID NO: 6293

SEQ ID NO: 6300 - DNA, 171 bp, Medicago truncatula; identical to SEQ ID NO: 6294

SEQ ID NO: 6301 - DNA, 97 bp, Medicago truncatula; identical to SEQ ID NO: 6295

SEQ ID NO: 6302 - DNA, 116 bp, Zea mays; identical to SEQ ID NO: 5743

SEQ ID NO: 6303 - DNA, 126 bp, Zea mays; identical to SEQ ID NO: 5748

SEQ ID NO: 6304 - DNA, 96 bp, Zea mays; identical to SEQ ID NO: 6298

SEQ ID NO: 6305 - DNA, 96 bp, Medicago truncatula; identical to SEQ ID NO: 6293

SEQ ID NO: 6306 - DNA, 171 bp, Medicago truncatula; identical to SEQ ID NO: 6294

SEQ ID NO: 6307 - DNA, 97 bp, Medicago truncatula; identical to SEQ ID NO: 6295

SEQ ID NO: 6308 - DNA, 116 bp, Zea mays; identical to SEQ ID NO: 5743

SEQ ID NO: 6309 - DNA, 126 bp, Zea mays; identical to SEQ ID NO: 5748

SEQ ID NO: 6310 - DNA, 96 bp, Zea mays; identical to SEQ ID NO: 6298

SEQ ID NO: 6311 - DNA, 111 bp, Sorghum bicolor
  misc_feature (82)..(82): n is a, c, g, or t
  misc_feature (89)..(89): n is a, c, g, or t
  misc_feature (108)..(108): n is a, c, g, or t
ctttacatactgagagttccttggcattctgtccacctccttggcccatcgtcagatatatgtgttgcttttggaggtgganatactgncaatggagctgtgtaggcntct

SEQ ID NO: 6312 - DNA, 133 bp, Sorghum bicolor
  misc_feature (1)..(1): n is a, c, g, or t
  misc_feature (7)..(7): n is a, c, g, or t
  misc_feature (50)..(50): n is a, c, g, or t
nctttgntggtgtgagaggttgaagctgccagcatgatctggtggccggnccggccggcgtctctcaagtgcgctcggatcggagacgcgtcgccagatcatgttgcagcttcactctctcgcaaccaccaaa

SEQ ID NO: 6313 - DNA, 130 bp, Zea mays
acttcgctggtgtgagagcttgaagctgccagcatgatctggctactcaaacgccgccggcctcccaagtgctcgatcggtggcgcttcaccagatcatgttgcagcttcactctctcgcaaccagcgaa

SEQ ID NO: 6314 - DNA, 91 bp, Zea mays
tgaagctgccagcatgatctggctactcaaacgccgccgggcctccaagtgctcgatcggtggcgcttcaccagatcatgttgcagcttca

SEQ ID NO: 6315 - protein, 69 aa, Glycine max
MAQAYTKSSNCVGAKYHHEAKKHSPYCVGFVCSLEPRLWGNPFLPKRNDVGWVMSTWDFRGKLLSGIPE

SEQ ID NO: 6316 - protein, 723 aa, Glycine max
MEETFVPFEGIKNDLRGRLMCYKQDWSGGIKAGLRIWAPTTYIFFASAIPVISFGEQLERDTDGVLTAVQTLASTSICGIIHSILGGQPLLILGVAEPTVIMYTFMFNFAKERPELGRDLFLAWTGWVCVWTALLLFLFAILGACSIINRFTRIAGELFGMLIAMLFMQQAIKGLVDEFRIPERQNSKSIEFIPSWRFANGMFALVLSFGLLLTALRSRKARSWRYGTGWLRSLIADYGVPLMVLVWTGVSYIPAGSVPHGIPRRLFSPNPWSPGAYENWTVIKDMVHVPVVYIIGAFIPATMIAVLYYFDHSVASQLAQQKEFNLRKPSSYHYDLLLLGFLTLMCGLIGIPPANGVIPQSPMHTKSLATLKHQLLRNKLVVTARKSMGKNASLGQLYGNMLEAYNQMQTPLVYQDPSARAQGLRELKESTIQAATSMGNVDAPVDETIFDVEKEIDDLLPVEVKEQRLSNLLQSTMVGGCVAAMPLLKKIPTSVLWGYFAFMAIESLPGNQFWERILLLFTAPSRRYKVLEDYHATFVETVPFKTIATFTIFQTIYLLICFGLTWVPIAGVMFPMMIMLLVPVRQYFLPKFFKGVHLQDLDAAAYEEQTALPFNLATHSEFGAGASQVGEGEILDEVITRSRGEFRHTSSPKITSSTPTPRTDPKSHLSPRLSFSARVGEFKTEQSPRSGARGPLSPKAGEVRLSNLGRSPLNPDSKQQDQN

SEQ ID NO: 6317 - protein, 723 aa, Glycine max
MEETFVPFEGIKNDLRGRLMCYKQDWTGGIKAGLRIWAPTTYIFFASAIPVISFGEQLERDTDGVLTAVQTLASTSICGIIHSILGGQPLLILGVAEPTVIMYTFMFNFAKERPELGRDLFLAWTGWVCVWTALLLFLFAVLGACSIINRFTRIAGELFGMLIAMLFMQQAIKGLVDEFRIPERQNPKSIEFISSWRFANGMFALVLSFGLLLTALRSRKARSWRYGTGWLRSLIADYGVPLMVLVWTGVSYMPAGSVPHGIPRRLFSPNPWSPGAYENWTVIKDMVHVPVVYIIGAFIPATMIAVLYYFDHSVASQLAQQKEFNLRKPSSYHYDLLLLGFLTLMCGLIGIPPANGVIPQSPMHTKSLATLKHQLLRNKLVVAARKSMGKNASLGQLYGNMQEAYNQMQTPLVYQDSSARAQGLRDLKESTIQAATSMGNVDAPVDETIFDVEKEIDDLLPVEVKEQRLSNFLQSIMVGGCVAAMPLLKKIPTSVLWGYFAFMAIESLPGNQFWERILLLFTAPSRRYKVLEDYHATFVETVPFKTIVTFTIFQTIYLLICFGLTWVPIAGVMFPMMIMLLVPVRQYFLPKFFKGIHLQDLDAAAYEEQTALPFNLATHSEFGAGASQVGEGEILDEVITRSRGEFRHTSSPKITSSTPTPRTDTNSHLSPRLSFSSRMGEFKTEQSPRSGARGPLSPKAGEVRLSHLGRSPLNPDSKQHDHN

SEQ ID NO: 6318 - protein, 748 aa, Glycine max
MEETFVPFEGIKNDLRGRLMCYKQDWTGGIKAGLRIWAPTTYIFFASAIPVISFGEQLERDTGTKYYSDFNGFFFFPEKKISCFAFADGVLTAVQTLASTSICGIIHSILGGQPLLILGVAEPTVIMYTFMFNFAKERPELGRDLFLAWTGWVCVWTALLLFLFAVLGACSIINRFTRIAGELFGMLIAMLFMQQAIKGLVDEFRIPERQNPKSIEFISSWRFANGMFALVLSFGLLLTALRSRKARSWRYGTGWLRSLIADYGVPLMVLVWTGVSYMPAGSVPHGIPRRLFSPNPWSPGAYENWTVIKDMVHVPVVYIIGAFIPATMIAVLYYFDHSVASQLAQQKEFNLRKPSSYHYDLLLLGFLTLMCGLIGIPPANGVIPQSPMHTKSLATLKHQLLRNKLVVAARKSMGKNASLGQLYGNMQEAYNQMQTPLVYQDSSARAQGLRDLKESTIQAATSMGNVDAPVDETIFDVEKEIDDLLPVEVKEQRLSNFLQSIMVGGCVAAMPLLKKIPTSVLWGYFAFMAIESLPGNQFWERILLLFTAPSRRYKVLEDYHATFVETVPFKTIVTFTIFQTIYLLICFGLTWVPIAGVMFPMMIMLLVPVRQYFLPKFFKGIHLQDLDAAAYEEQTALPFNLATHSEFGAGASQVGEGEILDEVITRSRGEFRHTSSPKITSSTPTPRTDTNSHLSPRLSFSSRMGEFKTEQSPRSGARGPLSPKAGEVRLSHLGRSPLNPDSKQHDHN

SEQ ID NO: 6319 - protein, 724 aa, Medicago truncatula
MEETFVPFEGIKNDLRGRLMCYKQDWTGGIKAGVRILAPTTYIFFASAIPVISFGEQLERNTEGVLTAVQTLASTSICGIIHSIIGGQPLLILGVAEPTVIMYTFMFNFAKERPELGRNLFLGWAGWVCVWTALILFLLAILGACSIINRFTRIAGELFGMLIAMLFMQQAIKGLVDEFRIPKREDTKAIEFLPSWRFANGMFALVLSFGLLLTALKSRKARSWRYGSGWLRSLIADYGVPLMVLVWTGVSYMPTASVPNGIPRRLFSPNPWSPGAYDNWTVVKDMVQVPVVFIIGAFIPATMIAVLYYFDHSVASQLSQQKEFNLRKPSSYHYDLLLLGFLTLLCGLIGIPPANGVIPQSPMHTKSLATLKHQLLRNRLVITARNSISKNASLGQLYGNMQEVYHQMQTPLIYQDPSARAQGLKELKETTIQAATSMGNVDAPVDETIFDVEKEIDDLLPVEVKEQRVSNLLQSVLVGGCVAAMPILKKIPTSVLWGYFAFMAIESLPGNQFWERILLLFTAPSRRYKVLEDYHATFVETVPFKTIALFTIFQTIYLFICFGLTWVPIAGVMFPLMIMLLVPLRQYFLPKFFKGAHLQDLDAAEYEEQTALPFNLASQSEFGAGASHIGEGEIFDEVITRSRGEFRHTTNSPKISSSTPTPRNDPKSRLSPHLSFNSRVGEFATEQSPRSGVRGTNSPMTKEMRLSGRGISPLNPDSKHQDKK

SEQ ID NO: 6320 - protein, 718 aa, Vitis vinifera
MEETFVPFRGIKNDLRGRLMCYKQDWAGGFRAGFRILAPTTYIFFASAIPVISFGEQLERNTEGVLTAVQTLASTAICGIIHSIIGGQPLLILGVAEPTVIMYTFMFNFAKERPDLGRKLFLAWTGWVCVWTAFLLFLLAILGACSIINRFTRVAGELFGLLIAMLFMQQAIKGIVDEFRIPKQENAKLTEFIPSWRFANGMFALVLSFGLLLTALRSRKARSWRYGTGWLRSLIADYGVPLMVLIWTAVSYIPAGSVPKGIPRRLVSPNPWSPGAYENWTVIKDMLDVPVLYIVGAFIPATMIAVLYYFDHSVASQLAQQKEFNLRKPPSFHYDLLLLGFLTIMCGLIGIPPSNGVIPQSPMHTKSLATLKHQLLRNRLVATARISMRKNSSLSQLYGNMQEAYQQMQTPLIYQEPSARQGLKELKESTIQLASSMGAIDAPVDETVFDVEKEIDDLLPVEVKEQRLSNLLQAAAVGGCVAAMPILKMIPTSVLWGYFAFMAIESLPGNQFWERILLLFTAPSRRYKVLEEYHATFVETVPFKSIATFTIFQTAYLLICFGITWVPIAGLLFPLMIMLLVPVRQYFLPKFFKGAHLQDLDAAEYEEAPALPFNLAMEGEMGAGASLAEGGEILDEIITRSRGEIRHMCSPKITSSTATPTKDPRNFQSPRLSEKAYSPRVSELRGEHSPQSSGRGKYSPKTGEVKPSNLGKSPHSSN

SEQ ID NO: 6321 - protein, 717 aa, Vitis vinifera
MEETFVPFRGIKNDLRGRLMCYKQDWAGGFRAGFRILAPTTYIFFASAIPVISFGEQLERNTEGVLTAVQTLASTAICGIIHSIIGGQPLLILGVAEPTVIMYTFMFNFAKERPDLGRKLFLAWTGWVCVWTAFLLFLLAILGACSIINRFTRVAGELFGLLIAMLFMQQAIKGIVDEFRIPKQENAKLTEFIPSWRFANGMFALVLSFGLLLTALRSRKARSWRYGTGWLRSLIADYGVPLMVLIWTAVSYIPAGSVPKGIPRRLVSPNPWSPGAYENWTVIKDMLDVPVLYIVGAFIPATMIAVLYYFDHSVASQLAQQKEFNLRKPPSFHYDLLLLGFLTIMCGLIGIPPSNGVIPQSPMHTKSLATLKHQLLRNRLVATARISMRKNSSLSQLYGNMQEAYQQMQTPLIYQEPSARGLKELKESTIQLASSMGAIDAPVDETVFDVEKEIDDLLPVEVKEQRLSNLLQAAAVGGCVAAMPILKMIPTSVLWGYFAFMAIESLPGNQFWERILLLFTAPSRRYKVLEEYHATFVETVPFKSIATFTIFQTAYLLICFGITWVPIAGLLFPLMIMLLVPVRQYFLPKFFKGAHLQDLDAAEYEEAPALPFNLAMEGEMGAGASLAEGGEILDEIITRSRGEIRHMCSPKITSSTATPTKDPRNFQSPRLSEKAYSPRVSELRGEHSPQSSGRGKYSPKTGEVKPSNLGKSPHSSN

SEQ ID NO: 6322 - protein, 717 aa, Ricinus communis
MEETFVPLRGIKNDLRGRLLCYKQDWTSGFKAGLRILAPTTYIFFASAIPVISFGEQLERNTDGVLTAVQTLVSTAVCGIIHSVIGGQPLLILGVAEPTVIMYTFMFNFVKERPDLGRDLFLAWTGWVCVWTAILLFLLAILGACSIINRFTRVAGELFGLLIAMLFMQQAVKGLVDEFRIPQREDRKSIEFIASWRFANGMFALVLSFGLLFTALRSRKARSWRYGTGWLRSLMADYGVPLMVLVWTGVSYIPSGSVPKGIPRRLFSPNPWSPGAYENWTVIKDMLNVPVFYIIGAFIPATMIAVLYYFDHSVASQLAQQKEFNLRKPPSYHYDLLLLGFLTLLCGLLGIPPSNGVIPQSPMHTKSLATLKHQLLRSRLVATARQSIRKNASLGQLYGNMKEAYQQMQTPLIYQQPSEGLKEFKESTIQVASCTGHIDAPVDETVFDIEKEIDDLLPVEVKEQRLSNLLQATMVGGCVAAMPFLKKIPTSVLWGYFAFMAIESLPGNQFWERILLLFTAPSRRYKVLEEYHATFVETVPFKTIAMFTIFQTFYLLICFGLTWVPIAGVMFPLMIMLLVPVRQYFLPKLFKGAHLQDLDAAEYEEAPALPYTLATESELGAGAVQAGDGEILDEVITRSRGEFRHMSSPKITSSTATPANDPKSHQSPRFSSSYSPRLSELRGEKSPKASGKGAKSPRTPELGLSKLGKSPSSSAQN

SEQ ID NO: 6323 - protein, 714 aa, Vitis vinifera
  misc_feature (701)..(702): Xaa can be any naturally occurring amino acid
MEETFVPFRGIKNDLRGRLMCYKQDWAGGFRAGFRILAPTTYIFFASAIPVISFGEQLERNTEGVLTAVQTLASTAICGIIHSIIGGQPLLILGVAEPTVIMYTFMFNFAKERPDLGRKLFLAWTGWVCVWTAFLLFLLAILGACSIINRFTRVAGELFGLLIAMLFMQQAIKGIVDEFRIPKQENAKLTEFIPSWRFANGMFALVLSFGLLLTALRSRKARSWRYGTGWLRSLIADYGVPLMVLIWTAVSYIPAGSVPKGIPRRLVSPNPWSPGAYENWTDMLDVPVLYIVGAFIPATMIAVLYYFDHSVASQLAQQKEFNLRKPPSFHYDLLLLGFLTIMCGLIGIPPSNGVIPQSPMHTKSLATLKHQLLRNRLVATARISMRKNSSLSQLYGNMQEAYQQMQTPLIYQEPSARGLKELKESTIQLASSMGAIDAPVDETVFDVEKEIDDLLPVEVKEQRLSNLLQAAAVGGCVAAMPILKMIPTSVLWGYFAFMAIESLPGNQFWERILLLFTAPSRRYKVLEEYHATFVETVPFKSIATFTIFQTAYLLICFGITWVPIAGLLFPLMIMLLVPVRQYFLPKFFKGAHLQDLDAAEYEEAPALPFNLAMEGEMGAGASLAEGGEILDEIITRSRGEIRHMCSPKITSSTATPTKDPRNFQSPRLSEKAYSPRVSELRGEHSPQSSGRGKYSPKTGEXXPSNLGKSPHSSN

SEQ ID NO: 6324 - protein, 731 aa, Populus trichocarpa
MEETFVPFRGIKNDLRGRLMCYKQDWTGGFRAGFRILAPTTYIFFASAIPVISFGEQLERNTDGVLTAVQTLASTAVCGIIHSIIGGQPLLILGVAEPTVIMYTFMFNFAKERADLGRNLFLAWTGWVCVWTSLLLFLLAVLGACSIINRFTRVAGELFGLLIAMLFMQQAIKGLVDEFRIPKREDPKSMEFIPSWRFANGMFALVLSFGLLLTALRSRKARSWRYGSGWLRSLVADYGVPLMVVVWTAVSYIPTGNVPKGIPRRLFSPNPWSPGAYENWTVVKASSEMLDVPISYIIGAFIPATMIAVLYYFDHSVASQLAQQKEFNLRKPSSYHYDLLLLGFLTLMCGLIGIPPSNGVIPQSPMHTKSLATLKYQVIYPEISQKIKLLRNRLVATARTSLRKNASLGQLYGNMQEAYHQIQTPLMYQQPSQGLKEFKESTIQAATCTGHIDAPVDETVFDIEKEIDDLLPVEVKEQRVSNLLQATMVGGCVAAMPFLKMIPTSVLWGYFAFMAIESLPGNQFWERILLLFTAPSRRYKVLEDFHATFVETVPFKSIAMFTIFQTAYLLICFGLTWIPIAGLMFPLMIMLLVPVRQYCLPKFFKGAHLQDLDAAEYEEAPALPFNLATEAELGGGAAYGGDGEILDEVITRSRGEFRHTSSPKISSSTTTPANNPKSLQSPRLSYTYSPRISELRGQKSPKSSGRGLNSPRTGDQKLSKLGKSPSSSEQN

SEQ ID NO: 6325 - protein, 703 aa, Brassica napus
MEETFVPFEGIKNDLKGRLMCYKQDWTGGFKAGFRILAPTTYIFFASAIPVISFGEQLERSTDGVLTAVQTLASTAICGIIHSIIGGQPLLILGVAEPTVIMYTFMFNFAKARPELGRNLFLAWSGWVCVWTALMLFVMAICGACSIINRFTRVAGELFGLLIAMLFMQQAIKGLVDEFRIPDRENQKLKEFLPSWRFANGMFALVLSFGLLLTGLRSRKARSWRYGSGWLRSLIADYGVPLMVLVWTGVSYIPAGDVPKGIPRRLFSPNPWSPGAYGNWTVVKEMLDVPIVHIIGAFVPASMIAVLYYFDHSVASQLAQQKEFNLRKPSSYHYDLLLLGFLTLMCGLLGIPPSNGVIPQSPMHTKSLATLKYQLLRNRLVATARRSIKTNASLGQLYNNMQEAYHHMQTPLVYQQPQGLKELKESTIQSTTLTGNLNAPIDETLFDIEKEIDDLLPVEVKEQRVSNFLQSTMVGGCVAAMPILKMIPTSVLWGYFAFMAIESLPGNQFWERILLLFTAPSRRFKVLEDYHATFVETVPFKTIATFTIFQTIYLLVCFGLTWIPIAGVMFPLMIMFLIPVRQYILPRFFKGAHLQDLDAAEYEEAPALPFNLAAETEIGSTTSYPGDSEILDEVITRSRGEFRHTSSPKVTSSNSTPVNSRSLSQVFSPRVGELRLGQMSPRVVGNSPKPPSTGRSPLNQGSH

SEQ ID NO: 6326 - protein, 524 aa, Glycine max
MSSMTSGGDTRKISKGRWSSSLDEKVGVGGNVGGEGPLKKGPWTAAEDAILVEYVKKHGQGNWNAVQKHSGLARCGKSCRLRWANHLRPDLKKGAFTAEEENRILELHAKMGNKWARMAAELPGRTDNEIKNYWNTRIKRMQRAGLPIYPEELCQRILNGNQESQNVGTMTNEACHHDDLSQTNNFDIPDVEFKNFKFRHGLPHVPSIFDMPESSLFDQSSDSSHSYNFLFPTMRPTKRPRESEMLYDSFGSCSINAAPLFDQYGNYTFEKISDHPGLSLPCDPVLNTTDQFHGDNLTGSHAALNGNASASVPIFGAMKLELPSLQYPETQHGSWGPPMSPLPSLESVDTLIQSPTLEPILSDPISPQSSGLLEAIVYNSKSLKGSNNDLLLQETIATANEVANISTLNHSFQTEWDELGDPNSPLGQSAASVLTDYTPVRMCSVDGYQSTETSQDHDDKHEAPTTQFPDSSSKKKILKQVDYTQPDALLDLGWFGNNTKYESDQFVQQDALGALFGDNCQHQP

SEQ ID NO: 6327 - protein, 524 aa, Glycine max; identical to SEQ ID NO: 6326

SEQ ID NO: 6328 - protein, 492 aa, Glycine max
MSSVTSGGDNRKISKGRRSSSLEEEAGVGGNIRGESPLKKGPWTAAEDAILVEYAKKHGQGNWNAVHKYSGLARCGKSCRLRWANHLRPDLKKGEFTAEEENRILELHAKMGNKWARMAAELPGRTDNEIKNYWNTRIKRMQRAGLPIYPEELCQRILNCNQESQNISILSNEASQHGDLSQTDFDIPDVEFKIFKFRHGLSHGQSIFDMPESSLFDQSSDSSHSYNLFPTMRPTKRPRESEMLYDSFESCTINAAPLFDQYDNYTSEKISDHPRLSLPRDPVLNTNDQFNGDNLTGSHAALNGNASSSVPMFRAMKLELPSLQYPETQHGSWGTPTSPLPSLESVDTLIQSPVVEPILLDPISPQSSGLLEAIVHNSKSLKGSNNDLLLQETIGTTNEVAKSSTLNHSFQTKWYELGEPNSPFDHDDKHEALTTQFPDSSRKKKNILKQMDYTQPDALLDLGWFGNSTEYGSDQSVLQDALSALLGEDCQR

SEQ ID NO: 6329 - protein, 611 aa, Glycine max
MDSKRFDRASRKVRVVTRIRGFAGPEANSEPAASRTVEWVSVNRENLEDVTISFGDQSSSRYSVDYCYKEDEDNELIYSREVKPLVSAAFDGHNSTVIAHGARGSGKTHAIQGSAERPGLAVLAIAEFLSVAEKNGKNIAVSFYEVDHQERAMDLLNPEKPPILVFEDHGRIQFKGLTQVLVKSIAEFQNLYSSACFALKGAPKKGGCEHVHRSHMGLIVHVFSQNGSLVSKVNFVDLAGYEDARKKSGDGSYLAEINKINKSIYALLNVCHALSTNESRVAYRESKITRMLQDSLRGTSKILLVSCLNPSFCQDTIYMVSLASRSCHWIHRAFLDSTKRNASSAKQMVNSHKNQIPKSVSGTAKKLHVSSKLLDKKVVVAKKSAIKGRKLFDEASHSVTKAEKEIAVAQVTQASKSLLDNSLLETGSDVVLNSGMEKKTGNHVVLNSGMEKKTRNHVVLNSGMEKKTRNHVVLNSGVEKDDSFSKARENVKLDLMVQNDDSSFNANIEVELNPLADQGISVDEEDHQKEHTPYASNYSEVLAKIVQEDHSINKENNNSRAIRDDSLAINSPPISSQLQDLSNSLKMLYSSTPSCMQIPKTEPIPLDIVEP

SEQ ID NO: 6330 - protein, 687 aa, Glycine max
MDSKQFDRASRKVRVVARIRGFSVGPEANSEPSASRAVEWVSVNRENLDDVTISFGDQSSSRYLVDYCYKEDEDNELIYSREVKPLVSAAFDGHNCTVIAHGARGSGKTHIIQGSAERPGLAVLAITEFLSVTEQNGKSIAVSFYEVDHQERPMDLLNPEKPPILVFEDRSRIQFKGLTQVPVKSIEEFQNLYSSACFALKGAPKKGGCERVHRSHMGLIVHVFSHNGSLLSKVNFVDLASYEDARKKSSDVSCLAETNKINKSIYALLNVCHALSTNESRVAYRESKITRMLQDSLRGTSKILLISCLNPSFCQDTIYMVSLASRSCHWIHRASLDSTKISASSAKQMVNSHKNQIPKSVSGTAKKLYGSSKLLDKKVVVAKKSAIKGRKLFDEASNSATKAEKEAQCISWYQTQDNSLSETGNDVILNSGVEKNTGNHVVINFGMEKDDSFSKASENGKHMQDDSIQDDSSLNANIEVELNPLADEGILVDEEDHQKDPYASNYSEALSKIVQEDHSMNKENNNSRAIGDHSSATISSPPISSQLRDLSNSLKMLYSSTPSCMQIPEKEPIPLDIVEPKTPTIEQNMSINRLDAMNAKSPWETFSMRGSGMKSSLVQEYLRFLNTANKEELKKLKGIGEKRATFILELREESPEPFKSLDDLKDIGLSAKQIKGIMKKEVGELFS

SEQ ID NO: 6331 - protein, 595 aa, Glycine max
MEKAIARELVQHFAIGTGFSVFTVPLSFRAQFSFRFAARKTTSFLDFGVASYSEAIYYKMRRMKKDIEDEVLPNDMSGAQLNDESYEGSAGIVLKKGPWTSTEDDILVDYVKKHGEGNWNAVQKHTGLFRCGKSCRLRWANHLRPNLKKGAFAAEEERLIAELHAKMGNKWARMAAHLPGRTDNEIKNYWNTRIKRRQRAGLPLYPPEVSLHALQESQHSQSTGGLNGGDKMHPDFLQKNSYEIHDAIFDSLKDNQGILPYVHELSDISVYGNKLKGLDSSQYCSFVPPTSPKRKRLKESTIPFIDSCAMKKKDLYPFDQIQDNNSDKIAQSFGMQAPLDPGLSSHSSMCYSHSLSNGNSSTSKPYEAMKLELPSLQYPELDLGSWGSSPPPSLLESVDDFLQSPTAISTLESDCSSPQNSGLLDALLYQAKTMSSSKNHCSDKSSNSSTATPGDRADSSILNVYETEWEDYADPVSPFGATSILNECPALRANANSLNGQLPVQTFTGNLPKLESVDQVWTPNNENLTLSLLNITRPDFLLASDWYDLGSGHCKNQTITTDAATAFLGDDLATDLKHMTAGISKTMFENPFQPL

SEQ ID NO: 6332 - protein, 553 aa, Glycine max
MRQMKIDIEDEVLPNDMSGTQLNDESYEGGAGIVLKKGPWTSTEDDILVDYVKKHGEGNWNAVQKHTGLLRCGKSCRLRWANHLRPNLKKGAFTAEEERVIAELHAKMGNKWARMAAHLPGRTDNEIKNYWNTRIKRCQRAGLPLYPPEVSLQALQESQHSQSSGGLNGGEKMHPDFLQKNSFEIHDGIFDSLKDNQGILPYVHELSDISVYGNMLKGLDSSQYCSFVPPTLPKCKRLKESTIPFIDSCDMKKYDLYSFDQIRDNNSNKIAQSFGMQAPLDPGPSSHSSMCYSHSLSNGNSSTSKPYEAVKLELPSLQYPELDLGSWGSSPPPSLLESVDDFLQSPTPISTLESDCSSPQNSGLLDALLYQAKTMSSSKNHCSDKSSNSSTATPGDRADSSALNVYETEWEDYADPVSPFGATSILNECTGLRANMNSLNEQLPVQTITGDLPNLESVDQVWTPDSENQTLSLLNNTCPDFLLTSDWYDLGSGHGKNQAISTDAATAFLGDDLATDHKYMTETLAKSSQVWGFGCCATAVNKMLAVFQLFILG

SEQ ID NO: 6333 - protein, 492 aa, Glycine max; identical to SEQ ID NO: 6328

SEQ ID NO: 6334 - protein, 524 aa, Glycine max; identical to SEQ ID NO: 6326

SEQ ID NO: 6335 - protein, 318 aa, Glycine max
MRVRASFFVLFSLSCLLCVLLSSAQQLPPDAVVSARLLDSHLQDSAFRALFSPITGVPYDAQVPTNLSGIKVSAMRLRSGSLRTRGVLSYKEFEIPIGVVEKPYVERLVLVYQNLGNWSDQFYPLPGFSYLAPVLGLLAYSGINLSASELPELDIRASEKPVLVNFPHVRPAPLGALAKCVYFDLHGSVQFDTLLPGNVCSTMQQGHFSIVVESNAPSPAPSSGGEFQDASGKNNKKNNKFMLRILAPCVVGGIVLLIIILGLLVVLVRRHTKGTRMQQLECVAYSNEIMDMTSIGDIKVPLAFGTRTRPMIEHDYFP

SEQ ID NO: 6336 - protein, 806 aa, Glycine max
KKKKSKKTVTYDGRSLIINGRRELLFSGSIHYPRSTPEEWAGILDKARQGGINVVQTYVFWNIHETEKGKYSIEPQYDYIKFIKLIQKKGMYVTLRVGPFIQAEWNHGGLPYWLREVPEIIFRSNNEPFKKHMKKYVSTVIKTVKDANLFAPQGGPIILAQIENEYNHIQRAFREEGDNYVQWAAKMAVSLDIGVPWIMCKQTDAPDPVINACNGRHCGDTFSGPNKPYKPAIWTENWTAQYRVFGDPPSQRSAEDIAFSVARFFSKNGSLVNYYMYHGGTNFGRTSSAFTTTRYYDEAPLDEYGMQREPKWSHLRDVHRALSLCKRALFNGASTVTKMSQHHEVIVFEKPGSNLCAAFITNNHTKVPTTISFRGTDYYMPPRSISILPDCKTVVFNTQCIASQHSSRNFKRSMAANDHKWEVYSETIPTTKQIPTHEKNPIELYSLLKDTSDYAWYTTSVELRPEDLPKKNDIPTILRIMSLGHSLLAFVNGEFIGSNHGSHEEKGFEFQKPVTLKVGVNQIAILASTVGLPDSGAYMEHRFAGPKSIFILGLNSGKMDLTSNGWGHEVGIKGEKLGIFTEEGSKKVQWKEAKGPGPAVSWYKTNFATPEGTDPVAIRMTGMGKGMVWINGKSIGRHWMSYLSPLGQPTQSEYHIPRTYFNPKDNLLVVFEEEIANPEKVEILTVNRDTICSFVTENHPPNVKSWAIKSEKFQAVVNDLVPSASLKCPHQRTIKAVEFASFGDPAGACGAFALGKCNAPAIKQIVEKQCLGKASCLVPIDKDAFTKGQDACPNVTKALAIQVRCE

SEQ ID NO: 6337 - protein, 825 aa, Medicago truncatula
MSLTLKLFSITLFSIITIVCAQNAAQTITYDGRSLLLDGKGELFFSGSIHYPRSTPDMWPDILDKARRGGLNLIQTYVFWNGHEPEKDKVNFEGRYDLVKFLKLVQEKGMYVTLRIGPFIQAEWNHGGLPYWLREVPDIIFRSNNEPFKKYMKEYVSIVINRMKEEKLFAPQGGPIILAQIENEYNHIQLAYEADGDNYVQWAAKMAVSLYNGVPWVMCKQKDAPDPVINACNGRHCGDTFTGPNKPYKPFIWTENWTAQYRVFGDPPSQRSAEDIAFSVARFFSKHGSLVNYYMYHGGTNFGRTTSAFTTTRYYDEAPLDEFGLQREPKWSHLRDAHKAVNLCKKSLLNGVPTTQKISQYHEVIVYEKKESNLCAAFITNNHTQTAKTLSFRGSDYFLPPRSISILPDCKTVVFNTQNIASQHSSRHFEKSKTGNDFKWEVFSEPIPSAKELPSKQKLPAELYSLLKDKTDYGWYTTSVELGPEDIPKKSDVAPVLRILSLGHSLQAFVNGEYIGSKHGSHEEKGFEFQKPVNFKVGVNQIAILANLVGLPDSGAYMEHRYAGPKTITILGLMSGTIDLTSNGWGHQVGLQGENDSIFTEKGSKKVEWKDGKGKGSTISWYKTNFDTPEGTNPVAIGMEGMAKGMIWVNGESIGRHWMSYLSPLGKPTQSEYHIPRSFLKPKDNLLVIFEEEAISPDKIAILTVNRDTICSFITENHPPNIRSFASKNQKLERVGENLTPEAFITCPDQKKITAVEFASFGDPSGFCGSFIMGKCNAPSSKKIVEQLCLGKPTCSVPMVKATFTGGNDGCPDVVKTLAIQVKCG

SEQ ID NO: 6338 - protein, 847 aa, Medicago truncatula
MTPTHNLAFLSILLVLLPAIVAAHDHGRVAGINNVTYDGKSLFVNGRRELLFSGSIHYTRSTPDAWPDILDKARHGGLNVIQTYVFWNAHEPEQGKFNFEGNNDLVKFIRLVQSKGMYVTLRVGPFIQAEWNHGGLPYWLREVPGIIFRSDNEPYKKYMKAYVSKIIQMMKDEKLFAPQGGPIILAQIENEYNHIQLAYEEKGDSYVQWAANMAVALDIGVPWIMCKQKDAPDPVINACNGRHCGDTFSGPNKPYKPSLWTENWTAQYRVFGDPVSQRSAEDIAFSVARFFSKNGNLVNYYMYHGGTNFGRTTSAFTTTRYYDEAPLDEYGMERQPKWSHLRDAHKALLLCRKAILGGVPTVQKLNDYHEVRIFEKPGTSTCSAFITNNHTNQAATISFRGSNYFLPAHSISVLPDCKTVVYNTQNVMNQLVYYKLISSHLIIKLIVSQHNKRNFVKSAVANNLKWELFLEAIPSSKKLESNQKIPLELYTLLKDTTDYGWYTTSFELGPEDLPKKSAILRIMSLGHTLSAFVNGQYIGTDHGTHEEKSFEFEQPANFKVGTNYISILATTVGLPDSGAYMEHRYAGPKSISILGLNKGKLELTKNGWGHRVGLRGEQLKVFTEEGSKKVQWDPVTGETRALSWLKTRFATPEGRGPVAIRMTGMGKGMIWVNGKSIGRHWMSFLSPLGQPSQEEYHIPRDYLNAKDNLLVVLEEEKGSPEKIEIMIVDRDTICSYITENSPANVNSWGSKNGEFRSVGKNSGPQASLKCPSGKKIVAVEFASFGNPSGYCGDFALGNCNGGAAKGVVEKACLGKEECLVEVNRANFNGQGCAGSVNTLAIQAKCSY

SEQ ID NO: 6339 - protein, 510 aa, Glycine max
MSQMTNEVDNNVHYDDQTGSQLNDDGNGVGVVLKKGPWTAAEDALLVNYVQKHGEGNWNAVQNYSGLSRCGKSCRLRWANHLRPNLKKGAFTAEEERMIAELHAKMGNKWARMAAHLPGRTDNEIKNYWNTRMKRRRRAGLPLYPPEVLLQAFQERKHGQGTGEISDGDGGHRDFLKKNNYEIHDAIFDSLKENQGILPFLPDLPAISANSFLPNGLGSPPYCNLLPSTLPNHDHLQESTMSFIGSSELNSNRFYPFDHIKDNTSDKISESFGLYSPLDRGVSHGSICYSHSLSNGNSSTSKPTSEAVKSELPSLQIPETEFGSWGTSPPPPLNESLDVFIHSPQPPNALDSGSSSPLNSGLLDALLYQANTLGCSKNNSSDKSSNSSIATPGDRAECSALNMYETEWEDYADPLSPFGATSILNEHPVVSTNGNSWDEWELFQTFSGNNERLQSIDQVWTPKSENQSMSLLNFTLPDVLITSDWHELYSDHDSTNQAIMTEASDDISGQ

SEQ ID NO: 6340 - protein, 510 aa, Glycine max
MSQMTNEINYNVHCNDQTGSQLNDEGNGVGMVLKKGPWTAAEDVLLVNYVQKHGEGNWNAVQKYSGLSRCGKSCRLRWANHLRPNLKKGAFTAEEERMIAELHAKMGNKWARMAAHLHGRTDNEIKNYWNTRMKRRQRAGLPLYPPEVLLQAFQERKHGQGTGEISNGDGGHHDFLKKNNYEIHDAIFDSLKENQGILPFLPDLPAISANSFLPNCLGSPPYCNFLPSTLPNHDHFQESTMSFIGSSELNSNEFYPFDRIKDNNSDKISESFGLYSPLDRGASSHGSICYSHSLSNGNSSTSKLISEAAKSELPSLQIPETEFGCWGTSPPPPLNESLDVFIHSPQPPNALDSGSSPLNSGLLDALLYQANTLGCSKNNSSDKSLNSSIATPGDRAESSALNMYETEWEDYADPLSPFGATSILNEHPVVSTNGNSWDDWELFQTFSGNNERLQSVDQVWAPKSGNQSMSLLNLTLPDVLITSDWHELYSDHDSMNQAVMTEASDDISGQ

SEQ ID NO: 6341 - protein, 510 aa, Glycine max; identical to SEQ ID NO: 6340

SEQ ID NO: 6342 - protein, 510 aa, Glycine max; identical to SEQ ID NO: 6339

SEQ ID NO: 6343 - protein, 553 aa, Glycine max; identical to SEQ ID NO: 6332

SEQ ID NO: 6344 - protein, 595 aa, Glycine max; identical to SEQ ID NO: 6331

SEQ ID NO: 6345 - protein, 723 aa, Glycine max; identical to SEQ ID NO: 6316

SEQ ID NO: 6346 - protein, 723 aa, Glycine max; identical to SEQ ID NO: 6317

SEQ ID NO: 6347 - protein, 748 aa, Glycine max; identical to SEQ ID NO: 6318

SEQ ID NO: 6348 - protein, 724 aa, Medicago truncatula; identical to SEQ ID NO: 6319

SEQ ID NO: 6349 - protein, 718 aa, Vitis vinifera; identical to SEQ ID NO: 6320

SEQ ID NO: 6350 - protein, 717 aa, Vitis vinifera; identical to SEQ ID NO: 6321

SEQ ID NO: 6351 - protein, 717 aa, Ricinus communis; identical to SEQ ID NO: 6322

SEQ ID NO: 6352 - protein, 714 aa, Vitis vinifera; identical to SEQ ID NO: 6323
  misc_feature (701)..(702): Xaa can be any naturally occurring amino acid

SEQ ID NO: 6353 - protein, 731 aa, Populus trichocarpa; identical to SEQ ID NO: 6324

SEQ ID NO: 6354 - protein, 703 aa, Brassica napus; identical to SEQ ID NO: 6325

SEQ ID NO: 6355 - protein, 698 aa, Glycine max
MPFASASMAKRSEELGLSLMNTDSANHDRIPGGCHPNDTTAPLPLVSPSPFPHWNLHETSQHYNNEPAGVNSMIDSSQFRSYQNFQMDHNYSHRAEEHNFLPCRPDSRFPCPEGYIGWPYQYDRHNNLAIPSNVRNASFNLNNFEKPDNGGMCVTPIYGSASRLQMVNPTGTAMSANIGQPSLDMNSGMALCNPNQGCVEPLLTIGKHDERYMTMGSGSNNKESKSSAVTPKFNVTGNSERAFLPPINSYHNHLGSRSSLNPGFDMNDTFSAFQNDSGFISDLAPSGNHEALFDSIPGLRLGPSYAFQWPAAGEQNRYLGQFNRDLGLAGVKDTSMEFTDVGLTNGLERCMDLNSLPIVGSQTMPFESRQSWANRQLVPSSSGVVTDNLPTEMLPKNNDKFSSQFFSSPPLAVATRSTRGQDLSSNPGQSQAGGSIQQSNSLLRPQSTSDVGIQSGMGYMTAQVSRPSNMSSLKRAASQPLSSTVQNQHRKTLPTQFIHPSIPNWNRLAPSVPNTSRAMSPLIRPAQSLTAQAPPHSVVPPSFPTTWTKSVLQAPNTTRAIHPKMHTATFLAPNDKRISSFHHPSSHTSPRTNQSNHQMLAQALAHQRLKAPIIPSAPRIASNYIKFKDQTAEPSGYKCLLCKRDLSYAPEGPISQPPVPPATAVLPCGHTFHDYCLERITPDDQSKYPPCIPCALLE

SEQ ID NO: 6356 - protein, 696 aa, Glycine max
MPFASASMEKRSEELGLSLMNTDSANHDRIPGVRHQNDTTVPLPLVSPSPFPHWHLHETSQYYNNEPAGVNSMIDSSQFRSYQNFQMDHNYYHRAEHNFLPCETDSCFPCPEGYIGWPYQYDRHNNLTIPVDVRDASFNLNNFEKPGNGGMCVTPSYGSASRLQMANPSGASMSANTGQPSLDMNLGMALCNPNKGCVEPLLTIGKRDERFMTTGSGSNNKESKSSAVTLKFNLTGNSDREFLPPVNIYHNQLGSRSSLNPGLDMNATFSAFQNDSEVISDLAPASNHEALFDSRPGLRLGPSYAFQWPAAGDQNHYLGQVNRDLGLGGVKDTSMEFTAVGHKNGLGCMDLNSLPIVGSLTMPFESGQRWANRQLAPSSSGTVTDKLPTELLPKNNDKFSLQLFSSPPLAVASGSTREQDLSSNHGQSQAGGSIQQSNSLLRPQSTSDVGIQAGKGYITAQVSRPSNLSSLKRAASQPLSSTIQNQQRKTLPTQFIHPSIPTPWTRLAPSVPNTSRAMSPLVRPALSLTPQAPHSVVPPSFPMTWTKSVLQAPNTTWAIPPRMYTAPFLAPNDKRISSSHHPSSHTSPCTNQSNHQALARALTRQRLKAPIIPSAPSIASNYIKFKDQTAEPIGYKCLLCKRDLSYAPEGPISQPPVPPATAVLPCGHTFHEYCLERITPDDQSKYPPCIPCALLE

SEQ ID NO: 6357 - protein, 415 aa, Glycine max
MEDDTTMPQDDQGNCDGTRGIGVLGRSSKKSKLKKVPQRGLGVAQLEKIRLEEQQKRDVAAILPSPSALSSTTPSHLPLPVKNFHDSNVSPSTPLLPCEPPSEFRSPLSLQQQHHQQQHMDVKVPSTVPLANSGDFEAGWPVVPGHGNVPKWWSSFQFDSEKNNFGVELGSPILPSVPFESSPIWPLPNLVQRTPQYQHQHQTSSPMASVSSGTLSTYMPHFTIEPPSNQNNNCSSVPVKSMEKMVGMKRQTPYPFSPDFPHVPAFNCISSPFAEVGTNAKTPCGNGSGFNFGNSTSREVSSSCLASNSEPKSKKRREENENFNGDFLTLAPPSPTSYPPSKSKLSLTFQAFHNQGNVEDQIPAAPPVFRLFNQQKQPFYGFFLPEPKEEQIGETAARIQNGHEVGESVDLNLKL

SEQ ID NO: 6358 - protein, 524 aa, Glycine max; identical to SEQ ID NO: 6326

SEQ ID NO: 6359 - protein, 492 aa, Glycine max; identical to SEQ ID NO: 6328

SEQ ID NO: 6360 - protein, 510 aa, Glycine max; identical to SEQ ID NO: 6339

SEQ ID NO: 6361 - protein, 510 aa, Glycine max; identical to SEQ ID NO: 6340

SEQ ID NO: 6362 - protein, 806 aa, Glycine max; identical to SEQ ID NO: 6336

SEQ ID NO: 6363 - protein, 825 aa, Medicago truncatula; identical to SEQ ID NO: 6337

SEQ ID NO: 6364 - protein, 847 aa, Medicago truncatula; identical to SEQ ID NO: 6338

SEQ ID NO: 6365 - protein, 595 aa, Glycine max; identical to SEQ ID NO: 6331

SEQ ID NO: 6366 - protein, 553 aa, Glycine max; identical to SEQ ID NO: 6332

SEQ ID NO: 6367 - protein, 492 aa, Glycine max; identical to SEQ ID NO: 6328

SEQ ID NO: 6368 - protein, 524 aa, Glycine max; identical to SEQ ID NO: 6326

SEQ ID NO: 6369 - protein, 553 aa, Glycine max; identical to SEQ ID NO: 6332

SEQ ID NO: 6370 - protein, 595 aa, Glycine max; identical to SEQ ID NO: 6331

SEQ ID NO: 6371 - protein, 510 aa, Glycine max; identical to SEQ ID NO: 6340

SEQ ID NO: 6372 - protein, 510 aa, Glycine max; identical to SEQ ID NO: 6339

SEQ ID NO: 6373 - protein, 241 aa, Glycine max
MEEGDSEAIFGALNLNPQLFCNEVLNIVDDVLDEAFNFFYQDASTKLNIEGTQRSQDLKKGVDCVRLNVQSVLDKQLAAWESYILRHCFALPQGFRMPNTDESNENALDPGAPFDPDIDAQLDSLREKLIEVGKESEMLNQEMQALERKSAVNVAGHINEAVQLYEQNSMHEVFQEIVTTASELGAKMAKLNSSMIEETDQTKTKRIYSTEMDLSAINPAKGLSNMKLDDVEEFVSVMKSM

SEQ ID NO: 6374 - protein, 190 aa, Glycine max
MEEGDSEAIFGALNLNPQLFCNEVLNIVDDVLDEAFNFFYQDASTKLNIEGTQRSQDLKKGVDCVRLNVQSVLDKQLAAWESYILRHCFALPQGFRMPNTDESNENALDPGAPFDPDIDAQLDSLREKLIEVGKESEMLNQEMQALERKSAVNVAGHINEAVQLYEQNPMHEVFQEIVTTASELGARWQS

SEQ ID NO: 6375 - protein, 362 aa, Glycine max
MNTKSLQILVHSPDLGISLQSTTNHETLSDLKNSLFPQSHQSFYFTFNGKPLPDKTPLSQFPPLSTLSLRSRLLGGGGDGGATGAESRDCYLNMYADKKPDKVDPNEQRLSKWHNCALSNEPLREPCVIDKLGNIFNKEALVEALLGKKLPKEFGHIKGLKDMINVQLSAIPGADDGAKFQCPVAGLEFNGKYRFFALRNCGHVLSAKALREVKSSSCLVCHKEYADVDKVVLNGSDEEVAVLRERMEEEKAKIREKKSKKVKNNGNDDGVSLEGTRLSGTKHGVDGKGVEKASAKVERNGKVGNGNVGVNGGAAAAAKRFKAVDLAPANATKDVYASIFTSSRKSEFKETYSCRSLPLGRN

SEQ ID NO: 6376 - protein, 345 aa, Glycine max
MNPKSLQILVQSPDLGISLQPTTKHETLSDLKHSLFPQSHRSFYFTFNGKPLPDKTPLSQFPPLSTLSLRSRLPGGGGDGGATGAESRDCYLNMYADKKPDKVDPNEQRLSKWHNCALSNEPLREPCVIDKLGNIFNKESLVEALLGKKLPKEFGHIKGLKDMINVQLSAIPGAEDGAKFQCPIAGLEFNGKYRFFALRNCGHVLSAKALREVKSSSCLVCHKEYADLDKIVLNGSDEEVVILRERMEEEKPKIREKKSKKVKHNNGDGGVEKASAKVERNGKVGNVALNGNGGGGGAAAAKRFKAVDLAPANATKDVYASIFTSSRKSDFKETYSCRSLPLGRN

SEQ ID NO: 6377 - protein, 459 aa, Medicago truncatula
MHRKSFQILVQSPDLQIHPKSVTGDETLSDLKHSIFPNSQSSFYFTLNGKPLSDDTNFSTSRIAPLSTLVLQSRLRGGGGDGGSTCAESRDCYLKMYAEKKPDKVDPNEQRLSKWQNCALSNEPLREPCVIDKLGNIFNKESLVEALLGKKLPKEFGYIKGLKDMIKIKLESVPGEDDGAKFRCPVAGLEFNGKYKFFALRNCGHVLSAKALKEVKSSACLVCHEEFGEGDKIVINGNEEEVEVLRERMEEEKAKVREKKTKKVKNNDSEAVDGLSLEASKLTGTKHGLNVEKASAKVDKNGKVANGNKGVNGGAAAAKRFKATDIAPANATEVYASIFTSSRKSEFKETYSCRSLPLVIDAGRMQYGLVNICQKSEWSGANSLEYYSLEDNFVHNIIDIRFKAANGNKSLTGGAAAKRFKATDIAPANATEVYALIFTSRKSEFKETCSCRSLPLGRN

SEQ ID NO: 6378 - protein, 372 aa, Glycine max
MGELQHHQQQAAAAAAPSRAAMRGVGGGEIVEVQGGHIVRSTGRKDRHSKVCTAKGPRDRRVRLAAHTAIQFYDVQDRLGYDRPSKAVDWLIKKAKAAIDQLAELPPWNPTATSMQHSMTAAFSSRGESNAFASHQQVEDNENANNISSSSGNKYNTGSGFLPASLDTDNIAETIKTFFPVEATSTSFQSYPPAPPDLGHQDLRLSLQSFQDPIMLHHQPHSHHQPVLFAGTAAAALDFDGGSGWSEHLHQHQQQNHHSEEQRLLYAGGNSGHGGGFVFNTPAPVQVPAFGQFFSQRGPLQSSNTPSIRAWIDPSVDHHHHHHHYLSQLIHQGSVAGGGGFSGFRIPARIQGEEEHDGVSDKPSSASSDSRH

SEQ ID NO: 6379 - protein, 370 aa, Glycine max
MGEPQHPHQHHQQAAATPSRAAMRGGGGGEIVEVQGGHIVRSTGRKDRHSKVCTAKGPRDRRVRLAAHTAIQFYDVQDRLGYDRPSKAVDWLIKKAKAAIDQLAELPPWNPTATCRGESPAFAAATRDSEQFSHPQVEQNENANNISSSSISIKYNSGSGFLPASLDTDNIAETIKTFFPVEATTTSFQSYPPAPPDLGQQDLRLSLQSFQDPIMLHHQPQSHHEPVLFAGTAAAALGFDGGYGWSEHQHQNHHSEEQRLLYAGGNSGHGGGFVFNTPAPVPAFGQFFSQRGPLQSSNTPSIRAWIDPSVDHHHHHHHYLSQLIHQGSVAGGSGFSSGFSGFRIPARIQGEEEHDGVSDKPSSASSDSRH

SEQ ID NO: 6380 - protein, 441 aa, Glycine max
MMKMGCSRCSFFLFLILLVALFPSSLSEIRFSEIRNDDRRIIPFDQFGFTHKGRLELSVSKISLSNSNLDLSKVGFFLCTLDSWLHVLQQLEDGEIRCALQSDLVKSVYSFNSLNGKDSFSTLYKEETDADQYNLVFANCHWQQLKVTMDVKSAMYNLEGNSNVRDYLSAGRTILPRVYLLFSLVYFALAALWISVLYKKRQTAFRIHYFMLGVVIFKALNLLCEAEDKSYIKRTGSAHGWDIVFYIFSFLKGISLFTLIVLIGTGWSFLKPFLQDKEKKVLIIVIPLQVIANIAQVVIDESGPFGHDWVTWKQIFLLVDVVCCCAVLFPIVWSIKNLREAARTDGKAAVNLMKLTLFRHYYVVVICYIYFTRVVVYALETITSYRYSWTSVVAAELATLAFYVFTGYKFKPEAHNPYFVIDDEEEEAAAEALKLEDEFEL

SEQ ID NO: 6381 - protein, 443 aa, Glycine max
MMKMGSSPSRCSFFLFLLLLVALFPSSLSEIRFSEIRNDDRSIVPFDQFGFTHKGRLELSVSKISLSNSNLDLSKVGFFLCTLDSWLHVFQQLEDGEIRCALQSDLVKSVYTFNSLNGKDSFSTLYKEETDADQYNLVFANCHSPQLKVTMDVKSAMYNLDGKSDVRDYLSAGRTILPRVYFLFSLVYFTLAALWISVLYKKRLTAFRIHYFMLAVVILKALNLLCEAEDKSYIKRTGSAHGWDIIFYIFSFLKGISLFTLIVLIGTGWSFLKPFLQDKEKKVLIVVIPLQVIANIAQVVIDENGPYGHDWATWKQVFLLVDVVCCCAVLFPIVWSIKNLREAARTDGKAAVNLMKLTLFRHYYVVVICYIYFTRVVVYALETITSYRYSWTSVVAAELATLAFYFFTGYKFKPEAHNPYFVIDDEEEEAAAEALKLEDEFEL

SEQ ID NO: 6382 - protein, 439 aa, Cucumis melo subsp. melo
MAAMDLFSSSMFILIIFLLPFSSFAEIRFTEIRNDNRPIIPFDVFGFSHGGRLELNVTHLTLSDSNPDLDLSKVGFFLCTRESWLHVIQQLEEGDISCALQSDLVKPVYTFDSLKKQDRFGVLYSETDADQYTLVFANCLQQFKVSMDVQSAMYNLEGKNARRDYLSAGKTILPRIYFVFSLIYFSLAVVWIHVLYKKRLTVYGIHFFMLAVVILKALNLLCEAEDKSYIKRTGSAHGWDVLFYIFSFLKGITLFTLIVLIGTGWSFLKPYLQDKEKKVLMIVIPLQVVANIAQVVIDETGPFEQEWVTWKQVFLLVDVICCCAVLFPIVWSIKNLREAARTDGKAAVNLMKLTLFRQYYIVVICYIYFTRVVVYALETITSYRYLWTSVVAGELATLAFYVFTGYKFKPEAHNPYFVVDDEEEEAAAEALKLEDEFEL

SEQ ID NO: 6383 - protein, 432 aa, Ricinus communis
MARFFLFFLFLSFSISLAEIRFSDIRNDDRPIIPFDEFGFTHKGQLELNVSNIHLSNPNPDLDLSRVGFFLCTRESWLHVIQQLEDGEIACALQSDLIKQVYTFNKLQKGQTFFSVVTSENDADQYTLVFANCLNSVKVSMDVKSTMYNIERNGNRDYLSAGKTILPRVYFLLSIVYFVMAGLWIHVLYKKRLTVFRIHFFMLAVVIMKALNLLFEAEDKSYIKRTGSAHGWDVLFYIFSFFKGIALFTLIVLIGTGWSFLKPYLQDKEKKVLMIVIPLQVIANIAQVVIDETGPYGQDWITWKQVFLLVDVVCCCAVLFPIVWSIKNLREAARTDGKAAVNLMKLTLFRQYYIVVICYIYFTRVVVYALETITSYRYLWTSVVAGELATLAFYAFTGYKFKPEAHNPYFVIDDEEEEAAAEQLKLEDEFEL

SEQ ID NO: 6384 - protein, 440 aa, Vitis vinifera
MAICSASSRCLALILLTTLSFSGCFAEIHTSEIRSDGQPIIPLDVFGFTHTGRLELNVSQISFSNSNPDLDLSKIGFFLCTRDSWLHVLQQLEESDITCALKSDVVKTVYSFDRLKGATSFGTVYQMNDADQFTLVFANCLQQVQISMNVRSVMYNLEDKNGRRDYLSAGKAVLPRVYFLFSLIYFGMAAIWIRVLHKKRLTVFRIHFFMLAVVILKALNLLCEAEDKSYIKRTGSAHGWDVLFYIFSFLKGISLFTLIVLIGTGWSFLKPYLQDKEKTVLMIVIPLQVVANIAQIVIDESGPYGHDWFTWKQVFLLVDILCCCAVLFPIVWSIKNLREAARTDGKAAVNLMKLTLFRHYYVVFICYIYFTRVVVYALETITSYRYLWTSTVAGELATLAFYVYTGYKFKPEAHNPYFVIDDDEEEAAAEQLKLEDEFEL

SEQ ID NO: 6385 - protein, 438 aa, Arabidopsis lyrata subsp. lyrata
MDFSSRFSSIVLLLFISISIASGEIRKSEIRSDDRPIIPLDEFGFTHTGRLELDASKISLSNTNPDLDLSKVGFFLCTRDAWVHVIQQLEEEEITCALQSDLVKHVFTFNNLKGDKSRFSTVFTENDADQYSLVFANCLQQVEISMDVRSAMYNLEGKKGGRDYLSAGRTVLPKVYFFFSVIYFSLAATWIYVLYKKRLTVFAIHFFMLGVVVLKALNLLCEAEDKSYIKKTGTAHGWDVLFYIFNFLKGITLFTLIVLIGTGWSFLKPYLQDKEKKVLMIVIPLQVVANFAQVVIDETGPYGQDWVTWKQIFLLVDVVCCCAVLFPIVWSIKNLREAAKTDGKAAVNLVKLTLFRQYYIVVICYIYFTRVVVYALETITSYKYMWTSVVASELATLAFYLFTGYKFRPEVHNPYFVVDDEEEEAAAEALKLEDEFEL

SEQ ID NO: 6386 - protein, 439 aa, Arabidopsis thaliana
MDLSSRFSSILILLLISISIASAEIRKSEIRSDDRPIIPLDEFGFTHSGRLELDASKIWLSNSNPDLDLSKVGFFLCTRDAWVHVIQQLEEEEITCALQSDLVKHVFTFNNLKGGDKSRFSTVFTENDADQYSLVFANCLQQVKISMDVRSAMYNLEGKKGGRDYLSAGRTVLPKVYFLFSVIYFSLAATWIYVLYKKRLTVFAIHFFMLGVVVLKALNLLCEAEDKSYIKKTGTAHGWDVLFYIFNFLKGITLFTLIVLIGTGWSFLKPYLQDKEKKVLMIVIPLQVVANFAQVVIDETGPYGQDWVTWKQIFLLVDVVCCCAVLFPIVWSIKNLREAAKTDGKAAVNLVKLTLFRQYYIVVICYIYFTRVVVYALETITSYKYMWTSVVASELATLAFYLFTGYKFRPEVHNPYFVVDDEEEEAAAEALKLEDEFEL

SEQ ID NO: 6387 - protein, 439 aa, Arabidopsis thaliana
MDLSSRFSSILILLLISISIASAEIRKSEIRSDDRPIIPLDEFGFTHSGRLELDASKIWLSNSNPDLDLSKVGFFLCTRDAWVHVIQQLEEEEITCALQSDLVKHVFTFNNLKGGDKSKFSTVFTENDADQYSLVFANCLQQVKISMDVRSAMYNLEGKKGGRDYLSAGRTVLPKVYFLFSVIYFSLAATWIYVLYKKRLTVFAIHFFMLGVVVLKALNLLCEAEDKSYIKKTGTAHGWDVLFYIFNFLNGITLFTLIVLIGTGWSFLKPYLQDKEKKVLMIVIPLQVVANFAQVVIDETGPYGQDWVTWKQIFLLVDVVCCCAVLFPIVWSIKNLREAAKTDGKAAVNLVKLTLFRQYYIVVICYIYFTRVVVYALETITSYKYMWTSVVASELATLGFYLFTGYKFRPEVHNPYFVVDDEEEEAAAEALKLEDEFEL

SEQ ID NO: 6388 - protein, 436 aa, Populus trichocarpa
MASRFLLFFLFTSLLLSISLAEIHFSEIRSDDRQIIPFDEFGFTHLGRLELNVTNIHLSNPNPDLDRSKIGFFLCTRDSWLHVINQLEDGEITCALQSDLIKPVFTFNELVKDQTSLSKTLTHNDADQYTLVFANCLTSLKVSMDVKSAMYNLDKGGKARDYLSAGKTMLPRVYYLLSLIYFGLAGVWIYVLYKKRLTVYRIHFFMLAVVILKTMNLLCEAEDKSYIKRTGYAHGWDVLFYIFSFLKGITLFTLIVLIGTGWSFLKPYLQGKEKKVLMIVIPLQVVANIAQVVIDETGPYGQDWITWKQVFLLVDVVCCCAVLFPIVWSIKNLREAARTDGKAAVNLMKLTLFRQYYIVVICYIYFTRVVVYALETITSYKYLWTSVVAGELATLAFYFFTGYKFKPEAHNPYFVVDDEEEEAAAEALKLEDEFEL

SEQ ID NO: 6389 - protein, 436 aa, Populus trichocarpa
MATRFTLFSLFTSLLLSLSLAEIRFSDIRSDDRQIIPFDEFGFTHFGRLELNVTNIRLSNPNPDLDRSKIGFFLCTRDSWLHVINQLEDGEIACALQSDLIKPVFTFNDLKKDHDSLSKIVTQNDADQYTLVFANCLTSLKVSMDVKSVMYNLDRGGKVRDYLSAGKTILPRVYYLLSLIYFGLVGVWIYVLYRKRLTVYRIHFFMLAVVILKTVNLLCEAEDKSYIKRTGYAHGWDVLFYIFSFLKGITLFTLIVLIGTGWSFLKPYLQDKEKKVLMIVIPLQVVANIAQVVIDETGPYGQDWITWKQVFLLVDVVCCCAVLFPIVWSIKNLREAARTDGKAAVNLMKLTLFRQYYIVVICYIYFTRVVVYALETITSYKYLWTSVVAGELATLAFYVFTGYKFKPEAHNPYFVVDDEEEEAAAEALKLEDEFEL

SEQ ID NO: 6390 - protein, 524 aa, Glycine max; identical to SEQ ID NO: 6326

SEQ ID NO: 6391 - protein, 492 aa, Glycine max; identical to SEQ ID NO: 6328

SEQ ID NO: 6392 - protein, 443 aa, Glycine max; identical to SEQ ID NO: 6381

SEQ ID NO: 6393 - protein, 441 aa, Glycine max; identical to SEQ ID NO: 6380

SEQ ID NO: 6394 - protein, 468 aa, Glycine max
MEEEDEILQARACKLPRRRGSDGESTNSRFHSSSWHHHNSSRIIRVSRASGGKDRHSKVMTSKGLRDRRVRLSVNTAIQFYDLQDRLGYDQPSKAVEWLIKSASDAISELPSLNNFPDTPQSDDHEKRENTADVAVGVVDGENGNGQNLSLAKSACSSNSETSKGSGLSLSRSDIRVKARERARERTTKEKEKEKEKNDESHRHHHNVVVVPHHNHNVNLVSQTASFTELLTGSDPNKGCDEANNNMMFNKAAGRLQWCSSTTPMDYFLGLSSSRTTTHNHNHLHHHQYSSSSSSGFSLAQIQLGHSLPEAMNHVSAFNNNVSGDNHNHSSSDPHLQQQHLSLIPDHLMSAVVTSSAASSHHHHHHQPSGNDYNLNSTMSSGLAGYNRGTLQSNSPSLLPHSQRFSPIDGSTVPFFIGAASSAAAVAAPAMENNNNNNHHQHQFSSVFDGSRLQLYYGHSDQKGKAKN

SEQ ID NO: 6395 - protein, 478 aa, Glycine max
MEEEDEIQAQKVRRRRGSDGESTNRFHSSWHHHHHHSSRIIRVSRASGGKDRHSKVMTSKGLRDRRVRLSVTTAIQFYDLQDRLGYDQPSKAVEWLIKSASDSISELPSLNNFPDTPKSDDHEKRANTDVAAGAVDGENYENENGNNNNQSQNMSLSKSGCSSTSETSKGSGLSLSRSDIRVKARERARERTTKEKEKEKNESHHHHSNVVVPHHRHHHHHNPVSQTASFTELLTGGIPKGCDDEEPNNMMMFNKEAAAASSGRQQWCSSSSAAAAAPMDYFLGPSSSRTTTTPPHNHHHHHHQYSSSGGFSLAQIQLGHSLPEAMNHNVSAFNNNVSGENQNHSSSDPHLQQQQHFSFIPDHLMSAVVTSSSHHQPSGSDYNLNFTMSSGLAGYNRGTLQSNSPSLLPHLQRFSPLDGSTVPFFIGAAPSAAVAAPAMENNTTTTNNHHHHQFSSGFDGSRLQLYYGHSDQKGKAKN

SEQ ID NO: 6396 - protein, 510 aa, Glycine max; identical to SEQ ID NO: 6339

SEQ ID NO: 6397 - protein, 510 aa, Glycine max; identical to SEQ ID NO: 6340

SEQ ID NO: 6398 - protein, 478 aa, Glycine max; identical to SEQ ID NO: 6395

SEQ ID NO: 6399 - protein, 468 aa, Glycine max; identical to SEQ ID NO: 6394

SEQ ID NO: 6400 - protein, 511 aa, Glycine max
MEEDEIQACKFPRVGNGRSSDQYQEEEEEGDLRRKGVGGGGGSDASTNHFHQSSWHYSSRIIRVSRASGGKDRHSKVMTSKGLRDRRVRLSVTTAIQFYDLQDRLGYDQPSKAVEWLIKAASEAISELPSLNNPFPDTPKQPSDEKRPTSGGGQQQQQQGFDDADGDTNYQQNQSQNLSLSKSACSSTSETSKGSGLSLSRSEIRVNRVKARERARERAAKEKEKEKEKESDFNIAHHHHHHNVNNMSHTASFTELLTGGIGSTVTVNPNTTTTTTTTATSPNGSSVHQIHEGHDHEANLFNKGSQQQQQQQHHHWSQTVTPMDYFSAGLLVGPSSSASTQQHQSSGQFQLGHGHAHAHALSISPFSGENHSEQMQHFSFMPDHLNNMPSSAASASQHSEGDNNNYNLNFSISSSGLAGYNRGTLQSNSPSSSFLPLLQRFQPLVDGSSNLPFFIGAAPPSSAPPTMDNNNSNNSNNHHHLQFSPIFDGRLQLCYGDGTRQHSDHKGKGKN

SEQ ID NO: 6401 - protein, 532 aa, Glycine max
MEEDEIQACKFPRVGNGRSSDQYQEEEEEGGDLRLRKGVGVGGGGGGGGSDASTNHFHQSSWHHSSRIIRVSRASGGKDRHSKVMTSKGLRDRRVRLSVTTAIQFYDLQDRLGYDQPSKAVEWLIKAASEAISELPSLNNPFPDTPKQLSDKKRPTSGGGQQQQQIQQGHFDDADGDTSYPQNQSQNLSLSKSACSSTSETSKGSGLSLSRSEIRVNRVKARERARERAAKEKEKEKEKEKEKEKESESSIAHHHHHHHVNNNNHMSHTASFTELLTGGIGSTVTVNPNTTTTTTTTTTSPNGSSVHQIHDGHDHETNLFNKGRQQQQQHHWSQTVTPMDYFSTGLLVGPSSSSARTQQHQHQSSSAHFQLGHAHALPISPFSGENHSEQLQHFSFMPDHLNNIPAHHVVTSSSASHQPNGGDNNYNLNFSISTSTGLAGYNNRGTLQSNSPSSSFLPHHLQRFQPLDGSSNLPFFIGAAAPSSAPPTMDNNNNNNSNNHHHLQFSPVFDGRLQLCYGDGTRHSDHKGKGKN

SEQ ID NO: 6402 - protein, 595 aa, Glycine max; identical to SEQ ID NO: 6331

SEQ ID NO: 6403 - protein, 553 aa, Glycine max; identical to SEQ ID NO: 6332

SEQ ID NO: 6404 - protein, 492 aa, Glycine max; identical to SEQ ID NO: 6328

SEQ ID NO: 6405 - protein, 524 aa, Glycine max; identical to SEQ ID NO: 6326

SEQ ID NO: 6406 - protein, 806 aa, Glycine max; identical to SEQ ID NO: 6336

SEQ ID NO: 6407 - protein, 825 aa, Medicago truncatula; identical to SEQ ID NO: 6337

SEQ ID NO: 6408 - protein, 847 aa, Medicago truncatula; identical to SEQ ID NO: 6338

SEQ ID NO: 6409 - protein, 532 aa, Glycine max; identical to SEQ ID NO: 6401

SEQ ID NO: 6410 - protein, 511 aa, Glycine max; identical to SEQ ID NO: 6400

SEQ ID NO: 6411 - protein, 510 aa, Glycine max; identical to SEQ ID NO: 6340

SEQ ID NO: 6412 - protein, 510 aa, Glycine max; identical to SEQ ID NO: 6339

SEQ ID NO: 6413 - protein, 553 aa, Glycine max; identical to SEQ ID NO: 6332

SEQ ID NO: 6414 - protein, 595 aa, Glycine max; identical to SEQ ID NO: 6331

SEQ ID NO: 6415 - protein, 361 aa, Medicago truncatula
MPFGLVSAWNKRRRSKSQDHTDPWIYKPAQLWQLDDKTPRPTKKLHGSSVYTLREMEEATCSFSEENLLGKGGFGKVYRGTLRSGEVVAIKKMELPAIKEAEGEREFRVEVDILSRLSHPNLVSLIGYCADGKHRFLVYEYMVNGNLQDHLNGIGERNMDWPRRLQVALGAAKGLAYLHSSSDVGIPIVHRDFKSTNILIDANFEAKISDFGLAKLMPEGQETHVTARVLGTFGYFDPEYTSTGKLTLQSDVYAFGVVLLELLTGRRAVDLNQGPNDQNLVLQVRHILNDRKKLCKVIDPEMARSSYTIQSIVMFANLASRCVRTESNERPSMADCVKEIQMIIYTNSKGLGMVMHSLRLI

SEQ ID NO: 6416 - protein, 361 aa, Medicago truncatula; identical to SEQ ID NO: 6415

SEQ ID NO: 6417 - protein, 363 aa, Glycine max
MPFGLVSLSAWNKRRRSKSQDHTDPWVYKPAQLWQLEDQMPRPTKRLHGSSVYTLKEMEEATCSFSDENLLGKGGFGKVYRGTLRSGEVVAIKKMELPAIKAAEGEREFRVEVDILSRLDHPNLVSLIGYCADGKHRFLVYEYMRRGNLQDHLNGIGERNMDWPRRLQVALGAAKGLAYLHSSSDVGIPIVHRDFKSTNILLDDNFEAKISDFGLAKLMPEGQETHVTARVLGTFGYFDPEYTSTGKLTLQSDVYAFGVVLLELLTGRRAVDLNQGPNDQNLVLQVRHILNDRKKLRKVIDPEMARNSYTIQSIVMFANLASRCVRTESNERPSMAECIKELLMIIYTNSKGLGMVMHSLRMI

SEQ ID NO: 6418 - protein, 363 aa, Glycine max
MPFGLVSLSAWNKRRRSKSQDHTDPWVYKPAQLWQLEDQTPRPTKRLHGSSVYTLKEMEEATCSFSDENLLGKGGFGKVYRGTLRSGEVVAIKKMELPAIKAAEGEREFRVEVDILSRLDHPNLVSLIGYCADGKHRFLVYEYMRKGNLQDHLNGIGERNMDWPRRLQVALGAAKGLAYLHSSSDVGIPIVHRDFKSTNILLDDNFEAKISDFGLAKLMPEGQETHVTARVLGTFGYFDPEYTSTGKLTLQSDVYAFGVVLLELLTGRRAVDLNQGPNDQNLVLQVRHILNDRKKLRKVIDPEMARNSYTIQSIVMFANLASRCVRTESNERPSIVECIKELLMIIYTNSKGLGMVMHSLRMI

SEQ ID NO: 6419 - protein, 372 aa, Glycine max
MPFGLVSLSAWNKRRRSKSQDHTDPCIVFFPIHNGVYKPAQLWQLEDQMPRPTKRLHGSSVYTLKEMEEATCSFSDENLLGKGGFGKVYRGTLRSGEVVAIKKMELPAIKAAEGEREFRVEVDILSRLDHPNLVSLIGYCADGKHRFLVYEYMRRGNLQDHLNGIGERNMDWPRRLQVALGAAKGLAYLHSSSDVGIPIVHRDFKSTNILLDDNFEAKISDFGLAKLMPEGQETHVTARVLGTFGYFDPEYTSTGKLTLQSDVYAFGVVLLELLTGRRAVDLNQGPNDQNLVLQVRHILNDRKKLRKVIDPEMARNSYTIQSIVMFANLASRCVRTESNERPSMAECIKELLMIIYTNSKGLGMVMHSLRMI

SEQ ID NO: 6420 - protein, 361 aa, Glycine max
MPFGLVSAWNKRRRSMSHDHSDPWIYKPAEFWQLEDQTPQPTKRRHRSSVFTLKEMEEATCSLSDDNLLGKGGFGRVYRATLKSGEVVAIKKMELPAIKAAEGEREFRVEVDILSRLDHPNLVSLIGYCADGKHRFLVYDYMHNGNLQDHLNGIGERKMDWPLRLKVAFGAAKGLAYLHSSSCLGIPIVHRDFKSTNVLLDANFEAKISDFGLAKLMPEGQETHVTARVLGTFGYFDPEYTSTGKLTLQSDVYAFGVVLLELLTGRRAVDLNQGPNDQNLVLQVRHLLNDRKKLLKVIDPEMARNSYTMESIFTFANLASRCVRSESNERPSMVDCVKEIQMIMYTNSKGLGMVMHRLRLV

SEQ ID NO: 6421 - protein, 361 aa, Glycine max
MPFGLVSAWNKRRRSKSQDHSDPWIYKPAEFWQLEDQTPQPTKRRHRSSVFTLREMEQATFSFSDDNLLGKGGFGRVYRGTLKSGEVVAIKKMELPAIKAAEGEREFRVEVDLLSRLDHPNLVSLIGYCADGKNRFLVYEYMHNGNLQDHLNGIGERKMDWPLRLKVALGAAKGLAYLHSSSCLGIPIVHRDFKSTNVLLDAKFEAKISDFGLAKLMPEGQETHVTARVLGTFGYFDPEYTSTGKLTLQSDVYAFGVVLLELLTGRRAVDLNQCPNDQNLVLQVRHLLNDQKKLRKVIDPEMTRNSYTMESIFMFVNLASRCVRSESNERPSMVDCVKEIQTILYTNSKGLEMVMHSLRLV

SEQ ID NO: 6422 - protein, 361 aa, Ricinus communis
MPFGLVSAWNKRRRSKSQDHTDPWIYKPVEFWKLDDQTPPSTKPRHGSSVFTLKEMEEATCSFSDENFLGKGGFGRVYKGTLRSGEVVAIKKMELPSFKEAEGEREFRVEVDILSRLDHPNLVSLIGYSADGKHRFLVYEYLQKGNLQDHLNGIGEEKMDWPMRLKVALGAARGLAYLHSSSAVGIPIVHRDFKSTNVLLNANFEAKISDFGLAKLMPEGQETFVTARVLGTFGYFDPEYTSTGKLTLQSDVYAFGVVLLELLTGRRAVDLSQGSSDQNLVLQVRHILNDRKKLRKMLDPELSRSSYTMESIAMFANLASRCVRIESSERPSMTECVKELQMIIYINSKALGTALHSFKKV

SEQ ID NO: 6423 - protein, 358 aa, Medicago truncatula
MPFGLVSAWNKRRRSKSRDHSDPWIYKPAEVWQLEDQTPQPTKRRHGSNVFTLKEMESATYSFSDDNLIGKGGFGRVYKGTLKSGEVVAIKKMEMPAIEGEREFRVEVDILSRLDHPNLVSLIGYCADGKHRFLVYEYMQNGNLQDHLNGIRERKMDWPERLRVALGAAKGLAYLHSSSCVGIPIVHRDFKSTNVLLDSNFEAKISDFGFAKLMPEGQEIHVTAGVLGTFGYFDPEYTSTGKLTLQSDVYAYGVVLLELLTGRRAVDLNQGPNDQNLVLQVRHLLNDGKMIRKMIDAEMARNSYTIESISMFANLASRCVHPESNERPSMKDCVKEIQMIIYTNTKGLGMVMHSLRML

SEQ ID NO: 6424 - protein, 353 aa, Vitis vinifera
MPFGLVTAWNKRRRSKSQDHSDPWMYKPVEYWQLDDQNPSTKRRHASSVFTLKEMEEATCSFSDEKLVGKGGFGRVYRGTLRSGEVVAIKKMELPPFKEAEGEREFRVEVDILSRLDHPNLVSLIGYCADGKQRFLVYEYMHNGNLQDHLNGIQDTKMDWPLRLKVALGAARGLAYLHSSSNVGIPIVHRDFKSTNILLNSNFDAKISDFGLAKLMPEGQDSYVTARVLGTFGYFDPEYTSTGKLTLQSDVYAFGVVLLELLTGRRAVDLNQGPNDQNLVLQVRHILNDRKKLRKVIDPEMGRSSYTVESIAMFANLASRCVRTESSERPSMAECVKELQLIFYTNTKGLGML

SEQ ID NO: 6425 - protein, 353 aa, Vitis vinifera
  misc_feature (154)..(154): Xaa can be any naturally occurring amino acid
  misc_feature (313)..(313): Xaa can be any naturally occurring amino acid
MPFGLVTAWNKRRRSKSQDHSDPWMYKPVEYWQLDDQNPSTKRRHASTVFTLKEMEEATCSFSDEKLVGKGGFGRVYRGTLRSGEVVAIKKMELPPFKEAEGEREFRVEVDILSRLDHPNLVSLIGYCADGKQRFLVYEYMHNGNLQDHLNGIXDTKMDWPLRLKVALGAARGLAYLHSSSNVGIPIVHRDFKSTNILLNSNFDAKISDFGLAKLMPEGQDIYVTARVLGTFGYFDPEYTSTGKLTLQSDVYAFGVVLLELLTGRRAVDLNQGPNDQNLVLQVRHILNDRKKLRKVIDPEMGRSSYTVESIAXFANLASRCVRTESSERPSMAECVKELQLIFYTNTKGLGML

SEQ ID NO: 6426 - protein, 490 aa, Glycine max
MREQEDWRITTALLTLLLVFVSSFPALSYGVVPPRTLLNKLSQGSYLTTQEQWFNQTLDHFSPYDHHQFRQRYFEFLDYFRIPDGPIFLVIGGEGPCNGITNDYIGVLAKKFGAAMVTLEHRYYGKSSPFNSLETENLKYLSSKQALFDLAVFRQYYQDSLNAKLNRTKTENPWFVFGGSYAGALSAWFRLKFPHLTCGSLASSAVVLAVYNFTEYDQQIGESAGAECKAVLQETTQLIEHKLATNGKELKASFNADDLEKDGDFMYLIADAAAVAFQYGNPDKVCKPMVEAKNAGEDLVDAYAKYVKEYYIGTFGVNVQTYDQEYLKKTAINEDSSTRLWWFQVCTEVAFFQVAPSNDSIRSSEIDAKYHMDLCKNIFGEGIFPDVDATNLYYGGTKIAGSKIVFANGSQDPWRHASKQTSSPDLPSYTITCSNCAHCTDFRGCPQSPLVLEGNEKNCSSPDAVHKVRQQITEHMDLWLSECQEGSSYI

SEQ ID NO: 6427 - protein, 490 aa, Glycine max
MREQEDWRITTALLTLLLVFVSSFPALSYGVVPPRTLLNKLSQGSYLTTQEQWFNQTLDHFSPYDHHQFRQRYFEFLDYFRIPDGPIFLVIGGEGPCNGITNDYIGVLAKKFGAAMVTLEHRYYGKSSPFNSLETENLKYLSSKQALFDLAVFRQYYQDSLNAKLNRTKIENPWFVFGGSYAGALSAWFRLKFPHLTCGSLASSAVVLAVYNFTEYDQQIGESAGAECKAVLQETTQLIEHKLATNGKELKASFNADDLEKDGDFMYLIADAAAVAFQYGNPDKVCKPMVEAKNAGEDLVDAYAKYVKEYYIGTFGVNVQTYDQEYLKKTAINEDSSTRLWWFQVCTEVAFFQVAPSNDSIRSSEIDAKYHMDLCKNIFGEGIFPDVDATNLYYGGTKIAGSKIVFANGSQDPWRHASKQTSSPDLPSYTITCSNCAHCTDFRGCPQSPLVLEGNEKNCSSPDAVHKVRQQITEHMDLWLSECQEGSSYI

SEQ ID NO: 6428 - protein, 488 aa, Glycine max
MKQEEWMITTALLSLLFVSSFPPLSYGVVPPRTLLNKLSEGKYLNTQELWFDQTLDHFSPYDHRQFRQRYYEFLDYFRIPDGPIFLVIGGEGILNGVANDYLAVLAKKFGAAMVTLEHRYYGKSTPFNSLETENLKYLSSKQALSDLAVFRQYYQDSINAKLNRTKIENPWFIFGGSYSGALSAWFRLKFPHLTCGSLASSAVVLAVYNYTEFDQQIGESAGPECKEALQETTQLIEHKLATSGKELKASFDAADLEIDGDFFYFLADATAIAFQYGNPDKVCKPLVEAKKAGEDLVDAYAKYVKEYYIGTFGTDVQTYDQKYLKRTAMNEDNSARLWWFQVCTEVAYFQVAPSNDSIRSSKVDIKYHLDLCKNVFGEGIFPDVDATNLYYGGTKIAGSKIIFTNGSQDPWRHASKQTSSPDMPSYIVKCYNCGHCSDYRGCPQFPFSIEGNEKNCTSPDAVHKVRQKISEHMDLWLSECVDTGRSFI

SEQ ID NO: 6429 - protein, 488 aa, Glycine max
MKQEEWMITTALLSLLFVSSFPPLSYGVVPPRTLLNKLSEGKYLNTQELWFDQTLDHFSPYDHRQFRQRYYEFLDYFRIPDGPIFLVIGGEGILNGVANDYLAVLAKKFGAAMVTLEHRYYGKSTPFNSLETENLKYLSSKQALSDLAVFRQYYQDSINAKLNRAKIENPWFIFGGSYSGALSAWFRLKFPHLTCGSLASSAVVLAVYNYTEFDQQIGESAGPECKEALQETTQLIEHKLATSGKELKASFDAADLEIDGDFFYFLADATAIAFQYGNPDKVCKPLVEAKKAGEDLVDAYAKYVKEYYIGTFGTDVQTYDQKYLKRTAMNEDNSARLWWFQVCTEVAYFQVAPSNDSIRSSKVDIKYHFDLCKNVFGEGIFPDVDATNLYYGGTKIAGSKIIFTNGSQDPWRHASKQTSSPDMPSYIVKCYNCGHCSDYRGCPQFPFSIEGNEKNCTSPDAVHKVRQKISEHMDLWLSECVDTGRSFI

SEQ ID NO: 6430 - protein, 455 aa, Medicago truncatula
MKPACSLGRFLSTDVIWFNQTLDHFSPYDHRQFRQRYYEFLDYFRAPDGPIFLVIGGEATCNGIVNDYIGVLAKKFGAAVVSLEHRYYGESTPFDTFSTENLKYLSSKQALFDLAVFRQYYQDSLNAKLNRSGVENPWFFFGGSYSGALSAWFRLKFPHLTCGSLASSAVVLAVQDFAEFDQQIGESAGPECKAVLQETTQLVETKLADDGKALRSIFNADDLEIDGDFLYYLADAAVIAFQYGNPDKLCKPLVDAKNAGEDLVDAYAKYVKEYYVGTFGITPKSYDQEYLKKTAINEDSSTRLWWFQVCTEVAYFQVAPSNDSIRSSKIDTKYHLDLCKNIFGDGVFPDVDATNLYYGGTKVAGSKIIFTNGSQDPWRHASKQTSSPDLPSYLIKCNNCGHCTDLRGCPQSPLVIEGNEKNCSSPDAVHKVRQKVQEDMDLWLSECIDSGRSSM

SEQ ID NO: 6431 - protein, 482 aa, Ricinus communis
MVPITVLLSSFLLLFTVSHGFAPPRSFLQSLSGSNTYLTTKELWFNQILDHYSPYDHRRFQQRYYEYLDYFRAPGGPIFLKICGESSCNGIANDYISVLAKKFGAAVVSLEHRYYGKSTPFKSSETKNLRYLSSKQALFDLAVFRQHYQEALNLKLNRTNVENPWIVFGISYSGALSAWYRLKFPHLTCGSVASSAVVLAVYNFTEFDQQIGESAGAECKAALQETTQLVDERLASNRKAVKTLFNAAELEIDGDFLYFLADAAVIAFQYGNPDKLCSPLVEAKKAGEDLVEAYAKYVKEYYVGSFGVSVETYNQKHLKDTAINENSSDRLWWFQVCTEVAYFQVAPSNDSIRSSKVNTRYHLDLCKNVFGEGIYPEVDTTNIYYGGTKIAGSKIVFTNGSQDPWRHASKQISSPDTPSYIITCHNCGHGTDMRGCPQSPLSLEGNAQNCSSPDAVQKVRQQVIEHIDLWLSECEASGRSYI

SEQ ID NO: 6432 - protein, 485 aa, Populus trichocarpa
MTTMKLVFISLLLLSTAPYASLALRTQVHSLSESSNSKNYLTTQELWFNQTLDHFSPFDHHKFPQRYYEFLDYFRISDGPIFLEICGESSCNGIVNDYISVLAKKFGAAVVSLEHRYYGRSLPFKSTTTENLRFLSSKQALFDLAVFRQYYQESLNLKLNRTSVENPWFVFGGSYAGALSAWFRLKFPHLTCGSLASSAVVLAIHNFTEFDQQIGESAGAECKATLQETTQLVEERLASNKQAVKALFDAAELEIDGDFLYFLADAAVIAFQYGNPDIVCSTLVKAKNNGDDLVEAYAKYVKEYYLGTFGSSVQTYNQKYLKDTSLNKHTGDRLWWFQVCTEVAYFQVAPSNDSIRSSKVDARYHLDLCKNVFGEGIYPEVDVTNIYYGGTNISGSKIVFANGSQDPWRHASKQTSSPDMPSFLISCHNCGHCTDIRGCPQTPLSLEGNARNCSSPEAVEKVRHQIIEKMDLWLSECRAGSWSSM

SEQ ID NO: 6433 - protein, 478 aa, Medicago truncatula
MMSPCLLVFLFFISTVSATPHLLRRRLSESARYLTKEELWFPQTLDHYSPYDHRKFQQRYYEFLDHFRIPDGPVFLVICGEYSCDGIRNDYIGVLAKKFGAAVVSLEHRYYGKSSPFKSLATKNLRYLSSKQALFDLAVFRQNYQDSLNAKLNRTNADNPWFVFGVSYPGALSAWFRLKFPHLTCGSLASSAVVLAVYNFTEFDQQIGESAGVECKAALQETTRLIERKLVTNGKALKASFNAADLEIDGDFLYFLADAAVTAFQYGNPDILCKPLVKAKKDGEDLVDAYAKFIKEFYLGTEGESTQDYNQNNLKNAAITENSSGRLWWFQVCTEVAYFQVAPSNDSIRSSKVDTRYHLDLCKNVFGEGIFPDVDATNIYYGGTKIAGSKIVFTNGSQDPWRRASKQISSPNMPSYTITCHNCGHGTDMRGCPQSPFNIEGNEKNCTSPDAVHKVRQKIIEHMDLWLSQCQDTGRTCI

SEQ ID NO: 6434 - protein, 490 aa, Populus trichocarpa
MEMMKLALMSTFLFFLLFSTASHAYLAPRTLLYSFSKSSTNSNRSLTTKELWFNQTLDHYSPFDHHKFQQRYYEFLDYFRVPDGPIFLKICGESSCDGIANDYIGVLAKKFGAAVVSLEHRYYGKSSPFKSTTTENLRYLSSKQALFDLAVFRQYYQESLNLKLNRTGVENPWFVFGVSYSGALSAWFRLKFPHLTCGSLASSAVVLAVYNYTEFDQQIGESAGAECKAALQETTQLVEERLASNKKAVKTLFDAAELEIDGDFLYFLADAAATAFQYGNPDKLCPPLVQAKKDGEDLVEAYAKYVKEDYVGSFGVSVQTYDQRHLKDTTLNENSGDRLWWFQVCTEVAYFQVAPANDSIRSSQVDTRYHLDLCKKVFGEGIYPEVDKTNIYYGGTNMAGSKIVFTNGSQDPWRHASKQISSPDMPSFVMSCHNCGHGTDMRGCPQSPFNIEGNARNCGSPDAVEKVRHQIIEKMDLWLSECHASGRSSM

SEQ ID NO: 6435 - protein, 487 aa, Populus trichocarpa
MTTMKLVFISLLLLSTAPYASLALRTQVHSLSESSNSKNYLTTQELWFNQTLDHFSPFDHHKFPQRYYEFLDYFRISDGPIFLEICGESSCNGIVNDYISVLAKKFGAAVVSLEHRYYGRSLPFKSTTTENLRFLSSKQALFDLAVFRHTIHMQESLNLKLNRTSVENPWFVFGGSYAGALSAWFRLKFPHLTCGSLASSAVVLAIHNFTEFDQQIGESAGAECKATLQETTQLVEERLASNKQAVKALFDAAELEIDGDFLYFLADAAVIAFQYGNPDKLCPPLVQAKKDGEDLVEAYAKYVKEDYVGSFGVSVQTYDQRHLKDTTLNENSGDRLWWFQVCTEVAYFQVAPANDSIRSSQVDTRYHLDLCKKVFGEGIYPEVDKTNIYYGGTNMAGSKIVFTNGSQDPWRHASKQISSPDMPSFVMSCHNCGHGTDMRGCPQSPFNIEGNARNCGSPDAVEKVRHQIIEKMDLWLSECHASGRSSM

SEQ ID NO: 6436 - protein, 520 aa, Medicago truncatula
MSSSEEASSMETTTIDKDLHVTFAQMMYHLLPNPYESQEINHLTLAYFVISSLDILNSLHLVEKEAVANWVLSFQVQRGTTNDPNNGQFYGFHGSKTSQFPPDENGVFHHNNSHLASTYCALAILKIVGYDLSSLDSESMSSSMKNLQQPDGSFMPIHIGGETDLRFVYCAAAICFMLDNWNGMDKEKVKDYILNCQSYDGGFGLVPGAESHGGATYCAIASLRLMGYVEDNVLSSCNLSSLIDLPLLLDWILQRQGTDGGFQGRPNKSTDTCYAFWIGGVLRILGGCNFVDNKALRGFLLSCQYKYGGFSKFPGDFPDLYHSYYGFAAFSLLEESGLKSLCSELGITNMAANGIVIELAILKRNTSYYSLKKYFKGSPMQEKKNQRKTLRLYQPLIHQMSSLHNLVGKGIISSSSSVSLSSTSKYFGGFASFQAASVYRKQRIDPSSGYKSVAGVNEVVKRVRGESLHFSPTRSRRRRLGTFDSIVVGMMEPRVLKLEKKKTMNEFGFWFDGKKKKVRE

SEQ ID NO: 6437 - protein, 520 aa, Medicago truncatula; identical to SEQ ID NO: 6436

SEQ ID NO: 6438 - protein, 455 aa, Medicago truncatula; identical to SEQ ID NO: 6430

SEQ ID NO: 6439 - protein, 490 aa, Glycine max; identical to SEQ ID NO: 6426

SEQ ID NO: 6440 - protein, 187 aa, Glycine max
MASCFPNASPFLVMLAMCLLISTSEAEKYVVGGSEKSWKFPLSKPDSLSHWANSHRFKIGDTLIFKYEKRTESVHEGNETDYEGCNTVGKYHIVFNGGNTKVMLTKPGFRHFISGNQSHCQMGLKLAVLVISSNKTKKNLLSPSPSPSPPPSSLLSPSPSPLPNNQGVTSSSGAGFIGVMMWLMLLL

SEQ ID NO: 6441 - protein, 187 aa, Glycine max
MASCLPNASPFLVMLAMCLLISTSEAEKYVVGGSEKSWKFPLSKPDSLSHWANSHRFKIGDTLIFKYEKRTESVHEGNETDYEGCNTVGKYHIVFNGGNTKVMLTKPGFRHFISGNQSHCQMGLKLAVLVISSNKTKKNLLSPSPSPSPPPSSLLSPSPSPLPNNQGVTSSSGAGFIGVMMWLMLLL

SEQ ID NO: 6442 - protein, 189 aa, Glycine max
MASCFPNASPFLVMLAMCLLISTSEAEKYVVGGSEKSWKFPLSKPDSLSHWANSHRFKIGDTLIFKYEKRTESVHEVNETDYEGCNTVGKYHIVFNGGNTKVMLTKPGFRHFISGNQSHCQMGLKLAVLVISSNKTKKNLLSPSPSPSPPPSSLLSPSPSPLPNNQGVTSSSGAGFIGVMMWVDVIALN

SEQ ID NO: 6443 - protein, 201 aa, Glycine max
MASCLPNNASPFLFMLSMWLLISISEAAKYVVGGSETWKFPLSKPDSLSHWASSHRFKIGDTLIFKYDERTESVHEVNETDYEQCNTVGKEHVLFNDGNTKVMLTKSGFRHFISGNQSHCQMGLKLMVVVMSNNTKKKLIHSPSPSPSPSPSPSPSPSPSPSPSLSSPSPSPLPNNQGVTRSSGAEFIGVMMWLGVMMLLL

SEQ ID NO: 6444 - protein, 279 aa, Glycine max
MDYSAGSSLFPLHRCKTIHLVRHAQGIHNVEGDKNYKAYMNPDYFDAHLTPLGWQQVDNLRKHVRDSGLINTIDLVIASPLMRTLQTTVGVFGGEGYTDKTDVLPLMVANAGNSYRAAISSLNSPPIVTVELCREHLGVHPCDRRRSVSEYQFLFPAVDFSLLDSDEDTWWKANVRETKEELAARGMKFLNWLWTRKEKEIAIVTHSGFLFHTLNAFGSDCHPLVKKEISKHFANCELRSMVIVDRGMIGLEQSTTNYPGKIPSGLDLPSDVADEKSEK

SEQ ID NO: 6445 - protein, 324 aa, Glycine max
MDCVAGSSLFPLHRCKTIHLVRHAQGIHNVEGDKNYNAYINPDYFDAHLTPLGWQQVDNLRKHVRDSGLINTIDLVIASPMMRTLQTAVGVFGGEGYTDKTDVLPLMVANAGNSYRAAISSLNSPPVVAVELCREHLGVHPCDRRRSVSEYQFLFPAVDFSLLDSDEDTWWKANIRETKEELAARGLKFLNWYELLWTQKEKEIAIVTHSGFLFHTLNAFGSDCHPLVKKEISKHFANCELRSMVIVDRSMIGSELSTTNYPGKIPSGLDLPSDVADEKEACSRKKEFVPVTAKNTPLSLIAVDPKGITLLVKTESNASSAINC

SEQ ID NO: 6446 - protein, 283 aa, Medicago truncatula
MDCGAGTCLFPLHRCKTIHLVRHAQGIHNVEGDKNYKAYLNPDYFDAHLTPLGWEQVDNLRKHVHSSGLINKIDLVIASPLMRTLQTAVGVFGGEGYTDDKTDVLPLMVANAGNSFHGAISSHNCPPIVAGELCREHLGVHPCDKRRSVSEYQFLFPAVDFSLIDSDEDVWWKDNVRETKEELAARGVEFLNWLWTRKEKEIAIVTHSGFLFHTLTTFGNDCHPLVKKEISKHFANCELRSMVLVDRNMIGSEASTTNYPGKIPSGLDKPSDAVDENVEKQGV

SEQ ID NO: 6447 - protein, 287 aa, Vitis vinifera
MDSGAGPSLFPLHRCKTLHLVRHAQGIHNVDGDKNYKAYLSPAFFDAQLTHLGWQQVDNLRKHVHACGLAKRIELVITSPLLRTMQTAVGVFGGEGYKDRMDVLPLMVANAGECNRSAISSLDSPPFLAVELCREHLGVHPCDKRRSISDYQFLFPAIDFSLIESDEDILWKANVRETNEEVAARGLKFMNWLWTRKEKEIAIVTHSGFLFHTLNAFGNDCHPLVKTEICKHFANCELRSMIIVDRSMAGSDSSTTNYPGKIPPGLDLPSDIADGKLENEARNSGLT

SEQ ID NO: 6448 - protein, 287 aa, Vitis vinifera
MDSGAGPSLFPLHRCKTLHLVRHAQGIHNVDGDKNYKAYLSPAFFDAQLTHLGWQQVDNLRKHVHACGLAKRIELVITSPLLRTMQTAVGVFGGEGYKDRMDVLPLMVANAGECNRSAISSLDSPPFLAVELCREHLGVHPCDKRRSISDYQFLFPAIDFSLAKSDEDILWKANVRETNEEVAARGLKFMNWLWTRKEKEIAIVTHSGFLFHTLNAFGNDCHPLVKTEICKHFANCELRSMIIVDRSMAGSDSSTTNYPGKIPPGLDLPSDIADGKLENEARNSGLT

SEQ ID NO: 6449 - protein, 338 aa, Ricinus communis
MTIFICTFISPINHHTISLTHHHHSISSSSSSSSSSTALFPLVCSSSSSFPVADMDGAPGPSLFPLHRCKTIHLVRHAQGMHNVEGDKNYKAYLSPKYYDAQLTQLGWQQVDNLRKHVQTCGLSKRIDLVVTSPLLRTLQTAVGVFGGEGYTNKVDTLPLMVANAGDSARAAISSFNSPPFIAVELCREHFGVHPCDKRRNISEYQFLFPAIDFSLIETDEDVLWKADVRETTKELTDRGLKFMNWLWTRKEKEIAIVTHSGFLFHTLSAFGNDCHPLVKKEICNRFTNCELRSMVIVDRSMIGTDPSTTNYPGKIPRGLDLPSDALEEDGPTTNSVV

SEQ ID NO: 6450 - protein, 282 aa, Arabidopsis thaliana
METGAGIGLYPLHRCKTIYLVRHAQGIHNVDGEKNYKAYMSHDYFDAELTQLGWKQVDSLRKHVHSSGLHKKIELVISSPLMRTLQTAVGVFGGEGYTDMSDVLPLMVANAGNSSRAAISSLNCPPVITEESCREHLGVHPCDQRRSISDYQFLFPAVDFSLIESEEDKLWKADVRETIEELAARGKKFLNWLWTRKEKEIAIVTHSGFLFHTLNALQNECHPDVKKEICGHFANCELRSMVIVDRSMLGSDSSVTDYPGKIPKGIDLPSDAVVDDNNIKVE

SEQ ID NO: 6451 - protein, 282 aa, Arabidopsis lyrata subsp. lyrata
METGAGIGLYPLHRCKTIYLVRHAQGIHNVDGEKNYKAYMSHDYFDAELTQLGWQQVDSLRKHVHSSGLHKKIELVISSPLMRTLQTAVGVFGGEGYTDMSDVLPLMVANAGNSSRAAISSSNCPPIITEESCREHLGVHPCDQRRSISDYQFLFPAVDFSLIKSEEDKLWKADVRETIEELAARGKKFLNWLWTRKEKEIAIVTHSGFLFHTLNALQNECHPDVKKEICSHFANCELRSMVIVDRSMLGSDTSVTDYPGKIPKGSDLPSDAVVDDNNIKVE

SEQ ID NO: 6452 - protein, 281 aa, Populus trichocarpa
MDSGPDPSLYPLHRCKTIHVVRHAQGLHNVEGEKNYKAYLNPEYLDAPLTQLGWQQVNYLRKHVHASGLSKRVELVVTSPLLRTLQTAVGVFGGEGYTDGMNALPLMVANVGNSGREAISSRNSPPFIAVEDCREHFGVHPCDKRHNVSEYQFLFPAVDFSLIETDEDVLWKADVRETTEELAARGLKFLNWLWTRKEKEIAIVTHSGFLVHTLRAFGTDCHPLVKKEMDTRFANCELRSMVIVDRSMIGSDVSTTNYPGKIPSGLDFPSDVGEEEAPNSI

SEQ ID NO: 6453 - protein, 281 aa, Populus trichocarpa
MDSGPGPSLYPLHRCKTIHLVRHAQGLHNVEGEKNYKAYLNPEYLDAPLTQLGWQQVDNLRKHVHASGLSKRVELVVTSPLFRTLQTAVGVFGGEGYTDGANPLPLMVANAGSSGRAAISSHNSPPFIAVEDCREHFGVHPCDKRHNVSDYQFLFPAVDFSLIETDEDLLWKADVRESTEELAARGLKFLNWLWTRKEKEIAIVTHSGFLVHTLRAFGNDCVPSVKKEMCTRFANCELRSMVIVDRSMIGSDVSTTNYPGKVPPGSDLPSDDAEEEAPNSI

SEQ ID NO: 6454 - protein, 526 aa, Glycine max
MIVKKGFLTTVAQKCNTLTQLKQLHAHILRCRINDTPYALAPLLSVLATSNDASFFSYARSIFRHLTNRNTFMHNTMIRGYLQCRSPLHAVSCYLSMLQNGVAVNNYTFPPLIKACIALLPSSPSNIVGRLVHGHVVKFGLRNDPYVVSAFIEFYSVSREVDTARVLFDETSYKDVVLGTAMVDGYGKMGNVKSAREVFDKMPERNAVSWSAMMAAYSRVSDFKEVLALFTEMQNEGTEPNESILVTVLTACAHLGALTQGLWVHSYARRFHLESNPILATALVDMYSKCGCVESALSVFDCIVDKDAGAWNAMISGEALNGDAGKSLQLFRQMAASRTKPNETTFVAVLTACTHAKMVQQGLWLFEEMSSVYGVVPRMEHYACVIDLLSRAGMVEEAEKFMEEKMGGLTAGDANVWGALLNACRIHKNIHVGNRVWKKLVDMGVTDCGTHVLTYNIYREAGWDVEANKVRSRIEEVGMKKKPGCSIIEVDNEVEEFLAGDHSHPQAQEMCKLLDSILKMGTLEHF

SEQ ID NO: 6455 - protein, 640 aa, Glycine max
MKLQFSIVALVLLGSTLSFCGLIVADLNSDQHALLEFASSVPHAPRLNWKNDSASICTSWVGVTCNSNGTRVVGLHLPGMGLTGTIPENSIGKLDALRVLSLHSNGLIGSLPSNVLSIPSLQFAYLQHNSFSGLIPSPVTPKLMTLDISFNSFSGTIPPAFQNLRRLTWLYLQNNSISGAIPDFNLPSLKHLNLSYNNLNGSIPNSIKAFPYTSFVGNALLCGPPLNHCSTISPSPSPSTDYEPLTPPATQNQNATHHKENFGLVTILALVIGVIAFISLIVVVFCLKKKKNSKSSGILKGKASCAGKTEVSKSFGSGVQGAEKNKLFFFEGSSHSFDLEDLLKASAEVLGKGSYGTAYKAVLEEGTTVVVKRLKEVVVGKKEFEQQLQIVGRIGNHPNVMPLRAYYYSKDEKLLVYNYMPGGSLFFLLHGNRGAGRSPLDWDSRVKILLGAARGIAFIHSEGGPKFSHGNIKSTNVLITQELDGCISDVGLPPLMNTPATMSRANGYRAPEATDSKKISHKSDVYGFGVLLLEMLTGKTPLRYPGYEDVVDLPRWVRSVVREEWTAEVFDEELLRGQYVEEEMVQMLQIALACVAKGSDNRPRMDEVVRMLEEIKHPELKNHHRQSSHESDSNVQTPTP

SEQ ID NO: 6456 - protein, 642 aa, Glycine max
MKVQFSIVALVLLGSTLCLSGLIVADLNSDQQALLEFASSVPHAPRLNWKKDSVSICTSWVGVTCNSNGTRVVGLHLPGMGLIGTIPENSIGKLDALRVLSLHSNGLIGSLPSNILSIPSLQFAYLQHNGFSGIIPSPVTPKLMALDISFNNFSGSIPPAFQNLRRLTWLYLQNNSISGAIPDFNLPSLKHLNLSNNNLNGSIPNSIKTFPYTSFVGNSLLCGPPLNHCSTISPSPSPATDYQPLTPPTTQNQNATHHKKNFGLATILALVIGVIAFISLIVVVICVFCLKKKKNSKSSGILKGKASCAGKTEVSKSFGSGVQGAEKNKLFFFEGSSHSFDLEDLLKASAEVLGKGSYGTAYKAVLEEGTTVVVKRLKEVVVGKKEFEQQLEIVGRVGSHPNVMPLRAYYYSKDEKLLVYNYMPGGSLFFLLHGNRGAGRTPLDWDSRVKILLGAAKGIAFIHSEGGPKFAHGNIKSTNVLINQELDGCISDVGLPPLMNTPATMSRANGYRAPEVTDSKKITHKSDVYSFGVLLLEMLTGKTPLRYPGYEDVVDLPRWVRSVVREEWTAEVFDEELLRGQYVEEEMVQMLQIALACVAKGPDQRPRMDQVVRMLEEIKHPELKNYHRQSSESESNVQTPTP

SEQ ID NO: 6457 - protein, 648 aa, Glycine max
MKFQFHAVPFVLLSFTVSLFGLIEADLNSDKQALLEFFSNVPHAPRLNWSESTPICTSWAGVTCNQNGTSVIEIHLPGAGFKGSIPENSLGKLDSLKILSLHSNGLRGNLPSDILSIPSLQYVNLQQNNFSGLIPSSISPKLIALDISSNNFSGSIPTTFQNLSRLTWLYLQNNSISGAIPDFKNLTSLKYLNLSYNNLNGSIPNSINNYPYTSFVGNSHLCGPPLNNCSKASNPSSSTSSLSPSHSPVSQPLSPAETPQNRTATTSKSYFGLATILALAIGGCAFISLLVLIIFVCCLKRTKSESSGILTGKAPCAGKAEISKGFGSGVEEAEKNKLFFFEGCSYSFDLEDLLKASAEVLGKGSYGTTYRAALEDGTTVVVKRLREVLVGKKEFEQQMEVVGRIGRHPNVMPLRAYYYSKDEKLLVYDYISRGSLFSLLHGNRGMGRAPLDWDSRMKIALGAAKGIASIHTDHMDSKLTHGNIKSSNVLINQQHDGCITDVGLTPMMSTQSTMSRANGYRAPEVTEYRRITQKSDVYSFGVLLLELLTGKAPLGYPGYEDMVDLPRWVRSVVREEWTAEVFDEELLRGQYFEEEMVQMLQIALACVAKVSDNRPTMDETVRNIEEIRLPELKNRNTSSESDSNVQTP

SEQ ID NO: 6458 - protein, 650 aa, Glycine max
MKFQFHAVPFVLLSFTVSLFGLIEADLNSDRQALLEFFSNVPHAPRLNWSDSTPICTSWAGVTCNQNGTSVIEIHLPGAGFKGSIPKNSLGKLDSLKILSLHSNGLRGNLPSDILSIPSLQYVNLQQNNFSGLIPSTISPKLIALDISSNNFSGSIPTTFQNLSRLTWLYLQNNSISGAIPDLKNLTSLKYLNLSYNNLNGSIPNSIINYPYTSFVGNSHLCGPPLNNCSAASPPSSSTSSLSPSPSPSPVYQPLSPAATPQNRSATTSKSYFGLATILALAIGGCAFISLLLLIIFVCCLKRNKSQSSGILTRKAPCAGKAEISKSFGSGVQEAEKNKLFFFEGCSYSFDLEDLLKASAEVLGKGSYGTTYRAALEDGTTVVVKRLREVLVGKKEFEQQMEVVGRIGRHPNVMPLRAYYYSKDEKLLVYDYISGGSLFSLLHGNRGMGRAPLDWDSRMKIALGAAKGIASIHTDHMDSKLTHGNIKSSNVLITQQHDGCITDVGLTPMMSTQSTMSRANGYRAPEVTEYRRITQKSDVYSFGVLLLELLTGKAPLGYPGYEDMVDLPRWVRSVVREEWTAEVFDEELLRGQYFEEEMVQMLQIALACVAKLADNRPTMDETVRNIQEIRLPELKNPNTSSESDSNLQTP

SEQ ID NO: 6459 - protein, 264 aa, Glycine max
MWNFASNCIAGTVGLKNDSKPTHSASECSDDENSVIGREEGLECPICWESFNIVENVPYVLWCGHTLCKNCILGLQWAVVKFPTLPVQLPLFISCPWCNLLSFRLVYRGNLKFPRKNYFLLWMVESMNGDRGKSHSPFCGDNQQHSIKDNLTMGSQVSHGNLRRGLVRHPETSSSNQYHGNTGNHLNTERFHVYLRKSLIFFVQLTAKFPLVIIFLLIVLYAIPASAAILALYVLVTILFALPSFLILYFSYPSLDWLVREIIT

SEQ ID NO: 6460 - protein, 264 aa, Glycine max
MWNFASNCIAGTVGLKNDSKPTHSASECSDDETSVIGREEGLECPICWESFNIVENVPYVLWCGHTLCKNCILGLQWAVVKFPTLPVQLPLFISCPWCNLMSFRLVYRGNLKFPRKNYFLLWMVESMNGDRGKSHSPFCSDNQQHSIKDNLTTGSQVSHGNLRRGQVCHPETLSSNLYHGNTGNHLNTERFHVYLWKSLIFFVQLTAKFPLVIIFLLIVLYAIPASAAILALYVLVTILFALPSFLILYFSYPSLDWLVREIIT

SEQ ID NO: 6461 - protein, 266 aa, Medicago truncatula
MWNFASNCIAGNVGLKKDSSNPTHSASECSDDETSVVGREEGLECPVCWESFNIVENVPYVLWCGHTLCKNCILGLQWATVKFPTLPVQLPLFISCPWCNLLSFRLVYRGNLRFPRKNYFLLWMVEGMNGDRVKSHSTCCGDNQQQCASKGNLTLGGQVNHGNLQGGQVHPPDTSNSSQPRANTRNHLDMERVHISLRKSLIFFVQLTAKFPLIIIFLLIILYAVPASAAILALYILVTILFALPSFLILYFSYPSLDWLVREIIA

SEQ ID NO: 6462 - protein, 267 aa, Glycine max
MWNFASSLIAGSVGLKNDSAKPTHPASECSDDETSMVTREERLECPICWESFNIVENVPYVLWCGHTLCKNCILGLQWAVVKFPTLPIQLPLFISCPWCNLLSLRLVYRGNLKFPRKNYFLLWMVESMNGDRVKSHSTVCGDHQPVWPIIKDSLTNGSQEGHGIPWRGQVCHTESSSSNQYHGNTSNYLSIETLHTSLRKSLVLFVHLIAKFPLIIIFLLIVLYAIPASAAILALYILVTILFALPSFLILYFAYPSLDWLVREIIT

SEQ ID NO: 6463 - protein, 266 aa, Glycine max
MWNFASSLIAGSVGLKNDSPKPTHSASEFSDDETSMVSREERLECPICWESFNIVENVPYVLWCGHTLCKNCILGLQWAVVNFPTLPIRLPLFISCPWCNLLSLRLVYQGNLKFPHKNYFLLWMVESMNGDRVKSHSTVCGDHQPVWPIIDSLTNGSQVSHDSLQGGQVCHPESSSSNHYHGDTSNYLSIETLHTSLRKSLVLFVHLTAKFPLIIIFLLIVLYAIPVIAAILALYILVTILFALPSFLILYFAYPSLDWLVREIIT

SEQ ID NO: 6464 - protein, 268 aa, Vitis vinifera
MWNFASNALSGTNGLKNDLLKPNQAPSECSDDEISTNTSREEGLECPICWESFNIVENVPYVLWCGHTLCKNCVLGLQWAVVKFPTLPIQLPFFISCPWCNLLSFRLVYKGNLTFPRKNFFLLWMVESMNGDRGKSHSSFCDHQPGWSSNRNLIIGNQGSHVNHRRPPYSHLPEQSESNHDGGHLINRFLNIERLHLSVRKSLVFFVHLTAKFPLVIIFLLIVLYAIPASAAILALYILITVLFALPSFLILYFAYPSLDWLVREIIT

SEQ ID NO: 6465 - protein, 267 aa, Populus trichocarpa
MWNFASKCLAGSVSLNNSLKPAQVPSEYSDDEASSVVSREEGLECPICWESFNIVENVPYVLWCGHTLCKNCILGLQWAVVKFPTLPIQLPLFISCPWCNLLSFRLVYRGNLKFPRKNYFLLWMVESKNGDREKSHGTFCEDQQPHWSSDSNLALGNQASRGNIRRGQYVHHAEPSEANHDHNHVNSYLNVRRIHSSLQKSLVFFVHLTAKFPLVIIFLLIILYAIPASAAILALYILITVLFALPSFLILYFAYPSLDWLVREIIT

SEQ ID NO: 6466 - protein, 269 aa, Vitis vinifera
MWNFASNCIAGSVGLKNNSPKPTQVASECSDDEVSSNISREEGLECPICFESFNIVENVPYVLWCGHTLCKNCILGLHWAVVKFPTLPIQLPLFISCPWCNLLSFRLVYKGSLKFPRKNYFLLWMLESMNGDREKSHSSFSGDHHQPVWSSDSNLALGSQVNHRILRREQFIHHSGPSGSNHEDGHVNNYLTLERLHSSLHKSLVFFVQLTAKFPLVVILLLIVLYAIPASAAILALYILITVLFALPSVLMLYFAYPSLDWLAREIIT

SEQ ID NO: 6467 - protein, 266 aa, Populus trichocarpa
MLNFASNCLAGSVSMNNSTKPTQVPSEYSDDEASSFSREEALECPICWESFNIVENVPYVLWCGHTLCKNCVLGLQWAVVKFPTLPIRLPLFISCPWCNLSSFRFVYRGNLKFPRKNYFLLWMVESKNGDRDKSPGTFCEDHQPHWSSDSNLAHGSRVSRGNIRRGHYIHHSEPSGTHHDHNHVNSYLNVERIHSSLQKSLAFFVSLTAKFPLVIIFLLIILYVIPASASILALYILITVLFALPSFLILYFAYPSLDWLVREIIT

SEQ ID NO: 6468 - protein, 264 aa, Ricinus communis
MWNFASNCIAGSVGVNSSPKLTQAALESSDDEASSVVSREEGLECPICWESFNIVENVPYVLWCGHTLCKNCILGLQWAVVKFPTLPIQLPLFISCPWCNLLSFRLVYRGNLKFPRKNYFLLWMVESKNEDGHKCQNTLYEDHQPLWSSDNNLSSGNQLSRSNIRREHHSEPSGVNHDHNNGNILLNMGRIHSSLQKSLVFFVHLTAKFPLVIIFLLIILYAIPASAAILALYILITVLFALPSFLILYFAYPSLDWLFREIIT

SEQ ID NO: 6469 - protein, 284 aa, Glycine max
MVAIEKKTQSSLHLRRNSFPAAAHPLVSQFEEQLQRLRGSEATSSLSSSSVCHKLNDMLDLHDYTDKLLQLPIEQQVLARECNDKCVDDLLEQSLRLLDICNTAKECLLQSKESMCDLVSVIRRKKNNEIGFTIEGAKYLVVRKKMKKQIRKALENLKQKDKNTSPMLSFLNEAEAITLSSLEQMLLFISGPKGHSKHSRWSAISKLMQPKRVMCDSQESNTNEFEKVDAALQSLISLKPSSIENFESHMENLELCIQDLEIGVDQLSRKLIRNRVSLLNIFNH

SEQ ID NO: 6470 - protein, 284 aa, Glycine max
MAAIEKKTQSSLHLRSNSLPSAAHPLVSQLEEQLQRLRGSEATSSLSSSSVCLKLNDMLDLHDYTDKLLQLPMEQQVSAQECNDRCVDDLLEGSLRLLDICSTTKDCLLQSKESMCDLMSVIRRKKSNETGFAVEGVKYLAARKNMKKQIRKALENLKQKDNNTSPMLNFLNEAEAITLCSLEQLLLFISGPKRHSKHSRWSAISMLMQPKRVICDSQEANTNEFEKVDAALQSLISHRPSSIENFHSHMENLEFCIQDLEIGVDQLSRKLIRNRVSLLNIFNH

SEQ ID NO: 6471 - protein, 282 aa, Glycine max
MAQTYGRRHELSNYKQKDKNANHRSGIETLYALPSTHLFPKKKKWQPLKRKHKALYIFAATACPLVSQLEEQLQRLRCSEATSSLSSSSVCHKLNDTLDLHDYTDKLLQLPIEQQVLAQECNDKCVDDLLEGSLRLLDICAKYLVVRKKMKKQIRKVLENLKQKDKNTSPMLSFLNEAEAITLSNHPELIRTNATHSRWSAISKLMQPKRVMCDSQESNTNEFEKVDAALQSLISLKPSSIENFESHMENLELCIQDLEIGVDQLSRKLIRNRVSLLNIFNF

SEQ ID NO: 6472 - protein, 474 aa, Glycine max
MKDTIVLYPNLGRGHLVSMVELGKLILTHHPSLSITILILTPPTTPSTTTTTLACDSNAQYIATVTATTPSITFHRVPLAALPFNTPFLPPHLLSLELTRHSTQNIAVALQTLAKASNLKAIVIDFMNFNDPKALTENLNNNVPTYFYYTSGASTLALLLYYPTIHPTLIEKKDTDQPLQIQIPGLSTITADDFPNECKDPLSYACQVFLQIAETMMGGAGIIVNTFEAIEEEAIRALSEDATVPPPLFCVGPVISAPYGEEDKGCLSWLNLQPSQSVVLLCFGSMGRFSRAQLKEIAIGLEKSEQRFLWVVRTELGGADDSAEELSLDELLPEGFLERTKEKGMVVRDWAPQAAILSHDSVGGFVTHCGWNSVLEAVCEGVPMVAWPLYAEQKMNRMVMVKEMKVALAVNENKDGFVSSTELGDRVRELMESDKGKEIRQRIFKMKMSAAEAMAEGGTSRASLDKLAKLWKQS

SEQ ID NO: 6473 - protein, 473 aa, Glycine max
MKDTIVLYPNLGRGHLVSMVELGKLILTHHPSLSITILILTPPTTPSTTTTLACNSNAQYIATVTATTPSITFHRVPLAALPFNTPFLPPHLLSLELTRHSTQNIAVALQTLAKASNLKAIVMDFMNFNDPKALTENLNNNVPTYFYYTSGASPLALLLYYPPINQVLIEKKDKDQPLQIQIPGLPTITADDFPNECKDPLSYVCQVFLQIAETMMGGAGIIVNTFEAIEEEAIRALSEDATVPPPLFCVGPVISAPYGEEDKGCLSWLNLQPSQSVVLLCFGSMGRFSRAQLKEIAIGLEKSEQRFLWVVRTELGGADDSAEELSLDELLPEGFLERTKEKGMVVRDWAPQAAILSHDSVGGFVTHCGWNSVLEAVCEGVPMVAWPLYAEQKMNRMVMVKEMKVALAVKENKDGFVSSTELGDRVRELMESDKGKEIRQRIFKMKMSAAEAMAEGGTSRASLDKLAKLWKQS

SEQ ID NO: 6474 - protein, 474 aa, Glycine max
MKDTIVLYPNVLRGHLVSMVELGKLILTHHPSLSITILILTPTTTSSTTSVSCNSNARYIATVTATTPAITFHHAPFATLPPSTPSLPSHILSIELTRHSTQNLAVALQTLAKASNLKALVIDFMNFNDPKALTENLNNNVPTYFYFASCASFLSLLLRLPTIHQTVTREKVKDQPLQIQIPGLPTISTDDFPNEAKDPSSESYQSLLQVAENMRCSVGIIANTFEALEEKSIRALCKDGTLPPLFFIGPLISAPYEEDKGCLSWLDSQPSQSVVLLSFGSLGRFSRAQLKEIAIGLEKSEQRFLWVVRSRLDDADSMEELSLDELMPEGFLERTKEKGLIMRNWAPQVQLLSHDSVGGFVTHCGWNSVLEAVCEGVPMVAWPLYAEQKMNRVIMVKEMKVALEVNENKDGLVSATELGDRVRELMDSVKGKEIRQRVFEMKKRAEEAMAEGGTSCVTLDKLAIKLWKGNMIDI

SEQ ID NO: 6475 - protein, 470 aa, Vigna angularis
MKDTIVLYPNIGRGHLVSMVELGKLILSHHPSLSITILILTPSPNATFTLASNSNAQYIAAVSATIPAITFHSVPMAQLPLDTHSLPPHLISVDLSRHSTHNVALALQSLVKGSNIKALVMDFLNFSNPKTLTENLTTNIPTFFYYTSAASSLVVLFHMSTTLPKQIKDEQFLLHFPGLPAISTDDFPNESLDPLNYTNQIFSQIAEAMKGSSGIIINTCEAIEEKAIAVLNDDGTVPPLFCVGPVISASYGEKDKGCLSWLESQPSQSVVLLCFGSMGLFSREQLKEMAIGLEKSQQRFLWVVRTELECGDSVEEKPSLNELLPEGFLERTKEKGLVVRDWAPQREILSHDSVGGFVTHCGWNSVLESVCEGVPMVAWPLYAEQKLNRVFMVQEMKVALALKEEKDGSVSGSELGERLKELMESDKGKEIRQKVFKMKLSAAEALGERGTSRVALNKLATLWETSYFTI

SEQ ID NO: 6476 - protein, 474 aa, Glycine max; identical to SEQ ID NO: 6472

SEQ ID NO: 6477 - protein, 1750 aa, Glycine max
MPPRIAPPPPADPSTDPTSPFFVHPSDGPSSVKVTPLLDGSNYHSWARSLRRALGAKLKFEFLDGTIPMPVDAFDPSFRAWNRCNMLIHSWILNSVEPSISRSIVFMDNASDVWLDLKERFSQGDLVRVSEIQQEIYALTQGTRSVTTFYSDLKALWEELEIYMPIPNCTCHHRCSCDAMRLARRHHHTLHVMRFLTGLNDEFNAVKSQILLIEPLPSITKIFSMVIQFERQNCVPNLDDSKALVNASTSKSQGSANGRSNSGSKRYCTYCHKTNHFVENCFQKHGVPPHMMKNHSGSAHHSAVDGGERVESSTASQNTTSVTMTPSLTQEQLDKLLQLIQPPSVNHCNASTSKQVCSFNTAGPSSADTKGMKISHFFYSSICNNIALDTWIIDSGASHHICASLHWFHSYSEINPMIIKLPNGNHVTTKYAGTVVFSSSFSITNVLYVPTFTVNLISVSQLCHHTPYTLNFTDTICSIQEQKSLKMIGLGESRDGLYYLTQTNKECASSNYNISSIFSSANNVHIPENAIWHFRLGHLSSSRIALLHSQFPFIVNDSSSVCDICHFAKHRKLPFVHSYHKAIKCFDLIHFDIWGPISIKSVHNHAYFLTAVDDHSRYTWITLMKNKSEARLHVQNFIHFIKTQYNHSVKSIRTDNGPEFLMPDFYASKGILHQTSCVDSPQQNGRVERKHQQILNIGRALLVQSNLPKSFWCYAVSHAVYIMNRVPAPNLQNKSPYTLLYNTAPDFDTLKVFGSLAFSMSITHCTEPQSYEEASKHEHWVTAMKEELNALAKNCTWKIVELPPHTKPIGCKWGIDYFETFSPVAKITTVRTLLAVAAIKNWHLHQLDVNNAFLHGDLQEDVYMKIPDGVTCAKPNSVCKLQKSLYGLKQASRKWYEKLTNLLLKEGYIQSISDYSLFTLTKGNTFTALLVYVDDIILAGDSIDEFDRIKNVLDLAFKIKNLGKLKYFLGLEVAHSRLGITISQRKYCLDLLKDSGLLGCKPASTPLDTSIKLHSAAGTPYADISGYRRIVGKLLYLNTTRPDIAFATQQLSQFMQAPTNVHFNAACRVLRYLKNNPGQGIFFSRTSEMQLIGYSDADWAGCMDSRKSISGYCFFIGKSLVSWRAKKQATVSRSSSEAEYRALSSAACELQWLLYLFADLRVQLTRTPTLYCDNQSAVHIASNPVFHERTKHLEIDCHLVREKLLKGTLKLLPVSTSDQVADFLTKALAPPKFHDFVSKLSMINIYHDKLEGGYHPTRHGIRQLRSGWADGPAYVTQCPIQTGQSYVYNYTIVGQRGTLFWHAHISWLRSTLYGPIIILPKQGAPYPFTKPYKEVPVIFGEWWNTDPEAVITQALQTGGGPNVSDAYTINGLPGPLYNCSAKDTFKLKVKPGKTYLLRLINAALNDELFFSIANHTLTVVDVDAIYVKPFDTDTILIAPGQTSNVLLKTKSHYPNATFFMSARPYATGQGTFDNSTVAAILEYEVPPHFVHSTTSVKKLSLFKPILPALNDTSFATNFANKLHSLASAQFPANVPQKVDKHFFFTVGLGTTPCPQNQTCQGPTNATKFAASVNNVSFIQPTTALLQAHFFGQSNGVYSPYFPISPLVPFNYTGTPPNNTMVSNGTKVVVLPFNTSVELVMQDTSILGAESHPLHLHGFNFFVVGQGFGNFDPKKDPVNFNLVDPVERNTVGVPSGGWVAIRFLTDNPGVWFMHCHLEVHTSWGLKMAWIVLDGKLPNQKLLPPPADLPNC

SEQ ID NO: 6478 - protein, 371 aa, Glycine max
MDRLLSSCSSSLNTNLKPFSLLPRFDSVRFNPFSSTRCSFTSISSKHETPPPLSSSPPKTLPPLSPSPLIHFHASVPPSQPLTPNNFQNPKAITARTFAILSSLVLLLIQPAFAPAAFATFQNAAKTGGPAAAAVGGKLIRTELLTSAWTGFFAGCLHTLSGPDHLAALAPLSIGRTRMESAAVGALWGCGHDAGQVIFGLIFLLLKDRLHIEIIRTWGTRVVGLTLLVIGAMGIKEASEVPTPCVALENGECDVSVYESRDSNPVVGKKKIGFATFATGIVHGLQPDALMMVLPALALPSRLAGAAFLIMFLLGTVVAMGSYTVFIGSCSEALKDRVPRITEKLTWASSLIAIALGFAIIISQFFGFSLY

SEQ ID NO: 6479 - protein, 282 aa, Glycine max
MAAITARTFAILSALVLLLIQPAFAPAAFATFQNAAKTSGPAAAAVGGKLIRTELLSSAWTGFFAGCLHTLSGPDHLAALAPLSIGRTQMESAAVGALWGCGHDAGQVIFGLIFLLLKDRLHIEIIQTWGTRVVGLTLLVIGAMGIKEASEVPILCVALENGECDVSVYESRDSNPVVGKKKIGFATFATGIVHGLEPDALMMVLPALALPSRLAGAAFLIMFLLGTVVAMGSYTVFIGSCSEALKDRVPRITEKLTWASSLVAIALGFAIITSQFFGFSLY

SEQ ID NO: 6480 - protein, 380 aa, Medicago truncatula
MDRLLSSSSSSLNTNLKPFTFLPLKPRFNSARFNFFPSNRSSFKWVASISRNNENPSPFLSATPLFVKPNNSLSHVANSDNPIIESQPVNKINATDFKKPKGLTVQTFVILSALVVLLIQPVFAPAAFATFANAAKTSGPATTAVGGKLIRTELLSSAWTGFFAGCLHTLSGPDHLAALAPLSIGRTRTESALVGALWGCGHDAGQLIFGLIFLLLKDRLHIEIIRTWGTRVVGLTLLVIGAMGIKEASEVSAPIVALENGESSVGAYESLDNPVAGKKKIGFATFATGIVHGLQPDALMMVLPALALPSRVSGAAFLIMFLVGTVVAMGSYTVFIGSCSQALKDRVPRITEKLTWASSLIAIALGFAIIISQFFGFSLY

SEQ ID NO: 6481 - protein, 371 aa, Ricinus communis
MERLLYSSSPTPLKFSLKSTSFLPRIHSLKLGFGPLTRPDFRRVNSVSCKHDNPSNPLTSVKLPSLSPLPPTGSTPKSHFNNQIENGAPLQQKAATLGTFLVLSAIIMFLIPPVFAPPAFATFQTAAETGGTAAAVGSKLMRTELLSSAWTGFLAGCLHTLSGPDHLAALAPLSIGRSRMESAVVGALWGCGHDAGQVIFGLLFLLLKDRLHIEIIRTWGTRVVGFTLLVIGAMGIREASEVPAPCVALENGECDVSVYEALESPTVGKKKIGFATFATGIVHGLQPDALMMVLPALALPSRLAGAAFLVMFLVGTVVAMGSYTVFLGSCSQALKDRVPRITEKLTWISSLVAIALGLAIIVSQFFGFSLY

SEQ ID NO: 6482 - protein, 382 aa, Vitis vinifera
MERLIYSYSPIPSKVRLKPFSPLSPIPSLPPFDSSRLCFSSFSCTHLKRLNASTPHSSFLCSLAPLLASSSSSSAFQAESPDESVSPPSSLPQIVAGASQQRKAATAGTITLLSALTILLIHPVLAQPAFATFQTAAKTGGPAAATVGGQLIRTELLSSAWTGFFAGCLHTLSGPDHLAALAPLSVGRSRMESAAVGALWGCGHDAGQMIFGLLFLLLKDRLHIEVIRTWGTRVVGFTLLVIGAMGIREASEVPTPCVAVENGECDVGTYEALENPTAKKKKIGFATFATGIVHGLQPDALMMVLPALALPSRLAGAAFLVMFLLGTVVAMASYTVFIGSCSQALKERVPRITEKLTWASSLIAIALGFAILISQFFGFSLY

SEQ ID NO: 6483 - protein, 379 aa, Glycine max
MDRLLSSSSPPSFTFLTRFESATARFNFSPSTRSHSHLKRLSSICCQHANPSPFSSSTPFLASSNHPINFPSFSSSSDPSTLESHSLNQIKTGAFPKPKVITARTLVILSALAMILIQPTIAPAAFATFQTAAKTGGPAAAAAVGRKLIHTELLSSAWTGFLAGCLHTLSGPDHLAALAPLSIGRTRMESAAVGALWGCGHDAGQVLFGLIFLILKDQLHIEIIRTWGTRVVGLTLLIIGAMGIREASEVHAPIVALESGECDVNVYESLDNPTVGKKKIGFATFATGIVHGLQPDALMMVLPALALPSRLAGAAFLIMFLIGTVIAMGSYTVFIGSCSQALKDRVPRITEKLTWVSSLIAIALGFAIIISQFFGFSLY

SEQ ID NO: 6484 - protein, 345 aa, Glycine max
MDRLLSSPSPPSFTFLTRFESATARFIFTRSHSHLKRVTSICCQHANPSPFTPFLASSNHPNTFPSISSPSVRSTPESHSLNQIKTGAFQKPKAITARTLVILSALAMILIQPAIAPAAFATFQTAAKTGGPAAAVGPDHLAALAPLSIGRTRMESAAVGALWGCGHDAGQVLFGLIFLILKDQLHIEIIRTWGTRVVGLTLLIIGALGIKEASEVHAPIVALESDECNVNVYESLDNPTVGKKKIGFATFATGIVHGLQPDALMMVLPALALPSRLAGAAFLIMFLIGTVIAMGSYTVFIGSCSQALKDRVPRITEKLTWASSLIAIALGLAIIISQFFGFHLY

SEQ ID NO: 6485 - protein, 371 aa, Ricinus communis; identical to SEQ ID NO: 6481

SEQ ID NO: 6486 - protein, 371 aa, Glycine max; identical to SEQ ID NO: 6478

SEQ ID NO: 6487 - protein, 383 aa, Vitis vinifera
MERLIHSSSSLLSKPFLKPAHSPHRLSRNDALPFRLSFLKRPYFVQLGSAFCALENSSSSSSSSSFRRLKFHAHCSKKGPSFSSSPDPDVSSTPGSHFLKRIVGAASNQQKVITAGAVLLVSALFVLLVHPIITSSAYATGFSAASAVNGKIVRTELLSSAWTGFFAGCLHTLSGPDHLAALAPLSIGRTRVESALVGALWGCGHDAGQLIFGLLFLLLKDRLHIEILRTWGTRVVGFTLLVIGAMGIREASESPAPCVVLENGECDVSMYDSLEAPVVGKKKIGFATFATGIVHGLQPDALMIILPALALPSRIAGAAFLGMFLIGTVVAMGSYTVFIGSCSQALKERVPRVTEKLTWASSLVAIALGLAIIFSQFFGFSLY

SEQ ID NO: 6488 - protein, 275 aa, Glycine max
MVRHGWSEMNFDTEGDDDDDRSNLSTEQSNSVVISNTGSIRTQKEVPGHVNVLLGHDQRKQELTASISTVQRDITTPITTIPNLVPTTPTISTSPFLNPNSNPDTVSPASTIPFSTPTTVNSPMFSGASWCIASPTASQTTLQVALDYACGFGGADCSAIQPGGSCYNPNSIRNHASYAFNKYYQKNPVPNSCNFGGTAVIISTNPSTGACQYPSTSTSTSVLNTTNSNGANVFGSVPVPTNPSPSSAAAPDTLNSFADICVILWIISTLQRNYL

SEQ ID NO: 6489 - protein, 232 aa, Populus trichocarpa
MRTELLTSAWAGLFAGCLHTLSGPDHLAALAPLSIGRSRMESAAVGALWGCGHDAGQVIFGLLFLLLKDRLHIEIIRTWGTRVVGLTLLVIGAMGIKEASEVPTPCVALENGECDVSAYEALETPTVGKKKKIGFATFATGIVHGLQPDALMMVLPALALPSRVAGAAFLIMFLFGTVVAMGSYTVFIGSCSEALKDRVPRITEKLTWVSSLIAIALGLGIIVSQLFGFSLY

SEQ ID NO: 6490 - protein, 282 aa, Populus trichocarpa
MLQAATLGIFVVVSGIIMFLIHPVFAFPAFATFQTAANTGGAAAAAGAKLMRTELLNSGWAGFFAGCLHTLSGPDHLAALAPLSIGRSRMESAAVGALWGCGHDAGQVIFGLLFLLLKDRLHIEVIRTWGTRVVGITLLVIGAMGIREASEVPTPCVALENGDRDVSVYEALETPTVGKKKRVGFATFATGIVHGLQPDALMMVLPALALPSRLAGAAFLIMFLFGTVVAMGSYTVFIGSCSEALKDRIPRITEKLTWASSLVAISLGLGLIISQFFGFSLY

SEQ ID NO: 6491 - protein, 282 aa, Vitis vinifera
MFQAATAGTITLLSALTILLIHPVLAQPAFATFQTAAKTGGPAAATVGGQLIRTELLSSAWTGFFAGCLHTLSGPDHLAALAPLSVGRSRMESAAVGALWGCGHDAGQMIFGLLFLLLKDRLHIEVIRTWGTRVVGFTLLVIGAMGIREASEVPTPCVAVENGECDVGTYEALENPTAKKKKIGFATFATGIVHGLQPDALMMVLPALALPSRLAGAAFLVMFLLGTVVAMASYTVFIGSCSQALKERVPRITEKLTWASSLIAIALGFAILISQFFGFSLY

SEQ ID NO: 6492 - protein, 482 aa, Glycine max
MGVSRSQKPHVVCVPFPAQGHVNPFMQLSKLLLCTGFHITFVNTEFNHKRLVKSLGQEFVKGQPHFRFETIPDGLPPSDKDATQSIAALCDATRKHCYEPLKELVKKLNASHEVPLVTSIIYDGLMGFAGKVARDLDISEQQFWTASACGLMGYLQFDELVERGIIPFQDESFTTDGSLDTNLDWISGMKNMRIRDCPSFVRTTTLDETSFICFGIEAKTCMKSSSIIINTIQELESEVLNALMAQNPNIYNIGPLQLLGRHFPDKDKGFKVSGSNLWKNDSKCIQWLDQWEPSSVIYVNYGSITVMSEDHLKEFAWGLANSNLPFLWIKRPDLVMGESTQLPQDFLDEVKDRGYITSWCPQEQVLSHPSVGVFLTHCGWNSTLEGISGGVPMIGWPFFAEQQTNCRYICTTWGIGMDIKDDVKREEVTTLVKEMITGERGKEMRQKCLEWKKKAIEATDMGGSSYNDFHRLVKEVLHNDVV

SEQ ID NO: 6493 - protein, 484 aa, Glycine max
MDSPLHIQKPHVVCVPFPAQGHVNPFMQLAKLLHCVGFHITFVNTEFNHNRFVKSHGPDFVKGLPDFKFETIPDGLPPSDKDATQDVPALCDSTRKTCYGPLKELVMKLNSSSPEMPPVSCIIADGTMGFAGRVARDLGIQEVQLWTASACGFVGYLQFEELVKRGILPFKDENFAIDGTLDKSLNWISEMKDIRLKDLPSFIRTTTLDDTMFDFLGSEARNTLRSSSIIINTFQDLDGEAIDVLRIKNPNIYNIGPLHLIDRHFLEKEKGFKASGSSLWKNDSKCLAWLDKWEPNSVIYVNYGSITVMTEHHLKEFAWGLANSKQHFLWIMRPDVVMGESISLPQEFFDEIKDRGYITSWCVQEKVLSHPSVGAFLTHCGWNSTLESISAGVPMICWPFFAEQQTNCKYVCTTWGIGMEINHDVRREEIAKLVKEMMMGEKGMEMRQKSLEWKKKAIRATDVGGSSYNDFYKLIKEVFHYSVL

SEQ ID NO: 6494 - protein, 486 aa, Glycine max
MSSKFVSNTQKPHVVCVPFPAQGHVNPFMQLAKLLHCVGFHITFVNTEFNHNRFVKSHGPDFVKGLPDFKFETIPDGLPPSDKDATQDVPALCDSTRKTCYGPLKELVMKLNSSSPEMPPVSCIIADGVMGFAGRVARDLGIQEVQLWTASACGFVGYLQFEELVKRGILPFKDENFAIDGTLDKSLNWISEMKDIRLKDLPSFIRTTTLDDTMFDFLGSEARNTLRSSSIIINTFQDLDGEAIDVLRIKNPNIYNIGPLHLIDRHFLEKEKGFKASGSSLWKNDSKCLAWLDKWEPNSVIYVNYGSITVMTEHHLKEFAWGLANSKQHFLWIIRPDVVMGESISLPQEFFDAIKDRGYITSWCVQEKVLSHPSVGAFLTHCGWNSTLESISAGVPMICWPFFAEQQTNCKYACTTWGIGMEINHDVRREEIAKLVKEMMMGEKGMEMKQKSLEWKKKAIRATDVGGSSYNDFYKLIKEVFHHSVL

SEQ ID NO: 6495 - protein, 304 aa, Glycine max
MWAWAVAVALAGITCFGCTNGFDKGLEVGTFFLLLPTLAELESLYFQFHVAKRRDSDSEPLLEPSIVQEVSFHDDNEEEEFLDEFEYDEDDGDGDEYYEEEEEYEEEAGDGGAGGGISLTGTWWDKKALAIAKEVTLSFDGELQIYAFRTLVNCTIQVRIENLSKKSGSPSMEDIEAFSTTYRAKLDEAEIAKVVPDNICLEVSSPGVERIVRIPDDLDRFKDRPMYVKYAINDDQNNPAAEGDGVFKLESFDMETKCCTWGLADVKVNRQKAGKGRPLNKKQSEWRLSTPFDSLRFVRLHSDI

SEQ ID NO: 6496 - protein, 307 aa, Glycine max
MDLIKAWRLSPSVSAIPSPFCAAPICVRTFSFQFSTSPYTRPKPLVPIPRGKSRDSDSEPLLESSIVQEVSFDDDDEEEFLDEFEYDEAADGDEYYEEEEEYEEEAGVPYAGDGGAGGGISLAGTWWDKKALAIAKEVTLSFDGELQIYAFRTLVNCTIQVRIENLSKKSGSPSLEDIEAFSATYRAKLDEAELAKSVPDNICLEVSSPGVERIVRIPDDLDRFKERPMYVKYAINDDLNNPAAEGDGVFRLESFDMETKCCTWGLADVKVNRQKAGKGRPLNKKQREWRLSTPFDSLRFVRLHSDI

SEQ ID NO: 6497 - protein, 579 aa, Glycine max
MLSRKRLIVSLSLATLLLFSSLSLTLCDKIPPQNDNNNDDDEDLSFLEEPDDAAATSHHGHFPDPDRFDEDGDDDGDFGDFSGFDHSTEEAFEVDDKDVVVLKERNFTTVVENNRFIMVEFYAPWCGHCQALAPEYAAAATELKPDGVVLAKVDATVENELANEYDVQGFPTVFFFVDGVHKPYTGQRTKDAIVTWIKKKIGPGVSNITTVDDAERILTAESKVVLGLLNSLVGTESDELAAASKLEDDVNFYQTVVADVAKLFHIDPSVKRPALILLKKEEEKLNHFDGQFVKAEIADFVTSNKLPLVTIFTRESAPVIFESQIKKQLLLFVTSNDTEKFVPVFKEAAKKFKGKLIFVHVELDNEDVGKPVADYFGITGNGPKVLAYTGNDDGRKFLLDEELTVDTITAFGNDFLEEKLKPFLKSDPVPESNDGDVKIVVGNNFDEIVLDESKDVLLEIYAPWCGHCQALEPTYNKLAKHLRNIESIVIAKMDGTTNEHPRAKSDGFPTLLFFPAGNKSSDPIPVDVDHTVKAFYKFLRKHASIPFQLQKPTSTAKTGSESSYVKESQSSSTDVKDEL

SEQ ID NO: 6498 - protein, 586 aa, Glycine max
MLTRKRLVVSLSLATLLLFSSLSLSLCDKTPPQNDNKKNNNDDDEDLSFLEESDDAATTSHQGHFPDPDEFDEDDGDDEDDFGDFAGFDHSSEEAFKEPEVDDKDVVVLKERNFTTVVENNRFVMVEFYAPWCGHCQALAPEYAAAATELKPDGVVLAKVDATVENELANEYDVQGFPTVFFFVDGVHKPYTGQRTKDAIVTWIKKKIGPGVSNITTVEEAERVLTAGSKVVLGFLNSLVGAESDELAAASKLEDDVNFYQTVVADVAKLFHIDASVKRPALILLKKEEEKLNHFDGQFVKAEIADFVTSNKLPLVTTFTRESAPVIFESQIKKQLLLFVTSNDTEKFVPVFKEAAKIFKGKLIFVHVESDNEDVGKPVADYFGIAGNGPKVLAFTGNDDGRKFLLDGEVTIDTITAFGNDFLEDKLKPFLKSDPVPESNDGDVKIVVGNNFDEIVLDESKDVLLEIYAPWCGHCQALEPTYNKLAKHLRSIESIVIAKMDGTTNEHPRAKSDGFPTLLFFPAGNKSSDPIPVDVDRTVKDFYKFLRKHASIPFQLQKLASTTKTASESSDVKESQSSTTEVKDEL

SEQ ID NO: 6499 - protein, 583 aa, Medicago truncatula
MLYHNKRLVVFLFLTTLLLISSFSFTLSEKTQNNDDDDEDLSFLEEPEDTTTTHHDHADFPDPDNFDDDDEGDDGDEFGDFSGYDPHSDEDFKEPEVDEKDVVVLIERNFTTVIENNQFVMVEFYAPWCGHCQALAPEYAAAATELKKDGVVLAKVDASVENELAYEYNVQGFPTVYFFIDGVHKPYNGQRTKDAIVTWIKKKTGPGVYNITTLDDAERILTSETKVVLGFLDSLVGAESDELAAASKLEDGVNFYQTVIPNVAKLFHIDPDVKRPALVLLKKEEEKLNHFDGQFVKAEIANFVSSNKLPLVNIFTRESAPVIFESPIKKQLLLFVTSNDTAKFITVFQEAAKLFKGKLIFVHVEMDNEDVGKPVADYFGLSGNTPKVLAFTGNEDGRKFLLDGEVTIDNIKAFGEDFLADKLKPFIKSDPIPESNDGDVKIVVGNNFDEIVLDESKDVLLEVYAPWCGHCQALEPTFNKLAKHLHSIESIVVAKMDGTTNEHPRAKSDGFPTLLFYPAGKKSSDPITVDVDRTVVAFYKFLKKHASIPFQLQKPTTTSKTNDSGSSDIKESQSSITDAKDEL

SEQ ID NO: 6500 - protein, 551 aa, Glycine max
MRILVVLSLATLLLFSSLFLTLCDDLTDDEDLGFLDEPSAAPEHGHYHDDDANFGDFEEDPEAYKQPEVDEKDVVILKEKNFTDTVKSNRFVMVEFYAPWCGHCQALAPEYAAAATELKGEDVILAKVDATEENELAQQYDVQGFPTVYFFVDGIHKPYNGQRTKDAIMTWIKKKIGPGIYNLTTVEDAQRILTNETKVVLGFLNSLVGPESEELAAASRLEDDVNFYQTVDPDVAKLFHIDPDVKRPALILVKKEEEKLNHFDGKFEKSEIADFVFSNKLPLVTIFTRESAPSVFENPIKKQLLLFATSNDSEKLIPAFKEAAKSFKGKLIFVYVEMDNEDVGKPVSEYFGISGNAPKVLGYTGNDDGKKFVLDGEVTADKIKAFGDDFLEDKLKPFYKSDPVPESNDGDVKIVVGNNFDEIVLDESKDVLLEIYAPWCGHCQALEPIYDKLAKHLRNIESLVIAKMDGTTNEHPRAKPDGFPTLLFFPAGNKSFDPITVDTDRTVVAFYKFLKKHASIPFKLQKPTSTSDAKGSSDAKESQSSDVKDEL

SEQ ID NO: 6501 - protein, 558 aa, Glycine max
MRILVLLSLATLLLFSSFSPTFCDHLADDEDLSFLDEPSAAPEHDHHYGADDSNFGDFEDFEEDDAEAYKQPEVDEKDVVVLKEKNFTDAVKNNRFVMVEFYAPWCGHCQALAPEYAAAATELKGEDVILAKVDATEENELAQQYDVQGFPTVHFFVDGIHKPYNGQRTKDAIVTWIRKKIGPGIYNLTTVEEAQRILTNETKVVLGFLNSLVGPESEELAAASRLEDDVNFYQTVNPDVAKLFHIDQDVKRPALILIKKEEEKLNHFDGKFEKSAIADFVFSNKLPLVTIFTRESAPSVFENPIKKQLLLFATSNDSETLVPAFKEAAKSFKGKLIFVYVEMDNEDVGKPVSEYFGISGNAPKVLGYTGNDDGKKFVLDGEVTTDKIKAFGEDFVEDKLKPFYKSDPVPESNDGDVKIVVGNNFDEIVLDESKDVLLEIYAPWCGHCQSLEPIYNKLAKHLRNIDSLVIAKMDGTTNEHPRAKPDGFPTLLFFPAGNKSFDPITVDTDRTVVAFYKFLKKHASIPFKLQKPTSTSESDSKGSSDAKESQSSDVKDEL

SEQ ID NO: 6502 - protein, 515 aa, Glycine max
MLSRKRLIVSLSLATLLLFSSLSLTLCDKIPPQNDNNNDDDEDLSFLEEPDDAAATSHHGHFPDPDRFDEDGDDDGDFGDFSGFDHSTEEAFEVDDKDVVVLKERNFTTVVENNRFIMVEFYAPWCGHCQALAPEYAAAATELKPDGVVLAKVDATVENELANEYDVQGFPTVFFFVDGVHKPYTGQRTKDAIVTWIKKKIGPGVSNITTVDDAERILTAESKVVLGLLNSLVGTESDELAAASKLEDDVNFYQTVVADVAKLFHIDPSVKRPALILLKKEEEKLNHFDGQFVKAEIADFVTSNKLPLVTIFTRESAPVIFESQIKKQLLLFVTSNDTEKFVPVFKEAAKKFKGKLKPFLKSDPVPESNDGDVKIVVGNNFDEIVLDESKDVLLEIYAPWCGHCQALEPTYNKLAKHLRNIESIVIAKMDGTTNEHPRAKSDGFPTLLFFPAGNKSSDPIPVDVDHTVKAFYKFLRKHASIPFQLQKPTSTAKTGSESSYVKESQSSSTDVKDEL

SEQ ID NO: 6503 - protein, 575 aa, Ricinus communis
MSPRVLLLLSLTTLFLFSKLSPSLSKSQNDEDDEDLSFLEEADDDKSKNDAASHHHNYPDSDDELDNDDFDNYSDFDESEADSYKEPEIDDKDVVVLKERNFSDVIEKNKFVMVEFYAPWCGHCQALAPEYAAAASELKGEEVVLAKVDATEESELAQEYDVQGFPTVYFFVDGVHKPYPGQRTKEAIVTWIKKKIGPGIYNLTTLDDAERVLTSESKVVLGYLNSLVGPESEEVAAASRLEDDVNFYQTVNPDVAKLFHLDPEVKRPALVMVKREAEKLSYFDGNFSKSEIADFVFANKLPLVTTFTRESAPSIFESPIKKQLLLFATSNNSEKVLPVFQDAAKLFKGKLIFVYVELDNEEVGKPVADYFGIVGDASQLLGYTGNDDGKKFVFDAEITMDKIKAFGEDFLEDKLKPFFKSDPIPETNDGDVKIVVGNNFDEIVLDESKDVLLEIYAPWCGHCQALEPTFNKLAKHLRGIESLVIAKMDGTTNEHPRAKSDGFPTLLFFPAGNKSFDPITVDTDRTVVAFYKFIKKHASIPFKLQKPDSTPKSESSEAKGSPQTESSTEDVKDEL

SEQ ID NO: 6504 - protein, 2751 aa, Medicago truncatula
MAESLQSLVSLSELVSTSSTNQRLRIFQREVPAFLNSSSTSDEMSTELASLLTDIIFRTVAIYDDRRSRKAVDDVIVKSLSGTVFMKTFAAALVQSMEKQLKSQSHVGCYRLLSWSCLLLSKSKFSTVSKNALCRVASGQASLLNLVWRRSFRERRACKKKIFHLFKELPDIYKVYVQEVKNGSIPYKDSPELLLLLLEFSTRSSSLFGEFKSAFLDIYVNAILSAKAKPGKSLIEAFHPLYLQMSHEDFGTIVLPAAVKMLKRNPEIVLESVGILLKSVKLDLSKYAAEILSVVLVQARHADEGRRDVALDIVKNLSQKSSNPDALDIMFNAIKSVIKGSEGRLAFPYQRVGMVNAIQELSNAPDGKYLINLSQTICDFLLSCYKDDGNEEVKIATLSAIASWADKSTNIIQESLVSFFASGLKEKEILRRGFLRSLRAICKNADAVLKMSPLLVPLVQLVKTGFTKAVQRLDGIYALLLVGKIAAVDIKAEEILVKEKIWATISQNEPSLIPISMASKLAVEDSIACIDLLEVLLLEHLQRTLSNFSVTSLLQLVIFFICHPRWDIRRIACNVAKRIITSVPQLSEDILSEFSKYLNLVEEKVSALRISDTDISLDPQVPFIPSVEVLVKALLIMSPAAMKVAPDSFVRIILCSHHPCVVGSAKRDAVWKRLCKCLQTHGFDVIDIVAANVINFVQVLLGPMGLRSANPLEQEAAISSLSNLMSIIPGDTYTEFEKHLLNLPERFSHNALSENDIQIFHTPEGMLSTEQGIYVAESVAFKNTKQAKGRFRMYGEEDGLDHTQSNHSMKRDQPSREAAGAGKKDSGKTTKKAGKFSTSIDKGKTAKEEARESLLKEEASIRDRVREIQKNLSLMLRTLGNMAIANSIFAHSRLPSMVLECFLLIFVDLLPYICDVKFVEPLLRSPIVSDEAFETLVMLSRCTASPLCDWALDISTALRLVVTDEVHLLLDLVPSVAEEQVNQKPSHGLFERIIDGLSTSCKSGALPVDSFTFVFPIMERILLCSKKTKFHDDVLRLIYLHMDAHLPLPRVRMLSVIFPTLHVLYHALSVVPAYKASIGPALNELSLGFQPDEVASALYGVYAKDVHVRMACLNAVKCIPAVSSRSLPQNTEVATSIWIALHDPEKKLLFLALGEFGWMSTSVAEVAEDIWDHYGFDFGTDFSGIFKALSHVNYNVRLAAAEALAAALDEHPDLIQESLSTLFSLYIRDMGIGNDNVDAGWLGRQGVALALHSAADVLRTKDLPVVMTFLISRALADLNADVRGRMINSGILIIDKNGKDNVSLLFPIFENYLNKTAPDEEQYDLVREGVVIFTGALAKHLAKDDPKVHAVVDKLLDVLNTPSESVQRAVSACLSPLMQSKQDEADTLVTRLLDQMMKSEKYGERRGAAFGLAGVVKGFGLSCLKKYKIVIILQECLAERNSAKSREGALLGFECLCETLGKLFEPYVDKFLTHKYVIQMLPLLLVSFSDQVAAVREAAECAARAMMSQLSAQGVKLVLPSLLKGLEDKAWRTKQSSVQLLGAMAYCAPQQLSQCLPKIVPKLTEVLTDSHPKVQSAGQTALQQVGSVIKNPEIAALVPTLLKGLSDPNEHTKYSLDILLQTTFVNSIDAPSLALLVPIVHRGLRVRSADTKKRASQIVGNMCSLVTEPKDMIPYIGLLLPEVKKVLVDPIPEVRSVAARAIGSLIGGMGEDNFPDLVPWLFETLKSDNSNVERSGAAQGLSEVLVDPIPEVRSVAARAIGSLIGGMGEDNFPDLVPWLFETLKSDNSNVERSGAAQGLSEVLAALGVEFFEHVFPDIIRNCSHQKASVRDGYLTLFKYLPRSLGVQFQKYLPQVLPAILDGLADENESVRDAALGAGHVLVEHYATTYALSLSLPLLLPAVEDGIINDSWRIRQSSVELLGDLLFKVAGTSGKALLEGGSDDEGSSTEAHGRAIIEVLGREKRNEILAALYMVRADVSLSVRQAALHVWKTIVANTPKTLREIMPVLMDTLIASLASASSERRQVAGRSLGELVGKLGERVLPLIIPILSQGLSDPDSSRRQGVCSGLSEVMASAGKSQLMTFMTDLIPTIRTALCDSEPAVRESAGLAFSTLYKSAGMQAIDEIVPTLLHALEDDKTSDTALDGLKQILSVRTSAVLPHILPKLVHPPLSAFNAHALGALAEVAGPGLDFHLGTVLPPLLSAMSDVDQEVQTSAKKAAETVVLVIDEEGVEPLISELLKGVSDSQAAIRRSSSYLIGYFFKNSKLYLVDEAPNMISTLIVLLSDPDSSTVTVAWEALSRVIMSVPKEVLPSYIKLVRDAVSSSRDKERRKKKGGPVLIPGFCLPKSLQPILPIFLQGLISGSAELREQAALGLGELIEVAGEQSLKEVVIPITGPLIRIIGDRFPWQVKSAILSTLTIMIRKGGISLKPFLPQLQTTFVKCLQDNTRTIRSGAAVALGMLSGLNTRVDPLVSDLLSSLQGSDGGVREAILSALKGVLKHAGKNVSSAVSSRIYSVLKDLIHHDDDRVRVYAASILGVLTQYLEAVQFTELIQEVTSLANSPNWPPRHGSILTISSLLYRNPAPIFSSSLFQTVVDCLRDALKDEKFPLRESSTKALGRLLLYRAQEDPSDTVLYKDVLSLLVTSTRDESSEVRRRALSAIKAVAKANPSAIMSHGTVIGPALAECLKDANTPVRLAAERCAIHAFQLTKGSENVQAVQKYITGLDARRLSKFPEFSDDSGDSDEDMSTS

SEQ ID NO: 6505 - protein, 2616 aa, Glycine max
MAAESLQSLVSLSELVSTSSTNHRVRIFRREIPAFLNSSTSEMSTELASLLTDIIFRTVAIYDDLRSRKAVDDVIVKALGGTVFMKTFAGALVQNMEKQSKFQSHVGGYRLLSWSCLLLSKSKFAAVSKNALCRVAAAQASLLSLVLKRSFRERRACRKKFFHLFSQLPDIYKVYMEELRNGRIPFKDSPELLMLLLEFSSRSPSLFGEFKVTFLDIYVNAILSAKEKPGKSLTEAFHPLYLQMSHEDFQSIVIPSSVKMLKRNPEIVLESVGILLKSVNLDLSKYAAEILSVVLAQARHADEGRRDGALAIVQSLSQKSSNPDALDTMFNAIKAVIKGSEGRLAFPYQRVGMVNAIQELSYAPDGKYLISLSRTICDFLLSYYKDDGNEEVKIVILSAIASWAVRSTDIIQESLVSFLASGLKEKETLRKGFLRSLHAICKNEDAVLKMLPLIGTLMQLVKTGFTKAVQRLDGIYALLLVAKIAAVDIKAEETLVKEKIWALISQNEPSVVPISMASKLSIEDNMTCVDLLEVLLVEHLQCTLSNFSVRLMLQLMIFFMCHPRWDIRRMAYDVARKIIPSAPQLSKDLLLEFSKYLTLIGEKHLALKTSDSDISLDPQVPFIPSVEVLVKALLIMSPAALKHAPESFFRIILCSHHPCVVGGAKIDAVWKRLSKCLQTQGFVVIDVISANVGNFLQVLLGPMGLKSANPLEQQAAILSLCNLMSIIPGDTYIEFEKNLLNLPERFAHDTLLENDIQIFLTPEGMLSTEQGVYVAESVTAKNTKQDHTRSNHSVRRDQPSREAAGAGKKDTGKAAKKADKGKTAKEEARELLLKEEASVRDRVREIQKNLSLMLRTLGDMAIANSVFAHSRLPSMVKFVEPLMRSPIVSDEAFETMVKLARCTAPPLCDWALDISTALRLIVTDEVHLLLDLVPSVTEEEFNERPHGLFERILDGLSISCKSGALPVDSFSFIFPIIERILLCSKKTKFHDDVLRIFYLHLDPHLPLPRIRMLSVLYHVLGVVPAYQASIGPALNELSLGLQPAEVASALYGVYAKDVHVRMACLNAVKCIPAVANRSLPENVEVATSIWIALHDPEKSVAQVAEDIWDHYGFDFGTDFSGLYKALSHINYNVRVAAAEALAAALDEHPDSIQESLSTLFSLYILDMGVGDDNVDAGWLGRQGIALALHAAADILRTKDLPVVMTFLISRALADLNADVRGRMINAGILIIDKNGKDNVSLLFPIFENYLNKTAPDEEKYDLVREGVVIFTGALAKHLAKDDPKVHAVVDKLLDVLNTPSEAVQRAVSACLSPLMQSKQDDAAALFNRLMDQMMKSEKYGERRGAAFGLAGLVKGFGISCLKKYRIVITLQESLAERNSAKSREGALLGFECLCETLGRIFEPYVIQMLPLLLVSFSDQVNAVREAAECAARAMMSQLSAQGVKLVLPSLLKGLEDKAWRTKQSSVQLLGAMAYCAPQQLSQCLPKIVPKLTEVLTDTHPKVQSAGQMALQQVGSVIKNPEISALVPTLLKGLSDPNEHTKYSLDILLQTTFVNSIDAPSLALLVPIVHRGLRERSADTKKRAAQIVGNMCSLVTEPKDMIPYIGLLLPEVKKVLVDPIPEVRSVAARAIGSLIGGMGEENFPDLVPWLFDTLKSDNSNVERSGAAQGLSEVLAALGIDFFEHVLPDIIRHCSHQKASVRDGYLTLFKYLPRSLGVQFQNYLPQVLPAILDGLADENESVRDAALGAGHVLVEHYATTSLPLLLPAVEDGIFNDSWRIRQSSVELLGDLLFKVAGTSGKALLEGGSDDEGSSTEAHGRAIIEILGRDKRNEVLAALYMVRADVSLSVRQAALHVWKTIVANTPKTLREIMPVLMDTLITSLASSSSERRQVAGRSLGELVRKLGERVLPLIIPILSQGLNDPNSSRRQGVCVGLSEVMASAGKSQLLTFMNELIPTIRTALCDSVSEVRESAGLAFSTLYKSAGMLAIDEIVPTLLHALEDDETSDTALDGLKQILSVRTSAVLPHILPKLVHPPLSAFNAHALGALAEVAGPGLDFHLCTVLPPLLSAMGDDDKEVQTLAKEASETVVLVIDEEGIEPLMSELVKGVNDSQAAVRRSSSYLIGYFFKNSKLYLVDEAPNMISTLIILLSDSDSSTVTVAWEALSRVIISVPKEVLPSYIKLVRDAVSTSRDKERRKKKGGPILIPGFCLPKALQPILPIFLQGLISGSAELREQAALGLGELIEVTSEQSLKEFVIPITGPLIRIIGDRFPWQVKSAILSTLTTMIKKGGISLKPFLPQLQTTFVKCLQDSTRTVRSSAALALGKLSGLSTRVDPLVSDLLSSLQGSDGGVSEAILTALKGVLKHAGKNVSSAVRTRFYSVLKELIHDDDEIVRTYASSILGILTQYLEDVQLTELIQELSSLANSPSWPPRHGSILTISSLFHYNPATICSSSLFSTIVDCLRDTLKDEKFPLRETSTKALGRLLLYRSQVDPSDTLLYKDVLSLLVSSTHDESSEVRRRALSAIKAVAKANPSAIMSHSTIVGPALAECMKDGNTPVRLAAERCALHAFQLTKGSENVQAAQKYITGLDARRLSKFPEYSDDSDDSHEDISSS

SEQ ID NO: 6506 - protein, 2636 aa, Vitis vinifera
MAAWSESLAAIAGSVSTVSTKKRVRIFRDEIPPILTNSEMSAELASLLVDIIFNTLYIYDDHGSRKAVDDVISKALGEVIFMKSFAATLVQFMEKQSKFQSNIGCYRLLKWSCLLLSKSRFASVSKNAFCRVATVQASVLHIVMQGSFRVRRACKRTFFCLFSQSLDIYKIYIEELKDARISYKDSPELIWLLLEFSSRKPLLFEQCKPIFLDIYVKAVLNAREEPAKGLSEAFHPLFTHMVHEDFKSIVVPSAIKMLKRNPEIVLESVGVLLKSVNLDLSKYAIEILSVVLAQARHADEGRRHGALSIVCCLSQKSSNPDAIEAMFNSIKAVIGGSEGRLAFPYQRVGMINALQELSNAPEGKYLNSLSPTICGFLLSCYKDDGNEEVKLAILPALASWVARSADALQRDVVSFLVSGLKEKEGLRRGHLRCLRFIFKNTDAIILVSSLLGPLVQLVKTGFTKAAQRLDGIYALLLVAKIAAVDIKAEETVAKEKLWSLISQNEPSLVPISMASKLSTEDCMACVDLLEVLIVEHLHRVLETFSVTPLSQLILFLVCHPSWDIRRAAYDNTKKIISAAPKLAEALLSEFTNFLSVVGEKIQLLKTSDTENSLDAQVPFLPSVEVLVKALIVISSEALAAVPSAIMQIIFCSHHPCIVGTGKRNAVWRRLQKGLQTRGFDVIGIITANVEILCKGLLGPTALMSPNHLEQEAAINSLSTLMSVIPKDTYIEFEKHFSNFPDRQSHDTVSENDIQIFHTPEGMLSSEQGVYVAESVATKNMRQAKGRFRMYDDQDDGDDVNSNLSVKRETNHSGRKETASREVTGVGKKDIGKSTKKADKGKTAKEEARELLLREEASIRQKVGVIKKNLSLMLRALGEMAIANPVFAHSELPSLVKFVEPLLRSPVVSEVAYETMVKLARCTASPLCNWALDIATALRLIVTEEVHVLLELIPSVGEGETNERPSLGLFERIISGLSVSCKSGPLPVDSFTFVFPIMERILLSSKKTGLHDDVLQILYLHMDPILPLPRLRMLSVLYHALGVVPTYQASIGPALNELCLGLQSDEVAPALYGVYAKDVHVRMACLNAVKCIPAVSSCSLPQNVEVATSIWIALHDREKSVAELAEDIWDRCGYVFGTDYSGLFKALSHINYNVRLAAGEALAAALDEYPDTIQETLSTLFSLYIRDVGFGEDNVDASWIGRQGIALALHSAADVLRTKDLPVVMTFLISRALADPNADVRGRMINAGILIIDKHGRDNVSLLFPIFENYLNKKTSDEEKYDLVREGVVIFTGALAKHLAKDDPKVHAVVEKLLDVLNTPSEAVQRAVSTCLSPLMQSKQEDAPALVSRLLDQLMKSDKYGERRGAAFGLAGVVKGFGISSLKKFGIATVLREGLADRNSAKCREGALLGFECLCEKLGRLFEPYVIQMLPLLLVSFSDQVVAVRDGAECAARAMMSQLSAQGVKLVLPSLLKGLEDKAWRTKQSSVQLLGAMAYCAPQQLSQCLPKIVPKLTEVLTDTHPKVQSAGQMALQQVGSVIKNPEISALVPTLLMGLTDPNDYTKYSLDILLQTTFVNSIDAPSLALLVPIVHRGLRERSAETKKKAAQIVGNMCSLVTEPKDMIPYIGLLLPEVKKVLVDPIPEVRSVAARALGSLIRGMGEENFPDLVSWLLDTLKSDASNVERSGAAQGLSEVLAALGTEYFEHLLPDIIRNCSHQRASVRDGYLTLFKYLPRSLGLQFQNYLQQVLPAILDGLADENESVRDAALSAGHVLVEHYATTSLPLLLPAVEDGIFNDNWRIRQSSVELLGDLLFKVAGTSGKALLEGGSDDEGASTEAHGRAIIEGLGRDKRNEVLAALYMVRADVSISVRQAALHVWKTIVANTPKTLREIMPVLMNTLITSLASSSSERRQVAGRSLGELVRKLGERVLPLIIPILAQGLKDPKTSRRQGVCIGLSEVMASAGKSQLLSFMDELIPTIRTALCDSTPEVRESAGLAFSTLYKSAGMQAIDEIVPTLLHSLEDDQTSDTALDGLKQILSVRTTAVLPHILPKLVHLPLTAFNAHALGALAEVAGPGLNFHLGIVLPALLSAMSDDDTDVQKLAKKAAETVVLVIDEEGVEGLISELLKGVGDNQASIRRSSSFLIGYFFKNSKLYLVDEAPNMITTLIVLLSDSDSATVAVAWEALSRVTNSVPKEVLPSYIKIVRDAVSTSRDKERRKKKGGPVLIPGFCLPKALQPLLPVFLQGLISGSAELREQAAQGLGELIEVTSEQALKEFVIPITGPLIRIIGDRFPWQVKSAILSTLSIIIRKGGIALKPFLPQLQTTFIKCLQDNTRTVRSSAALALGKLSALSTRVDPLVGDLLSSLQVSDGGVREAILTALKGVLQHAGKSVSVAVRTRVYVLLKDFVHHDDDQVRNSAASILGILSQYMEDGQLSDLLQELSSLDSSLSWSARHGSILTISSMLRHSPSSICTSPVFPSVVYCLKDNLKDEKFPVRETSTKALGRLLLHRVQSDPSNTAAHLDVLSPMVSALQDDSSEVRRRALSALKAVAKANPSALMTHITIFGPALAECLKDGNTPVRLAAERCALHAFQLTKGTENVQAAQKFITGLDARRLSKFPEHSDDSEDNEDDPTSG

SEQ ID NO: 6507 - protein, 2543 aa, Vitis vinifera
MAAWSESLAAIAGSVSTVSTKKRVRIFRDEIPPILTNSEMSAELASLLVDIIFNTLYIYDDHGSRKAVDDVISKALGEVIFMKSFAATLVQFMEKQSKFQSNIGCYRLLKWSCLLLSKSRFASVSKNAFCRVATVQASVLHIVMQGSFRVRRACKRTFFCLFSQSLDIYKIYIEELKDARISYKDSPELIWLLLEFSSRKPLLFEQCKPIFLDIYVKAVLNAREEPAKGLSEAFHPLFTHMVHEDFKSIVVPSAIKMLKRNPEIVLESVGVLLKSVNLDLSKYAIEILSVVLAQARHADEGRRHGALSIVCCLSQKSSNPDAIEAMFNSIKAVIGVQELSNAPEGKYLNSLSPTICGFLLSCYKDDASWVARSADALQRDVVSFLVSGLKEKEGLRRGHLRCVSSLLGPLVQLVKTGFTKAAQRLDGIYALLLVAKIAAVDIKAEETVAKEKLWSLISQNEPSLVPISMASKLSTEDCMACVDLLEVLIVEHLHRVLETFSVTPLSQLILFLVCHPSWDIRRAAYDNTKKIISAAPKLAEALLSEFTNFLSVVGEKIQLLKTSDTENSLDAQVPFLPSVEVLVKALIVISSEALAAVPSAIMQIIFCSHHPCIVGTGKRNAVWRGLLGPTALMSPNHLEQEAAINSLSTLMSVIPKDTYIEFEKHFSNFPDRQSHDTVSENDIQIFHTPEGMLSSEQGVYVAESVATKNMRQAKETNHSGRKETASREVTGVGKKDIGKSTKKADKGKTAKEEARELLLREEASIRQKVGVIKKNLSLMLRALGEMAIANPVFAHSELPSLVKFVEPLLRSPVVSEVAYETMVKLARCTASPLCNWALDIATALRLIVTEEVHVLLELIPSVGEGETNERPSLGLFERIISGLSVSCKSGPLPVDSFTFVFPIMERILLSSKKTGLHDDVLQILYLHMDPILPLPRLRMLSVLYHALGVVPTYQASIGPALNELCLGLQSDEVAPALYGVYAKDVHVRMACLNAVKCIPAVSSCSLPQNVEVATSIWIALHDREKSVAELAEDIWDRCGYVFGTDYSGLFKALSHINYNVRLAAGEALAAALDEYPDTIQETLSTLFSLYIRDVGFGEDNVDASWIGRQGIALALHSAADVLRTKDLPVVMTFLISRALADPNADVRGRMINAGILIIDKHGRDNVSLLFPIFENYLNKKTSDEEKYDLVREGVVIFTGALAKHLAKDDPKVHAVVEKLLDVLNTPSEAVQRAVSTCLSPLMQSKQEDAPALVSRLLDQLMKSDKYGERRGAAFGLAGVVKGFGISSLKKFGIATVLREGLADRNSAKCREGALLGFECLCEKLGRLFEPYVIQMLPLLLVSFSDQVVAVRDGAECAARAMMSQLSAQGVKLVLPSLLKGLEDKAWRTKQSSVQLLGAMAYCAPQQLSQCLPKIVPKLTEVLTDTHPKVQSAGQMALQQVGSVIKNPEISALVPTLLMGLTDPNDYTKYSLDILLQTTFVNSIDAPSLALLVPIVHRGLRERSAETKKKAAQIVGNMCSLVTEPKDMIPYIGLLLPEVKKVLVDPIPEVRSVAARALGSLIRGMGEENFPDLVSWLLDTLKSDASNVERSGAAQGLSEVLAALGTEYFEHLLPDIIRNCSHQRASVRDGYLTLFKYLPRSLGLQFQNYLQQVLPAILDGLADENESVRDAALSAGHVLVEHYATTSLPLLLPAVEDGIFNDNWRIRQSSVELLGDLLFKVAGTSGKALLEGGSDDEGASTEAHGRAIIEGLGRDKRNEVLAALYMVRADVSISVRQAALHVWKTIVANTPKTLREIMPVLMNTLITSLASSSSERRQVAGRSLGELVRKLGERVLPLIIPILAQGLKDPKTSRRQGVCIGLSEVMASAGKSQLLSFMDELIPTIRTALCDSTPEVRESAGLAFSTLYKSAGMQAIDEIVPTLLHSLEDDQTSDTALDGLKQILSVRTTAVLPHILPKLVHLPLTAFNAHALGALAEVAGPGLNFHLGIVLPALLSAMSDDDTDVQKLAKKAAETVVLVIDEEGVEGLISELLKGVGDNQASIRRSSSFLIGYFFKNSKLYLVDEAPNMITTLIVLLSDSDSATVAVAWEALSRVTNSVPKEVLPSYIKIVRDAVSTSRDKERRKKKGGPVLIPGFCLPKALQPLLPVFLQGLISGSAELREQAAQGLGELIEVTSEQALKEFVIPITGPLIRIIGDRFPWQVKSAILSTLSIIIRKGGIALKPFLPQLQTTFIKCLQDNTRTVRSSAALALGKLSALSTRVDPLVGDLLSSLQVSDGGVREAILTALKGVLQHAGKSVSVAVRTRVYVLLKDFVHHDDDQVRNSAASILGILSQYMEDGQLSDLLQELSSLDSSLSWSARHGSILTISSMLRHSPSSICTSPVFPSVVYCLKDNLKDEKFPVRETSTKALGRLLLHRVQSDPSNTAAHLDVLSPMVSALQDDSSEVRRRALSALKAVAKANPSALMTHITIFGPALAECLKDGNTPVRLAAERCALHAFQLTKGTENVQAAQKFITGLDARRLSKFPEHSDDSEDNEDDPTSG

SEQ ID NO: 6508 - protein, 2870 aa, Glycine max
MAAESLQSLVSLSELVSTSSTNQRVRIFRREIPAFLNSSTSEMSTELASLLIDIIFRTVAIYDDLRSRKAVDDVIVRALGGTVFMKTFAGALVQNMEKQSKFQSHVGGYRLLSWSCLLLSKSQFAAVSKNALCRVAAAQASLLSLVLRRSFRERKACRKKFLHLFSQSPDIYKVYMEELRNGRIPFKDSPELLMLLLEFSSRSPSLFGEFKVTFLDIYVNAILSAKEKPGKSLTEAFHPLYLQMSHGDFQSLVIPSSVKMLKRNPEIVLESVRILLKSVNLDLSKYAAEILSVVLAQARHADEGRRDGALAIVHSLSQKSSNPDALDTMFNAIKSVIKGSEGRLAFPYQRVGMVNAIQELSNAPDGKYLISLSRTICDFLLSYYKDDGNEEVKIVILSAIASWAVRSTDIIQESLVSFLVSGLKEKETLRKGFLRSLHAICKNEDAILKMLPLFGPLVQLVKTGFTKAVQRLDGMYALLLVVTIAAVDIKAEETLVKEKIWALISQNEPSVVPISMASKLSIEDSMACVDLLEVLLVEHLQRTLSNFSVRLMLQLMISFMCHPRWDIRRMTYDVARKIITSAPQLSEDLFLEFSKYLTLIGEKHLALKISDTDISLDPQVLFIPSVEVLVKALLIMSPAALKHAPESFFRIILCSHHPCVVGGAKRDAVWKRLSKCLQTHGFVVIDIISANVGGFLQSEWYLLLHEFVDISATFLLMGENRSFGPGTVLFGAILVSDEYTPFSGKISDIAAFSGKLVTVLANLTHTTLLRFILCSLYSLNAQTLIRQGHTVLAHSRSDHFLVAQQLGVTFFPNPHDLCKEHPEVILLCSSIISTQRVLLTLPLQHLKCSTLFVEVFSIKEFPKNLLLHALPSDFDVLCTHPMFGPQSAPHAWVDLPFVYEMVRIGANEHPIVHCEKFLGIFAREGCRMVEISWSNRFGDYGTDFGWGKPAKVLLGPMGLKSANPLEQQAAILSLCNLMSIIPGDTYLEFEKNLLNLPEQFAHDTLSENDIQIFHTPEGMLFTEQGVYVAESVTAKNTKQDNTRSNHSVKRDQPSREAAGAGKKDTGKAAKKADKGKTAKEEARELLLKEEASVRDRVREIQKNLSLMLRTLGDMATANSVFAHSRLPSMVKFVEPLMRSPIVSDEAFETMVKLARCTAPPLCDWALDISTALRLIVTDEVHLLLDLVPSVAEEEANERPHGLFERILDGLSISCKSGALPVDSFSFIFPIIERILLCSKKTKFHDDVLRIFYLHLDPHLPLPRIRMLSVLYHVLGVVPAYQALIGPALNELSLGLQPAEVASALNGVYAKDVHVRMACLNAVKCIPAVANRSLPENVEVATSIWIALHDPEKSVAQVAEDIWDHYGFDFGTDFSGLYKALAHINYNVRVAAAEALAAALDEHPDSIQESLSTLFSLYIRDMGVGDVNVDAGWLGRQGIALALHSAADILGTKDLPVVMTFLISRALADPNADVRGRMINAGILIIDKNGKDNVSLLFPIFENYLNKTAPDEEKYDLVREGVVIFTGALAKHLAKDDPKVHAVVDKLLDVLNTPSEAVQRAVSACLSPLMQSKQDDAAALVSRLMDQMMKSEKYGERRGAAFGLAGLVKGFGISCLKKYRIVITLQESLAERNSAKSREGALLGFECLCETLGRIFEPYVIQMLPLLLVSFSDQVNAVREAAECAARAMMSQLSAQGVKLVLPSLLKGLEDKAWRTKQSSVQLLGAMAYCAPQQLSQCLPKIVPKLTEVLTDTHPKVQSAGQMALQQVGSVIKNPEISALVPTLLKGLSDPNEHTKYSLDILLQTTFVNSIDAPSLALLVPIVHRGLRERSADTKKRAAQIVGNMCSLVTEPKDMIPYIGLLLPEVKKVLVDPIPEVRSVAARAIGSLIGGMGEENFPDLVPWLFDTLKSDNSNVERSGAAQGLSEVLAALGIEFFEHVLPDIIRNCSHQKASVRDGYLTLFKYLPRSLGVQFQNYLPQVLPAILDGLADENESVRDAALGAGHVLVEHYATTSLPLLLPAVEDGIFNDSWRIRQSSVELLGDLLFKVAGTSGKALLEGGSDDEGSSTEAHGRAIIEILGRDKRNEVLAALYMVRADVSLSVRQAALHVWKTIVANTPKTLREIMPVLMDTLITSLASSSSERRQVAGRSLGELVRKLGERVLPLIIPILSQGLNDPNSSRRQGVCVGLSEVMASAAKSQLLTFMNELIPTIRTALCDSVSEVRESAGLAFSTLYKSAGMLAIDEIVPTLLHALEDDETSDTALDGLKQILSVRTSAVLPHILPKLVHPPLSAFNAHALGALAVVAGPGLDFHLCTVLPPLLSAMGDDDKEVQTLAKEAAETVVLVIDEEGIEPLISELVKGVNDSQAAVRRSSSYLIGYFFKNSKLYLVDEAPNMISTLIILLSDSDSSTVTVAWEALSRVIISVPKEVLPSYIKLVRDAVSTSRDKERRKKKGGPVLIPGFCLPKALQPILPIFLQGLISGSAELREQAALGLGELIEVTSEQSLKEFVIPITGPLIRIIGDRFPWQVKSAILSTLTTMIKKGGISLKPFLPQLQTTFVKCLQDSTRTVRSSAALALGKLSGLSTRVDPLVSDLLSSLQGSDGGVRDAILTALKGVLKHAGKNLSSAVRTRFYSILKDLIHDDDDRVRTYASSILGILTQYLEDVQLTELIQELSSLANSSSWPPRHGSILTISSLLHYNPATICSSSLFPTIVDCLRDTLKDEKFPLRETSTKALGRLLLYRSQVDPSDTLLYKDVLSLLVSSTHDDSSEVRRRALSAIKAVAKANPSAIMSLGTIVGPALAECMKDGNTPVRLAAERCALHAFQLTKGSENVQAAQKYITGLDARRLSKFPEYSDDSDDSDEDTSSS

SEQ ID NO: 6509 - protein, 483 aa, Glycine max
MGKPGEDHLSLPSAEDPRRNAAAASGCAVGLRCLVVLLFSVAVFLSALFWLPPFAHFADPKDLYLNSKYKDHDIVASFYVQKPVSLLEDNILQLSNDIFEEIGAPSTKVIILSLDPLPRSNTTKVVFAVDPDGKYSEMSAAAISLIRASFKYLVIRQSYLQLTTFLFGVPSVFEVLKFKGGITIIPQQSVFPLQTVQTLFNFTLNFSIYEIQSNFDELTSQLKSGLHLAPYENLYVILSNSEGSTVVAPTVVQSSVLLAVGIPPSKERLKQLAQTIMGHHSWNLGLNNTQFGRAKQVRLSSILQHSLHGSGGSGSPSPSPLPYPHHHYHHHHHHQSHHHNTHVFPETSPAPTPTTGEGATLHNFGAPAPARSVPAPGRSSYAQPPNCRFAHVTPAAPPTTAPHYPVASPWVGPPAHGFDSSVPALSPLPNVAFAHAEPPPKNEAAAEHLNSHFHGPSPSSSSAGCAGTVKWTSLMFLVLVLLV

SEQ ID NO: 6510 - protein, 507 aa, Glycine max
MGKPGEHHLLPSGVAAEDPRRNAASPPGCAVGFRCLVVLLFSVAVFLSALFWLPPFAHFADPKDLHINSKYKDHDIVASFYVQKPVSLLEENILQLSNDIFEEIGVLSTKVVILSLDPLPQSNTTKVVFAVDPDSKYSEMSAAAISLIRASFKYLVIRQSYLQLSTSLFGVPSVFEVLKFKGGITIIPQQSVFPLQMVQTLFNFTLNFSIYEIQSNFDELTSQLKSGLHLAPYENLYVILSNSEGSTVTAPTVVQSSVLLAVGIPPSKERLKQLAQTIMGHHSWNLGLNNTQFGRVKQVRLSSILQHSLHGNGGNGSPSPAPQPHPHPHPHHHHHHHHHHHHHSHHHHAHVFPETSPAPAPTPTTGEGSTSHNFGAPAAPARSLPAPWRSSYAQPPNCRFEHRKRSPRNSQKHAHLTPAVSPTNAPHYPVASPWVGPPAHGFHSSVPALSPLPNVAFAHAEPPPKNEPSAERPNSHFQGPSPSSSCAGCVGTVKWTSLMFLVLVLLV

SEQ ID NO: 6511 - protein, 512 aa, Glycine max
MGKPGEHHPLPSYSAAEDQRRNAAPPPGCAVGLRCLVVMLFSVAVFLSPLFWLPPFAHFADPKDLHLDSKYKDHDIVASFYVQKPVSLLEDNILLLSKDIFEEIGVPSTKVVILSLDPLPRSNTTKVVFAVDPDGKYSEMSAAAISLIRASFKYLVIRQSYLQLTTSLFGVPSVFEVLKFKGGITIIPQQSVFPLQTVQTLFNFTLNFSIYEIQSIFDELTSQLKSGLHLAPYENLYVILSNSEGSTVTAPTVVQSSVLLAVGIPPSKERLKQLAQTIMGHHSWNLGLNNTQFGRVKQVRLSSIWQHSLHGNGGNGSPSPAPQPHPHPHHHHHHHHHHHHHHHHHSHHHHAHVFPETSPAPAPTPTPTTGEDSTSHNFGAPAAPARSLPAPWRSSYAQPPNCRFEHRKRSPRNTQKHAHLTPAVSPTNVPHYPVASPGVGPPAHHGFHSLVPALSPLPNVAFAHAEPPPKNDSSAERPKSHFQWPSPSFSSAGCVGTVKWTSLVFLVVVLLV

SEQ ID NO: 6512 - protein, 339 aa, Glycine max
MHAKSAQSSFRDRTQEFHSITERLKKSGSGPNGPSSSTSSTRSEEQRSAIANQSEFNRRASKIGYGIHQTSQKLAKLAKLAKRTSVFDDPTMEIQELTGVIKQDITALNSAVVDLQFLCNSRNESGNVSADTTSHSSTVVDDLKTRLMSTTKEFKDVLTMRTENMKVHENRRQLFSSSASKDSANPFIRQRPLAARAAASTSNAPALPWANGSPSSSQAFPKKQVDGESQPLLQQQQQQQEVVPLQDSYMQSRAEALQNVESTIHELSNIFNQLATLVSQQGEIAIRIDENMDDTLANVEGAQGALLKYLNSISSNRWLMIKIFSVLIFFLMVFLFFVA

SEQ ID NO: 6513 - protein, 339 aa, Glycine max
MHVKSAQSSFRDRTQEFHSITERLKKSGSGPNGPSSSSTSSRSEEQRSAIANQSEFNRRASKIGYGIHQTSQKLAKLAKLAKRTSVFDDPTMEIQELTGVIKQDITALNSAVVDLQLVCSSRNETGNVSADTSSHSSTVVDDLKTRLMSTTKEFKDVLTMRTENMKVHENRRQLFSSSASKDSANPFIRQRPLAARAAASTSSAPALPWANGSPSSSQAFPKKQVDGESQPLLQQQQQQQEVVPLQDSYMQSRAEALQNVESTIHELSNIFNQLATLVSQQGEIAIRIDENMDDTLANVEGAQGALLKYLNSISSNRWLMIKIFFVLIFFLMVFLFFVA

SEQ ID NO: 6514 - protein, 337 aa, Glycine max
MYTKSAQSSFRDRTHEFQSIAERLKKTGSAPNGQSSSSSRSEEQRSAIANQSEFNRRASKIGLGIHQTSQKLAKLAKLAKRTSVFDDPTMEIQELTGVIKQDITALNSAVVDLQLLCNSRNESGNASTDTTSHSTTVVDDLKTRLMSTTKEFKDVLTMRTENLKVHENRRQLFSANGSKDSANPFVRQRPLATRSAANTSNAPAPPWATGSSSSQLFPKKQVDGESQPLLQQQQQQQQEVVPLQDSYMQSRAEALQNVESTIHELSNIFNQLATLVSQQGEIAIRIDENMDDTLANVEGAQGALLKYLNSISSNRWLMIKIFFVLIFFLMVFLFFVA

SEQ ID NO: 6515 - protein, 340 aa, Vitis vinifera
MPVKLQQSSFRDRTPEFLNVAERLKKSFSSTQNGANSASKAEEQRFAVAMQSEFNKRASKIGFGIHQTSQKLSKLAKLAKRTSVFDDPTMEIQELTAVIKQDITALNSAVVDLQLLSNSRNESGNISSDTTSHSTTVVDDLKNRLMSATKEFKEVLTMRTENLKVHENRRQLFSTASKDSTNPFVRQRPLATRSAASASASPPPWANGSPSSSQLFPRKQIDGESQPLIQQQQQQQQQQQQQLVPLQDSYMQSRAEALQNVESTIHELSSIFNQLATLVSQQGELAIRIDENMDDTLANVEGAQGALLKYLHSISSNRWLMIKIFFVLIFFLMVFLFFVA

SEQ ID NO: 6516 - protein, 336 aa, Glycine max
MHTKSAQSSFRDRTHEFQSIAERLKKTGPAPNGQSSSSSRSEEQRSAIANQSEFNRRASKIGFGIHQTSQKLAKLAKLAKRTSVFDDPTMEIQELTGVIKQDITALNSAVVDLQLLSNSRNESGNASTDTTSHSTTVVDDLKTRLMSATKEFKDVLTMRTENLKVHENRRQLFSATASKDSANPFVRQRPLATRSAASTSNAPAAPWATGSSSSQLFPKKQVDGESQPLLQQQQQQQEVVPLQDSYMQNRAEALQNVESTIHELSNIFNQLATLVSQQGEIAIRIDENMDDTLANVEGAQGALLKYLNNISSNRWLMIKIFFILIFFLMVFLFFVA

SEQ ID NO: 6517 - protein, 338 aa, Vitis vinifera
MSMKSAQSSYRDRTQEFLNVAERLKKSFSSAAPNAVTSSGAKPDGTRSSLAIQKEFKDRASRIGYGIHQTSQKLAKLAKLAKRTSVFDDPTMEIQELTAVVKQDITALNAAVVDLQLLCNSQNESGNISSDTTSHSTTVVDDLKNRLMSATKEFKDVLTMRTENLKVHENRRQLFSSTASKESTNPFVRQRPLAAKSTATASSSPPPWANESSSSSPLFPRKQGNVESQPLLQQQQQQQQLVPLQDSYMQSRAEALQNVESTIHELSNIFTQLATMVSQQGELAIRIDENMEDTLANVEGAQGQLVRYLNSISSNRWLMIKIFFVLIVFLMIFLFFVA

SEQ ID NO: 6518 - protein, 346 aa, Ricinus communis
MSVVAPGKSSYRDRTQEFLSVVERLKKSFSSANNAAASSTSSSSSISKPDATRSAVAIQSEFNKRASKIGFGIHQTSQKLSKLAKLAKRSSVFDDPTMEIQELTAVIKQDITALNAAVVDLQLLCNSQNESGNISSDTTTHSTTVVDNLKNRLMSATKEFKEVLTMRTENLKVHENRRQLFSSTASKDSTNPFVRQRPLASRSTANASPAPPPPWANGSASSSQLFPSKQTDGESQPLLQQQRQQQQQMVPLQDSYMQSRAEALHNVESTIHELSNIFTQLATMVSQQGELAIRIDENMDDTLSNVEGAQNQLVRYLNSISSNRWLMIKIFFVLIVFLMIFLFFVA

SEQ ID NO: 6519 - protein, 336 aa, Medicago truncatula
MQFKSSQSSFRDRTHEFLTVAERLKKSVSSGSAPNGATTSAPSSSFPSSSRSDDPRSAVAIQSEFNRRASKIGYGIHQTSQKLSKLAKLAKRTSVFDDPTMEIQELTSVIKQDITALNSAVVDLQLISNSRNESGNVSTDTTSHSTTVVDDLKTRLMSTTKEFKDVLTMRTENLKVHENRRQLFSANASKDSANPFIRQRPLATKSAASTSSAPAPPWASGKQVDGESQPLLQQQQQQVVPLQDSYMQSRAEALQNVESTIHELSNIFNQLATLVSQQGEVAIRIDENMDDTLANVEGAQGALLKYLNSISSNRWLMIKIFFVLMFFLMVFLFFVA

SEQ ID NO: 6520 - protein, 1131 aa, Glycine max
MSTSRPSQSSSNSRRSRHSARMAQATVDAKIHATFEESGSSFDYSSSVRVSGTADGVNQPRSDKVTTAYLRGKMIQPFGCLLAIDEKNHMQTCKVIAYSENEPEMLTMVSHAVPSVGDHPALGIGTDIKTLFTAPSVSGLQKALGCADVSLLNPILVHCKTSGKPFYAIVHRVTGSLIVDFEPVKPYEVPMTAAGALQSYKLAAKAITRLQSLPSGNMERLCDTMVQEVFELTGYDRVMAYKFHEDDHGEVIREITKPCLEPYLGLHYPATDIPQASRFLFRKNKVRMIVDCHAKHVRVLQDEKLQFDLILCGSTLRAPHSCHAQYMANMDSIASLVLAVVVNDNEEDGDTDAVQPQKTERLWGLVVCHNTTPRFVPFPLRYAREFLPQVFADHVHKEIELEYQIIEKNILHHPGHLLCMLMRDAPLGIASESPNIMDLVKCDGAALIYRNKVWRLGVTPSEPQIREIALWLSEYHMDSTSFSTDSLFDAGFPSALSLGDVVCGMASVRVTAKDMVFWFRSHTAAEIRWGGAKHEAGEKDDSRRMHPRSSFKAFLEVVKARSLPWKEYEMDAIHSLQIILRNAFKEDTESLDLNAKAINTRLRDLKIEGINDLKIERMQELEAVTSEIVRLDYTATVPILAVDVDGLVNGWNIKIAELTGLPIGEATGKHLLTLVEDSSTDRVKKMLNLALLGEEEKNVQFEIKTLGSKMDSGPISLVVNRCASRDLRDNVVGVCFVAHDITAQKNVMDKFIRIEGDYKAIVQNRNPLIPPIFGTDEFGWCCEWNPAMMKLTGWKREEVMDKMLLGEIFGTQMAACRLKNQEAFVNLGVVLNKAMTGSETEKVPFGFFARNGKYVECLLSVSKKLDVEGLVTGVFCFLQLASPELQQALHIQRLSEQTASKRLNALSYMKRQIRNPLCGIVFSRKMLEGTDLGTEQKQLLRTSAQCQQQLSKILDDSDLDTIIDGYLDLEMAEFTLHEVLVTSLSQVMEKSNGKSIRIVNDVAGHIMMETLYGDSLRLQQVLADFLLISINFTPNGGQVVVAGSLTKEQLGKSVHLVKLELSITHGGSGVPEVLLNQMFGNNGLESEEGISLLIRAKLLKLMNGDVRYLREAGKSAFILSAELAAAHNLKA

SEQ ID NO: 6521 - protein, 1130 aa, Glycine max
MSTSRPSQSSSNSRRSRHSARMAQATVDAKIHATFEESGSSFDYSSSVRVSGTADGVNQPRSDKVTTAYLNHMQRGKMIQPFGCLLAIDEKTCKVIAYSENAPEMLTMVSHAVPSVGDHPALGIGTDIKTLFTAPSVSGLQKALGCADVSLLNPILVHCKTSGKPFYAIVHRVTGSLIVDFEPVKPYEVPMTAAGALQSYKLAAKAITRLQSLPSGNMERLCDTMVQEVFELTGYDRVMAYKFHEDDHGEVIAEITKPGLEPYLGLHYPATDIPQASRFLFRKNKVRMIVDCHAKHVRVLQDEKLQFDLILCGSTLRAPHSCHAQYMANMDSIASLVLAVVVNDNEEDGDTDAVQPQKRERLWGLVVCHNTTPRFVPFPLRYACEFLAQVFAVHVHKEIELEYQIIEKNILRTQALLCMLMRDAPLGIVSESPNIMDLVKCDGAALIYRNKVWRLGVTPSEPQIREIALWLSEYHMDSTGFSTDSLFDAGFPSALSLGDVVCGMASVRVTAKDMVFWFRSHTAAEIRWGGAKHEAGEKDDSRRMHPRSSFKAFLEVVKARSLPWKEYEMDAIHSLQIILRNAFKEDTESLDLNAKAINTRLSDLKIEGINDLKIERMQELEAVTSEIVRLIDTATVPILAVDVDGLVNGWNIKIAELTGLPIGEATGKHLLTLVEDSSTDRVKKMLNLALLGEEEKNVQFEIKTHGSKMDSGPISLVVNACASRDLRDNVVGVCFVAHDITAQKNVMDKFIRIEGDYKAIVQNRNPLIPPIFGTDEFGWCCEWNPAMMKLTGWKREEVMDKMLLGEIFGTQMAACRLKNQEAFVNLGVVLNKAMTGSETEKVPFGFFARNGKYVECLLSVSKKLDVEGLVTGVFCFLQLASPELQQALHIQRLSEQTASKRLNALSYMKRQIRNPLCGIVFSRKMLEGTDLGTEQKQLLRTSAQCQQQLSKILDDSDLDTIIDGYLDLEMAEFTLHEVLVTSLSQVMTKSNGKSIRIVNDVAGHIMMETLYGDSLRLQQVLADFLLISINFTPNGGQVVVAGSLTKEQLGKSVHLVKLELSITHGGSGVPEVLLNQMFGNNGLESEEGISLLISRKLLKLMNGDVRYLREAGKSAFILSAELAAAHNLKA

SEQ ID NO: 6522 - protein, 1130 aa, Glycine max
MSTSRPSQSSSNSRRSRHSARMAQATVDAKIHATFEESGSSFDYSSSVRVSGTADGVNQPRSDKVTTAYLNRMQRGKMIQPFGCLLAIDEKTCKVIAYSENAPEMLTMVSHAVPSVGDHPALGIGTDIKTLFTAPSVSGLQKALGCADVSLLNPILVHCKTSGKPFYAIVHRVTGSLIVDFEPVKPYEVPMTAAGALQSYKLAAKAITRLQSLPSGNMERLCDTMVQEVFELTGYDRVMAYKFHEDDHGEVIAEITKPGLEPYLGLHYPATDIPQASRFLFRKNKVRMIVDCHAKHVRALQDEKLQFDLILCGSTLRAPHSCHAQYMANMDSIASLVLAVVVNDNEEDGDTDAVQPQKRERLWGLVVCHNTTPRFVPFPLRYACEFLAQVFAVHVHKEIELEYQIIEKNILRTQALLCMLMRDAPLGIVSESPNIMDLVKCDGAALIYRNKVWRLGVTPSEPQIREIALWLSEYHMDSTGFSTDSLFDAGFPSALSLGDVVCGMASVRVTAKDMVFWFRSHTAAEIRWGGAKHEAGEKDDSRRMHPRSSFKAFLEVVKARSLPWKEYEMDAIHSLQIILRNAFKEDTESLDLNAKAINTRLSDLKIEGINDLKIERMQELEAVTSEIVRLIDTATVPILAVDVDGLVNGWNIKIAELTGLPIGEATGKHLLTLVEDSSTDRVKKMLNLALLGEEEKNVQFEIKTHGSKMDSGPISLVVNACASRDLRDNVVGVCFVAHDITAQKNVMDKFIRIEGDYKAIVQNRNPLIPPIFGTDEFGWCCEWNPAMVKLTGWKREEVMDKMLLGEIFGTQMAACRLKNQEAFVNLGVVLNKAMTSSETEKVPFGFFARNGKYVECLLSVSKKLDVEGLVTGVFCFLQLASPELQQALHIQRLSEQTASKRLNALSYMKRQIRNPLCGIVFSRKMLEGTDLGTEQKQLLRTSAQCQQQLSKILDDSDLDTIIDGYLDLEMAEFTLHEVLVTSLSQVMTKSNGKSIRIVNDVAGHIMMETLYGDSLRLQQVLADFLLISINFTPNGGQVVVAGSLTKEQLGKSVHLVKLELSITHGGSGVPEVLLNQMFGNNGLESEEGISLLISRKLLKLMNGDVRYLREAGKSAFILSAELAAAHNLKA

SEQ ID NO: 6523 - protein, 1122 aa, Glycine max
MSTSRPSQSSSNSRRSRHSARMAQATVDAKIHATFEESGSSFDYSSSVRVSGTADGVNQPRSDKVTTAYLNHMQRGKIIQPFGCLLAIDEKTCKVIAYSENAPEMLTMVSHAVPSVGDHPALGIGTDIKTLFTAPSASALQKALGFAEVLLLNPVLIHCKTSGKPFYAIIHRVTGSMIIDFEPVKPYEVPMTAAGALQSYKLAAKAITRLQSLPSGSMERLCDTMVQEVFELTGYDRVMAYKFHEDDHGEVIAEITKPGLEPYLGLHYPATDIPQASRFLFMKNKVRMIVDCHAKHVRVLQDEKLPFDLTLCGSTLRAPHSCHAQYMANMDSIASLVMAVVVNDNEEDGDTDAIQPQKRKRLWGLVVCHNTTPRFVPFPLRYACEFLAQVFAIHVNKEIELEYQIIEKNILRTQTLLCDLVMRDAPLGIVSESPNIMDLVKCDGAALIYKNKVWRLGVTPSESQIREIAFWLSEYHMDSTGFSTDSLSDAGFPSAPSLGDVVCGMAAVRVTAKDVVFWFRSHTAAEIRWGGAKHEAGEKDDGRRMHPRSSFKVFLDVVKARSLPWKEYEIDAMHSLQLILRNAFKDTESMDLNTKAINTRLSDLKIEGMQELEAVTSEIVRLIETATVPILAVDVDGLVNGWNIKIAELTGLPVGEAMGKHLLTLVEDSSTDRVKKMLNLALLGEEEKNVQFEIKTHGSKMDSGPISLVVNACASRDLRDNVVGVCFVAHDITAQKNVMDKFTRIEGDYKAIVQNRNPLIPPIFGTDEFGWCCEWNPAMTKLTGWKREEVMDKMLLGELFGTHMAACRLKNQEAFVNLGVVLNKAMTGLETEKVPFGFFARNGKYVECLLSVSKKLDVEGLVTGVFCFLQLASPELQQALHIQRLSEQTALKRLNALSYMKRQIRNPLCGIIFSRKMLEGTALGTEQKQLLRTSAQCQQQLSKILDDSDLDSIIDGYLDLEMAEFTLHEVLVTSLSQVMTKSNGKSIRIVNDVAEQIVMETLYGDSLRLQQVLADFLLISINFTPNGGQVVVAGTLTKEQLGKSVHLVKLELSITHGGSGVPEALLNQMFGNNGLESEEGISLLISRKLLKLMNGDVRYLREAGKSAFILSAELAAAHNLKG

SEQ ID NO: 6524 - protein, 1123 aa, Glycine max
MSTSRPSQSSSNSGRSRRSARAMALATVDAKLHATFEESGSSFDYSSSVRISGTADGVNQPRHDKVTTAYLHHMQKGKMIQPFGCLLALDEKTCKVIAYSENAPEMLTMVSHAVPSVGDHPALGIGTDIKTLFTAPSASALQKALGFAEVLLLNPVLIHCKTSGKPFYAIIHRVTGSMIIDFEPVKPYEVPMTAAGALQSYKLAAKAITRLQSLPSGSMERLCDTMVQEVFELTGYDRVMAYKFHEDDHGEVIAEITKPGLEPYLGLHYPATDIPQASRFLFMKNKVRMIVDCHAKHVRVLQDEKLPFDLTLCGSTLRAPHSCHAQYMANMDSIASLVMAVVVNDNEEDGDTDAIQPQKRKRLWGLVVCHNTTPRFVPFPLRYACEFLAQVFAIHVNKEIELEYQIIEKNILRTQTLLCDLVMRDAPLGIVSESPNIMDLVKCDGAALIYKNKVWRLGVTPSESQIREIAFWLSEYHMDSTGFSTDSLSDAGFPSALSLGDVVCGMAAVRVTAKDVVFWFRSHTAAEIRWGGAKHEAGEKDDGRRMHPRSSFKVFLDVVKARSLPWKEYEIDAMHSLQLILRNAFKDTESMDLNTKAINTRLSDLKIEGMQELEAVTSEIVRLIETATVPILAVDVDGLVNGWNIKIAELTGLPVGEAMGKHLLTLVEDSSTDRVKKMLNLALLGEEEKNVQFEIKTHGSKMDSGPISLVVNACASRDLRDNVVGVCFVAHDITAQKNVMDKFTRIEGDYKAIVQNRNPLIPPIFGTDEFGWCCEWNPAMTKLTGWKREEVMDKMLLGELFGTHMAACRLKNQEAFVNLGVVLNKAMTGLETEKVPFGFFARNGKYVECLLSVSKKLDVEGLVTGVFCFLQLASPELQQALHIQRLSEQTALKRLNALSYMKRQIRNPLCGIIFSRKMLEGTALGTEQKQLLRTSAQCQQQLSKILDDSDLDSIIDGYLDLEMAEFTLHEVLVTSLSQVMTKSNGKSIRIVNDVAEQIVMETLYGDSLRLQQVLADFLLISINFTPNGGQVVVAGTLTKEQLGKSVHLVKLELSITHGGSGVPEALLNQMFGNNGLESEEGISLLISRKLLKLMNGDVRYLREAGKSAFILSAELAAAHNLKG

SEQ ID NO: 6525 - protein, 1124 aa, Lathyrus sativus
MSTTRPSQSSNNSGRSRNSARIIAQTTVDAKLHATFEESGSSFDYSSWVRVSGSVDGDQQPRSNKVTTAYLNHIQRGKQIQPFGCLLALDEKTCKVVAYSENAPEMLTMVSHAVPSVGDHPALGIGTDIRTVFTAPSASALQKALGFAEVSLLNPILVHCKTSGKPFYAIIHRVTGSLIIDFEPVKPYEVPMTAAGALQSYKLAAKAITRLQSLASGSMERLCDTMVQEVFELTGYDRVMAYKFHEDDHGEVIAEIAKPGLEPYLGLHYPATDIPQAARFLFMKNKVRMIVDCNAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEYQILEKNILRTQTLLCDMLMRDAPLGIVSQSPNIMDLVKCDGAALFYRNKLWLLGATPTEYQIREIALWMSEYHTDSTGLSTDSLLDAGFPGALSLSDTVCGMAAVRITSKDIVFWFRSHTAAEIRWGGAKHEPGEQDDGRKMHPRSSFKAFLEVVKARSVPWKDFEMDAIHSLQLILRNASKDTDIIDLNTKAINTRLNDLKIEGMQELEAVTSEMVRLIETATVPILAVDVDGTVNGWNIKIAELTGLPVGEAIGKHLLTLVEDSSTDIVKKMLNLALQGEEEKNVQFEIKTHGDQVEFGPISLIVNACASRDLRENVVGVCFVAQDITAQKTVMDKFTRIEGDYKAIVQNPNQLIPPIFGTDEFGWCCEWNAAMIKLTGWKREEVMDKMLLGEVFGTQMSCCRLKNQEAFVNFGIVLNKAMTGLETEKVAFGFFSRKGKYVECLLSVSKKIDAEGLVTGVFCFLQLASPELQQALHIQRLSEQTALKRLKVLTYMKRQIRNPLAGIVFSSKMLEGTDLETEQKQIVNTSSQCQRQLSKILDDSDLDGIIDGYLDLEMAEFTLHEVLVTSLSQVMNRSNTKGIRIANDVAEHIAKESLYGDSLRLQQVLADFLLISINSTPNGGQVVIASSLTKEQLGKSVHLVNLELSITHGGSGVPEAALNQMFGNNVLESEEGISLHISRKLLKLMNGDVRYLKEAGKSSFILSVELAAAHKLKG

SEQ ID NO: 6526 - protein, 1124 aa, Pisum sativum
MSTTRPSQSSNNSGRSRNSARIIAQTTVDAKLHATFEESGSSFDYSSSVRVSGSVDGDQQPRSNKVTTAYLNHIQRGKQIQPFGCLLALDEKTCKVVAYSENAPEMLTMVSHAVPSVGDHPALGIGTDIRTVFTAPSASALQKALGFAEVSLLNPILVHCKTSGKPFYAIIHRVTGSLIIDFEPVKPYEVPMTAAGALQSYKLAAKAITRLQSLASGSMERLCDTMVQEVFELTGYDRVMAYKFHEDDHGEVIAEIAKPGLEPYLGLHYPATDIPQAARFLFMKNKVRMIVDCNAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEYQILEKNILRTQTLLCDMLMRDAPLGIVSQSPNIMDLVKCDGAALFYRNKLWLLGATPTESQLREIALWMSEYHTDSTGLSTDSLSDAGFPGALSLSDTVCGMAAVRITSKDIVFWFRSHTAAEIRWGGAKHEPGDQDDGRKMHPRSSFKAFLEVVKARSVPWKDFEMDAIHSLQLILRNASKDTDIIDLNTKAINTRLNDLKIEGMQELEAVTSEMVRLIETATVPILAVDVDGTVNGWNIKIAELTGLPVGEAIGKHLLTLVEDSSTDIVKKMLNLALQGEEEKNVQFEIKTHGDQVESGPISLIVNACASKDLRENVVGVCFVAQDITAQKTVMDKFTRIEGDYKAIVQNPNQLIPPIFGTDEFGWCCEWNAAMIKLTGWKREEVMDKMLLGEVFGTQMSCCRLKNQEAFVNFGIVLNKAMTGLETEKVPFGFFSRKGKYVECLLSVSKKIDAEGLVTGVFCFLQLASPELQQALHIQRLSEQTALKRLKVLTYMKRQIRNPLAGIVFSSKMLEGTDLETEQKRIVNTSSQCQRQLSKILDDSDLDGIIDGYLDLEMAEFTLHEVLVTSLSQVMNRSNTKGIRIANDVAEHIARETLYGDSLRLQQVLADFLLISINSTPNGGQVVIAASLTKEQLGKSVHLVNLELSITHGGSGVPEAALNQMFGNNVLESEEGISLHISRKLLKLMNGDVRYLKEAGKSSFILSVELAAAHKLKG

SEQ ID NO: 6527 - protein, 1171 aa, Medicago truncatula
MKSKMVSELSDVREKGRKVKERLQLGGRQTRAVLAAAAAGAGYVCDKMSTTRPSQSSNNSGRSRNSARIIAQTTVDAKLHATFEESGSSFDYSSSVRVSGSVDGEHQPRSNKVTTAYLNTIQRGKQIQPFGCLLALDEKTCKVIAYSENAPEMLTMVSHAVPSVGDHPALGIGTDIRTIFTAPSASALQKALGFAEVSLLNPILVHCKTSGKPFYAIIHRVTGSLIIDFEPVKPYEVPMTAAGALQSYKLAAKAITRLQSLPSGSMERLCDTMVQEVFELTGYDRVMAYKFHEDDHGEVIAEVTKTGLEPYLGLHYPATDIPQAARFLFMKNKVRMIVDCHAKHVKVLQDEKLPFDLTLCGSTLRAPHSCHLQYMANMDSIASLVMAVVVNDSDEDGDSADAVLPQKKKRLWGLVVCHNTTPRFVPFPLRYACEFLAQVFAIHVNKEIELEFQILEKNILRTQTLLCDMLMRDAPLGIVSQSPNIMDLVKCDGAALLYRNKLWILGATPSEPQIREIALWMSEYHTDSTGLSTDSLSDAGFPGALKLNDTVCGMAAVRITSKDIVFWFRSHTAAEIRWGGAKHEPGEQDDGRKMHPRSSFKAFLEVVKARSIPWKDFEMDAIHSLQLILRNASKDTDMIDLNSKAINTRLNDLKIEGMQELEAVTSEMVRLIETATVPILAVDVDGMVNGWNIKISELTGLPVGEAIGKHLLTLVEDSSTDIVKKMLNLALQGQEEKNVQFEIKTHGSKTDCGPISLIVNACASRDLHENVVGVCFVAQDITAQKTVMDKFTRIEGDYKAIVQNPNQLIPPIFGTDEFGWCCEWNAAMIKITGWKREEVMDKMLLGEVFGTHMSCCRLKNQEAFVNFGIVLNKAMTGLETEKVPFGFLSRKGKYVECLLSVSKKIDAEGLVTGVFCFLQLASPELQQALHIQRLSEQTALKRLKVLTYMRRQIRNPLSGIVFSSKMLENTELGTEQKRIVNTSSQCQRQLSKILDDSDLDSIIDGYLDLEMAEFTLHEVLVTSLSQVMNRSNTRSIRIVNDVAEHIAMETLYGDSLRLQQVLADFLLISINSTPNGGQVVIAATLTKEQLGKSVHLVNLELSITHGGNGVAEAVLNQMFGNNGLESEEGISLHISRKLLKLMNGDVRYLKEAGKSSFILSVELAAAQKLRG

SEQ ID NO: 6528 - protein, 1124 aa, Vitis vinifera
MSSSRPTQSSSTSGRSKHSARIIAQTTVDAKLHADFEESGSSFDYSSSVRFTPAGGDQQPRSDKVTTAYLHHIQKGKLIQPFGSLLALDEKTFKVIAYSENAPEMLTMVSHAVPSVGEHPVLGIGTDVRTIFSGPSASALHKALGFGEVSLLNPILVHCKTSGKPFYAIIHRVTGSLIIDFEPVKPYEVPMTAAGALQSYKLAAKAITRLQSLPSGSLERLCDTMVQEVFELTGYDRVMAYKFHDDDHGEVVSEITKPGLEPYLGLHYPATDIPQAARFLFMKNKVRMICDCRAKHIQVLQDEKLPFDLTLCGSTLRAPHSCHVQYMENMNSIASLVMAVVVNDGDEEGESSNSGQPQKRKRLWGLVVCHHTTPRFVPFPLRYACEFLAQVFAIHVNKELELESQILEKNILRTQTLLCDMLMRDAPLGIVSQSPNVMDLVKCDGAALLYKNKVWRLGITPSDFQLHDICSWLSEYHMDSTGLSTDSLYDAGYPGALALGDAVCGMAAVKITSKDTLFWFRSHTAAEVRWGGAKHEPGEKDDGRKMHPRSSFKAFLEVVKTRSLPWKDYEMDAIHSLQLILRNAFKDSEAMDVNTNAIHTKLNDLKIEGMQELEAVTSEMVRLIETASVPILAVDVDGLVNGWNTKISELTSLPVDKAIGMHLLTLVEDSSADTVKKMLHLALQGQEEQNVQFEIKTHGSKRDSGPISLVVNACASRDLHENVVGVCFVAQDITSQKTVMDKFTRIEGDYKAIVQNPNPLIPPIFGTDEFGWCSEWNPAMVKLSGWNREEVMDKMLLGEVFGTHMACCRLKNREAFVGLGIVLNSVMTGRESEKVSFGFFSKSGKYVECLLSVSKKLDREGAVTGVFCFLQLASQELQQALHIQRLSEQTALKRLKALAYIKRQIKNPLSGIIFSRKMMEDTDLGEEQQQILHTSAQCQRQLSKILDDHDLDSIIEGYLDLEMVEFTLREVLVASISQVMIKSNGKGIQIVNDAEEGIMTETLYGDGLRLQQVLADFLLISVNFTPGGGQLSVAASLIKDRLGESVHLVHLELRITHAGNGVPEQLLNQMFGNNGDASEEGISLLISRKLVKLMNGDVQYLREAGKSTFIISIELAAARKKPQA

SEQ ID NO: 6529 - protein, 1124 aa, Vitis riparia
MSSSRPTQSSSTSGRSKHSARIIAQTTVDAKLHADFEESGSSFDYSSSVRFTPAGGDQQPRSDKVTTAYLHHIQKGKLIQPFGSLLALDDKTFKVIAYSENAPEMLTMVSHAVPSVGEHPVLGIGTDVRTIFSGPSASALHKALGFGEVSLLNPILVHCKTSGKPFYAIIHRVTGSLIIDFEPVKPYEVPMTAAGALQSYKLAAKAITRLQSLPSGSLERLCDTMVQEVFELTGYDRVMAYKFHDDDHGEVVSEITKPGLEPYLGLHYPATDIPQAARFLFMKNKVRMICDCRAKHIQVLQDEKLPFDLTLCGSTLRAPHSCHVQYMENMNSIASLVMAVVVNDGDEEGESSNSGQPQKRKRLWGLVVCHHTTPRFVPFPLRYACEFLAQVFAIHVNKELELESQILEKNILRTQTLLCDMLMRDAPLGIVSQSPNVMDLVKCDGAALLYKNKVWRLGITPSDFQLHDICSWLSEYHMDSTGLSTDSLYDAGYPGALALGDAVCGMAAVKITSKDTLFWFRSHTAAEVRWGGAKHEPGEKDDGRKMHPRSSFKAFLEVVKTRSLPWKDYEMDAIHSLQLILRNAFKDSEAMDVNTNAIHTKLNDLKIEGMQELEAVTSEMVRLIETASVPILAVDVDGLVNGWNTKISELTSLPVDKAIGMHLLTLVEDSSADTVKKMLHLALQGQEEQNVQFEIKTHGSKRDSGPISLVVNACASRDLDENVVGVCFVAQDITSQKTVMDKFTRIEGDYKAIVQNPNPLIPPIFGTDEFGWCSEWNPAMVKLSGWNREEVMDKMLLGEVFGTHMACCRLKNREAFVGLGIVLNSVMTGRESEKVSFGFFSKSGKYVECLLSVSKKLDREGAVTGVFCFLQLASQELQQALHIQRLSEQTALKRLKALAYIKRQIKNPLSGIIFSRKMMEDTDLGEEQQQILHTSAQCQRQLSKILDDHDLDSIIEGYLDLEMVEFTLREVLVASISQVMIKSNGKGIQIVNDAEEGIMTETLYGDGLRLQQVLADFLLISVNFTPGGGQLSVAASLIKDRLGESVHLVHLELRITHAGNGVPEQLLNQMFGNNGDASEEGISLLISRKLVKLMNGDVQYLREAGKSTFIISIELAAARKKPQA

SEQ ID NO: 6530 - protein, 282 aa, Populus trichocarpa; identical to SEQ ID NO: 6490

SEQ ID NO: 6531 - protein, 232 aa, Populus trichocarpa; identical to SEQ ID NO: 6489

SEQ ID NO: 6532 - protein, 339 aa, Glycine max; identical to SEQ ID NO: 6513

SEQ ID NO: 6533 - protein, 339 aa, Glycine max; identical to SEQ ID NO: 6512

SEQ ID NO: 6534 - protein, 347 aa, Arabidopsis thaliana
MSARHGQSSYRDRSDEFFKIVETLRRSIAPAPAANNVPYGNNRNDGARREDLINKSEFNKRASHIGLAINQTSQKLSKLAKLAKRTSVFDDPTQEIQELTVVIKQEISALNSALVDLQLFRSSQNDEGNNSRDRDKSTHSATVVDDLKYRLMDTTKEFKDVLTMRTENMKVHESRRQLFSSNASKESTNPFVRQRPLAAKAAASESVPLPWANGSSSSSSQLVPWKPGEGESSPLLQQSQQQQQQQQQQMVPLQDTYMQGRAEALHTVESTIHELSSIFTQLATMVSQQGEIAIRIDQNMEDTLANVEGAQSQLARYLNSISSNRWLMMKIFFVLIAFLMIFLFFVA

SEQ ID NO: 6535 - protein, 841 aa, Medicago truncatula
MWKVPSSLVLLLLLQLACSLICSVIASVSYDSKAITINGQSRILISGSIHYPRSTPEMWPDLIQKAKEGGLDVIQTYVFWNGHEPSPGKYYFEGNYDLVKFIKLVQQAGLYVHLRIGPYVCAEWNFGGFPVWLKYIPGISFRTDNEPFKFQMQKFTEKIVDMMKADRLFESQGGPIIMSQIENEYGPMEYEIGAPGKSYTKWAADMAVGLGTGVPWIMCKQDDAPDPVINTCNGFYCDYFSPNKDYKPKMWTEAWTGWFTEFGGPVPHRPAEDMAFSVARFIQKGGSFINYYMYHGGTNFGRTAGGPFIATSYDYDAPLDEYGLLQQPKWGHLKDLHRAIKLSEPALISGDPTVTRIGNYQEAHVFKSKSGACAAFLGNYNPKAFATVAFGNMHYNLPPWSISILPDCKNTVYNTARVGSQSAQMKMTRVPIHGGLSWQVFTEQTASTDDSSFTMTGLLEQLNTTRDLTDYLWYSTDVVIDPNEGFLRSGKDPVLTVLSAGHALHVFINSQLSGTIYGSLEFPKLTFSQNVKLIPGVNKISLLSVAVGLPNVGPHFETWNAGVLGPITLNGLDEGRRDLSWQKWSYKVGLHGEALSLHSLGGSSSVEWVQGSLVSRMQPLTWYKTTFDAPDGIAPFALDMGSMGKGQVWLNGQNLGRYWPAYKASGTCDNCDYAGTYNENKCRSNCGEASQRWYHVPHSWLIPTGNLLVVFEELGGDPNGIFLVRRDIDSVCADIYEWQPNLISYQMQTSGKTNKPVRPKAHLSCGPGQKISSIKFASFGTPVGSCGNFHEGSCHAHKSYNTFEKNCVGQNSCKVTVSPENFGGDPCPNVLKKLSVEAICT

SEQ ID NO: 6536 - protein, 841 aa, Medicago truncatula; identical to SEQ ID NO: 6535

SEQ ID NO: 6537 - protein, 840 aa, Glycine max
MVICLKLIIMWNVALLLVFSLIGSAKASVSYDSKAITINGQRRILISGSIHYPRSTPEMWPDLIQKAKDGGLDVIQTYVFWNGHEPSPGKYYFEGNYDLVKFIKLVQQAGLYVHLRIGPYVCAEWNFGGFPVWLKYIPGISFRTDNEPFKHQMQKFTTKIVDLMKAERLYESQGGPIIMSQIENEYGPMEYEIGAAGKAYTKWAAEMAMGLGTGVPWVMCKQDDTPDPLINTCNGFYCDYFSPNKAYKPKMWTEAWTGWFTEFGGPVPHRPAEDLAFSVARFIQKGGSFINYYMYHGGTNFGRTAGGPFIATSYDYDAPLDEYGLLRQPKWGHLKDLHRAIKLCEPALVSGDPTVTKIGNYQEAHVFKSKSGACAAFLANYNPKSYATVAFGNMHYNLPPWSISILPDCKNTVYNTARVGSQSAQMKMTRVPIHGGFSWLSFNEETTTTDDSSFTMTGLLEQLNTTRDLSDYLWYSTDVVLDPNEGFLRNGKDPVLTVFSAGHALHVFINGQLSGTAYGSLEFPKLTFNEGVKLRAGVNKISLLSVAVGLPNVGPHFETWNAGVLGPISLSGLNEGRRDLSWQKWSYKVGLKGEILSLHSLSGSSSVEWIQGSLVSQRQPLTWYKTTFDAPAGTAPLALDMDSMGKGQVWLNGQNLGRYWPAYKASGTCDYCDYAGTYNENKCRSNCGEASQRWYHVPQSWLKPTGNLLVVFEELGGDPNGIFLVRRDIDSVCADIYEWQPNLISYQMQTSGKAPVRPKVHLSCSPGQKISSIKFASFGTPAGSCGNFHEGSCHAHKSYDAFERNCVGQNWCTVTVSPENFGGDPCPNVLKKLSVEAICS

SEQ ID NO: 6538 - protein, 841 aa, Glycine max
MVMCLKLKLIMWNVALLLAFSLIGSAKASVSYDSKAITINGQRRILISGSIHYPRSTPEMWPDLIQKAKDGGLDVIQTYVFWNGHEPSPGKYYFEGNYDLVKFIKLVQQAGLYVHLRIGPYVCAEWNFGGFPVWLKYIPGISFRTDNEPFKVQMQKFTTKIVDLMKAERLYESQGGPIIMSQIENEYGPMEYEIGAAGKAYTKWAAEMAMELGTGVPWIMCKQDDTPDPLINTCNGFYCDYFSPNKAYKPKMWTEAWTGWFTEFGGPVPHRPAEDLAFSVARFIQKGGSFINYYMYHGGTNFGRTAGGPFIATSYDYDAPLDEYGLLRQPKWGHLKDLHRAIKLCEPALVSGDPTVTKIGNYQEAHVFKSMSGACAAFLANYNPKSYATVAFGNMHYNLPPWSISILPNCKNTVYNTARVGSQSAQMKMTRVPIHGGLSWLSFNEETTTTDDSSFTMTGLLEQLNTTRDLSDYLWYSTDVVLDPNEGFLRNGKDPVLTVFSAGHALHVFINGQLSGTAYGSLEFPKLTFNEGVKLRTGVNKISLLSVAVGLPNVGPHFETWNAGVLGPISLSGLNEGRRDLSWQKWSYKVGLKGETLSLHSLGGSSSVEWIQGSLVSQRQPLTWYKTTFDAPDGTAPLALDMNSMGKGQVWLNGQNLGRYWPAYKASGTCDYCDYAGTYNENKCRSNCGEASQRWYHVPQSWLKPTGNLLVVFEELGGDLNGISLVRRDIDSVCADIYEWQPNLISYQMQTSGKAPVRPKVHLSCSPGQKISSIKFASFGTPVGSCGNFHEGSCHAHMSYDAFERNCVGQNLCTVAVSPENFGGDPCPNVLKKLSVEAICS

SEQ ID NO: 6539 - protein, 843 aa, Glycine max
MSFNKLKVWNVPLLLVVFACSLLGQASASVSYDHKAIIINGQRRILLSGSIHYPRSTPEMWPDLIQKAKEGGLDVIQTYVFWNGHEPSPGKYYFGGNYDLVRFIKLVQQAGLYVNLRIGPYVCAEWNFGGFPVWLKYIPGISFRTDNGPFKFQMEKFTKKIVDMMKAERLFESQGGPIILSQIENEYGPMEYEIGAPGRSYTQWAAHMAVGLGTGVPWIMCKQDDAPDPIINTCNGFYCDYFSPNKAYKPKMWTEAWTGWFTEFGGAVPHRPAEDLAFSIARFIQKGGSFVNYYMYHGGTNFGRTAGGPFIATSYDYDAPLDEYGLARQPKWGHLKDLHRAIKLCEPALVSGDSTVQRLGNYEEAHVFRSKSGACAAFLANYNPQSYATVAFGNQHYNLPPWSISILPNCKHTVYNTARVGSQSTTMKMTRVPIHGGLSWKAFNEETTTTDDSSFTVTGLLEQINATRDLSDYLWYSTDVVINSNEGFLRNGKNPVLTVLSAGHALHVFINNQLSGTAYGSLEAPKLTFSESVRLRAGVNKISLLSVAVGLPNVGPHFERWNAGVLGPITLSGLNEGRRDLTWQKWSYKVGLKGEALNLHSLSGSSSVEWLQGFLVSRRQPLTWYKTTFDAPAGVAPLALDMGSMGKGQVWINGQSLGRYWPAYKASGSCGYCNYAGTYNEKKCGSNCGEASQRWYHVPHSWLKPSGNLLVVFEELGGDPNGIFLVRRDIDSVCADIYEWQPNLVSYEMQASGKVRSPVRPKAHLSCGPGQKISSIKFASFGTPVGSCGSYREGSCHAHKSYDAFLKNCVGQSWCTVTVSPEIFGGDPCPRVMKKLSVEAICT

SEQ ID NO: 6540 - protein, 845 aa, Glycine max
MSFHKLIMWNVPLLLVVVVFACSLIGHASASVSYDHKAITINGQRRILLSGSIHYPRSTPEMWPDLIQKAKEGGLDVIQTYVFWNGHEPSPGKYYFGGNYDLVRFIKLVQQAGLYVNLRIGPYVCAEWNFGGFPVWLKYIPGISFRTDNGPFKFQMEKFTKKIVDMMKAERLFESQGGPIILSQIENEYGPMEYEIGAPGRAYTQWAAHMAVGLGTGVPWIMCKQEDAPDPIINTCNGFYCDYFSPNKAYKPKMWTEAWTGWFTEFGGAVPHRPAEDLAFSIARFIQKGGSFVNYYMYHGGTNFGRTAGGPFIATSYDYDAPLDEYGLPRQPKWGHLKDLHRAIKLCEPALVSGDPTVQQLGNYEEAHVFRSKSGACAAFLANYNPQSYATVAFGNQRYNLPPWSISILPNCKHTVYNTARVGSQSTTMKMTRVPIHGGLSWKAFNEETTTTDDSSFTVTGLLEQINATRDLSDYLWYSTDVVINSNEGFLRNGKNPVLTVLSAGHALHVFINNQLSGTAYGSLEAPKLTFSESVRLRAGVNKISLLSVAVGLPNVGPHFERWNAGVLGPITLSGLNEGRRDLTWQKWSYKVGLKGEALNLHSLSGSSSVEWLQGFLVSRRQPLTWYKTTFDAPAGVAPLALDMGSMGKGQVWINGQSLGRYWPAYKASGSCGYCNYAGTYNEKKCGSNCGQASQRWYHVPHSWLKPTGNLLVVFEELGGDPNGIFLVRRDIDSVCADIYEWQPNLVSYDMQASGKVRSPVRPKAHLSCGPGQKISSIKFASFGTPVGSCGNYREGSCHAHKSYDAFQKNCVGQSWCTVTVSPEIFGGDPCPSVMKKLSVEAICT

SEQ ID NO: 6541 - protein, 839 aa, Cicer arietinum
MGFKLNVLLLLVLLSSSLIGHFEASVSYDYKAITINGQRKILLSGSIHYPRSTPEMWPDLIQKAKEGGLDVIQTYVFWNGHEPSPGKYYFEGNYDLVKFIRLVQQAGLYVHLRIGPYACAEWNFGGFPVWLKYIPGISFRTDNGPFKFQMQKFTTKIVNIMKAERLYESQGGPIILSQIENEYGPMEYELGAPGKAYAQWAAHMAIGLGTGVPWVMCKQDDAPDPVINTCNGFYCDYFSPNKAYKPKMWTEAWTGWFTGFGGTVPHRPAEDLAFSVARFIQKGGSFINYYMYHGGTNFGRTAGGPFIATSYDYDAPLDEYGLLRQPKWGHLKDLHRAIKLCEPALVSADPTVTRLGNYQEAHVFKSKSGACAAFLANYNPHSYSTVAFGNQHYNLPPWSISILPNCKHTVYNTARLGSQSAQMKMTRVPIHGGLSWKAFNEETTTTDDSSFTVTGLLEQINATRDLSDYLWYSTDVVINPDEGYFRNGKNPVLTVLSAGHALHVFINGQLSGTVYGSLDFPKLTFSESVNLRAGVNKISLLSVAVGLPNVGPHFETWNAGVLGPITLNGLNEGRRDLTWQKWSYKVGLKGEDLSLHSLSGSSSVDWLQGYLVSRRQPLTWYKTTFDAPAGVAPLALDMNSMGKGQVWLNGQSLGRYWPAYKATGSCDYCNYAGTYNEKKCGTNCGEASQRWYHVPHSWLKPTGNLLVMFEELGGDPNGVFLVRRDIDSVCADIYEWQPNLVSYQMQASGKVSRPVSPKAHLSCGPGQKISSIKFASFGTPVGSCGNYREGSCHAHKSYDAFQRNCVGQSSCTVTVSPEIFGGDPCPNVMKKLSVEAICT

SEQ ID NO: 6542 - protein, 846 aa, Populus trichocarpa x Populus deltoides
MALKKTSMCNSSNALLVLLFLVSSLACSVTASVSYDSKAITINGQRRILISGSIHYPRSSPEMWPDLIQKAKEGGLDVIQTYVFWNGHEPSPGKYYFEGNYDLVKFVKLAKEAGLYVHLRIGPYICAEWNFGGFPVWLKYIPGINFRTDNGPFKAQMQKFTTKIVNMMKAERLFETQGGPIILSQIENEYGPMEYEIGSPGKAYTKWAAEMAVGLRTGVPWVMCKQDDAPDPIINTCNGFYCDYFSPNKAYKPKMWTEAWTGWFTQFGGPVPHRPAEDMAFSVARFIQKGGSFINYYMYHGGTNFGRTAGGPFIATSYDYDAPLDEYGLLRQPKWGHLKDLHRAIKLCEPALVSGDATVIPLGNYQEAHVFNYKAGGCAAFLANYHQRSFAKVSFRNMHYNLPPWSISILPDCKNTVYNTARVGAQSARMKMTPVPMHGGFSWQAYNEEPSASGDSTFTMVGLLEQINTTRDVSDYLWYMTDVHIDPSEGFLRSGKYPVLGVLSAGHALHVFINGQLSGTAYGSLDFPKLTFTQGVKLRAGVNKISLLSIAVGLPNVGPHFETWNAGILGPVTLNGLNEGRRDLSWQKWSYKIGLHGEALGLHSISGSSSVEWAEGSLVAQRQPLSWYKTTFNAPAGNSPLALDMGSMGKGQIWINGQHVGRHWPAYKASGTCGDCSYIGTYNEKKCSTNCGEASQRWYHVPQSWLKPTGNLLVVFEEWGGDPNGISLVRRDVDSVCADIYEWQPTLMNYQMQASGKVNKPLRPKAHLSCGPGQKIRSIKFASFGTPEGVCGSYRQGSCHAFHSYDAFNNLCVGQNSCSVTVAPEMFGGDPCLNVMKKLAVEAICS

SEQ ID NO: 6543 - protein, 843 aa, Fragaria x ananassa
MGLRLVMWNVVVAAALVVLCSCFASVRASVSYDSKAIVINGQRRILISGSIHYPRSTPEMWPDLIQRAKDGGLDVIQTYVFWNGHEPSPGKYYFEDNYDLVKFIKLVQQAGLYVHLRIGPYVCAEWNFGGFPVWLKYVPGIQFRTDNGPFKDQMQRFTTKIVNMMKAERLFESHGGPIILSQIENEYGPMEYEIGAPGKAYTDWAAQMAVGLGTGVPWVMCKQDDAPDPVINACNGFYCDYFSPNKAYKPKMWTEAWTGWFTEFGGAVPYRPAEDLAFSVAKFLQKGGAFINYYMYHGGTNFGRTAGGPFIATSYDYDAPLDEYGLLRQPKWGHLKDLHRAIKLCEPALVSSDPTVTPLGTYQEAHVFKSNSGACAAFLANYNRKSFAKVAFGNMHYNLPPWSISILPDCKNTVYNTARIGAQTARMKMPRVPIHGGFSWQAYNDETATYSDTSFTTAGLLEQINITRDATDYLWYMTDVKIDPSEDFLRSGNYPVLTVLSAGHALRVFINGQLAGTAYGSLETPKLTFKQGVNLRAGINQIALLSIAVGLPNVGPHFETWNAGILGPVILNGLNEGRRDLSWQKWSYKIGLKGEALSLHSLTGSSSVEWTEGSFVAQRQPLTWYKTTFNRPAGNSPLALDMGSMGKGQVWINDRSIGRYWPAYKASGTCGECNYAGTFSEKKCLSNCGEASQRWYHVPRSWLNPTGNLLVVLEEWGGDPNGIFLVRREVDSVCADIYEWQPNLMSWQMQVSGRVNKPLRPKAHLSCGPGQKISSIKFASFGTPEGVCGSFREGGCHAHKSYNAFERSCIGQNSCSVTVSPENFGGDPCPNVMKKLSVEAICS

SEQ ID NO: 6544 - protein, 839 aa, Populus trichocarpa
MCNSSNALLVLLFLVSSLACSVTASVSYDSKAITINGQRRILISGSIHYPRSSPEMWPDLIQKAKEGGLDVIQTYVFWNGHEPSPGKYYFEGNYDLVKFVKLAKEAGLYVHLRIGPYICAEWNFGGFPVWLKYIPGINFRTDNGPFKAQMQKFTTKVVNMMKAERLFETQGGPIILSQIENEYGPMEYEIGSPGKAYTKWAAEMAVGLRTGVPWVMCKQDDAPDPIINTCNGFYCDYFSPNKAYKPKMWTEAWTGWFTQFGGPVPHRPAEDMAFSVARFIQKGGSFINYYMYHGGTNFGRTAGGPFIATSYDYDAPLDEYGLLRQPKWGHLKDLHRAIKLCEPALVSGDATVIPLGNYQEAHVFNYKAGGCAAFLANYHQRSFAKVSFRNMHYNLPPWSISILPDCKNTVYNTARVGAQSARMKMTPVPMHGGFSWQAYNEEPSASGDSTFTMVGLLEQINTTRDVSDYLWYMTDVHIDPSEGFLRSGKYPVLGVLSAGHALHVFINGQLSGTAYGSLDFPKLTFTQGVKLRAGVNKISLLSIAVGLPNVGPHFETWNAGILGPVTLNGLNEGRRDLSWQKWSYKIGLHGEALGLHSISGSSSVEWAEGSLVAQRQPLSWYKTTFNAPAGNSPLALDMGSMGKGQIWINGQHVGRHWPAYKASGTCGDCSYIGTYNEKKCSTNCGEASQRWYHVPQSWLKPTGNLLVVFEEWGGDPNGISLVRRDVDSVCADIYEWQPTLMNYQMQASGKVNKPLRPKAHLSCGPGQKIRSIKFASFGTPEGVCGSYRQGSCHAFHSYDAFNNLCVGQNSCSVTVAPEMFGGDPCLNVMKKLAVEAICS

SEQ ID NO: 6545 - protein, 841 aa, Prunus persica
MGLRLVMWNVLVLLVVLCSWVGSAKASVSYDSKAIVINGQRRILISGSIHYPRSSPEMWPDLIQKAKEGGLDVIQTYVFWNGHEPSPGKYYFEDNYDLVKFIKLIQQAGLYVHLRIGPYVCAEWNFGGFPVWLKYIPGIQFRTDNGPFKAQMQRFTTKIVNMMKAERLFQSQGGPIILSQIENEYGPMEYELGAPGKVYTDWAAHMALGLGTGVPWVMCKQDDAPDPIINACNGFYCDYFSPNKAYKPKMWTEAWTGWYTEFGGAVPSRPAEDLAFSVARFIQKGGSFINYYMYHGGTNFGRTAGGPFIATSYDYDAPLDEYGLLRQPKWGHLKDLHRAIKLCEPALVSADPTVTPLGTYQEAHVFKSKSGACAAFLANYNPRSFAKVAFGNMHYNLPPWSISILPDCKNTVYNTARVGAQSAQMKMPRVPLHGAFSWQAYNDETATYADTSFTTAGLLEQINTTRDSSDYLWYLTDVKIDPNEEFLRSGKYPVLTILSAGHALRVFINGQLAGTSYGSLEFPKLTFSQGVNLRAGINQIALLSIAVGLPNVGPHFETWNAGVLGPVILNGLNEGRRDLSWQKWSYKVGLKGEALSLHSLSGSSSVEWIQGSLVTRRQPLTWYKTTFNAPAGNSPLALDMGSMGKGQVWINGRSIGRYWPAYKASGSCGACNYAGSYHEKKCLSNCGEASQRWYHVPRTWLNPTGNLLVVLEEWGGDPNGIFLVRREIDSICADIYEWQPNLMSWQMQASGKVKKPVRPKAHLSCGPGQKISSIKFASFGTPEGGCGSFREGSCHAHNSYDAFQRSCIGQNSCSVTVAPENFGGDPCPNVMKKLSVEAICS

SEQ ID NO: 6546 - protein, 2205 aa, Glycine max
  misc_feature (1611)..(1611): Xaa can be any naturally occurring amino acid
MSGGRRRDGRDSRALKKRKLNRTPEEELEAKFGFDLFTEGEKRLGWLLTYASSSVDDEDGYKVYSCVDLYFVAQDGSSFKTKFRFRPYFYVATKDKMEIDVEAYLKRRYEGQIADVEIIEKEDLDLKNHLSGLRKSYLKLSFDTVQQLMDVKRDLMPTVERNKVKSDAAEAFLSMSTERREQRPQDFLDCITDLREYDVPYHVRFAIDNDIRCGQWYDVGVPTNNGVTLEKKTDLLQRAEVRICAFDIETTKLPLKFPDADYDLIMMISYMVDGQGYLIINRECVGDDIEDIEYTPKPEFEGCFKVTNVQNEIELLRLWFSHMQDVKPGIYVTYNGDFFDWPFLERRATHHGFKMSDELGFKCDTNQGECRARYACHLDCFAWVKRDSYLPQGSQGLKAVTKAKLGYDPLEVNPEDMVCFAKEKPQMMASYSVSDAVATYYLYTTYVHPFIFSLATIIPMSPDEVLRKGSGTLCEMLLMVQAYKANVICPNKHQSDPEKFYNNHLLESETYIGGHVECLESGVFRSDIPSSFKLEPSAYQQLINNLDRDLQYAITVEGKMDLEFVSNYDEVKNAIMEKLVKLREAPIREECPLIYHLDVAAMYPNIILTNRLQPPSIVTEEVCTACDFNRPGKTCLRKLEWVWRGETFMAKKSDYYALKTQIESEFVDDSEKNNRALSHYSEKSSKSFLDLPKAEQQSRLKERLKKYCQKAYKRVLDKPVTELREAGICMRENPFYVDTVRSFRDRRYEYKGLNKVWKGKLSEAKASGNSIKIQEAQDMVVLYDSLQLAHKCILNSFYGYVMRKGARWYSMEMAGVVTYTGAKIIQNARLLVEKIGKPLELDTDGIWCALPGSFPENFTFKTRDPKKKFTISYPCVMLNVDVAINNSNDQYQTLTDPIRKTYTTRSECSIEFEVDGPYKAMILPASKEEGILIKKRYAVFNDDGTLAELKGFEIKRRGELKLIKVFQAELFDKFLHGSTLEECYSAVASVANGWLDLLDNQGKDIADSELLDYISESSTMSKSFADYGLQKSCAVATARRLADFLGDTMVKDKGLRCQYIVASEPKGTPVSERAVPVAIFETDAEVMKFYVRKWCKVSSDVDIRSIIDWSYYKQRLSSAIQKIITIPAAMQKVANPVPRVVHPDWLHKKVREKEDKFRQRKLVDAFKSMNRNEHSKKHNDSNRVPLVIDDDIVNELEDFGNKDRSSTCRPRPIIRHYEANNERHSGKLNDQDVEQQHNKPLQQKVDKNVDYEGWLQIKKQTWKDILERRKKRRLENSKKSDRVNGVLQQMNGKGNQGRSHVSSYLKRLEVDLTKRHWQIIQLVPSSLIGHFFAWVVVDGSMHKIPVSVPRVFYLNSRSDITEEFMGKRVNKTLPHGRHSYNLYEVSINEIQYGEASKKLAALLADPDVEGVYETKVPLEFNAIVQLGCVCKVDKTANKRSLQEPWNLSELHMKTTVECAYLEQSISFFYFYHSISEGRAIYVGYFPALKAITVVVVNPYQNKDLSPTFLERQFHDACQSLSIDSPPRNGINFKLDYVAHVKDAEAVMQRAINGHREENHMPMVAVIECPNVQLVKLGIQVLDNFPCLSVPYNARDSQYQILGWQQVAAKLXMQRCAASVQWLNQRIALSRYAHVPLGNFELDWLIFIADIFFSRALHDNQQVLWISDDGLPDLGGINGEQNCFVDEVQQPVLTYPGAYRNVTVELKIHHLAVNALLKYNLVNEMEGGTLLGFGHELDSGAFSTNDQNGFDESTSCAQAFRVLKQLIQRCLADAVTSGNVYADSILQHLYRWLCSPKSKLHDPALHQLLHKVMQKVFALLLAEFRKLGAMIVFANFTKIVIDTGKYDLSRAKAYCDSLLRTIQSRDLFEWVELEPLQFWCSLLFMDQYNYGGIPTKSDEALNDESQVDIISSWNIAEYLPKKIQDHFVFIVSQFMYIPWNYAKKQAQIRASLQNGDSCTPSINIGAAEAFESEVTEFTKDQISSYFTHKLLGIVHDIGLHMKGMNRSENNQSTSGLPQLTGDVHRGDASLEFIKHVCAVLALDHSVQHEVLVLRKNLLKYVDVKEFAPEAKFHGPCHSFVLSNVICSYCNDCRDLDLCRDSALLTEEWRCAVPQCGQPYDREVMENALLQTVRQRERLYQLQDLVCTRCHQVKAAHLAEQCVCAGSFRCKEDASEFREKMQIFLNIASHQKFQLLEECTSWILELR

SEQ ID NO: 6547 - protein, 2207 aa, Glycine max
MSGDGRRRDRRDNRASKKRKLNRTPEEELEAKLGFDLFSEGEKRLGWLLTFASSSVDDEDSYKVYSCVDLYFVAQDGSSFKTKFRFRPYFYVATKDKMEIDVEAYLKRRYEGQIADVEIIEKEDLDLKNHLSGLRKSYLKLSFDTVQQLMDVKRDLMPTVERNKAKSDAAEAFLSVSTERREHRPQDFLDCITDVREYDVPYHVRFAIDNDIRCGQWYDVGVSSNNGVTLEKKTDLLQRAEVRICAFDIETTKLPLKFPDADYDLIMMISYMVDGQGYLIINRECVGDDIEDIEYTPKPEFEGCFKVTNAQNEIELLRLWFSHMQEVKPGIYVTYNGDFFDWPFLERRATHHGFKMSDELGFKCDMNQGECRARYACHLDCFAWVKRDSYLPQGSQGLKAVTKAKLGYDPLEVNPEDMVRFAKEKPQMMASYSVSDAVATYYLYTTYVHPFIFSLATIIPMSPDEVLRKGSGTLCEMLLMVQAYKANVICPNKHQSDPEKFYNNHLLESETYIGGHVECLESGVFRSDIPSSFTLEPSAYQQLINNLDRDLQYAITVEGKMDLEFVSNYDEVKNAIMEKLVKLRDAPIREECPLIYHLDVAAMYPNIILTNRLQPPSIVTEEVCTACDFNRPGKTCLRKLEWVWRGETFMAKKSDYYALKTQIESEFVDDSEKNNKALTHYSEKSSKSFLDLPKAEQQSRLKERLKKYCQKAYKRVLDKPVTELREAGICMRENPFYVDTVRSFRDRRYEYKGLNKVWKGKLSEAKASGNSMKIQEAQDMVVLYDSLQLAHKCILNSFYGYVMRKGARWYSMEMAGVVTYTGAKIIQNARLLVEKIGKPLELDTDGIWCALPGSFPENFTFKTKDPKKKFTISYPCVMLNVDVAINNTNDQYQTLTDPIRKTYTTHSECSIEFEVDGPYKAMILPASKEEGILIKKRYAVFNDDGTLAELKGFEIKRRGELKLIKVFQAELFDKFLHGSTLEECYSAVASVANGWLDLLDNQGKDIADSELLDYISESSTMSKSLADYGQQKSCAVTTARRLADFLGDTMVKDKGLRCQYIVASEPKGTPVSERAVPVAIFETDAEVMKFYVRKWCKVSSDVGIRSIVDWSYYKQRLSSAIQKIITIPAAMQKVANPVPRVVHPDWLHKKVREKEDKFRQRKLVDAFKSMNRNEHSKRHDDSTRVPLVMDGDIVNELEDFGNKDRSSTCRPRPIIRHYEANNEQHSRKVNDQEDVEQQHNKPLQQNVYRSVDYQGWLQIKKRTWKDILERRKKQRLENSKKSDRVSSVLEQMNGKGNQGRSHVSSYLKRLEVDLTKRHWQIIQLVPSSLIGQFFAWVVVDGSMHKIHVSVPRVFYLNSRSAITEGFMGKRVNKTLPHGRHSYNLYEVSINEIQYGEASQKLAALLADPDVEGVYETKVPLEFNAIVQLGCVCKVDKTANKRSLQEPWNLSELHMKTTAECAYLEQSISFFYFYHSISEGRAIYIGYFPASKTMTVVVVNPYQNKDLSPVFLERHFHDACQSLSIEPPPRNGINFKVDYVAHVKDAEAVMQRAINGHREENHMPMVAVIECPNVQLVKLGIRALDNFPCLSVPYNARDSQYQILGWQQVAAKTGMQRCAASVQWLNQRIALSRYAHVPLGNFELDWLIFIADIFFSRALHDNQQVLWISDDGLPDLGGINSEQNCFVDEVQQPALTYPGAYRNVTVELKIHHLAVNALLKYNLVNEMEGGTLLRFGHELDSGAFSTNDQNGFDESTSCVQAFRVLKQLIQRCLADAVTSGNVYADSILQHLYRWLCSPKSKLHDPALHQLLHKVMQKVFALLLAEFRKLGATIVFANFSKIIIDTGKYDLSRAKAYCDSLLRTIQSRDLFEWIELEPLQFWCSLLFMDQYNYGGIPTKSDEAVNNESQVDIISSWNIAEYLPKKIQDHFVFIVSQFMYIPWNYAKKQAQIRASLQNGDSCTPSINIGAAEAFESEITEFTKEQIGSYFTHKLLGIVHDIGLHMKGMNRLENNQSTSGLPPLTGDVHRGDASLEFIKHVCAVLALDQSVQHEVLVLRKNLLKYVDVKEFAPEAKFHGPCHSFILSNVICSYCNDCRDLDLCRDSALLTEEWRCAVPQCAQPYDREVMENALLQTVRQRERLYHLQDLVCTRCHQVKAAHLAEQCACAGSFRCKEDASEFREKMQIFLNIASRQKFQLLQECTSWILELR

SEQ ID NO: 6548 - protein, 2248 aa, Medicago truncatula
MNRKWDRRDNKVSKKQKLLNSAEEELEAKLGFDLFSEGEKRLGWLLTFSSSSYEDEDTGKVYSCIDLYFVKQDGSSFKTKYRFRPYFYVATKNKMEMDVDAYLRRRYESQIADIKIVEKEDLDLKNHLSGLRKSYLRLSFDTVQQLMNVKSDLMQVVERNKAKSDAAEAYESILTGRREQKLQDFLDCIIDLREYDVPYHVRFAIDNDIRCGQWYDVGVSNDGVTLERRTDLLQRAEVRVCAFDIETTKLPLKFPDADYDSVMMISYMVDRQGYLITNRECVGDDIEDLEFTPKPEFEGFFKVTNVQNEIELLRLWFSHMQEVKPGIYVTYNGDFFDWPFLERRAAHHGFKMSDELGFQCDMNQGECRAKFAPHLDCFAWVKRDSYLPQGSQGLKAVTKAKLGYDPKEVNPEDMVRFAKEKPQMMASYSVSDAVSTYYLYTTYVHPFIFSLATIIPMSPDEVLRKGSGTLCEMLLMVQSYKANVICPNKHQSDPEKFYKNHLLESETYIGGHVECLESGVFRSDIPCSFTLEPSAFEQLISNLDRDLQYAIRVEGKMDLESVSNYDEVKNAIMEKLVNLRDAPIRDDCPLIYHLDVAAMYPNIILTNRLQPPSIVTDEICTACDFNRPGKTCLRKLEWVWRGATFAAKKRCIFLNVAALDYYHLKKQIESEFVDGVNERSSKSFLDLPKAEQQLRLKERLKKYCQKVMAYKRVLDKPVTELREAGICMRENPFYVDTVRFMLSGSSFRDRRYEYKGLNKVWKGKLSEAKASGNSIKIQEAQDMVVLYDSLQLAHKCILNSFYGYVMRKGARWYSMEMAGVVTYTGAKIIQNARLLVEKIGKPLELDTDGIWCALPGSFPENFTFKTVDSKRKLTISYPCVMLNVDVAINNTNDQYQTLTDPNRKTYTTHSECSIEFEVDGPYKAMIIPASKEEGILIKKRYAVFNDDGSLAELKGFEIKRRGELKLIKVFQADLFEKFLHGSTLKECYSEVAKEANRWLDLLDNQGKDIADSELLDYISESSTMSKSLADYGQQKSCAVTTAKRLADFLGDTMVKDKGLRCQYIVASEPKGTPVSERAVPVAIFETDADIMKFYVRKWCKVSSDVGIRSIIDWSYYKQRLSSSIQKIITIPAAMQKVANPVPRVVHPDWLHKKVREKEDKFRQRKIDDTFKSMNKNEHSKKHNDSSGVNLVMVDDTVNDMEDFGNKGRSSTLGPRPIIRHYEANNEQHSEKFNGQEDSEQQHIDSSNIDQQNETSCENVDRTVDYQGWLQLKKRKWKSMLGKRKKQRMSFDFLRLENSKKSDHLNGSLEQTNSKMNHGRSNVSSYFRRHEVVLTRGHWQIIQLVHSPQVGQFFAWVVVDGIMLKIPISIPRVFYLNSRSPTEEFSGKRVNKTLPHGRHSYNLYEVLVVTINEVQYKEESKKLAALLADPDIEGVYETKVPLEFNAIVQLGCVCKVDKTAKKRSLQEPWNLNELHMKTTTECAYLEQSISLFYLYHSISEGRAIYAGYFPGSQAITFVVVNPYQNQDLSPAYLDRQFRDACRTLSIEAPPRNGINFKVEYVALVKDAETIMQSAINDLRSEHGPMVAVIECPDVQLLKLGIRALDDFPCLSIPFNARDSQYPVKCSETAGPYCLFILGWQQMAAKLGMQRCAASVQWLNEKIALSRYAHVPLGNMEFDWLMFTVDTFFCRALRDNQQVLWISDDGFPDLGGNIGEENCFLDEVRQPVCTFPGAYRKISVELKIHHLAVDALLKCNQVNEMEGGALLGFGHEFDSEAFQVNGQNGFEESTSCTHAFRVLKHLIQRCLADAVTSGNVFADAILQHLYRWLCSPQSKFHDPALHQLLHKVMQKVFALLLAEFRKLGATIVFANFSKIIIDTGKYDFSTAKAYCDSLLRTIQSRLVFQKDLFEWIELEPLQFWCSLLFMDQYNYGGIPAKSDEAMNDESQVDIISSWNIAEYLPKKIQDHYVFIVSQFMYIPWNYTRKQAAIRASVQNGDSCTPSINIGAAEAFESEITEYIKEQISSYFTDKLLGVVRDIVLHMKGMGRSESDQSTSSGLHQLTDDLHRGDAALEFIKHVCAVLALDQSVQHDVHVMRKNLLKYVRVREFAPEAEFHDPCHSFILPNVICSYCNECRDLDLCRDPTLLNEEWHCAVPQCGQPYDREVMENALLQIARQRERQYHLQDLVCVRCNQVKAAHLAEQCACAGSFKCKEDATEFCKKMRVIYNIASRQKFQLLQECTAWMLELKIE

SEQ ID NO: 6549 - protein, 2221 aa, Populus trichocarpa
MNGESRRWDRKDLRRSSKKQKLMRTAEEELESKLGFDLFTEGDKRLGWLLTFSSSSLDDEETGRVYSCVDLYFVSQDGSAFKSKYKFRPYFYAATKEKMEMDVEGYLRRRYESQIAYIEIVEKEDLDLKNHLSGLHKSYLKISFATVQQLMDVKRDLLHVVERNQAKSDAAEAYESILTGKREQRPQDFLDCIIDLREYDVPYHVRFAIDNDIRCGQWYDVSVSSTGVKLEKRTDLLQRAEVHVCAFDIETTKLPLKFPDADYDLIMMISYMVDGQGYLITNRECVGEDIEDLEYTPKPEYEGCFKVTNVKNEVELLKQWFAHMREVKPGIYVTYNGDYFDWPFLESRAAYHGFKMGDEVGFSCDKNQGECRAKFACHLDCFAWVKRDSYLPQGSQGLKAVTKAKLGYDPLEVNPEDMVRFAKEKPQMMASYSVSDAVATYYLYMTYVHPFIFSLATIIPMSPDEVLRKGSGTLCEMLLMVQAYMANVICPNKHQSDQDKFYKSHLLESETYIGGHVECLESGVFRSDLPTSFKLDPSAYELLIKNLDRDLQYAIRVEGKMDLDLISNYDEVKNVIMEKLVCLRDEPVREECPLIYHLDVAAMYPNIILTNRLQPPSIVTDEICTACDFNRPDKTCLRKLEWVWRGEIFMAKKSDYYHLKKQIESEFVDGTDGQFSKSFLDLSKMDQQSKLKERLKKYCQKAYKRVLDKPVTEVREAGICMRENSFYVDTVRSFRDRRYEYKGLNKVWKGKLSEAKASGNSIKIQEAHDMVVLYDSLQLAHKCILNSFYGYVMRKGARWYSMEMAGVVTYTGAKIIQNARLLVDKIGKPLELDTDGIWCVLPGCFPENFTFKTKDSKKKLTISYPCVMLNVDVARNNTNEQYQTLVDPVNKTYATHSECSIEFEVDGPYKAMILPASKEEGILIKKRYAVFNDDGTLAELKGFEIKRRGELKLIKVFQAELFDKFLHGSTLEECYSAVAAVANRWLDLLDNQGKDIADSELLDYISESSTMSKSLSDYGQQKSCAVTTARRLADFLGDTMVKDKGLRCQYIVACEPRGTPVSERAVPVAIFETDPEIMKFYLRKWCKTSSDVGIRSIIDWSYYKQRLGSAIQKIVTIPAAMQKVANPVPRVVHPDWLHRKVREKEDKFRQRKLVDIFNLRSRDDLSRKMDDATITNHDEANVKDLEDFQIKSSSINRPRPIVRCYDVNEKRSAKKTGQLNSAEQQTDSVHELSSQPQHNTSYAENIDRNVDYQGWLELKKRKWKDILDRRKKQRLNNTRTSHHITDASELLGGLTNHKGAQRRTGVGSYFTTHEVALTRCHWQIIQLLPSSRCGQFFAWVVVEGIMLKIPITIPRAFYLNAKAPAMENFPGRRVTKTLPHGRPSYNLVEVIIDEDKFRKESKKLAALLADPEVEGIYESKVPLEFNAVIQIGCVCKVDKTAKKRNAQDGWSLSELHMKTTTECSYLEQSISFFYIYHSISEGRAIYVIYLPALGTVSVVVVNPYQNKDITPSFLERQFREACQALSIEAIPPRNSIVFKVDYVGHVKDAEKILQGTISELRDKHHGPTLAVIECPNAHLMKSGVPALDDFPCVSIPSNARDSQYQVLGWQQASAKIGMQRSAASSQWLNERISLSRYAHVPLGNFELDWLIFTADVFFSRALHDQQQVLWISDDGVPDLGGNHEESTCFADEVQQPVLTYPGAYRKVSVELKIHHLAVDALLKSNQINEMEGGALLGFDQDMNSSTTLYDQSGFDEATSSASGLRVLKQLIQRCLADAVTSGNVFADAILQHLYRWLCSPQSKLHDPALHRILHKVMQKVFALLLAELRKLGATIIFANFSKVIIDTGKFELTAAKAYCDSVLKTLQNRELFEWIELEPLQFWHSLLFMDQYNYGGIPARPDDSSHNDLHHHSPREEPKVDIVSNWNIAEYLPKKIQDHFVLIVSEFMFIPWDYAQKQAATREALRDGNSCTPSITIVAAENFESHMVEYIKGQIGTHFTDKLLGIARDTVLHMKGINKSENGQQISLGIQQPAGMNHKGDPALEFIKHVCAVLALDQHVQHEVLVMRKNLLKYVRVREFAPEAEFHDPCPSFILPNVICSYCNDCRDLDLCRDSAVLAEEWRCAVPQCGQPYDREVMENALLQIVRQRERLYHLQDLVCLRCNQVKAAHLSEQCSCAGSYRCREDVSEFRRKMQIFLNVAIRQKFQLLQECTSWILEVIL

SEQ ID NO: 6550 - protein, 2227 aa, Ricinus communis
MNGKDNRRRDRNNYNRSSKKQKLIRNAEEELDSKLGFDLFTEGDKRLGWLLTFASSSWEDEETRRVHSCVDLYFVSQDGSAFKSKFKFRPYFYAATKEKMEMDVEAYLRRRYESQIADIEIVEKEDLDLKNHLSGLRKRYLKISFSTVQQLMDVKKDLSHVVERNRAKFDTADAYESLLTGRREQRPQDFLDCIVDLREYDVPYHVRFAIDNDIRCGQWYDVSVSSSGVMLERRTDLLQRAEVRICAFDIETTKLPLKFPDADYDLIMMISYMIDGQGFLIINRECVGEDIEDLEYTPKPEFEGCFKVTNVKNEVELLKQWFAHMQEVKPGIYVTYNGDYFDWPFLESRAAYHGIKMSDEVGFSCDKNQGECRARSACHLDCFAWVKRDSYLPQGSHGLKAVTKAKLGYDPLEVNPEDMVRFAKEKPQTMASYSVSDAVATYYLYMTYVHPFIFSLATIIPMSPDEVLRKGSGTLCEMLLMVQAYKANVICPNKHQSDPEKFYKNHLLDSETYIGGHVECLESGVFRSDLPTHFKLDPSAYDQLIGNLDRDLQYAIIVESKMDLDSVSNYDEVKNAIMEKLVMLRDEPVREECPLIYHLDVAAMYPNIILTNRLQPPSIVTDEICTACDFNRPDKTCLRKLEWVWRGEIFMANKSDYYHLKKQIESEFVDGIDGQLSKPFLDLPKVEQQSKLKERLKKYCQKAYKRVIDKPVTELREAGICMRENPFYVDTVRSFRDRRYEYKGLNKLWKGKLSEAKTSGNPIKIQEAQDMVVLYDSLQLAHKCILNSFYGYVMRKGARWYSMEMAGVVTYTGAKIIQNARLLVEKIGKPLELDTDGIWCVLPGSFPENFTFKTKDLKKKLTISYPCVMLNVDVARNNTNEQYQTLVDPLNKTYATHSECSIEFEVDGPYKAMILPASKEEGILIKKRYAVFNDDGTLAELKGFEIKRRGELKLIKVFQAELFDKFLHGSTLEGCYSAVAAVANRWLDLLDNQGKDIADSELLDYISESSTMSKSLVDYGQQKSCAVTTARRLADFLGDTMVKDKGLRCQYIVACEPKGTPVSERAVPVAIFETDAEIMKFYLRKWCKTSTDIGIRSIIDWSYYKQRLSSAIQKIITIPAAMQKVANPVPRVVHPDWLHKKVREKEDKFRQRKLVDIFRLSSKEDFVRKNNDTITDNCMMDEENVEDLEDFRNKSISTNGPRPIVHCYATNSEEHSVKATGRMDSSHQQTDNGESVHELSSLVQQTASSGESIDRNVDYQGWLELKKRKWKDTLERRKRQRLGNLRNSSHANGDFEPLSSVINRKKAQSRTGVGSYFTTHEIALTRCHWQIIQLFPGSHCGEFFAWVVVEGIMLKVPITVPRVFYLNSKAPITEKFPGRRVNKTLPHGRHSYNLVEVIIDEDKFKKESKKLAALLADPEVEGIYETKVPLEFNAILQIGCVCKVDKTAKKRNAQDRWSLNELQMKTTTECSYLEQSISFFYLYQSISEGRAVVVVYLPFLRTVSVVVVNPYQNKDLSPSFLERQFREACIALSVEPPTPRNAIVFKVDYVGHVKDAERILQGTIREVRDKHHGPTLAVIECPNDHLMKSGIPALDNFPCVRIPSNARDSQYQVLGWQQAAAKTAMQRSAASSQWLNERITLSRYAHVPLGNFELDWLIFTADVFISRALRDQQQLLWISDDGVPDLGGISEESSCFADEVHQPILTYPGAYRKVSVELKIHHLAVNALLKSSQVNEMEGGALLGFDQDMSSGSHICEQYGVDEATSSAPALRVLKQLIQRCLADAVTSGSVFADALLQHLYRWLCSPQSKLHDPALHRVLHKVMQKVFALLLAEFRKLGATIIFANFSKVIIDTGKFSLSAAKAYCDSLLKTLQTRELFEWIELEPLQFWHSLLFMDQYNYGGIPARADDISHSESQGAHSQRQESQVDIVSSWNIAEYLPKTIQDHFVLIVSEFMFIPWEYAQKQDANKASLQDVSSCTPSITISAAETYESHIVEYLKGQISTYFTDKLLGIVRETVLHMKGINKSENDQPSSGFPQVAGNIHKRVPALEFIKHVCAVLALDLNVQHEVLVMRKNLLKYVRVREFAPEAEFHDPCPSFVLPNVICSYCNDCRDLDLCRDTALLAQEWRCAVPQCGQPYDREGMENALLQIVRQRERLYHLQDLVCIRCNQVKAAHLAEQCACAGAYRCKEDVSEFRSKMQIFLNVAISQKFQLLQECTSWILEVH

SEQ ID NO: 6551 - protein, 2196 aa, Vitis vinifera
MSGEIRRRDRADVWKHKKQKLIRNAEEEVESKLGLDLFSEGEKRLGWLLTFASSSWEDEETHKVYSCVDLYFVSQDGSSFKSKYKFRPYFYAATKDKMEMDVEAYLRRRYEGQIADIEIMYKEDLDLKNHLSGLCKSYLKISFDNVQQLMHVKSDLLHVVERNRAKFDAAEAYESILTGKSKQRTQDFIDYIVDLREYDVPYHVRFAIDKDVRCGQWYDVNVSSAGVMLERRTDLLQRAEVHVCAFDIETTKLPLKFPDAEYDLVMMISYMVDGQGYLIINRECVGEDIEELEYTPKPEFEGCFKVTNVKNEKELLRMWFAHMREVKPGIYVTYNGDFFDWPFLESRAAHHGLKMSDEVGFQCDKNQGECRAKFSCHLDCFAWVKRDSYLPQGSQGLKAVTKAKLGYDPLEVNPEDMVRFAKELPQMMASYSVSDAVSTYYLYMTYVHPFIFSLATIIPMPPDEVLRKGSGTLCEMLLMVQAYKANVICPNKHQSDPEKFYHNQLLESETYIGGHVECLESGQLIVNLDRDLQYAIRVEGKMDVESVSNYDEVKNAIKEKLMKLQGEPIREEFPLIYHLDVAAMYPNIILTNRLQPSSIVSDEICTACDFNRPGKNCLRKLEWVWRGEAFMAKKSDYYHLKRQIESELVDGGDSRFSKSFIDLPKTEQQLKLKERLKKYCQKAYKRVLDKPATELREAGICMRENSFYIDTVRSFRDRRYEYKGLNKVWKGKLSEAKASGNSIRIQEAQDMVVLYDSLQLAHKCILNSFYGYVMRKGARWYSMEMAGVVTYTGAKIIQNARLLIEKIGRPLELDTDGIWCVLPGSFPENFTFRTKDLKKKLTISYPCVMLNVDVARNNTNDQYQTLVDPINKTYATHSECSIEFEVDGPYKAMILPASKEEGILIKKRYAVFNDDGTLAELKGFEIKRRGELKLIKVFQAELFDKFLHGSTLEECYAAVASVANRWLDLLDNQGKDIVDSELLDYISESSTMSKSLADYGEQKSCAVTTARRLADFLGDTMVKDKGLRCQYIVACEPRGTPVSERAVPVAIFETDAEIMKFYVRKWCKISSDVGIRSIVDWSYYKQRLGSAIQKIITIPAAMQKVANPVPRVVHPDWLYKKVREKEEKFRQRKLVDMFGSLKRDDNVKMNVDAITSNHVISEENIEDLEDFRNKGRTSSAGPRPIVRCYEVNGKQQSDAMNCLANSPQEPANHSESALTPMQPTDISTDNIDRNVDYQGWLEMKKRKWKDAREKRKRQRMDNSKTSNQTNGVSELPGGVINHKQAQGRTGVNSYFRRHELALTHSYWQIIQLAPSSQHGQFFAWVIVEGVMLKIPITVPRVFYLNSKALITEEFPGRRVNKTLPHGHHSYNLIEIIIDEDQFRGESRKLAAHLADPEVEGIYETKVPLEFNAVLQIGCVCKVDKTAKKRNIQDGWSLSELHMKTTTECPYLEQSISFFYLYHSISEGRAIYVGYFPASRTISVVVVNPFQNKELSPSIIEKQFREACEALSIEPPQPRNGISFKVDYVGYVKDAEKFLQRTINDHRHQHHGPEVAVIECPNVHLLKSGIRALDDLPCVNIPSNARDSHYQALGWQIVAAKIGMQRCAAATQWLNERISLARYAHVPLGNFEPDWLIFTADLFFSRALRDQQQVLWISDNGIPDLGGLNEEDTCFADEVHQPVLTYPGAYRKVSVELKIHHLAVNALLKSNQVNEMEGGALFGFEQDMNMGAHGFNEQCGFDEATLCAPTFRVLKQLIQRCLADAVSSGNVFADAILQHLYRWLYSPQSKLHDPALHRILHKVMQKVFALLLAEFRKLGATIVFANFSKVIIDTGKSDLSAAKAYCDSLLKTLQTRDLFEWIEIEPLHFWHSLLFMDQYNYGGVQARSHGGSLIGSSDPTSESIEDESQVDIVSSWNIAEQLPKTIQDHFVLIVSEFMYTPWKYAREQAANRASARNGDSCTPSITAAAAEVFESHITEYLKEQISSYFADKLLRIVRDTVLHMKGMNRSENDQHTGDAALEFIKHVCAVLALDQNVQHDILVMRKNLLKYVHVREFAPEAEFCDPCQSFILPNVICSYCNDCRDLDLCRDSALLAQEWRCAVPQCGQPYDREVMENALLQIVRQRERLYHVQDLVCLKCNQVKAAHLAEQCSCAGSFRCKEDVSEFQSKMQVFLKIAMLQKFQLLQECTSWILEIR

SEQ ID NO: 6552 - protein, 586 aa, Glycine max; identical to SEQ ID NO: 6498

SEQ ID NO: 6553 - protein, 579 aa, Glycine max; identical to SEQ ID NO: 6497

SEQ ID NO: 6554 - protein, 583 aa, Medicago truncatula; identical to SEQ ID NO: 6499

SEQ ID NO: 6555 - protein, 522 aa, Glycine max
MLTRKRLVVSLSLATLLLFSSLSLSLCDKTPPQNDNKKNNNDDDEDLSFLEESDDAATTSHQGHFPDPDEFDEDDGDDEDDFGDFAGFDHSSEEAFKEPEVDDKDVVVLKERNFTTVVENNRFVMVEFYAPWCGHCQALAPEYAAAATELKPDGVVLAKVDATVENELANEYDVQGFPTVFFFVDGVHKPYTGQRTKDAIVTWIKKKIGPGVSNITTVEEAERVLTAGSKVVLGFLNSLVGAESDELAAASKLEDDVNFYQTVVADVAKLFHIDASVKRPALILLKKEEEKLNHFDGQFVKAEIADFVTSNKLPLVTTFTRESAPVIFESQIKKQLLLFVTSNDTEKFVPVFKEAAKIFKGKLKPFLKSDPVPESNDGDVKIVVGNNFDEIVLDESKDVLLEIYAPWCGHCQALEPTYNKLAKHLRSIESIVIAKMDGTTNEHPRAKSDGFPTLLFFPAGNKSSDPIPVDVDRTVKDFYKFLRKHASIPFQLQKLASTTKTASESSDVKESQSSTTEVKDEL

SEQ ID NO: 6556 - protein, 339 aa, Glycine max
  misc_feature (238)..(238): Xaa can be any naturally occurring amino acid
MLFHNQPMELVLLQILRLAWLAATLPIIVASIPTPKLSCLRATLLAFARRGKIMHSSQKFTISQRFFLHFYIVAFIWTTLLLLGTWAYAYNMVPLVVEPFSYSTITSFLTGGSTIKTDTYKLRQGYVAWQAVFLLLMMEVQVLRRLYETRHVFNYSPSARMHVIGYLTGLFFYVGAPLSLCGGCAVEVFNFLANLVTKFIVKGKNQMQVTELEFWQVVNPLFKLGWKHWIGAAVFLWXWIHQHQCHKILGSLRHSRQADEYVIPHGDWFEIVSSPHYLSEIVIYASFVVATGGSNLTIWLLFVFVVANLAFAAVETHSWYRQKFEDYPSSRFAIIPFIL

SEQ ID NO: 6557 - protein, 333 aa, Glycine max
MEVVLVQMLRLAWVAATLPIIVASIPTPKLNCLRGTLLGFARRGKIMHSSSQKVTISQRFFLHFYVVAFIWTTLLLVGTWAYAYSMVPLVVEPFSYSTITSFLTGGSTIRTDTHKLRQGYVAWQAVFLLLMMEVHVLRRLYETIHVFNYSPSARMHAVGYLTGLFFYVGAPLSLCGGCAVEVFNFLANLVTEFIVKGKNQMQVTELEFWQVVNPLFKLGWKHWIGAAVFLWGWIHQHQCHKILGSLRHSRQADEYVIPHGDWFEIVSSPHYLSEIVIYASFVVATGGSNLTIWLLFVFVVANLSFAAVETHGWYRQKFEDYPSSRFAIIPFIL

SEQ ID NO: 6558 - protein, 440 aa, Glycine max
MGCSASRTITIVANNNNQEDPSPSASLASSSSSFSSSSASHKSINSASSPAAAPVRRRTLSLPMPLVHHPPIKKGDSHHLVSLTSTTYGSLLPIDQKDSNFTQKNQPHITKTSNQTDPEHSLSPDSVINTWELMDGLDEEQEQEQEIANAKKLPYASILDKPSSCRYTAFDGSARKKLLDSFESMKTSQTAMEKDLNSSSSTSPAPTTKKPLWQHLSEEALLAKLDPSVAWSYRRALSSRNLDRNILSRDVRSMGSSPLIFHSSSSCSSSSFSFGKNNNINNSLCRLSGTEDRIVLYCTSLRGIRKTYEDCCSVRMILRGFRVAVDERDISMDSSYRKELKDLLGGKAAVTLPQVFIRGRYVGNAEEMKHLNESGELARLLEGFPTQDPGFVCDNCGDARFVPCPNCSGSRKVFEHEDGGLRRCPECNENGLIRCPGCGS

SEQ ID NO: 6559 - protein, 411 aa, Glycine max
MGCSASRTITIVANNNNQEDPSPSASLASSSSSFSSSSASHKSINSASSPAAAPVRRRTLSLPMPLVHHPPIKKGDSHHLVSLTSTTYGSLLPIDQKDSNFTQKNQPHITKTSNQTDPEHSLSPDSVINTWELMDGLDEEQEQEQEIANAKKLPYASILDKPSSCRYTAFDGSARKKLLDSFESMKTSQTAMEKDLNSSSSTSPAPTTKKPLWQHLSEEALLAKLDPSVAWSYRRALSSRNLDRNILSRDVRSMGSSPFLCRLSGTEDRIVLYCTSLRGIRKTYEDCCSVRMILRGFRVAVDERDISMDSSYRKELKDLLGGKAEVTLPQVFIRGRYVGNAEDMKHLNESGAIGFPTQDPGFVCDNCGDARFVPCPNCSGSRKVFEHEDGGLRRCPECNENGLIRCPGCGS

SEQ ID NO: 6560 - protein, 424 aa, Glycine max
MGCSASRTITIVANNNNQLEDPSSASLASSFSSSSASHKSINSTSSPAAAPVRRRALSLPMPLVHHPPIKKGDTHHLVSLTSTTYGSLLLIDQKDPNLTQKNQPRLTKTSNQTDPAHSLSPDSVINTWELMDGLDEEEEEEEEEIANAKKKPPYTSILDKPSSCRYTAFDGSARKKLLDSFESLKTSQTAMEKENSSSSPAPTKKPLWQHLSEEALLAKLDPSVAWSYRRALSSRNLGRNTLSRDVRSMGSSPLIFHSSSFSFGKNNSLCRLSGTEDRIVLYCTSLRGIRKTYEDCCSVRMILRGFRVAVDERDISMDSSYRKELKDALGGKAVTLPQVFIRGRYVGNAEQMKHLNESGELARLLEGFPTQDPGFVCDNCGDARFVPCPNCNGSRKVFEHEEGGLRRCPDCNENGLIRCPGCCP

SEQ ID NO: 6561 - protein, 463 aa, Glycine max
MGIPIRSGNIKRQNEAMRLTLATFVGVVFGFSLGVSFPTLALTRMNLPSSLLPSIDLTYVDDNYSKISTKSLWDAWASFRRDRSMYKKVHKLNDTKIWVPTNPRGAERLPPKIVKSESDFYLHRLWGMPYQDLSIKPKYLVTFTVGSDQKDNIDAAVKKFSENFTIVLFHYDGRASDWEKFEWSKRAIHISARKQTKWWYAKRFLHPDIVAPYDYIFIWDEDLGVEHFDAEEYLKMVRKHGLEISQPGIDPSSSFTWQMTRKRDSGEVHKKAEERSGWCSDPHLPPCAAFVEIMAPVFSRDAWRCVWHMIQNDLVHGWGLDFVLRKCVEPPHEKIGVVDTQWVVHQSVPSLGNQGQAERGRAPWEGVRERCNKEWTIFQERMAEAERDYFQTREIQGESNAYTSSGLENTCKAKSDRGRGKGRKGKWCGNFLPKRKYISVLDGGGAVTMMDIPSWGKKMVKEF

SEQ ID NO: 6562 - protein, 447 aa, Vitis vinifera
MPMFQHYQKDGLVGFDGGGDGHVLDLDTAVKDGVLGGGGGGVVGGIAEKLDLKRMIEELDLSEIPSVFICPISLEPMQDPVTLCTGQTYERSNILKWFSLGHLTCPTTMQELWDDSVTPNKTLYHLIYSWFSQKYLLMKKRSEDVQGRASELLETLKKVKGQARVQALKELHQVVAAHATARKTVEEGGVALISALLGPFTSHAVGSEVIGILVNLTLDSESKANLMQPAKISLMVDLLNEGSIETKINSTRLIEMLMEEKDFRSEIVSSHSLLVGLMRLVKDKRHPNGNLPGLTLLRTICLHKQVRNLFVSIGAIPQLVELLPALNPDCLESALFILDTLSSLPEGRLALRDCLNTIPNMVRLLMRVSESCTQYALAILWSVCKLAPEECSSIAVEAGLAAKLLLVIQSGCNPVLKQRSAELLKLCSLNYTDTTFISKCKLTKTIQ

SEQ ID NO: 6563 - protein, 449 aa, Glycine max
MPMFQPCRKDMVTGYEGGADGQILDLDTAVKDGVLGGVEGGVVGGGVGEKVDLGKMIEELELCEVPSVFICPISLEPMQDPITLCTGQTYERSNILKWFNLGHFTCPTTMQELWDDSVTPNTTLYRLIHTWFSQKYLLMKKRSEDVQGRASELLETLKKVKGQARVQALKEIHQLVASHATARKAVIDEGGVSVVSSLLGPFTSHAVGSEVIGILVTLTLDSESRKNLLQPAKVSLMVDILNEGSIETKINCTRLIESLIEEKDFRSEVISSHSLLVGLMRLVKDKRHSNGVCPGLSLLRTICLHKEVRNLLVSIGAVSQLVELLSGMEPDCTELALCVLDALASVPEGRVALKDCSNTIPIMVKLLMRISENCTQYALSILWSVCKLSPDECSSIAVDAGLAAKLLLVIQSGCNPILKQQSAELLKLCSLNYSDTIFISKCKLTRTIQ

SEQ ID NO: 6564 - protein, 449 aa, Glycine max
MPMFQPCRKDLVAGYEGGGDGQILDLDTAVKDGVLGGVEGGVLGGGVGEKVDLGKMIEELELCEVPSVFICPISLEPMQDPVTLCTGQTYERSNILKWFNLGHFTCPTTMQELWDDSVTPNTTLYRLIHMWFSQKYLLMKKRSEDVQGRASELLETLKKVKSQARVQALKELHQLVASHATARKTVIDEGGVSVVSSLLGPFTSHAVGSEVIGILVTLTLDSESRKNLLQPAKVSLMVDILNEGSIETKINCTRLIESLIEEKDFRSEVILSHSLLVGLMRLVKDKRHNNGVCPGLSLLRTICLHKEVRNLLVSIGAVSQLVELLSGMEPDCLELALCVLDALASVPEGRVALKDCSNTIPIMVKLLMRISENCTQYALSILWSVCKLSPEECSSIAVDAGLAAKLLLVIQSGCNPILKQQSAELLKLCSLNYSDTIFLSKCKLTRTIQ

SEQ ID NO: 6565 - protein, 471 aa, Medicago truncatula
MPMYQPSKRDMVVGYEGGGDGQILDLDTAVKDGVLGGVDCGGIVGTGVVGEKLDLRKMIQELELCEVPSVFICPISLEPMQDPVTLCTGQTYERNNILKWFNMGHFTCPTTMQELWDDSITPNTTLYRLIYTWFSQKYLLMKKRSEDVQGRASELVETLKKVKGQARVHALKELHQVVSVHATARKSVIDGGGVSVLSSLLGPFTSHAVGSEVIGILVSLTLDSESKKNLMQPAKISLMVDILNEGSIETKINCTRLIETLIEEKDFRSEIISSHSLLVGLMRLVKDKRHSNGICPGLSLLRTVCFYKEVKILLVSIGAVSQLVELLSGMDHDCLELALCVLDSLSSIPEGRVALKECVNTIPIMVRLLMRISESCTQYALSILWSVCKLAPEECSSIAVDAGLAAKLLLVIQSGCNPILKQQSAELLKLCSLNYSDTIFISKFITIGAERFRCPEVLFHPSMISKYLFGM

SEQ ID NO: 6566 - protein, 448 aa, Arabidopsis thaliana
MPMFQPLKRDGLIGFEGGGDGQVLDLDTAVKDGVLGGVNGGGVGVVDEKLDLKKMIKELDLQDIPSVFICPISLEPMQDPVTLCTGQTYERLNIHKWFNLGHLTCPTTMQELWDDTVTPNKTLHHLIYTWFSQKYVLMKKRSEDVQGRAIEILGTLKKAKGQARVHALSELKQIVIAHLMARKTVVEEGGVSVISSLLGPFTSHAVGSEVVAILVSLDLDSDSKSGLMQPAKVSLIVDMLNDGSNETKINCARLIRGLVEEKGFRAELVSSHSLLVGLMRLVKDKRHRNGVSPALRLLKPISVHKQVRSLMVSIGAVPQLVDILPSLDPECLELALFVLDALCTDVEGRVAVKDSANTIPYTVRVLMRVSENCTNYALSILWSVCKLAPEECSPLAVEVGLAAKLLLVIQSGCDAALKQRSAELLKLCSLHYSDTMFISKCKLTRTIQ

SEQ ID NO: 6567 - protein, 445 aa, Arabidopsis lyrata subsp. lyrata
MPMFQPLKRDGLIGFEGGGDGQVLDLDTAVKDGVLGGVNGGVVDEKLDLKKMIKELDLQDIPSVFICPISLEPMQDPVTLCTGQTYERLNIHKWFNLGHLTCPTTMQELWDDTVTPNKTLHHLIYTWFSQKYVLMKKRSEDVQGRAIEILGTLKKAKGQARVHALSELKQIVVAHLMARKTVVEEGGVSVISSLLGPFTSHAVGSEVVAILVSLDLDSDSKSGLMQPAKVSLIVDMLNDGSNETKINCARLIKGLVEEKGFRAELVSSHSLLVGLMRLVKDKRHRNGVSPALGLLKPISVHKQVRNLMVSIGAVPQLVDILPSLDPECLELALFVLDALCSDMEGRVAVKDSANTIPYTVRVLMRVSENCTSYALSILWSVCKLAPEECSPLAVEVGLAAKLLLVIQSGCDAALKQRSAELLKLCSLHYSDTMFISKCKLTRTIQ

SEQ ID NO: 6568 - protein, 452 aa, Vitis vinifera
MPMYQPSGRRRDGGVMYDVGGDGGHVLDLETAVKDGILGGGGGVVCGSGVTEKLDLKKMIEDLDSIDVPSVFICPISLEPMQDPVTICTGQTYERSNIVKWFSMGHFTCPTTMQELWDDSITPNKTLYQLIYSWFSQKYLVMKKRSEDVQGRALEVLETLKKVKGQARIQALKELRQVVSIHASAKKTVADNGGIGLISSLLGPFTSHAVGSEVIGILVNLSLDSESKSNLMQPAKISLMVDMLNEGSIETKINCTKLIEILMEGRDFESEIVPSLSLLVGLLRLVKDKRHQNGILAGLALLKTICLHEPVRNSVVSIGAVPQLVELLPNLNPACLELALYILEVLSTLPQGRLALKDCPNMIPNVVKLLMRVSESCTQLALAILSAVCKLAPEECASLAVEAGLAAKLLLVIQSGCNPVLKQRAAELLKLCSLNYTATIFISKCKLTRTIQ

SEQ ID NO: 6569 - protein, 448 aa, Arabidopsis thaliana
MPMFQPLKRDGLIGFEGGGDGQVLDLDTAVKDGVLGGVNGGGVGVVDEKLDLKKMIKELDLQDIPSVFICPISLEPMQDPVTLCTGQTYERLNIHKWFNLGHLTCPTTMQELWDDTVTPNKTLHHLIYTWFSQKYVLMKKRSEDVQGRAIEILGTLKKAKGQARVHALSELKQIVVAHLMARKTVVEEGGVSVISSLLGPFTSHAVGSEVVAILVSLDLDSDSKSGLMQPAKVSLIVDMLNDGSNETKINCARLIRGLVEEKGFRAELVSSHSLLVGLMRLVKDKRHRNGVSPALRLLKPISVHKQVRSLMVSIGAVPQLVDILQSLDPECLELALFVLDALCTDVEGRVAVKDSANTIPYTVRVLMRVSENCTNYALSILWSVCKLAPEECSPLAVEVGLAAKLLLVIQSGCDAALKQRSAELLKLCSLHYSDTMFISKCKLTRTIQ

SEQ ID NO: 6570 - protein, 444 aa, Arabidopsis thaliana
MPMFQPSKNGGFDGHILDLHSAVKDGVLGGGDGKFLVVVTDEKKKLDLKEMISELELPEIPSVFICPISLEPMQDPVTLCTGQTYERSNILKWFNIGHCTCPTTMQELWDDLVTPNKTLHQLIYTWFSQKYVLMKKRSEDVQGRAIEILGTLRKAKGKAKVHALSELKQVVMAHAIAKKTVVDEGGVFVISSLLSPFTSHAVGSEAIAILVNLELDSDSKAGLMQPARVSLMVDMLNDGSIETKINCARLIGRLVEEKGFRAELVSSHSLLVGLMRLVKDRRRRNGVSPALTLLKSVSVHKQVRNLLVRIGAVPQLVDVLPCLDVECLESALFVLDSLCLESEGRIALKDSVNTIPHTVRLLMKVSEKCTNYAISILWSVCKLASEECSSLAVEVGLAAKLLLVIQSGCDPALKQRSAELLKLCSLHYSDSMFISKCKLTRTIQ

SEQ ID NO: 6571 - protein, 444 aa, Arabidopsis thaliana
MPMFQPSKNGGFDGHILDLHSAVKDGVLGGGDGKFLVVVTDEKKKLDLKEMISELELPEIPSVFICPISLEPMQDPVTLCTGQTYERSNILKWFNIGHCTCPTTMQELWDDLVTPNKTLHQLIYTWFSQKYVLMKKRSEDVQGRAIEILGTLRKAKGKAKVHALSELKQVVMAHAIAKKTVVDGGGVFVISSLLSPFTSHAVGSEAIAILVNLELDSDSKAGLMQPARVSLMVDMLNDGSIETKINCARLIGRLVEEKGFRAELVSSHSLLVGLMRLVKDRRRRNGVSPALTLLKSVSVHKQVRNLLVRIGAVPQLVDVLPCLDVECLESALFVLDSLCLESEGRIALKDSVNTIPHTVRLLMKVSEKCTNYAISILWSVCKLASEECSSLAVEVGLAAKLLLVIQSGCDPALKQRSAELLKLCSLHYSDSMFISKCKLTRTIQ

SEQ ID NO: 6572 - protein, 211 aa, Glycine max
MNDNMTAMADQCIHDPSIERLMDATMSSSSEGMMMLRPTNSHNYTTSGHNLTPKGCAFKPIRRRSRTSKSTPITLLKANTSNFRALVQQFTGCPTTTTMSLAIHKGPITLNFQQDGTKQHIHHDQHHTKITTRGAMPPFATISSNQNHASVPFPKQQLMQEQQSGYFLPTYSGNSYRPISCMDDGLIFDNDFSLHELTVNAISNDSDGLFM

SEQ ID NO: 6573 - protein, 221 aa, Glycine max
MTATADQCMHEFYQQPLMDGMAMDPSIEGLMDASMSSSSEGMIMLSPSNSHNNTTIGHHNLTPKGCAFKQIRRRSRASKSTPITLLKANTSNFRALVQQFTGCPTTTAMSLAIHKGPVTLNFQQGGSKQHIHHHHHTKITTRGAMPPFIGTISSNQNQVSVPLPKQHLMQEQQSGHFLPTSSGNSYRPINCMDDGLIFDNDFSLHELTVNAISNDIDDLFM

SEQ ID NO: 6574 - protein, 467 aa, Glycine max
MASSKCCMISPQQNQNAPTCYPSPMGMVYADMMGSLSLATVSNNASSSQESNGYSYGYASGVENARSTRWSFPFTREFLSSNFEDCSDVVVGAGDSNNNINEKTNHNNGKFSEEESNPNENNPAGGKEVDSGHSKLCARGHWRPAEDSKLKELVALHGPQNWNLIAEKLEGRSGKSCRLRWFNQLDPRINRRAFSEEEEERLMQAHRIYGNKWAMIARLFPGRTDNAVKNHWHVIMARKYREQSSAYRRRRMSQPVYRRVDQNPTFVCSSRDNNASTTEPEPESSPSYYPNLNDRGVALTNNMASFPSLHGVAAGAGGVVEFGSNVSPLNMTRGREAVSNTTHVGLCAQAQQQAPFDFFSGGGSHDMVLESMSQMRSRERTNESYNHHCQLSGFYPHHPQQYLMAMQQQLDNNNFYSFLNSSSSASTTRTREPSSPCVAEIRDKVVNSDPPDGVPPPFFDFFGVGAT

SEQ ID NO: 6575 - protein, 478 aa, Glycine max
MEFDYGVNLQIPNRPTSSSSSTTTTTKFNAPTCYPSPIGVVFADMMGSLSLATVSNNASSSQESNVYGYGYGYASGVGNGSTRWSFPFMREFLSSNFEDCSDLVGAGESNNSNEKTNHNNGKFSEEESNPNENHANGKEVDSGHSKLCARGHWRPAEDSKLKELVALYGPQNWNLIAEKLEGRSGKSCRLRWFNQLDPRINRRAFSEEEEERLMQAHRIYGNKWAMIARLFPGRTDNAVKNHWHVIMARKYREQSSAYRRRRMSQSVHRRVEQNPTFVCSSSRDNASTTEQEPEPSPSYYPNLIHHGVALTNNMASFPPFHGVAACNGVVVEFGSNGSPQNMTSGREAMPNTTHVGLSAQAQQQAPFDFFSGGGSNDIVLESISHMRSRERTNGSHNHHCQLSGCYPHYPQQYLMAMQQQLDNNNNFYSFLNSSPAASTAREPSSSPCVAEIRDKVENSDPPDGVPPPFFDFLGVGAT

SEQ ID NO: 6576 - protein, 483 aa, Pisum sativum
MSLEDSLRSLSLDYLNLLINGQAFSDVVFSVEGRLVHAHRCILAARSLFFRKFFCGPDPPSGLDPSGNRVNSSTRSGVIPVNSVGYEVFLLMLQFLYSGQVSIVPQKHEPRPNCGDRGCWHTHCTSAVDLALDTLSAARYFGVEQLALLTQKQLASMVEKASIEDVMKVLLASRKQDMHQLWTTCSHLVAKSGLPPEVLAKHLPIDIIAKIEELRMKSSLSRRSLIPHHHHNPHHHHDHLTAAADLEDQKIRRMRRALDSSDVELVKLMVMGEGLNLDEALALPYAVESCSREVVKALLELGAADVNFPAGPTGKTPLHIAAEMVSPDMVAVLLDHHADPNVRTVDGVTPLDILRTLTSDFLFKGAVPGLTHIEPNKLRLCLELVQFAALVMSREEGNNNNNANNNNTGSSATNMYPHNHMNEEHHSHHNNNSNMDSRLVYLNLGANTQMSTSRLDSGDDDHNSNQREAMNPSMYHHHHSHDY

SEQ ID NO: 6577 - protein, 483 aa, Pisum sativum
MSLEDSLRSLSLDYLNLLINGQAFSDVVFSVEGRLVHAHRCILAARSLFFRKFFCGPDPPSGLDPSGNRVNSSTRSGVIPVNSVGYEVFLLMLQFLYSGQVSIVPQKHEPRPNCGDRGCWHTHCTSAVDLALDTLSAARYFGVEQLALLTQKQLASMVEKASIEDVMKVLLASRKQDMHQLWTTCSHLVAKSGLPPEVLAKHLPIDIIAKIEELRMKSSLSRRSLIPHHHHNPHHHHDHLTAAADLEDQKIRRMRRALDSSDVELVKLMVMGEGLNLDEALALPYAVESCSREVVKALLELGAADVNFPAGPTGKTPLHIAAEMVSPDMVAVLLDHHADPNVRTVDGVTPLDILRTLTSDFLFKGAVPGLTHIEPNKLRLCLELVQSAALVMSREEGNNNNNANNNNTGSSATNMYPHNHMNEEHHSHHNNNSNMDSRLVYLNLGANTQMSTSRLDSGDDDHNSNQREAMNPSMYHHHHSHDY

SEQ ID NO: 6578 - protein, 483 aa, Medicago truncatula
MSLEDSLRSLSLDYLNLLINGQAFSDVVFSVEGRLVHAHRCILAARSLFFRKFFCGPDPPSGLDPSGNRVNPSGSARSGVIPVNSVGYEVFLLMLQFLYSGQVSIVPQKHEPRPNCGDRGCWHTHCTSAVDLALDTLAAARYFGVEQLALLTQKQLASMVEKASIEDVMKVLLASRKQDMHQLWTTCSHLVAKSGLPPEVLAKHLPIDIIAKIEELRIKTSLSRRSLMPHHHHPHHHDHLTAAADLEDQKIRRMRRALDSSDVELVKLMVMGEGLNLDEALALPYAVENCSREVVKALLELGAADVNFPAGPTGKTPLHIAAEMVSPDMVAVLLDHHADPNVRTVDGVTPLDILRTLTSDFLFKGAVPGLTHIEPNKLRLCLELVQSAALVMSREEGNNNNSNNNNNNATASSATNMYPHHNMNEDHRHSHNNNNMDSRLVYLNLGANTQMSTSRMDSGDDDNTHREAINNSMYHHHSHGHDY

SEQ ID NO: 6579 - protein, 482 aa, Medicago truncatula
MSLEDSLRSLSLDYLNLLINGQAFSDVVFSVEGRLVHAHRCILAARSLFFRKFFCGPDPPSGLDPSGNRVNPSGSARSGVIPVNSVGYEVFLLMLQFLYSGQVSIVPQKHEPRPNCGDRGCWHTHCTSAVDLALDTLAAARYFGVEQLALLTQKQLASMVEKASIEDVMKVLLASRKQDMHQLWTTCSHLVAKSGLPPEVLAKHLPIDIIAKIEELRIKTSLSRRSLMPHHHHPHHHDHLTAAADLEDQKIRRMRRALDSSDVELVKLMVMGEGLNLDEALALPYAVENCSREVVKALLELGAADVNFPAGPTGKTPLHIAAEMVSPDMVAVLLDHHADPNVRTVDGVTPLDILRTLTSDFLFKGAVPGLTHIEPNKLRLCLELVQSAALVMSREEGNNNNSNNNNNATASSATNMYPHHNMNEDHHHSHNNNNMDSRLVYLNLGANTQMSTSRMDSGDDDNTHREAINNSMYHHHSHGHDY

SEQ ID NO: 6580 - protein, 488 aa, Glycine max
MSLEESLRSLSLDYLNLLINGQAFSDVTFSVEGRLVHAHRCILAARSLFFRKFFCGPDPPSGLDPTGPRGVNSSRSGGVIPVNSVGYEVFLLMLQFLYSGQVSIVPQKHEARPNCGERGCWHTHCTSAVDLALDTLAAARYFGVEQLALLTQKQLASMVEKASIEDVMKVLLASRKQDMQQLWATCSHLVAKSGLPPEVLAKHLPIDIVAKIEELRLKSSLARRSLVPSHHHHHHHHHHHAAAALDLEDQKIRRMRRALDSSDVELVKLMLMGEGLNLDEALALPYAVENCSREVVKALLELGAADVNYPSGPAGKTPLHIAAEMVSPDMVAVLLDHHADPNVRTVDGVTPLDILRTLTSDFLFKGAVPGLTHIEPNKLRLCLELVQSAALVMSREDGNNANNNNNNATNNSAAPIYPPPMNEDHNNNSSSSSGNNNNNNIGNLNLDSRLVYLNLGATASMSSRLDNAEDEREAMNQTMYHHHHSHDY

SEQ ID NO: 6581 - protein, 487 aa, Glycine max
MSLEESLRSLSLDYLNLLINGQAFSDVTFSVEGRLVHAHRCILAARSLFFRKFFCGPDAPCGLDPAGPRGVNSSRSGVIPVNSVGYEVFLLMLQFLYSGQVSIVPQKHEARPNCGERGCWHTHCTSAVDLALDTLAAARYFGVEPLALLTQKQLASMVEKASIEDVMKVLLASRKQDMQQLWATCSHLVAKSGLPPEVLAKHLPIDIVAKIEELRLKSSLARRSLVPSHHHHHHHPHHHAAAALDLEDQKIRRMRRALDSSDVELVKLMVMGEGLNLDEALALPYAVENCSREVVKALLELGAADVNYPSGPAGKTPLHIAAEMVSPDMVAVLLDHHADPNVRTVDGVTPLDILRTLTSDFLFKGAVPGLTHIEPNKLRLCLELVQSAALVMSREEGNNANNNNNGPHSSSSAAPIYPPPMNEDHNNNNNSSSSSGNNNIGNLNLDSRLVYLNLGATASMSSRLDNAEDEREAMNQNMYHHHHSHDF

SEQ ID NO: 6582 - protein, 483 aa, Lotus japonicus
MSLEDSLRSLSLDYLNLLINGQAFSDVTFSVEGRLVHAHRCILAARSLFFRKFFCGPDPPPPSGNLDSPGGPRVNSPRPGGVIPVNSVGYEVFLLMLQFLYSGQVSIVPQKHEPRPNCGERACWHTHCTSAVDLALDTLAAARYFGVEQLALLTQKQLASMVEKASIEDVMKVLLASRKQDMHQLWTTCSHLVAKSGLPPEVLAKHLPIDIVAKIEELRLKSTLARRSLIPHHHHHHHHHGHHDMGAAADLEDQKIRRMRRALDSSDVELVKLMVMGEGLNLDEALALPYAVENCSREVVKALLELGAADVNYPSGPSGKTPLHIAAEMVSPDMVAVLLDHHADPNVRTVDGVTPLDILRTLTSDFLFKGAVPGLTHIEPNKLRLCLELVQSAALVMSREEGNANANSSNNNNAPCSAATPIYPPMNEDHNSSSSNANLNLDSRLVYLNLGAAQMSGDDDSSHGSHREAMNQAMYHHHHSHDY

SEQ ID NO: 6583 - protein, 490 aa, Vitis vinifera
MTLEDSLRSLSLDYLNLLINGQAFSDVTFNVEGRLVHAHRCILAARSLFFRKFFCGPDPPAGLDPGGSRMGSAAAALATSPRGGNSHVIPVNSVGYEVFLLVLQFLYSGQVSIVPQKHEPRPNCGERGCWHTHCTSAVDLALDTLAAARSFGVEQLALLTQKQLASMVEKASIEDVMKVLIASRKQDMHQLWTTCSHLVAKSGLPPEVLAKHLPIDVVAKIEELRLKSSLARRSLMPHHHHHQDIGAAADLEDQKIRRMRRALDSSDVELVKLMVMGEGLNLDEALALHYAVENCSREVVKALLELGAADVNYPAGPAGKTPLHIAAEMVSPDMVAVLLDHHADPNVRTVDGVTPLDVLRTLTSDFLFKGAVPGLTHIEPNKLRLCLELVQSAALVLSREEGSANAPSSTTIYPPMSDDHHSSSSSSNMASLNLDSRLVYLNLGATGSGQMGSRMDREDDVSHNNQREAMNRHGSQGGCDTSMYHHSHEY

SEQ ID NO: 6584 - protein, 490 aa, Vitis vinifera
  misc_feature (68)..(68): Xaa can be any naturally occurring amino acid
MTLEDSLRSLSLDYLNLLINGQAFSDVTFNVEGRLVHAHRCILAARSLFFRKFFCGPDPPAGLDPGGXRMGSAAAALATSPRGGNSHVIPVNSVGYEVFLLVLQFLYSGQVSIVPQKHEPRPNCGERGCWHTHCTSAVDLALDTLAAARSFGVEQLALLTQKQLASMVEKASIEDVMKVLIASRKQDMHQLWTTCSHLVAKSGLPPEVLAKHLPIDVVAKIEELRLKSSLARRSLMPHHHHHQDIGAAADLEDQKIRRMRRALDSSDVELVKLMVMGEGLNLDEALALHYAVENCSREVVKALLELGAADVNYPAGPAGKTPLHIAAEMVSPDMVAVLLDHHADPNVRTVDGVTPLDVLRTLTSDFLFKGAVPGLTHIEPNKLRLCLELVQSAALVLSREEGSANAPSSTTIYPPMSDDHHSSSSSSNMASLNLDSRLVYLNLGATGSGQMGSRMDREDDVSHNNQREAMNRHGSQGGCDTSMYHHSHEY

SEQ ID NO: 6585 - protein, 481 aa, Populus trichocarpa
MTLEDSLRSLSLDYLNLLINGQAFSDVTFSVEGRLVHAHRCILAARSLFFRKFFCGPDPPSGLDPSGSRINTVGSPGSRSNVIPVNSVGYEVFLLLLQFLYSGQVSIVPQKHEPRPNCGERGCWHTHCTSAVDLALDTLAAARYFGVEQLAMLTQKQLANMVEKASIEDVMKVLIASRKQDMHQLWTTCSHLVAKSGLPPEVLAKHLPIDVVAKIEELRLKSSIARRSLMPHHHHHLHDLTSAADLEDQKIRRMKRALDSSDVELVKLMVMGEGLNLDEALALHYAVENCSREVVKALLELGAANVNYQAGPAGKTPLHIAAEMVSPDMVAVLLDHHADPNVRTVDGVTPLDILRTLTSDFLFKGAVPGLAHMEPNKLRLCLELVQSAAMVLSREEGNVNATSTLIYPSMSDEHNTSSSGSNLANLNLDSRLVYLNLGAAGSGQMGSRMDEEDDSNHNNQRDHHAMSRHDPTMYHHHSHDF

SEQ ID NO: 6586 - protein, 411 aa, Glycine max; identical to SEQ ID NO: 6559

SEQ ID NO: 6587 - protein, 440 aa, Glycine max; identical to SEQ ID NO: 6558

SEQ ID NO: 6588 - protein, 628 aa, Glycine max
MVRGGGLQSMDSDPIGSFFLHKPIVLNSFPAEDTNNKWKKLSLHHNMDATASNTKDNTIPFQVSLRCSPNNHDDASSPPSLHNNRTEMDLFSDKNSTKDDDNNNNKVDASASLPDNDHHSTTPPTLEFKLNTGGLNLLTTNTNSDQSMVDDEISPNSEDKRAKNEMAVLQADLERMKRENQKLRDSLDEVTTNYSALQMHFMNLMQERKGEEGEEEQEEVYGGEKKQQLGESGGDGILVPRQFMDLGLAANNGTSTGIEPSSSSGGRSQDRSRSPNVEVASKELGTNDEEEKKEYGRGIEREDDSPSGHAHKVPRFSPPKDNNSVEAEATMRKARVSVRARSETPMIADGCQWRKYGQKMAKGNPCPRAYYRCSMASACPVRKQVQRCAEDRTVLITTYEGNHNHPLPPTAMAMAQTTSSAARMLLSGSMSSADSIMNANFLTGTLLPCSSSMATISASAPFPTVTLDLTHSPNPLQFPRQQHPNQLQIGVPQNNFANSPAASLLPQIFGQALYNNQSKFSGLQMSSSHYDADPSSQFGNNQLPPHQVVPPHLADTVGAAIATDPNFTAALAAAITSIIGGAPLQHSNSSNNNNSNSNNKGNMTANNSNNGNGNVASSSNNNCNNGKQ

SEQ ID NO: 6589 - protein, 614 aa, Glycine max
MIRRGGLSMDSDPIGSFFLHKPIVLNSFSAEDTNNHNPEWKKLSLHNNNMDATVTTKDYTIPFRINLSCSSADNHDDVSSPTSLRSRTEMDFFSNKNSTKDDDNNIVAAAGSASLPDNDHHSISPPTLDLKVNTCLNLLTTNASSDQSMVEDEISPNSEDKETKKEMADLQGDLERIKRENQKLRDTLDEVNTNYNALQMHFMNMMQERKGEEGEDQQEVSDGKVKEKKQGQSGGGVLVSRQFMDLGLASADIEPSSSSGGIRSQDRSGSPNIDVASKGLGTSNNDGNNSVNDEEEKEYDRGIESEDSPSGHADKVPRFSSPSKNNNVDQAEAEATMRKARVSVRARSEAPMITDGCQWRKYGQKMAKGNPCPRAYYRCTMAAGCPVRKQVQRCAEDRTVLITTYEGNHNHPLPPTAMAMAQTTSSAARMLLSGSMSSADSIMNADFLTRTLLPCSSSMATISASAPFPTVTLDLTHSPNPLQFPRQQHPNQLQIGVPQNFANSPSSLMPQIFGQALYNQSKFSGLQMSSHDTADPSSQFGYQPHQVPPHLADTVGAAIATDPNFTSALAAAITSIIGGAQQQHSNINNNSNNNVNMTANINNGNGNSNGNGKQ

SEQ ID NO: 6590 - protein, 194 aa, Glycine max
MKKILVSIKFLFCFSLLCVLFSSLPLLLQSLKPSLMQFFSYLVEKSYMFLFCNGLLLVLIAINSAPINASSPPTTERAAFSVHIEENSSQLESKEPDIAVAAAPIAAEETEFPQEEENVLEIVERENVLSDTQEGGNALVTIDEDVHDTEELNKKCEDFIKRMKATFSSTNLELRAVDRFYFDNRSCLMNLPFF

SEQ ID NO: 6591 - protein, 194 aa, Glycine max
MKKILVSIKFLFCFSLLCVLFSSLPLLLQSLKPSLMQFFSYLVEKSYMFLFCNGLLLVLIAINSAPINASSPPTTERAAFSVHIEENSSQLESKEPDIAVAAAPIAAEETEFPQEEENVLEIVERENVLSDTQEGENALVTIDEDVHDTEELNKKCEDFIKRMKATFSSTNLELRAVDRFYFDNRSCLMNLPFF

SEQ ID NO: 6592 - protein, 191 aa, Glycine max
MKKILVSIKFLLCLSLLCVLFLSFPLLLQSLKPSLMQFFSYMVEKSYMFLLCNGLLLVLIAINSAPINASSPPTTERAAVAVHIEEKSSQLESKEPDIAVAAPIAGEETESPHKEEKILVRVEQDNVLSDTQEEENVLVIIDEDKHDTEELNKKCEDFIKRMKATFSSNNLELRAVDSFYFDNQKLPVAVN

SEQ ID NO: 6593 - protein, 161 aa, Vitis vinifera
MQTLKNLVVKLPKDLTIKPKYLVTFTVGCDQKKNVDAAVKKFSEDFTILLFHYDGQTTEWDEFEWSKRAIHVSVRRQTKWWYAKRFLHPDIVAPYDYIFIWDEDLGVEHFNAEEYIRLVRKYGLEISQPGLEPNKGLTWQMTKRRGDREVHKNRGETGLVP

SEQ ID NO: 6594 - protein, 372 aa, Pisum sativum
MATPVEPPNGIRADGKHYYSMWQTLFEIDTKYVPIKPIGRGAYGIVCSSVNRETNEKVAIKKIQNAFENRVDALRTLRELKLLRHLHHENVIALKDIMMPVHRTSFKDVYLVYELMDTDLHQIIKSSQTLSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKRYIKSLPYSPGTPFSRLYPNAHPLAIDLLAKMLVFDPTKRISVTEALQHPFMASLYDPNCDPPAIIPIDLDIDEDLGEEMIRELMWREMVHYHPGSAMGNAELSS

SEQ ID NO: 6595 - protein, 371 aa, Glycine max
MATPVEPPNGIRTEGKHYYSMWQTLFEFDSKYVPIKPIGRGAYGIVCSSVNRETNEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGSPFSRLYPNAHPLAIDLLAKMLVFDPTKRISVTEALQHPYMAPLYDPNCDPPAVIPIDLDIDEDLGEEMIREMMWKEMLHYHPESAMENAGLC

SEQ ID NO: 6596 - protein, 371 aa, Glycine max
MATPVEPPNGIRTEGKHYYSMWQTLFEIDSKYVPIKPIGRGAYGIVCSSVNREINEKVAIKKIQNAFENRVDALRTLRELKLLRHLHHENVIALKDIMMPVHRNSFKDVYLVYELMDTDLHQIIKSSQALSNDHCQYFLFQLLRGLKYLHSANILHRDLKPGNLLINANCDLKICDFGLARTNCSKNQFMTEYVVTRWYRAPELLLCCDNYGTSIDVWSVGCIFAELLGRKPIFPGSECLNQLKLIINILGSQREEDIEFIDNPKAKKYIKSLPYSPGTPLSQLYPNAHPLAIDLLAKMLVFDPTKRISVTQALQHPYMAPLYDPNCDPPAVIPIDLDIDEDLGEEMIRDMMWKEMLHYHPESAMESAGLC

SEQ ID NO: 6597 - protein, 371 aa, Vitis vinifera
MATPVEPPNGTRCEGKHYYSMWQTLFEIDTKYVPIKPIGRGAYGIVCSSVNKETNEKVAIKKIHNAFDNRVDALRTLREIKLLRHLRHENVIALKDVMMPIHRRSFKDVYLVYELMDTDLHQIIKSSQALTNDHCQYFLFQLLRGLKYLHSANILHRDLKPGNLLINANCDLKICDFGLARTSTGKGQFMTEYVVTRWYRAPELLLCCDNYGTSIDVWSVGCIFAELLGRKPIFPGTECLNQLKLIINILGSQREADIEFIDNPKARKYIKSLPFSPGTPFSRLYPNAHPMAIDLLQKMLIFDPSKRIGVTEALQHPFMSSLYDPSKNPPAQVPIDLDIDEDLGEEMIREMMWKEMLHYHPEAVTSNGEAS

SEQ ID NO: 6598 - protein, 372 aa, Nicotiana tabacum
MATPVEPPNGIRTPGKHYYSMWQSLFEIDTKYVPIKPIGRGAYGIVCSSVNRETNEKVAIKKINNAFENRIDALRTLRELKLLRHLRHENVIALKDVMMPIHRRSFKDVYLVYELMDTDLHQIIKSSQTLSNDHCQYFLFQLLRGLKYLHSANILHRDLKPGNLLINANCDLKICDFGLARTSSGKDQFMTEYVVTRWYRAPELLLCCDNYGTSIDVWSVGCIFAELLGRKPVFPGTECLNQLKLIINILGSQREEDIEFIDNPKARKYIKSLPYSPGTPFSRLYPHAHPLAIDLLQRMLVFDPSKRISVIEALQHPYMSPLYDPNTDPPAQVPINLDIDEDLGEETIREMMWSEILEYHPEAATAAMEVVL

SEQ ID NO: 6599 - protein, 372 aa, Solanum lycopersicum
MATPVEPPNGIRSPGKHYYSMWQSLFEIDTKYVPIKPIGRGAYGIVCSSVNRESNEKVAIKKINNAFENRVDALRTLRELKLLRHLRHENVIALKDVMMPIHRRSFKDVYLVYELMDTDLHQIVKSSQTLTNDHCQYFLFQLLRGLKYLHSANILHRDLKPGNLLINANCDLKICDFGLARTSSGKDQFMTEYVVTRWYRAPELLLCCDNYGTSIDVWSVGCIFAELLGRKPVFPGTECLNQLKLIINILGSQREEDLEFIDNPKARKYIKSLPYSPGTPFSRLYPQAHPLAIDLLQRMLVFDPSKRISVMEALQHPYMSPLYDPNTDPPAQVPINLDIDEDLGEETIRDMMWTEILHYHPEAATAAMEEVM

SEQ ID NO: 6600 - protein, 384 aa, Petunia x hybrida
MATPVEPPNGIRTPGKHYYSMWQSLFEIDTKYVPIKPIGRGAYGIVCSSVNRETNEKVAIKKINNAFENRIDALRTLRELKLLRHLRHENVIALKDVMMPIQRRSFKDVYLVYELMDTDLHQIIKSSQTLSNDHCQYFLFQLLRGLKYLHSANILHRDLKPGNLLINANCDLKICDFGLARTSSGKDQFMTEYVVTRWYRAPELLLCCDNYGTSIDVWSVGCIFADVLGRKPVFPGTECLNQLKLIINILGSQREEDIEFIDNPKARKYIKSLPYSPGTPFSRLYPNAHPLAIDLLQRMLVFDPSKRISVMEALQHPYMSPLYDPNTDPPAQVPINLDIDEDLVEETIREMMWEEILHYHPEAAVALLWKLFYELLLVPSRHRP

SEQ ID NO: 6601 - protein, 372 aa, Populus trichocarpa
MATPVEPPNGVRNQGKHYYSMWQTLFEIDTKYVPIKPIGRGAYGIVCSSVNRETTEKVAIKKIHNAFENRVDALRTLRELKLLRHLLHENVIGLKDVMMPIQRRSFKDVYLVYELMDTDLHQIIKSSQALTNEHCQYFLFQLLRGLKYLHSANILHRDLKPGNLLINANCELKICDFGLARTSNGKNQFMTEYVVTRWYRAPELLLCCDNYGTSIDVWSVGCIFAELLGRKPIFPGTECLNQLKLIISILGSQREEDLEFIDNPKAKKYIKSLPYSPGTPLSRLYPNAHPLAIDLLQKMLVFDPSKRITVTGALEHPYMSLLYDPSSNPPAQVPIDLDIDEELGEEMIREMMWKEMLHYHPEAAAVNGEVRT

SEQ ID NO: 6602 - protein, 372 aa, Ricinus communis
MATPVEPPNGVSIHGKHYYSMWQTLFEIDTKYVPIKPIGRGAYGIVCSSVNRETNEKVAIKKIHNAFENRVDALRTLRELKLLRHLRHDNVIQLRDVMMPIHRRSFKDVYLVYELMDTDLHQIIKSSQALSNDHCQYFLFQLLRGLKYLHSANILHRDLKPGNLLINANCDLKICDFGLARTSNGKGQFMTEYVVTRWYRAPELLLCCDYYGTSIDVWSVGCIFAELLGRKPIFPGTECLNQLKLIINILGSQREEDLEFIDNPKAKKYIKSLPYSPGTPFSRLYPNAHPLAIDLLLKMLVFDPSKRITVTEALQHPYMSPLFDPSSNPPAQVPIDLDIDEDLGEEMIREMMWKEILHYHPEAATATGLICA

SEQ ID NO: 6603 - protein, 224 aa, Glycine max
MVVSLGPGKFYGTSLPRPRIYTDVKFNDHRVDPPVPVNDPLMSWAQEAHWSMGGLSFKRLRLQGKIEGNVERLRSQREKFQAQSPSPSPPARADLRRSKRAASPLTPPAPVMAKRRRYMDLIQEEEEEEEEGVVVRRTSVRKSGLVKKLGDDFDRVALENDESNTVSSLKTTRGRKLVKNGELGNKTVVEVAEKSNTKGKKSASEAEKSPGVRTSSRLAKRVSN

SEQ ID NO: 6604 - protein, 217 aa, Glycine max
MVVALGPGKFYGTSLPRPRIYTDVKFNDHRVDPPVPVNDPLMSWAEEAHWSMGGLSFKRLRLQGKIEGNVERLRSQREKIQARSPSPPARSDLRRSKRAASPLTPPAPVMTKRRRYMDLIQEEEKEEEQEVVVRRSRLVKKLGDDFDRVALENDGYDTVASLKMTRGRKLVKNGEPVKKTVVEVTEKSNTKAKKSVASEAEKSSGARTSSRLAKRFL

SEQ ID NO: 6605 - protein, 399 aa, Medicago truncatula
MGTVTRSPNGRKPSEIMRLIVTTFIGVVFGFFLGVSFPTLSLTKFNLPSGLLPSIDLSYIEERYTGRRAWSFINNSNRRALPNRLSNDTSKIWVPSNPRGAESLPPGIVEAESDFYLRRLWGKPSEDLTFKPKYLVTFTVGYEMKKNIDAAVKKFSENFTILLFHYDGRANEWDEFEWSKKAIHVSARKQTKWWYAKRFLHPDIVAPYDYIFIWDEDLGVEHFNAEEYLKLVKKHGLEISQPGLEPNKGLTWQMTKRRGDKEVHKVTEEKPGWCSDPHLPPCAAFVEIMAPVFSREAWRCVWHMIQNDLVHGWGLDFAVRRCVEPAHEKIGVVDAQWIVHQGVPTLGNQGKTETGKAPWQGVRERCRKEWTMFQSRLANAEHAYFKSGGGIDMSNSTGH

SEQ ID NO: 6606 - protein, 399 aa, Glycine max
MGIITRSSAGRKPSEIMRFFVTTFISIVLGFFIGVSVPTLSITKLNLPSGLLPSIDLSYIEDRYTGRQAWSFMNNGNKRSSSQVQLSNDTSKIWVPSNPRGAERLPPGIVEAESDYYLRRLWGKPSEDLTSRPNYLVTFTVGYDQKNNIDAAVKKFSGNFTILLFHYDGRTTEWDEFEWSKQAIHVSVHKQTKWWYAKRFLHPDIVAPYDYIFIWDEDLGVEHFNAEEYIKLVRKHGLEISQPGLEPNRGLTWQMTKRRGDQEVHKVTEEKPGWCSDPHLPPCAAFVEIMAPVFSRDAWRCVWHMIQNDLVHGWGLDFALRKCVEPAHEKIGVVDSQWIVHQGIPSLGNQGESQTGKAPWQGVRERCRKEWTMFQSRLANAEYAYHNSIGIDTSNSTAH

SEQ ID NO: 6607 - protein, 399 aa, Glycine max
MVIITRSSAGRKPSEIMKFFLTTFIGIVFGFFIGVSIPTLSITKLNLPSGLLPSIDLSYIEDRYAGRQAWSFMNNGNKRSSSQVQLSSDTSKIWVPSNPRGAERLPPGIVEAESDFYLRRLWGKPSEDLTSRPNYLVTFTVGYDQKNNIDAAVKKFSGNFTILLFHYDGRTTEWDEFEWSKQAIHVSVHKQTKWWYAKRFLHPDIVAPYDYIFIWDEDLGVEHFNAEEYIKLVRKHGLEISQPGLEPNKGLTWQMTKRRGDQEVHKVTEEKPGWCSDPHLPPCAAFVEIMAPVFSRDAWRCVWHMIQNDLVHGWGLDFALRRCVEPAHEKIGVVDSQWIVHQGLPSLGNQGESQTGKSRWQGVRERCRKEWTMFQSRLANAENAYYKSMGTDTSNSTAH

SEQ ID NO: 6608 - protein, 397 aa, Glycine max
MGISSRSSSNRKPSDSMRLIVTTFVGIVFGFFIGVSFPALTTKLNLPSSLLPAIDISYIQEKYAGGNAPSFVKNNNSISSKHRLINDTFKIWVPSNPRGAERLPPEIIEAETDFYLRRLWGQPSEDLTSKPKYLVTFTVGYNQRYNIDANVKKFSENFTIVLFHYDGHTTEWDEFEWSKRAIHVSVRKQTKWWYAKRFLHPDIVAPYDYIFIWDEDLGVEHFNAEEYLKLVKKHGLEISQPGLEPNKGLTWQMTKRRGDREVHKETEEKPGWCADPHLPPCAAFVEIMAPVFSRDAWRCVWHMIQNDLVHGWGLDFALRKCVEPAHEKIGVVDSQWIIHQSVPSLGNQGESQPGKAPWHGVRERCKREWTMFQSRLANAEDAYYRAVGGDMFNSTTP

SEQ ID NO: 6609 - protein, 397 aa, Glycine max
MGIGSRSSTNRKPSDSMRLIMTTFVGIVFGFFIGVSFPALTTKLNLPSSLLPAIDISYIQEKYAGGNAPSFVKNNNSISSKHQLINDTLKIWVPSNPRGAERLPPEIIEAETDLYLRRLWGQPSEDLTSKPKYLVTFTVGYSQRYNIDANVKKFSENFTIVLFHYDGKTTEWGEFEWSKRAIHVSVRKQTKWWYAKRFLHPDIVAPYDYIFIWDEDLGVEHFNAEEYLKLVKKHGLEISQPGLEPNKGLTWQMTKRRGDREVHKETEEKPGWCSDPHLPPCAAFVEIMAPVFSRDAWHCVWHMIQNDLVHGWGLDFALRKCVEPAHEKIGVVDSQWIIHQSVPSLGNQGESQSGKAPWQGVRERCKREWTMFQSRLANAEDAYYKAVGVDMFNSTTP

SEQ ID NO: 6610 - protein, 395 aa, Ricinus communis
MGIFSRSMVSRKPNETMRLIVTTFLGVAFGFLIGISFPALSLSKLNISSSLLPSVDISYINEKTFGYTWSSRKNNSTTGAPNSNDTSKIWAPLNPRGAERLPPGIIEAESDYYLRRLWGNPNEDLISKPKYLVTFTVGYDQRKNIDANVKKFSENFTVLLFHYDGRVSEWDEFEWSKRAIHVSARKQTKWWYAKRFLHPDIIAPYDYIFIWDEDLGVEHFNAEEYLKIVKKHGLEISQPGLEPNKGLTWQMTKRRGDREVHKITEEKPGWCTDPHLPPCAAFIEIMAPVFSRDAWRCVWHMLQNDLVHGWGLDFALRKCVEPAHEKIGVVDSQWIVHQTVPSLGNQGESQNGKAPWQGVRERCRKEWTMFQNRMTYAENAYFRAMAIESSNSTAH

SEQ ID NO: 6611 - protein, 401 aa, Populus trichocarpa
MGILALSAGSRKPNETMRILLTTFFGVVFGFLIGVSFPTLSLTKSNKSSGFFPVIDLAYSENKPGSKTVLSPWSSMKGNNSSSMQAPNSKDKSKIWVPSNPRGAERLPPGFVVAESDYYLRRLWGDPKEDLTRAPRYLVTFTVGYDQRKNIDACVKKFSENFTILLFHYDGRVSEWDEFEWSKSAIHVSARKQTKWWYAKRFLHPDIVAPYDYIFIWDEDLGVEHFNAEEYIKLVKKHGLEISQPGLEPNKGLTWQMTKRRGDSEVHKITDEKPGWCTDPHLPPCAAFVEIMAPVFSRDAWRCVWHMIQNDLVHGWGLDFALRKCIEPAHEKIGVVDSQWIVHQTIPSLGNQGESQNGKKPWQGVKERCRKEWTMFQNRLASAERTYFRTAGLDPPNSNGH

SEQ ID NO: 6612 - protein, 490 aa, Vitis vinifera
MVVGSMSHSTTVNLEVFAGSWSSSSPFVQRDFPAGYVLSSFGCWENAGKGKEEIMNPFELAGLSIYIAASLVLKIETEDCKYNEKCWTQFPLLGCSVIVRKPNETMRLIVTISVGVVFGFLIGISFPTLSITKLNLPSSLLPNVDIAYIRDKSSGFSTQALLDALSSAKYNRTQAQNLNGTSKIWAPSNPRGAERLPPGIVAAESDFYLRRLWGKPSEDLTIKPKYLVTFTVGYDQKKNVDAAVKKFSEDFTILLFHYDGRTTEWDEFEWSKRAIHVSVRRQTKWWYAKRFLHPDIVAPYDYIFIWDEDLGVEHFNAEEYIRLVRKYGLEISQPGLEPNKGLTWQMTKRRGDREVHKETEEKPGWCPNPHLPPCAAFVEIMAPVFSRDAWRCVWHMLQNDLVHGWGLDFALRRCVEPAHEKIGVVDSQWIVHQTVPSLGNQGQAENGKAPWQGVRERCKKEWTMFRVRMTNAEKAYYKEMGINPTNSTAD

SEQ ID NO: 6613 - protein, 396 aa, Populus trichocarpa
MGIFSRSAAGRKPNETIKIILTTFLGVAFGFLIGVSFPTLSLTKLNISPNFIPSIDISYKEGLTPQNTRSSKGNNSGSMQAPNLNNTSKIWVPSNPRGAERLPPRIVAAESDLYLRRLWGNPNEDLTSTPKYLVTFTVGYDQRMNIDACVKKFSENFTILLFHYDGRIAEWDEFEWSTRAIHVSVRRQTKWWYAKRFLHPDIVARYDYIFIWDEDLGVEHFNAEEYLKLVKKHGLEISQPGLEPSKGLTWQMTKRRDDREVHKITDEKPGWCTDPHLPPCAAFVEIMAPVFSRDAWRCVWYMIQNDLIHGWGLDFALRKCVEPAHEKIGVVDSQWIVHQGVPSLGSQGESQNGKAPWQGVRERCRKEWTMFQTRLTSAENAYFRAAGLDPSNSNGH

SEQ ID NO: 6614 - protein, 385 aa, Vitis vinifera
MRLIVTISVGVVFGFLIGISFPTLSITKLNLPSSLLPNVDIAYIRDKSSGFSTQALLDALSSAKYNRTQAQNLNGTSKIWAPSNPRGAERLPPGIVAAESDFYLRRLWGKPSEDLTIKPKYLVTFTVGYDQKKNVDAAVKKFSEDFTILLFHYDGRTTEWDEFEWSKRAIHVSVRRQTKWWYAKRFLHPDIVAPYDYIFIWDEDLGVEHFNAEEYIRLVRKYGLEISQPGLEPNKGLTWQMTKRRGDREVHKETEEKPGWCPNPHLPPCAAFVEIMAPVFSRDAWRCVWHMLQNDLVHGWGLDFALRRCVEPAHEKIGVVDSQWIVHQTVPSLGNQGQAENGKAPWQGVRERCKKEWTMFRVRMTNAEKAYYKEMGINPTNSTAD

SEQ ID NO: 6615 - protein, 216 aa, Glycine max
MSKLQSDALREAISGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKCYRVF

SEQ ID NO: 6616 - protein, 216 aa, Glycine max
MSKLQSDALREAISGIMADSKEKNRKFVETIELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQETLESKVNESKAMVKFQLKKVLCMGVAVGNVSMEEKQIFQNVQLSVNFLVSLLKKNWQNVRCLYLKSTMGKSYRVF

SEQ ID NO: 6617 - protein, 216 aa, Glycine max
MSKLQSDALREAISGIMADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 6618 - protein, 216 aa, Glycine max
MSKLQSDALREAISGIMTDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 6619 - protein, 216 aa, Medicago truncatula
MSKLQSEAVREAITGIMADSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 6620 - protein, 216 aa, Medicago truncatula
MSKLQSDAVREAITGIMGDSKEKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 6621 - protein, 216 aa, Medicago truncatula
MSKLQSEAVREAISGIMADSKEKNRKFVETIELQIGLKNYDPQKDKRFSGSVKLPHIPRPKMKLCMLGDAQHVEEAEKIGLESMDVEALKKLNKNKKLVKKLAKKYHAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 6622 - protein, 216 aa, Glycine max
MSKLQSDALREAISQVVSNSKEKNRKFTETIELQIGLKNYDPQKDKRFSGSVKLPHIPRPKMKICMLGDAQHVEEAEKIGLDYMDVEALKKLNKNKKLVKKLAKKYHVFLASEAVIKQIPRLLGPGLNKAGKFPTLVTHQESLESKVNETKAMVKFQLKKVLCMGVAVGNCTMEEKQIFQNVQLSVNFLVSLLKKNWQNVRCLYLKSTMGSAIRVF

SEQ ID NO: 6623 - protein, 216 aa, Zea mays
MSKLQSESVKDAISQIVGDAKEKNRKFTETVELQIGLKNYDPQKDKRFSGSVKLPHIPRPKMKVCMLGDAQHVEEAEKMGLDYMDVEALKKMNKNKKLVKRLAKKYHAFLASEAIIKQIPRLLGPGLNKAGKFPTLVTHQESLESKVNETKATVKFQLKKVLCMGVAVGNLAMEEKQIQQNIQMSVNFLVSLLKKNWQNVRCLYVKSTMGKPYRVF

SEQ ID NO: 6624 - protein, 216 aa, Zea mays
MSKLQSDSVKDAISQIVGDAKEKNRKFTETVELQIGLKNYDPQKDKRFSGSVKLPYIPRPKMKVCMLGDAQHVEEAEKMGLDYMDVEALKKMNKNKKLVKRLAKKYHAFLASEAIIKQIPRLLGPGLNKAGKFPTLVTHQESLESKVNETKATVKFQLKKVLCMGVAVGNLAMEEKQIQQNIQMSVNFLVSLLKKNWQNVRCLYVKSTMGKPYRVF

SEQ ID NO: 6625 - protein, 440 aa, Glycine max; identical to SEQ ID NO: 6558

SEQ ID NO: 6626 - protein, 566 aa, Glycine max
  misc_feature (122)..(122): Xaa can be any naturally occurring amino acid
  misc_feature (215)..(215): Xaa can be any naturally occurring amino acid
  misc_feature (217)..(217): Xaa can be any naturally occurring amino acid
  misc_feature (273)..(273): Xaa can be any naturally occurring amino acid
MKIVSYNVNGLRQRIAQFGSLRNLLNSFDADIVCFQETELRRQEVTADLVMAGGYESFFSCTRTSQKGRTGYSGVITFCRVKSAFLSNEVVLQLAEKEGFTGLLGNFQTSNNKLPFLMGDLXEFTKDELLSLDSEGRCIITDHTHFVLFNVYGSQAGGDDTERIQFKQIFYRILQKRWGSLLHQGRRIFVVVDLNIAPFAIDRCDIGPDFEKNEXVXWFKSMLIENWGQFSDVFRAKHPDRREAYTSWSQNTGAEVFNFGSRIDHILFSGSCXHELDLQCHSFIRCLVKECDILTQYKRCKPESTLRWKGGRSVKLEGSDHAPVFMSLHEIPDVSLHSTPPLSARYVPMVHGIQQTLATKHLSVLMKRQVSKKMKSFEMAQEDIAMDSTCERKEPVNRAEKAKSSQWSQLSLRSFFQKSANLDNGSSVKVVNDSCTDYSNNQAEPSQPSPRLQETPTVFAHSSSPKKYGLDTDTCDQDLAGPNGSSTKEEMSNVASLEWQRIQQLMQNSIPICKGYKEPCIARVVKKQGPNFGRRFYVCAHAEGPASNLEANCGYFKWASSKSKNK

SEQ ID NO: 6627 - protein, 622 aa, Glycine max
MKIVSYNVNGLRQRIAQFGSLRNLLNSFDADIICFQETKLRRQEVTADLVMADGYESFFSCTRTSQKGRTGYSGVITFCRVKSAFSSNEVVLPLAAEEGFTGLLGNSQTSNDKLPFLMEDLEEFSKDELLSLDSEGRCIITDHTHFVLFNLYGPRAGGDDTERIQFKQKFYRILQKRWESLLHQGRRIFVVGDLNIAPFAIDRCDAGPDFENNEFRKWFKSMLIENGGRFSDVFRAKHPDRREAYTCWSQNTGAEVFNFGSRIDHILFAGSCLHELDDLQCHSFIRCHVKECDILTQYKRCKPESTLRWKGGHSVKLEGSDHAPVLMSLHEIPDVSLHSTPSLSARYVPMVHGIQQTLVSVLMKRQVSELMKSCEMAQEDIAMDGTCEREEPVNRAGSSTRSPNECHFPPSQDFEVSSILKPNKLSGGSSQESVSKSGSENKKSTTRQCNRSNKKARNGQWSQLSLRSFFQKSTNLDKGSSIKEVVNDSCTDYSNNNQAEPSQPSPRLQEIPTVCAHNGSPKQYELDTDTCDPDLAGPNGSSTKEEKSNVASLEWQRIKQLMQNSIPICKGHKEPCIARVVKKQGPNFGRRFYVCARAEGPASNPEANCGYFKWASSKSRNK

SEQ ID NO: 6628 - protein, 613 aa, Medicago truncatula
MKIVSYNVNGLRQRITQFGSLRNLLNSFDADILCFQETKLSRQDVTADLVMVDGYESFFSCTRTSQKGRTGYSGVITFCRVRSAFSSNEAALPLAAEEGFTGLLCSSQTSEGKLPFFMEEDLEDFSKDELLNVDSEGRCVVTDHGHFVLFNIYGPRAGGDDTERIQFKKTFYRILQKRLESLLHQGRRIFVVGDLNIAPFAVDRCDAGPDFEKNEFRRWFRSMLIENGGRFSDVFRAKHPDKMDAYTCWSQSSGAEVFNYGSRIDHILCAGSCLHKSDDLQSHSFIGCHVKECEILTQYKRFKPESTLSSHRWKGGQSIKLEGSDHAPVCATLMGIPEVSLHSTPSLSSRYVPMVHGVQQSLVSLLMKRRVSESCKMANGDILTVSTCERIEEPVDKIGSSTCECDLFPNQDSEGSILKPNELSAGSSQESVSKSGSVYEKSITQKCNESKKKARNSQSSQLSIRSFFQKSTSLDNGVKDSCISYSNNEAEPSQPNSQLLETCTIIDHSSNPGQDEINADVCGQDLAEINNSSRKEEKSNVASQEWQRIQKLMQNSIPLCKGHKEPCIARVVKKQGANFGRRFYTCARAEGPASNPEANCGYFKWATSKSKNK

SEQ ID NO: 6629 - protein, 371 aa, Glycine max; identical to SEQ ID NO: 6596

SEQ ID NO: 6630 - protein, 372 aa, Pisum sativum; identical to SEQ ID NO: 6594

SEQ ID NO: 6631 - protein, 372 aa, Gossypium hirsutum
MATPVKPPNGIHYQGKHYYSMWQTTFEIDTKYVPIKPIGRGAYGIVCSSVNRETNEKVAIKKINNAFENRVDALRTLRELKLLRHLRHENVIASKDVMMPTHRRSFKDVYLVYELMDTDLHQIIKSSQVLTNDHCQYFLFQLLRGLKYLHSANILHRDLKPGNLLINANCDLKICDFGLARTSNAKGQFMTEYVVTRWYRAPELLLCCDNYGTSIDVWSVGCIFAELLGRKPIFPGTECLNQLKLIINILGSQKEEDLEFIDNPKARKYIKSLPYSLGSPFSHLYPNAHPLAIDLLQKMLVFDPSKRISVTEALQHPYMAPLYDPNSNPSAQVPLDLDIDEDLGEEMIREKMWKEMLHYHPEAATANGGVCL

SEQ ID NO: 6632 - protein, 710 aa, Glycine max
MGSNFLSPPAKRSAPDPYPFHPNGPSKRSRQSKPPPPLSVPPGHVAFRLLCNASRIGGVIGKSGSVIKTLQQSTGAKIRIEDAPQELPDRIILVIADAALSGKILLRNEEVIEVSKAQEALLKVFDRILRSGGGDRSVDVGDRVMSCRLVADAAQAGSVIGKGGKVVERIKKETGCKIRVLTDDLPLCASASDEIIEIEGRVSSVKKALVAVSQRLQDCHPVDRTKMMGSKPYEIVQYEALDALPRATSTAAPRVTLTAAPRGTLTAVQHETVDHLLLRSSALSTLSSSSNSYATRIHSLPTEVNRVSSLEPKALKQEVTFRILCSNDRVGGVIGKGGNIVRALQSETGATISIGPAVAECEDRLITIAASENPESRYSPAQKAAVLVFSRSIEVGFEKGLDSGLNKGSIVTVRLVVPSSQVGCLIGKGGVIVSEMRKATGANIRIIGTDQVPKCASDNDQVVQISGEFSSVQDALYNAMGRLRDNLFVSTQNSAGTRSLSSLRVDTSPYGRQQDVVPLGSQLPPATSHSLSRHTFAQGIDHLGLSRNLDHPSSPGLWTRNLDRPSSPGLWTRNLDRPSSPGLWTRNLDHRPSSPGLWAPPTVAGINSRGINDFSLGLTSRKGGLELVSGSKSAIVTNTIVEIVVPDDTIDCVYGENGSNLARLRQISGANVVVHEPRPGTSDRIIVISGTPDETQAAQSLLQAFILSGS

SEQ ID NO: 6633 - protein, 663 aa, Glycine max
MGSNFLSPPAKRSALDPNPFPPNGPSKRSRQSKPPPPLSVPPGHVAFRLLCNASRIGGVIGKSGSVIKTLQQSTGAKIRIEDAPQESPDRVILVIADAALSCKVLLRNEEVVEVSKAQEALLKVFDRILEVAAEMEGVDVGDRVMSCRLVADSAQAGSVIGKGGKVVERIKKETGCKIRVLTDDLPLCASASDEMIEIEGRVSSVKKALVAVSQRLQDCPSVNRIKMMGNKPYEIVQYETLDALPREILTAAPRGTLTVVPHETVDHLLLRSSALSTLSSSSNSYATRVHSLSAEVNRVSSLEPKALQQEVSFRILCSNDRVGGVIGKGGNIVRALQSETGATISIGPLVAECEDRLITIAASENPESRYSPAQKAAVLVFSRSIEVGFEKELDSGLNKGSTVTVRLVVPSSQVGCLIGKGGVIVSEIRKATGANIRIIGTDQVPKCASDNDQVVQISGEFSSVQDALYNATGRLRDNLFVSTQNSAGTRSLSSLRVDTSPYGIQQDFVPHGSQLPATTSHCLSRHTFAQGIDHLGLSRNLDHPSSPGLWTRNLDLAGINSRSINDFSLGLTSRKGGLELVSGSKSAIVTNTTVEIVVPDDTIDCVYGENGRNLVRLRQISGAKVVIHEPRPGTSDRIIVISGTPDETQAAQSLLQAFILSGS

SEQ ID NO: 6634 - protein, 766 aa, Medicago truncatula
MGSNFLSPPAKRSITGLPDPNPFPNGSSKRAKPSKPPQQPLPIPAGHVAFRLLCNSSRIGGVIGKSGTVIKNLQLTTGAKIRIEDSPNESPDRVIMVIGASNIDGKVMVRSHSGDGEAIEVSKAQEALLRVFDRILEVAAEMEGIELGDRTVSCRLVADSAQAGSVIGKGGKVVEKIKKDTGCKIWVCKDNLPACISSPDEVIEIEGSVSSVKKALVAVSRNLQDRHHADRTKMTGQNSHEVIHHEALVGVPRETLMSVPRETFIGAPRETLTAVPCETLTDLHVDHLLQRRSALSILPSSSNSYATGVHSLSAEVNRVSSLEPKAHQQEITFKIICSNDRIGGVIGKGGNIIRALQSETGATVSVGPSVAECEDRLITITASESPESRYSPAQKATVLVFSRSVEAGIEKGIDSGLNTGSSVTAQLVVSSNQVGCLLGKGGVIVSEMRKATGASIRIVGTDKVSKCASDNDQVVQISGEFSNVQDALYNATGRLRDNLFGGTLKSAGTRSLSSVQSDTSPYGRLRDVPLGSQSSLRADTNAFVRLRDVPLVGQSSLQADTSPYVRLRDVSLGGQSSLQSDTSPYGRLRDIPLGGQSSLQSDTSPYGKLRDIPLGGQSAVGISHSLSRHTFSQGIDHFSLGRNYDRPSSPGLWTPPRVTGMNSGSINEASWGSTSRKGGLELVSGSKSAIVTNTTIEIVVPEDTLYLVYGENGSNLARLRQISGAKVVIHEPRPGTSDRTIVLSGSPDETQAAQSLLQAFILNGSS

SEQ ID NO: 6635 - protein, 194 aa, Glycine max; identical to SEQ ID NO: 6591

SEQ ID NO: 6636 - protein, 194 aa, Glycine max; identical to SEQ ID NO: 6590

SEQ ID NO: 6637 - protein, 121 aa, Medicago truncatula
MALGRGSALVLLVCFFVLNSELAHAATYTVGGPGGWTFNTVGWPNGKRFRAGDTLVFNYSPSAHNVVAVNKGGYDSCKTPRGAKVYRSGKDQIRLARGQNYFICNFVGHCESGMKIAINAA

SEQ ID NO: 6638 - protein, 121 aa, Medicago truncatula
MALGRASALVLLVCFFVLNSELAHAATYTVGGPGGWTFNTVGWPNGKRFRAGDTLVFNYSPSAHNVVAVNKGGYDSCKTPRGAKVYRSGKDQIRLARGQNYFICNFVGHCESGMKIAINAA

SEQ ID NO: 6639 - protein, 121 aa, Glycine max
MALGRGSAVVLLLCFLVLQSEMARAATYRVGDSRGWTFNTVTWPQGKRFRAGDTLAFNYSPGAHNVVAVSKAGYDSCKTPRGAKVYRSGKDQIRLARGQNYFICNYVGHCESGMKIAINAA

SEQ ID NO: 6640 - protein, 121 aa, Glycine max
MALGRGSAVVLLLCFLLLHSQMARAATYTVGDSGGWTFNTVAWPKGKLFRAGDTLAFNYSPGTHNVVAVNKAGYDSCKTPRGAKVYKSGTDQIRLAKGQNYFICNYVGHCESGMKIAINAA

SEQ ID NO: 6641 - protein, 122 aa, Cicer arietinum
MALGRGSALVVLLVCFLVIHSELAQAAIYTVGGAGGWTFNTIAWPNGKNFKAGDTLVFNYSPGAHNVVAVSKAGYGSCKTPRGAKVYRSGKDQIRLARGQNYFICNYVGHCESGMKIAINAV

SEQ ID NO: 6642 - protein, 125 aa, Populus trichocarpa
MVQGRGSAMVATVAVMLCMLLLHFDMAHAATYTVGGPGGWTFNVSGWPKGKSFKAGDILVFNYSTAAHNVVAVNKAGYSSCTSPRGAKVYTSGKDQIKLVKGQNFFICSFAGHCQSGMKIAVNAA

SEQ ID NO: 6643 - protein, 124 aa, Glycine max
MSQGRGSASLPIVVTVVSLLCLLERANAATYSVGGPGGWTFNTNAWPNGKRFRAGDILIFNYDSTTHNVVAVDRSGYNSCKTPGGAKVFSSGKDQIKLARGQNYFICNYPGHCESGMKVAINAL

SEQ ID NO: 6644 - protein, 127 aa, Glycine max
  misc_feature (16)..(16): Xaa can be any naturally occurring amino acid
MSQGRGSASLPIVVTXVSLLCLLVLLERADAATYTVGGPGGWTFNTNAWPKGKRFRAGDILIFNYDSTTHNVVAVDRSGYNSCKTPGGAKVFSSGKDQIKLARGQNYFICNYPGHCESGMKVAINAV

SEQ ID NO: 6645 - protein, 122 aa, Medicago truncatula
MALGRGSVVVLLVCFFVLNSELVHAATYNVGGTVGWTFNTVGWSRGKRFRAGDTLVFNYRQGTHNVVAVTKEVYDKCSTPRRGSKVYRSGKDRVRLAKGQNYFMCNFPGHCGSGVKIAINAA

SEQ ID NO: 6646 - protein, 610 aa, Medicago truncatula
MENQPSPLPPKTYKLTATSISYSKNLQTNNTIIAPFLFFKHCTPTPPNYILKDVSLTAYPSEILAIVGPSGAGKSTLLDILSARRLPLSGTLSLNSSPITNPSTFRKLSAYVPQHDACLPMLTVSETFAFSASLLKPKTIDIAAIVSSLLNELRLTHLANTRLNHGLSGGERRRVSIGLSLLHDPAVLLLDEPTSGLDSSSAFKVMQTLKSTCVSYNRTIVLSIHQPSFKILSCIDRILLLSKGTVVHHGSLASLQSFLLSKGFTVPHQLNALEYAMEILNQLNEIEPMITPPSLPESPENSESSIACTSASDNIGRTKGKSREIRYKSSRIHEICTLFRRFWKIIYRTKQLLLTNTAEALLVGLVLGTIYINIGFDKEGIEKRFGLFAFTLTFLLSSTTETLPIFINERPILLRETSSGVYRLSSYLIANTLVFLPYLLVVAVIYSIPVYFLVGLCSSWLSFAYFVLVIWVIVLMANSFVLFLSSLAPNYIAGTSLMTVLLAAFFLFSGYFISKDCLPKYWLFMHFFSMYKYALDALLINEYSCLATRCMIWFQENDQECMITGGDVLQKRGLHEGQRWTNVYFLIGFFVFYRVLCFLVLLRRVSRSKT

SEQ ID NO: 6647 - protein, 601 aa, Glycine max
  misc_feature (414)..(414): Xaa can be any naturally occurring amino acid
MEDPSESPPPLKTYKLTATSISYTKSTTTKPSFSSLFFTACTNTPPTYILKDISLTALPSQILAVVGPSGAGKSTLLDILAARTLPSHGTLLLNSAPLVPSTFRKLSSYVPQHDHCLPLLTVSETFLFAAKLLKPKTSNLAATVSSLLSELRLTHLSNTRLAHGLSGGERRRVSIGLSLLHDPAVLLLDEPTSGLDSTSAFKVMRILKQTCTTRNRTIILSIHQPSFKILACIDRILLLSKGTVVHHGSVATLHAFLHSSGFTVPHQLNALEYAMEILSQLNEVKPVTPPSIPESPQSSISTSSVSEGGARSSREIIRYRSSRVHEIFTLYSRFWKIIYRTRQLLLPNTAEALLVGLVLGTIYINIGFDKEGIEKRFGLFAFLSVFLLSSTTETLPIFINERLILLRETSSGVXRLSSYLIANTLVFLPYLFVIAVIYSIPVYFLVGLCASWLSFAYFVLVIWVIVLMANSFALFLSSLAPNYIAGTSLLTVLLAAFFLFSGYFISKESLPKYWLFMHFFSMYKYALDALLINEYSCLVSRCLIWYQENEQCMVTGGDVLQKRGLKESERWTNVYFLLGFFLLYRVLCFLVLARRVSRSKT

SEQ ID NO: 6648 - protein, 599 aa, Glycine max
  misc_feature (82)..(86): Xaa can be any naturally occurring amino acid
MEDPSDSPPPPPPPPPQTPLKTYKLSATSISYTKSTTKPSFTSLFFTPCTTTPPTYILKDISLTALPSQILAVVGPIGAGKXXXXXGTLLLNSAPLVPSTFRKLSSYVPQHDHCLPLLTVSETFLFAAKLLKPKTSNLAAIVSSLLSELRLTHLSNTRLARGLSGGERRRVSIGLCLLHDPAVLLLDEPTSGLDSTSAFKVMRILKQTCVSRNRTIILSIHQPSFKILACIDRILLLSKGQVVHHGSVATLQAFLHSNGFTVPHQLNALEYAMEILSQLNEAKPVTPPSIPESPERSSSVISVSDGGVRSSREIIRYKSSRVHEIFTLYSRFWKIIYRTRQLLLTNTAEALLVGLVLGTIYINIGFDKEGIEKRFGLFAFTLTFLLSSTTETLPIFINERPILLRETSSGVYRLSSYLIANTLVFLPYLFVVAVIYSIPVYFLVGLCASWLSFAYFVLVIWVIVLMANSFVLFLSSLAPNYIAGTSLLTVLLAAFFLFSGYFISKESLPKYWLFMHFFSMYKYALDALLINEYSCLVTKCLIWYQENEQCMVTGGDVLQKKGLKESERWTNVYFLLGFFVLYRVLCFLVLVRRVSRSKT

SEQ ID NO: 6649 - protein, 593 aa, Populus trichocarpa
PQPPPPLKTYKITASSISYVKSTTTSNSIIAPFLLFKQCTTTPPSYILKEVSLTAYPSQILAVVGPSGAGKSTLLDILAARTSPTSGILLLNSTPINPSSFRKLSAYVPQHDACLQLLTVSETFTFAARLLNPKSSQIATIVESLLNELNLTHLANARLAHGLSGGERRRVSIGLSLLHDPGILLLDEPTSGLDSKSALNVMQTLKSIATSRYRTVILSIHQPSFNILSTIDKILLLNKGTVVHHGSLSSLESFLLSNGFTVPPQLNALEYAMEILNQLQESKPNTPPSLPPSPDNSTISPSDNKARSIRNKISRLHEICVLYSRFWKIIYRTRQLLLTNTLEALIVGLVLGTIYINIGYGKQGIEKRFGLFAFTLTFLLSSTTETLPIFINERPILLRETSSGLYRLSSYLIANTLVFLPYLLAIAIIYSVSIYFVVGLCGTWQAFAYFVLVIWVIVLMGNSFVLFLSSLAPNYIAGTSLVTILLGGFFLFSGYFISQDSMPKYWLFMHFFSMYKYALDALLINEYSCLVNKCFLWYQENSTCMVTGGDVLQKRGLHERQRWTNIYILLGFFVFYRVLCLLVLIRRVSRSKK

SEQ ID NO: 6650 - protein, 597 aa, Vitis vinifera
MEDHSSLPPPPHKTYRITASSISYTKPTTNNYTIVPTFLFQPCTTTPPTYILRDICLTAYPSQVLAIVGPSGAGKSTLLDILAARTSPTSGSLLLNSSPLNRSSFRKLSAYVPQHDACLPQLTVSETFAFAASLLVPKSSKIAIIVASLLSELRLTHLAHTRLAHGLSGGERRRVSIGLSLLHDPAVLLLDEPTSGLDSNSAFNVMQTLQSIAQSRHRTVILSIHQPSFKILSTIDKVLLLSKGTVIHHGTLSSLETFLLSHGFTVPSQLNSLEYAMEILSQLHEHKPLTPPSLPPSPEIPEISPSNHSGSMIRYRSSRLHEVLALYNRFWKIVYRTRQLLLVNALEALGVGLVLGTIYINIGFDKQGMEKRLGLFAFTLTFLLSSTTETLPIFINERPILLRETSSGVYRLSSYLIANTLVFLPYLLAIAIIYSVSVYFLVGLCATWQAFAYFVLVIWVIVLMANSFVLFLSSVAPNYIAGTSLVTIFLGAFFLFSGYFISKDSMPKYWLFMHFFSMYKYALDAFLINEYSCLVSRCLLWYEENKTCMATGRDVLQKKGLHERQRWTNIYMLIGFFFFYRVLCFLVLIRRVRRSKN

SEQ ID NO: 6651 - protein, 583 aa, Vitis vinifera
MGKVSTTGNSDHSSLPPPPHKTYRITASSISYTKPTTNNYTIVPTFLFQPCTTTPPTYILRDICLTAYPSQVLAIVGPSGAGKSTLLDILAARTSPTSGSLLLNSSPLNRSSFRKLSAYVPQHDACLPQLTVSETFAFAASLLVPKSSKIAIIVASLLSELRLTHLAHTRLAHGLSGGERRRVSIGLSLLHDPAVLLLDEPTSGLDSNSAFNVMQTLQSIAQSRHRTVILSIHQPSFKILSTIDKVLLLSKGTVIHHGTLSSLETFLLSHGFTVPSQLNSLEYAMEILSQLHEHKPLTPPSLPPSPEIPEISPSNHSGSMIRYRSSRLHEVLALYNRFWKIVYRTRQLLLVNALEALGVGLVLGTIYINIGFDKQGMEKRLGLFAFTLTFLLSSTTETLPIFINERPILLRETSSGVYRLSSYLIANTLVFLPYLLAIAIIYSVSVYFLVGLCATWQAFAYFVLVIWVIVLMANSFVLFLSSVAPNYIAGTSLVTIFLGAFFLFSGYFISKDSMPKYWLFMHFFSMYKYALDAFLINEYSCLVSRWLHERQRWTNIYMLIGFFFFYRVLCFLVLIRRVRRSKN

SEQ ID NO: 6652 - protein, 504 aa, Medicago truncatula
MAPSSDHINHLSHPCIYGDYVSSHPERKSGFMKWLSKLFKGGSNRGRSGRHHYDSAEEGMSWRAPSRALDDRARAQKEKEDLGHAMSLSSAEDMKRPNAHQGYRWGEENNEDYGKALHDNFNSSAHPPYAPAPFYPNEYRRLCGGCNQEIIYGNCLGCMDTYFHPDCFRCHSCRSPITEREFSLSGKHPYHKSCFKELTHPKCEVCFQFIPINAAGLIEYRCHPFWSQKYCPSHEYDNTARCCSCERLEPRNTKYYRLEDGRSLCLECMESAIMDTGDCQPLYHSIRDYYEGMHMRIDQQVPMLLVEREALNDAIVGEKTGFHHLPETRGLCLSEEQTVTSIHRRPRIGGHRLIGMRTQPQKLIRKCEVTAILVLYGLPRLLTGAILAHELMHAWLRLKGYRNLSPEVEEGICQVLSYMWLESEVMPTTNSHCMASTSTAVASSSKKGAKSHVENKLGEFFKNQIVNDSSPAYGGGFRAANEAVNKYGLRSTLEHIRLTGFFPV

SEQ ID NO: 6653 - protein, 516 aa, Glycine max
MASSSDVNHLSHPCIYERKSGFMKWLSKLFRGGSNRGRGCRHLHEPAEESIVRGAPSRALDDRGRAQKEKEDLGHAMALSSAEDLKRPNGYNWGEDTGDDYSKAPHDTLNSSAHPPFAPTPFYPHPHKYRVCGGCNQEIMYGNCLGCMDTYFHPNCFRCHSCGYPITEREFSLSGKHPYHKSCFKELTHPKCEVCFQFIPINAAGLIEYRCHPFWSQKYCPSHEYDNTARCCSCERLEPLNIKYYRLEDGRSLCLECMESAIMDTGDCQPLYHSIRDYYEGMQMRIDQQVPMLLVEREALNEAIVGEKNGFHHLPETRGLCLSEEQTVTSIHRRPRIGGHRLIGMRTQPQKLTRKCEVTAILVLYGLPRLLTGAILAHELMHAWLRLHGYRNLTPEVEEGICQVLSYMWLESEVMPSFQNMPSTSTSAGSSYSSSSSSSSSSSSSSSKKGAKSHVENKLGEFFKNQIANDSSPAYGGGFRAANEAVNKYGLRRTLDHIHWTGFFPVEKERKFSKYG

SEQ ID NO: 6654 - protein, 492 aa, Glycine max
MAPSSDVNHLSHPCIYERKSGFMKWLNKLFRGGPNRGRGGRHLHEPAEESRVWGAPSRALDDRARAQKEKEDLGHAMALSSAEDLKRPNGYNWGEDTGDDYSKAPRDTLNSSAHPPFAPTPFYPHEYRICGGCNQEIMYGNCLGCMDTYFHPNCFRCHSCGYPITEREFSLSGKHPYHKSCFKELNHPKCEVCFQFIPINAAGLIEYRCHPFWSQKYCPSHEYDNTARCCSCERLEPLNIKYYRLEDGRSLCLECMESAIMDTGDCQPLYHSIRDYYEGMQMRIDQQIPMLLVEREALNEAIVGEKNGFHHLPETRGLCLSEEQTVTSIHRRPRIGGHRLIGMRTQPQKLTRKCEVTAILVLYGLPRLLTGAILAHELMHAWLRLNGYRNLNPEVEEGICQVLSYMWLESEVMPSFQNMPSTSTSAASSYSSSKKGAKSHVENKLGEFFKNQIANDSSPAYGGGFRAANEAVNRYGLRRTLDHIHWTGFFPV

SEQ ID NO: 6655 - protein, 495 aa, Glycine max
MAPTSDINHLSHPCIYERKSGFMKWFGKIFNIGSSRGRGGGRHLQQPVEENMVWPAPARSLDDRARSRKEEEDLDHAIALSLGENFKRPTGYRWRTGTDEDYAKALQDRRFSSAHPPYAPVPFYPRGYGTCGGCNQEILYGNCLGVGHSYFHPDCFRCHSCRYPITEREFSLSGKHPYHKSCFKELTHPKCEVCHQYIPINAAGLIEYRCHPYWNQKYCPSHEYDNTARCCSCERLESRGERYYRLEDGRILCFECMESAITDTGECQPLYHSIRDYYEGMNMKIDQQVPMLLVGREALNEAIVGEKNGFHHLPETRGLCLSEEQTVTSVYRWPRIGGHRLISMRSQAQRLPRKCEVTAILVLYGLPRLLTGAILAHELMHAWLRLKGYQNLSLEVEEGICQVLSYMWLDAEVMSCARTTPSTSSSASSSSYSNSSKKGVKSLVENKLGEFFMNQIANDSSPAYGGGFRAANQAVNKYGLRCTLEHIRLTGNFPL

SEQ ID NO: 6656 - protein, 495 aa, Glycine max
MAPPSDINHLSHPCIYERKSGFMKWFGKIFNIGSSRGRGGGRHLQQPVEENMVWPAPAKSLDDCARSRKEEEDLDHAIALSLGENFKRPTGYRWRTGTDEDYAKALQDRMFSSAHPPYAPVPFYTRGYGTCGGCNQEILYGNCLGVGHNYFHPDCFRCHSCRYPITEREFSLSGKHPYHKTCFKELTHPKCEVCHQYIPINAAGLIEYRCHPYWNQKYCPSHEYDNTARCCSCERLESRDERYYRLEDGRILCFECMESAITDTGECQPLYHAIRDYYEGMNMKIDQQVPMLLVGREALNEAIVGEKNGFHHLPETRGLCLSEEQTVTSVYRWPKIGGHRLIGMRSQAQRLPRKCEVTAILVLYGLPRLLTGAILAHELMHAWLRLKGYQNLSPEVEEGICQVLSYMWLDAEVMSCARTMSSTSAAASSSSYSSSSKKGVKSHVENKLGEFFMNQIANDSSPAYGGGFRAANEAVNKYGLRCTLEHIRLTGHFPL

SEQ ID NO: 6657 - protein, 498 aa, Ricinus communis
MAPPSSSSSSSSGVNHISNPCIYERKSRFMKWLSKLFKGGPTRGGGSRHPQLLGEENMVSWRAPARSLDEHTRPGKEKEESDHAMALSLAEDWKRPGYRWRTDNDEELARALQDSLNPSGYPPYAPPQYYQRGYRLCGGCHGDIGYGNYLGCMGKFFHPDCFRCSSCGYPITENEFSLSGRDPYHKTCFKELTHPKCEVCHQYIPTNDAGLIEYRCHPFWSQKYCPSHEHDSTARCCSCERLESWNTRYYSLGDGRSLCLECMESAIMDTGDCQPLYHSIRDYYEGMNMKLDQQIPMLLVERQALNEAIVGEKNGYHHMPETRGLCLSEEQTVTSIQRRPRIGGNRLVGIRTQPQKLTRKSCEVTAILVLYGLPRLLTGAILAHELMHGWLRLKGYRNLNPEVEEGICQVLSYMWLESEVLPSKGMPSTSAASSSSSSSKKGGKSNAENKLGEFFMHQIANDASPAYGGGFRAANAAVNKYGLRRTLDHIRLTGHFPL

SEQ ID NO: 6658 - protein, 505 aa, Vitis vinifera
MASSGVNHLSQPCIYGQLASSYAERKSRFMKWLSKLFKSGGSGRGVIGGQHPQFLGDENMVWRVPPRSLDGRPRSDKEKEDLDHAIALSLAEDLKRPKGYGWGSDTDEDLSRSLHDSLNTSSYPPYAPTPYYPSGYRVCGACKQDIGFGNYLGCMGTFFHPECFRCRSCGYPITEHEFSLSGRDAYHKSCFKELTHPKCEVCHQFIPTNGAGLIEYRCHPFWSQKYCPSHEHDNVARCCSCERLESWNARYISLGDGRSLCLECMESAIMDTGDCHSLYHAIRDFFEGMNMKLDQEIPMLLVERQALNEAIVGEKNGHHHLPETRGLCLSEEQTVKSIQVLRRPRLAGQRLVGMRSQPQKLTRKCEVTAILVLYGLPRLLTGAILAHELMHGWLRLKGFRNLSPEVEEGICQVLSYMWLESEVMPGFNRNMASTSSGAASSSSSSSKKGGKSEVEKKLGEFFMHQIAHDVSPAYGEGFRAANAAVNKFGLRITLDHIRLTGSFPL

SEQ ID NO: 6659 - protein, 2222 aa, Glycine max
MQSGGGAGGGPGRNPAGRAASTSSAAASPSSSSSAASHLESLKQQQQQQQQQQQMGSRQSFQQQLLRKPEGSEAFLAYQAGLQGVFGSNNFPSSSMQLPQQSRKFVDLAQHGSNQIQGVEQQMLNPAQAAYFQYALQASQQKSALEMQSQQQPKMGMLGPSSVKDQEMRMGNLKMQDLMSMPAVNQAQASSSRNSSEHFTRGEKRVEQGQQLAPDQKSEGNSSSQGAVGNLMSGNIIRPVQDLATQQSIPNSMNNQIAMAAQLRAMQAWAHERNIDLSHPANANLMAQLIPLMQSRMVQQPKANDTNLGSLSSPIPVSNQQVTSPAVASESSAHAHSSSDVSAQSGSAKARQTAPPSHLSPPISAGIASSSSDMAALQFSLHGRDAQGSLKQSVLTVNGMPSVHPQQSSANMNLGADHPLNAKSSSSGSEPVKMQYIRQLNQSASQAGGLTNEGGSGNHTKTQGGPSQMPQQRNGFTKQQLHVLKAQILAFRRLKKAEGALPQELLRAIIPPPLDLQVQQPIHSEGAQNQEKSAGNIVAEQPRQNEVNAKESQPISSINGKISSKQEVFVRDENSPVTAVHLQPTPPVTKESAGQEEQQSVACAPKSDQESEHGIGRNELVLDKGKAVAAPQASVTDAMQLNKPAQASTVSQPKDVGSTRKYHGPLFDFPFFTRKHDSFGSSMMINNNNLSLAYDVKELLFEEGMEVLGKRRTESLKKIEGLLAVNLERKRIRPDLVLRLQIEEKKLRLLDLQARLRDEIDQQQQEIMAMPDRPYRKFVRLCERQRMELARQVQASQRALREKQLKSIFQWRKKLLETHWAIRDARTARNRGVAKYHERMLREFSKRKDDDRNKRMEALKNNDVDRYREMLLEQQTSIEGDAAERYAVLSTFLSQTEEYLHKLGSKITAAKNQQEVEEAAKAAAAAARLQGLSEEEVRVAAACAGEEVMIRNRFMEMNAPKDSSSVSKYYSLAHAVSEKVVCQPSMLRAGTLRDYQLVGLQWMLSLYNNKLNGILADEMGLGKTVQVMALIAYLMEFKGNYGPHLIIVPNAVMVNWKSELHTWLPSVSCIFYAGGKDYRSKLYSQEIMAMKFNVLVTTYEFIMYDRARLSKIDWKYIIIDEAQRMKDRDSVLARDLDRYRCQRRLLLTGTPLQNDLKELWSLLNLLLPEVFDNKKAFNDWFSKPFQKEGPTQNTEDDWLETEKKVIIIHRLHQILEPFMLRRRVEDVEGSLPPKVSIVLRCKMSAVQSAIYDWVKSTGTLRLDPEGENSKIQKNPHYQAKEYKTLNNRCMELRKTCNHPSLNYPLLSELSTNSIVKSCGKLWILDRILIKLQRTGHRVLLFSTMTKLLDLLEDYLNWRRLVYRRIDGTTSLDDRESAIMDFNSPDSDCFIFLLSIRAAGRGLNLQSADTVVIYDPDPNPKNEEQAVARAHRIGQKREVRVIYMEAVVDKISSHQKEDEVRSGGTVDMEDELVGKDRYIGSIESLIRNNIQQYKIDMADEVINAGRFDQRTTHEERRLTLETLLHDEERYQENVHDVPSLQEVNRMIARSEEEVELFDQMDEELDWPEDVMQHDEVPEWLRANTREVNAAIAALSKRPLKNTLLGGSVAIESSEVVGSERRRGRPKGKKHPNYKELEDENGEYSEASSEDRNEDSAQGEIGEFEDDVCSGADGNRLEEDGLTSDAGYEIARSSENARNNHVVEEAGSSGSSSDSQRLTKTVSPSVSSKKFGSLSALDSRPGSISKIMGDELEEGEIAVSGDSHMDHQQSGSWIHDRDEGEDEQVLQQPKIKRKRSLRVRPRHAMERLEDKSGNEIISLQRGESSLLADYKYQIQTRIDPESKSFGDSNASKRDKNESSLTSLKNKQKLSSRKVANTSKLHGSPKSNRLNCTSAPSEDGNEHPRESWEGKHLNPNGSSAHGTKTTEIIQRGCKNVISKLQRRIDKEGHQIVPLLTDLWKRIENSGHAGGSGNSLLDLHKIDQRIDRMDYSGVMELVFDVQFMLRGAMHFYGYSYEVRTEARKVHDLFFDILKIAFPDTDFVEARGALSFSSQVPAGTAASSPRQVTVGPSKRHRVTNDAETDPCPSQKPSQSGSTTNGENTRFKGHLPQKNSRTGSGSAREQPQQDNPPLLAHPGQLVVCKKKRNERDKSLGKGRTGSTGPVSPPSAAIRSPGSGSTPKDARLAQQGRVSQPSQHSNGSAGSVGWANPVKRLRTDSGKRRPSHM

SEQ ID NO: 6660 - protein, 2222 aa, Glycine max
MQSGGGAGGGPGRKPAGRAPSTSSAAASPSSSSSAASHLESLQQQQQQQQQQQQIGSRQSFQQQLLRKPEGSEAFLAYQAGLQGVFGSNNFPSSSMQLPQQSRKFVDLAQHGSNQVQGVEQQMLNPVQAAYFQYALQASQQKSALAMQSQQQPKVGMLGPSSVKDQEMRMGNLKMQDLMSMQAVNQVQASSSRNSSEHFTWGEKRVEQGQQLAPDQKSEGNSSSQGPAVGNLMPGNIIRPVQALATQQSIPNTMNNQIAMAAQLRAMQAWAHERNIDLSHPANANLMAQLIPLMQSRIVQQPKANDTNLGAMSSPVPVSNQQVTSPAVASESSAHANSSSDVSAQSGSAKARQTAPPSHLSPPISAGIASSSSDMAAQQFSLHGRDAQGSLKQSVLTINGMPSVHPQQSSANMNLGADHPLNVKTSSSGSEPAKMQYIRQLSQSTSQAGGLTNEGGSGNHPKTQGGPSQMPQQRNGFTKQQLHVLKAQILAFRRLKKAEGALPQELLRAIIPPPLDLQVQQPIHSEGAQNQEKSAGNIVAEHPRQNEVNAKDSQPISSINGKNSSKQEVFVRDENSTVTAVQVQGTPRVTKESAGKEEQQSVACSAKSDQESEHGIGRTPVRNELVLDKGKAVAAPQASVNDAMQLNKPAQASAVSQTKDVGSTRKYHGPLFDFPFFTRKHDSFGSSMMINNNNLSLAYDVKELLFEEGIEVLGKRRTESLKKIEGLLAVNLERKRIRPDLVLRLQIEEKKLRLLDLQARLRDEIDQQQQEIMAMPDRPYRKFVRLCERQRMELARQVQASQRALREKQLKSIFQWRKKLLETHWAIRDARTARNRGVAKYHERMLREFSKRKDDDRNKRMEALKNNDVDRYREMLLEQQTSIQGDAAERYAVLSTFLTQTEEYLHKLGSKITAAKNQQEVEEAAKAAAAAARLQGLSEEEVRAAAACAGEEVMIRNRFMEMNAPKDNSSVSKYYSLAHAVSEKVVCQPSMLRAGTLRDYQLVGLQWMLSLYNNKLNGILADEMGLGKTVQVMALIAYLMEFKGNYGPHLIIVPNAVMVNWKSELYTWLPSVSCIFYAGGKDYRSKLYSQEIMAMKFNVLVTTYEFIMYDRARLSKIDWKYIIIDEAQRMKDRDSVLARDLDRYRCQRRLLLTGTPLQNDLKELWSLLNLLLPEVFDNKKAFNDWFSKPFQKEGPTQNTEDDWLETEKKVIIIHRLHQILEPFMLRRRVEDVEGSLPPKVSIVLRCKMSAVQSAIYDWVKSTGTLRLDPEGENSKIQKNPHYQAKEYKTLNNRCMELRKTCNHPSLNYPLLGELSTNSIVKSCGKLWILDRILIKLQRTGHRVLLFSTMTKLLDLLEDYLNWRRLVYRRIDGTTNLDDRESAIMDFNSPDSDCFIFLLSIRAAGRGLNLQSADTVVIYDPDPNPKNEEQAVARAHRIGQKREVRVIYMEAVVDKISSHQKEDELRSGGTVDMEDELVGKDRYIGSIESLIRNNIQQYKIDMADEVINAGRFDQRTTHEERRLTLETLLHDEERYQENVHDVPSLQEVNRMIARSEEEVELFDQMDEELDWPEDVMQHDEVPEWLRANTREVNAAIAALSKRPSKNTLLGGSIGMESSEVGSERRRGRPKGKKHPNYKELEDENGEYSEANSEDRNEDSAQEGENGEFEDDGYSGADGNRLEEDGLTSDAGYEIALSSENARNNHVVEEAGSSGSSSDSQRLTKTVSPSVSSKKFGSLSALDARPGSISKIMGDELEEGEIVVSGDSHMDHQQSGSWIHDRDEGEDEQVLQKPKIKRKRSLRVRPRHAMERPEDKSGSEMISLQRGESSVLADYKYQIQKRIDPESKSFGDSNASKHDKNEASLKNKQKLPSRKIANSSKLHGSPKSNRLNCTSAPSEDGNEHPTESWEGKHLNPNGSSAHGTKTTEIIQRGCKNVISKLQRRIDKEGHQIVPLLTDLWKRMENSGHAGGSGNNLLDLRKIDQRIDRMDYSGVMELVFDVQFMLRGAMHFYGYSYEVRTEGRKVHDLFFDILKIAFPDTDFGEARGALSFSSQAPAGTAASPRQGTVGPSKRHRMTNDAETDPCPSQKLSQSGSTSNGENARFKGHLPQKNSRTGSSSAREQPQQDNPPLLAHPGQLVVCKKKRNDRDKSLGKGRTGSTGPISPPSAIRSPGSGSTPKDARLAQQGRGSQPSQHSNGSGGSVGWANPVKRLRTDSGKRRPSHM

SEQ ID NO: 6661 - protein, 2229 aa, Glycine max
MQSGGGGGGRNPGVGSAGRTTTSSAAASPTSSSSASQLGLDSMQQQQQQQQQQQIGSRQSFQQQLLRKPEGNEAFLAYQAGIQGVFGSNNFSSPSAMQLPQQPRKLHLGSNQDIQLRGQGVEQQMLNPVHQAYLQYALHAAQQRPTLGIQSQQQTKMGMLSSASLQDQEMRMGNLKMQDIMSMQAANQGQGSSSRNSSERGARGDKQMDQGQQMTPDQKSEGKPSTQGPTIGHLIPGNMIRPMQGPETQQGIQNVVNTQIAVSAQLQAMQAWARERNIDLSHPANAHLMAQLIPLMQSRMVSQSKVNESNIGAQSSPVPVSKQQVTSPAVASESSAHANSSSDMSGQSGSSKARQTAPSSHLGSITNAGIAGNSSDMATQQFNVHGRESQAPPRQPVVVGNGMPSMHSQQSSANTNLGADHPLNAKTSSSGPEPPQMQYTRQLNQSAPQAGGPTNEGGLGNPAKSQGRPAQMPQQRTNFTKQQLHVLKAQILAFRRLKKGEGTLPQELLRAIVPPPLEMQAQQPNHSARGQNQDKPAGNIAAEQISPIESSAKEPQSIPSINGQSSLKHESFARDEKSIVPPVHVQAVAPPVSKESAPTLSAGKKDQKSIGCSVKSNQDGECVNNTTVRNELALDRGKAIAPQAPVSDTMQIKKPSQTSTGPQPKDVGPTRKYHGPLFDFPFFTRKHDSFGSSMMLNNNNNLSLAYDVKDLLFEEGMEVLNKKRTENLKKIEGLLAVNLERKRIRPDLVLRLQIEEKKLRLVDLQARLRDEIDQQQQEIMAMPDRPYRKFVRLCERQRMELARQVQASQRAVREKQLKSIFQWRKKLLEAHWAIRDARTARNRGVAKYHEKMLREFSKRKDDDRNKRLEALKNNDVDRYREMLLEQQTSIPGDAAERYAVLSTFLTQTEEYLHKLGSKITAAKNQQEVEEAAKAAAAAARLQGLSEEEVRAAAACAGEEVMIRNRFLEMNAPRDSSSVNKYYNLAHAVNETVIRQPSMLRAGTLRDYQLVGLQWMLSLYNNKLNGILADEMGLGKTVQVMALIAYLMEFKGNYGPHLIIVPNAVLVNWKSEFYNWLPSVSCIFYVGSKDHRSKLFSQEVCAMKFNVLVTTYEFIMYDRSKLSKIDWKYIIIDEAQRMKDRDSVLARDLDRYRCQRRLLLTGTPLQNDLKELWSLLNLLLPEVFDNKKAFNDWFSKPFQKEGPTQNVEDDWLETEKKVIIIHRLHQILEPFMLRRRVEDVEGSLPPKVSIVLKCKMSAVQSAIYDWVKSTGTLRLDPEDEKHKLHRNPAYQVKQYKTLNNRCMELRKTCNHPLLNYPFFSDLSKEFIVRSCGKLWILDRILIKLQRTGHRVLLFSTMTKLLDILEEYLQWRRLVYRRIDGTTSLEDRESAIVDFNSPDSDCFIFLLSIRAAGRGLNLQSADTVVIYDPDPNPKNEEQAVARAHRIGQKREVKVIYMEAVVDKIASHQKEDELRSGGTVDMEDELAGKDRYMGSIESLIRNNIQQYKIDMADEVINAGRFDQRTTHEERRLTLETLLHDEERYQETVHDVPSLQEVNRMIARSKEEIELFDQMDDELDWIEEMTRYDHVPKWLRANTREVNAAIGALSKRSSKNTLLGGSIGIESSEFGSERKRGRPKGKKHPNYKELDDEILEYSEVSSDERNEYAHEEGEMGEFDDDGYSMADGVQTIDKDQLEDGLLCDAGYEFPQSLESARNNQMVEEAGTSGSSSDSQRVRQIVSPSVSSQKFGSLSALDARPSSISKRMTDELEEGEIAVSGDSHMDHQQSGSWIHDRDEGEDEQVLQKPKIKRKRSLRVRPRHATERPEEKSGSEMASHLAVQADHKYQAQLRTDPESKLFGDSNASRHEQNTPALKNKRTLPSRRVANTSKLHGSPKSSRLNCMSVPSQDAGDHSRESWEGKPINSSGSSAHGTKMTEIIQRRCKNVISKLQRRIDKEGHEIVPLLMDLWKRIENSGSGNSLLDLRKIDQRIDKFEYNGATELVFDVQFMLKSAMHFYGFSHEVRTEARKVHDLFFEILKIAFPDTDFRDARSALSFSSQAAAGTVTSPRQAAVSQSKRHRLINEMETESYPSQRSLQRGSASSGENNRIKVHLPQRESRTGSGGGSSTREQQQEDSSLLAHPGELVVCKKRRNDREKSAVKPKTGPVSPSSMRTPGPSSVPKEARLTQQGSHAQGWAGQPSQQPNGSGGSVGWANPVKRLRTDSGKRRPSHT

SEQ ID NO: 6662 - protein, 2226 aa, Glycine max
MQSGGGGGGRNPGVGPAGRTGTSSAAASPTSSSSASQLGLDSMQQQQQQQQQQIGSRQSFQQQLLRKPEGNEAFLAYQAGIQGVFGNNNFSSPSAMQLPQQPRKLHLGSNQDTHQRGQGIEQQTLNPVHQAYLQYALHAQQRPTLGIQSQQHTKTGMLSSASLKDQEMRMGHLKMQDIMSMQAANQGQGSSSRNSSERVARGDKQMEQGQQIAPDQKSEGKPLTQGPTIGHLISGNMIRPMQAPETQQGIQNVVNTQIAASAQLQAMQAWARERNIDLSHPANAHLMAQLIPLMQSRMVSQSKVNESSIGAQSSPVPVSKQQVTSPAVASESSAHANSSSDMSGQSGSSKARQTAPPSHLGSITNAGIAGNSSEMATQQFNVRGRESQAPPRQPVVVGNGMPSMHSQQSSANTNFSADHPLNAKTSSSGPEPPQMQYMRQLNQSAPQAGGPTNEGGSGNHAKSQGPPTQMPQHRTSFTKQQLHVLKAQILAFRRLKKGEGTLPQELLRAIVPPPLEMQVQQPNHAAGGQNQDKPAGNIVAELISPIESSAKEPLSIPSINGQSSLKQESFVRDEKSIVPAVHVQAVAPPVSKESAPTLSAGKEEQKSIGCSVKSNQDGERVNNNTVRNELALDRGKAVAPQAHVSDTMQIKKPAQTSSVPQPKDVGSTRKYHGPLFDFPFFTRKHDSFGSSMMLNNNNNLSLAYDVKDLLFEEGMEVLNKKRTENLKKIEGLLAVNLERKRIRPDLVLRLRIEEKKLRLVDLQARLRDEIDQQQQEIMAMPDRPYRKFVRLCERQRMELARQVQASQRAVREKQLKSIFQWRKKLLEAHWAIRDARTARNRGVAKYHEKMLREFSKHKDDDRNKRLEALKNNDVDRYREMLLEQQTSIPGDAAERYAVLSTFLTQTEEYLHKLGSKITTAKNQQEVEEAAKAAAAAARLQGLSEEEVRAAAACAGEEVMIRNRFLEMNAPRDSSSVNKYYNLAHAVNETVIRQPSMLRAGTLRDYQLVGLQWMLSLYNNKLNGILADEMGLGKTVQVMALIAYLMEFKGNYGPHLIIVPNAVLVNWKSEFYNWLPSVSCIFYVGSKDHRSKLFSQEVCAMKFNVLVTTYEFIMYDRSKLSKIDWKYIIIDEAQRMKDRDSVLARDLDRYRCQRRLLLTGTPLQNDLKELWSLLNLLLPEVFDNKKAFNDWFSKPFQKEGPTQNVEDDWLETEKKVIIIHRLHQILEPFMLRRRVEDVEGSLPPKVSIVLKCKMSAVQSAIYDWVKSTGTLRLDPEDEKRKLHRNPAYQMKQYKTLNNRCMELRKTCNHPLLNYPFFSDLSKEFIVKSCGKLWILDRILIKLQRTGHRVLLFSTMTKLLDILEEYLQWRRLVYRRIDGTTSLEDRESAIVDFNSPDSDCFIFLLSIRAAGRGLNLQSADTVVIYDPDPNPKNEEQAVARAHRIGQTREVKVIYMEAVVDKIASHQKEDELRSGGTVDMEDELAGKDRYMGSIESLIRNNIQQYKIDMADEVINAGRFDQRTTHEERRLTLETLLHDEERYQETVHDVPSLQEVNRMIARSKEEIELFDQMDDELDWIEEMTRYDHVPKWLRANTREVNAAIGALSKRPSKNTLLGGSIGMESSEFGSERKRGRPKGKKHPNYKELDDEILEYSEVSSDERNEYAHEGEIGEFDDDGYSVADGAQTIDKDQLEDGLLCDAGYEFPQSLESARNNQMVEEAGSSGSSSDSQRVRQIVSPSVSSQKFGSLSALDARPSSISKRMTDELEEGEIAVSGDSHMDHQLSGSWIHDRDEGEDEQVLQKPKIKRKRSLRVRPRHATERPEEKSGSEMASHLAVQADHKYQAQLRTDPESKLFGDSNASRHEQNSPSLKNKRTLPSRRVANTSKLHGSPKSSRLNCMSVPSQDGGEHSRESWEGKPINSSGSSAHGTKMTEIIQRRCKNVISKLQRRIDKEGHEIVPLLTDLWKRIENSGSVNSLLDLRKIDQRIDKFEYNGATELVFDVQFMLKSAMHFYGFSHEVRTEARKVHDLFFDILKIAFPDTDFRDARSALSFSSQATASTVTSPRQVAVGQSKRHKLINEMETESYALQRSLQRGSASSSENNRIKVHLPQRESRTGSGGGSSTREQQQDDSSLLAHPGELVVCKKRRNDREKSVVKPKTGPASPSSMRTPGPSSVTKDARLSQQGSHAQGWAGQPSQQPNGSGGPVAWANPVKRLRTDSGKRRPSHT

SEQ ID NO: 6663 - protein, 2238 aa, Medicago truncatula
MQSNGGAGDGPGRNSAGRAASTSSAAASPTSSSSAASHMGLDSLQQQQQMIGGSRQSFQQQLLRKSEGSEAVLAYQAGHQGLFGNNNYSSSTAMQLPPQSRNFFALAQHGPNQGQGIEQQRLNPVRQAYSQYALQSFQQRPALAMQSQQQPKMEMLGPTSVKDQEMRMGNFKLQDLMSMQAVNHGQGSSSSRNSSEHFSHGEKRVEQGQQLASDKKNEGKSSTQGLGIGHLMPGNNIRPVQALPTQQSIPIAMNNQIATSDQLRAMQAWAHERNIDLSQPANANFAAQLNLMQTRMVQQSKESGAQSSSVPVSKQQATSPAVSSEGSAHANSSTDVSALVGSVKARQTAPPSHLGLPINAGVAGNSSDTAVQQFSLHGRDAQGSLKQLIVGVNGMPSMHPQQSSANKSLGADSSLNAKASSSRSDPEPAKMQYVRQLSQHASLDGGSTKEVGSGNYAKPQGGPSQMPQKLNGFTKNQLHVLKAQILAFRRLKKGDGILPQELLEAISPPPLDLHVQQPIHSAGAQNQDKSMGNSVTEQPRQNEPKAKDSQPIVSFDGNSSEQETFVRDQKSTGAEVHMQAMLPVTKVSAGKEDQQSAGFSAKSDKKSEHVINRAPVINDLALDKGKAVASQALVTDTAQINKPAQSSTVVGLPKDAGPAKKYYGPLFDFPFFTRKQDSFGSSMMANNNNNLSLAYDVKELLYEEGTEVFNKRRTENLKKIEGLLAVNLERKRIRPDLVLKLQIEEKKLRLLDLQARLRGEIDQQQQEIMAMPDRPYRKFVKLCERQRVELARQVQTSQKALREKQLKSIFQWRKKLLEVHWAIRDARTARNRGVAKYHEKMLKEFSKNKDDDRNKRMEALKNNDVDRYREMLLEQQTSLPGDAAERYNVLSTFLTQTEEYLQKLGSKITSAKNQQEVEESAKAAAAAARLQGLSEEEVRAAAACAGEEVMIRNRFMEMNAPKDGSSSVSKYYNLAHAVNEKVLRQPSMLRAGTLREYQLVGLQWMLSLYNNKLNGILADEMGLGKTVQVMALIAYLMEFKGNYGPHLIIVPNAVLVNWKVSFNSFVSTIFLFFSELHTWLPSVSCIFYVGSKDHRSKLFSQEVMAMKFNVLVTTYEFIMYDRSKLSKIDWRYVIIDEAQRMKDRESVLARDLDRYRCHRRLLLTGTPLQNDLKELWSLLNLLLPEVFDNKKAFNDWFSKPFQKEDPNQNAENDWLETEKKVIIIHRLHQILEPFMLRRRVEEVEGSLPPKVSIVLRCRMSAFQSAIYDWIKSTGTLRLNPEEEQSRMEKSPLYQAKQYKTLNNRCMELRKTCNHPLLNYPFFSDLSKDFMVKCCGKLWMLDRILIKLQRTGHRVLLFSTMTKLLDILEEYLQWRRLVYRRIDGTTALEDRESAIVDFNSPNSDCFIFLLSIRAAGRGLNLQSADTVVIYDPDPNPKNEEQAVARAHRIGQKREVKVIYMEAVVDKISSHQKEDEMRIGGTIDMEDELAGKDRYIGSIESLIRSNIQQYKIDMADEVINAGRFDQRTTHEERRLTLETLLHDEERCQETVHDVPSLQEVNRMIARNEEEVELFDQMDEEEDWLEEMTRYDQVPDWIRASTREVNAAIAASSKRPSKKNALSGGNVVLDSTEIGSERRRGRPKGKKNPSYKELEDSSEEISEDRNEDSAHDEGEIGEFEDDGYSGAGIAQPVDKDKLDDVTPSDAEYECPRSSSESARNNNVVEGGSSASSAGVQRLTQAVSPSVSSQKFASLSALDAKPSSISKKMGDELEEGEIAVSGESHMYHQQSGSWIHDRDEGEEEQVLQKPKIKRKRSLRVRPRHTMEKPEDKSGSEMASLQRGQSFLLPDKKYPLQSRINQESKTFGDSSSNKHDKNEPILKNKRNLPARKVANASKLHVSPKSSRLNCTSAPSEDNDEHSRERLKGKPNNLRGSSAHVTNMTEIIQRRCKSVISKLQRRIDKEGHQIVPLLTDLWKRIENSGFAGGSGNNLLDLRKIDQRINRLEYSGVMEFVFDVQFMLKSAMQFYGYSYEVRTEARKVHDLFFDILKTTFSDIDFGEAKSALSFTSQISANAGASSKQATVFPSKRKRGKNDMETDPTPTQKPLQRGSTSNSESGRIKVQLPQKASRTGSGSGSAREQLQQDSPSLLTHPGDLVVCKKKRNERGDKSSVKHRIGSAGPVSPPKIVVHTVLAERSPTPGSGSTPRAGHAHTSNGSGGSVGWANPVKRMRTDSGKRRPSHM

SEQ ID NO: 6664 - protein, 2175 aa, Medicago truncatula
MQSGGGGPGRTAGRASTPSAAASPSSSSSASQLGFESLQQQHQQQQQQHQQQQQQQQIGSRQSFQQQLLRKPEGNEAFLAYQAGRQGVFGSNNFQQPNAMQLPQQSGKFVNLAQHGSNQDGQLRGQGSEQQQMINPVQQAYLQYAFQAAQQKQPALGIHSQQQAKMGMLNPASVKDQEMRMGNLKMQEAMSMQAVNQAQGSSSRNSSEHNARGEKQMEQGQQIRPIQAPEAQQGSVQNVMNTQIAVAHQLQMMQAWARENNIDLSHPTNANLMAKLIPMMQSRMVLPPKAGESNVGAQSSPVPVSKQQVNSPAVASESSAHANSSSDVSGQSGSSKARHTVPPSHLGPTTNAGHSSDMAMQQFNIHGRESQAPLRQQVKAGNGMPSMHSQQSSAAMNLGAADHSLNVKGLSSSAEPPQMQYIRQLNQSTAQAGGPTKEGGSRNNAKSQVPPAQMPERQSAFTKQQLHVLKAQILAFRRIKKGEGMLPPELLQAITPPPLEVQAEQPNQPAGGQNQVRSAGHIAAEQPRHVEANAKESKSIPAVNGHSSVKQESFSREEKSAPPPVHIQAVMPSMSKESASTSSAGKEEQKTIGSSFKPKQDSEHGNNSTPVRNESALDRGKAIAPQASVSDTMQITKPAQATTVSQPKDVGPARKYHGPLFDFPFFTRKHDSFGSSMMVNNNNNLSLAYDVKDLLSEEGAEVLNKKRTENLKKIEGLLAVNLERKRIRPDLVLRLQIEEKKLRLLDVQARLRDEIDQQQQEIMAMPDRPYRKFVRLCERQRMELVRQVQASQKAAREKQLKSIFLWRKKLLEAHWAIRDARTARNRGVGKYHERMLREFSKHKDDDRSKRLEALKNNDVDRYREMLLEQQTSIPGDAAERYTVLSSFLSQTEEYLHKLGSKITAAKNQQEVEEAAKAAADAARLQGLSEEEVRAAAACAGEEVMIRNRFLEMNAPRDSSSVNKYYNLAHAVNEMVIRQPSLLRAGTLRDYQLVGLQWMLSLYNNKLNGILADEMGLGKTVQVMALIAYLMEFKGNYGPHLIIVPNAVMVNWKSELYKWLPSVSCIFYAGGKDYRTKLFHQVSVFQKIDWKYIVIDEAQRMKDRDSVLARDLDRYRCQRRLLLTGTPLQNDLKELWSLLNLLLPEVFDNKKAFHDWFSKPFQKEGATQNAEDDWLETEKKVITIHRLHQILEPFMLRRRVEDVEGSLPPKDSIVLRCKMSSVQSAIYDWVKSTGTLRLDPEDEERKVQRNPNYQLKQYKTLNNRCMELRKTCNHPLLNYPFFSDLSKEFIVKSCGKLWILDRILIKLQRTGHRVLLFSTMTKLLDILEEYLQWRRLVYRRIDGTTSLEDRESAINDFNGPDSDCFIFLLSIRAAGRGLNLQSADTVVIYDPDPNPKNEEQAVARAHRIGQKRPVKVIYMEAVVDKIPSHQKEDEMRGRGTVDLEDELAGKDRYIGSIEGLIRNNIQQYKIDMADEVINAGRFDQRTTHEERRLTLETLLHDDERYQETVHDVPSLQEVNRMIARSEEEVELFDQMDDELDWIEEMTCYDHVPKWIRANSKEVNAAIGALSKRPLKKTLIGWKRGRPKKHTSYKELDDEDLEYSEASSEERNGSANEEGEAGDFEDDGYSGADGAQPIAKDQLENSMLCDGGYEFPPSLEMVRNNQVVQDAGSSGSSADCQKLTQIVSPSISAQKFGSLSALDARPGSISKKNDELEEGEIAVSFDSHMEHQQSGSWIHDRDEGEDEQVLQKPRIKRKRSIRVRPRHATEKPEDKSGSETIPRLSVQADRKYQAQLRADLESKSHVESNASRNEQNSSIKNKRTLPSRRVANTSKLHSSPKPTRLSAPSEDGGEHSRESWEGKPINSSGSSAHGSRMTEIIQRRCKNVISKLQRRIDKEGHQIVPLLTDLWKRIENSGYSGGSGNNLLDLRKIDQRIDKLEYTGATDLVFDVQFMLKSAMQYYGFSLEVRTEARKVHNLFFDILKIAFPDTDFQDAKSALSFTGPISAPTMVSSPRQVAVGQGKRHRLVNEVEPDSHPSQRQLQRGSASSGENSRIRVRVPPKESRSGYGSGSSIREQPQQQDDSPPLLTHPGELVVCKKRRNEREKSLVKSRTGPVSPSMRSPGAGSVPKDVRLTQQTQGWTGQPSSQQPNGGSVGWANPVKRLRTDSGKRRPSHM

SEQ ID NO: 6665 - protein, 2268 aa, Vitis vinifera
MQSGGGPGRNPAVGPPGRATSTSSASPSSSSSAVSTPHLGFDSIQQQQQQQQQQSRQVRVFKSLQQQLLRKPEGNEALLAYPGGGLQGVMGGGNFASSSSSMQLPQQPRKFIDLAQQHGASHIREDNQNKSQGVEQPVLNPVHQAYLQYAFQAAHQKSALGMQPQQQAKMGMVGPPSWKDQDARMGNLKMQDLISIQAANQAQASSSKKPAEHYARGEKQMEQVQAPISDQRSESKPPTMPTAVGQLMPGNVTRPMQSVQNQQSIQNMANNQLAVAAQLQAMQAWALERNIDLSLPANANLMAQLIPLMQTRMVTQPKPNESNMGAQPSPVQGPKQQVTSPPVASENSPHGNSSSDVSGQSGSAKARQTVPPSPFGSNPNAAIVNNTNNIPVQQFSVQGRESQVPPRQSVVIGNGMSPMHPPQPSVNMSQGVDHPLHAKNTLSGQESLQMQYLRQLNRSSPQSAVPPNDGGLGNHYQSQGGPLPQVPQQRFGFTKQQLHVLKAQILAFRRLKKGEGTLPQELLRSIAPPPLESQLQQAFLPSTAINQDKSAGKNVEDHGRQLESNEKDSQAVPSTNGHNFSKEEAFAGDDKATPSTVHMPGAPTVMKEPIPVLSAGKEEPQTTAFSVKSDQEFERGIQKTPIRSDFAPDRGKAVAPQVGVPDSLQVKKPVQTSSTPQQKDAGSTRKYHGPLFDFPFFTRKHDSFGSAMMVNNNSNLTLAYDVKDLLFEEGMEVLNKKRTENLKKISGLLAVNLERKRIRPDLVLRLQIEERKLRLLDLQARLRDEVDQQQQEIMAMPDRPYRKFVRLCERQRMELMRQVQVSQKAMREKQLKSIFQWRKKLLEAHWAIRDARTARNRGVAKYHERMLREFSKRKDDDRNRRMEALKNNDVERYREMLLEQQTSIPGDAAERYAVLSSFLTQTEEYLHKLGSKITAAKNQQEVEEAANAAAAAARAQGLSEEEVRTAATCAGEEVMIRNRFIEMNAPKESSSVNKYYTLAHAVNERVMRQPSMLRAGTLRDYQLVGLQWMLSLYNNKLNGILADEMGLGKTVQVMALIAYLMEFKGNYGPHLIIVPNAVLVNWKSELHNWLPSVSCIYYVGGKDQRSKLFSQEVCAMKFNVLVTTYEFIMYDRSKLSKVDWKYIIIDEAQRMKDRESVLARDLDRYRCQRRLLLTGTPLQNDLKELWSLLNLLLPEVFDNRKAFHDWFSKPFQKEGPTHNAEDDWLETEKKVIIIHRLHQILEPFMLRRRVEDVEGSLPPKVSIVLRCKMSAIQGAIYDWIKSTGTLRVDPEDEKRRVQKNPIYQAKVYKTLNNRCMELRKACNHPLLNYPYFNDFSKDFLVRSCGKMWILDRILIKLQRTGHRVLLFSTMTKLLDILEEYLQWRRLVYRRIDGTTSLEDRESAIVDFNSAGSDCFIFLLSIRAAGRGLNLQSADTVVIYDPDPNPKNEEQAVARAHRIGQTREVKVIYMEAVVDKISSHQKEDEFRSGGTVDSEDDLAGKDRYIGSIESLIRNNIQQYKIDMADEVINAGRFDQRTTHEERRLTLETLLHDEERYQETVHDVPSLQEVNRMIARSEDEVELFDQMDEELNWIEDMTRYDQVPKWLRASTRDVNIAVANLSKKPSKNTFFAANIGLESSEKGSDLSPKTERKRGRPKGKPVYRELDDENGEFSEASSDERNGYSAHEEEGEIGEFEDEEFSGAVGAQPSNKDQSEEDGRICDGGYEYLRALESTRNKHILDEAGSSGSSSDSRRLTQMVSPSISSRKFGSLSALDARPSSLSKRLPDELEEGEIAVSGDSHMDHQQSGSWIHDRDEGEDEQVLQPKIKRKRSIRIRPRHTVERPEEKSSNEKSSLQRGDSSQLPMQVDHKYEAQLRSDPEAKLFGESNAFKHDQSDSSLKSRRNLPSRKIGNTSKLHASPKSGKLNCMSARAEDVAEHSREGWDGKVMNTGGPRMPEIMQRKCKNVISKLQRRIDKEGHQIVPLLTDWWKRVENSGYISGPGNNILDLRKIDQRIDRLEYIGVMELVFDVQQMLKNSMQYYGLSHEVRVEARKVHELFFNILKIAFPDTDFREARNAISFSGPVSTPASAPSPRQAAVGQGKRHKPINEVEPDPSPPPKQLLRGAAAAAAAAAAASEDTRAKSHISQKESRLGSSSSRDQDDSPLLTHPGDLVISKKKRKDREKSAAKPRSGSSGPVSPPSMGRSIRSPGPGSMQKDGRSTQQATHQQAWASQPAQQANGGSGGGGTVGWANPVKRMRTDAGKRRPSHL

SEQ ID NO: 6666 - protein, 2248 aa, Ricinus communis
MQSGGGGPSRVGPAGRAASTSSAASPSSSSSAASPQLGFDSVQQHHQHQQLGSRQALQHQLLRKPEGNEALLAYQAGAFQGVIGGSNFAPSPGSMQMPQQSRKFFDLAQQQNSSQDGQNRNQAVEQQVLNPVHQAYLQFAFQQQKSALVMQSQQQAKMGMLGPATGKDQEMRMGNSKMQELTSIQAASQAQASSSKNSSENFTRGEKQVEQGQQLAPEQRNEQKPPTQPPGVGQAMPANVVRPMQAPQAQQSIQNMVNNQLAMAAQLQAMQAWALERNIDLSLPANANLMAQLIPLMQSRMAAQQKANESNAGAQASPVPVSVSKHQVASPPVASESSPHANSSSDVSGQSGPPKARQTVPSGPFGSSSNSGIVNSANSLAMQQLAFQNRENQAPPRTGVILGNGMPSMHPSQLSANMSQGGDQNMPAKNAINSPETLQMQHLKQMNRSSPQSAGLSNDGGSSNHNSSQGTPSVQMAQNRVGFTKQQLHVLKAQILAFRRLKKGEGTLPQELLRAIAPPPLELQLQQQFLPAGGSNQDRSGGKILEDQAKHLESNEKNSQAMPSMNGQNAAKEEAVAGVEKPTVSASNIEGPTAAKDPTTSVAVRKEEQQTATFPVKSDQEVERSLQKTPVRSDVTADKGKAVAPQVPVSDAVQAKKPAQTSVAPQPKDVGSARKYHGPLFDFPFFTRKHDSIGSSGMINTNNNLILAYDVKDLLFEEGLEVLNKKRSENLKKINGLLAVNLERKRIRPDLVLRLQIEEKKLKLLDLQARLRDEVDQQQQEIMAMPDRPYRKFVRLCERQRMEQARQVQASQKAMRDKQLKSIFQWRKKLLEAHWGIRDARTARNRGVAKYHERMLREFSKRKDDDRNKRMEALKNNDVERYREMLLEQQTNIEGDAAERYAVLSSFLTQTEEYLHKLGSKITAAKNQQEVEEAANAAATAARLQGLSEEEVRVAAACAGEEVMIRNRFMEMNAPKDSSSVSKYYSLAHAVNERVIRQPSMLRAGTLRDYQLVGLQWMLSLYNNKLNGILADEMGLGKTVQVMALIAYLMEFKGNYGPHLIIVPNAVLVNWKSELHNWLPSVSCIYYVGSKDQRSKLFSQEVSAMKFNVLVTTYEFIMYDRSKLSKVDWKYIIIDEAQRMKDRESVLARDLDRYRCQRRLLLTGTPLQNDLKELWSLLNLLLPEVFDNRKAFHDWFSKPFQKEGPAHDAEDDWLETEKKVIIIHRLHQILEPFMLRRRVEDVEGSLPPKVSIVLRCRMSAIQSAVYDWIKSTGTLRVDPEDEKRRAQKNPIYQPKVYKTLNNRCMELRKACNHPLLNYPYFNDFSKDFLVRSCGKLWILDRILIKLQRTGHRVLLFSTMTKLLDILEEYLQWRRLVYRRIDGTTSLEDRESAIVDFNSPDSDCFIFLLSIRAAGRGLNLQSADTVIIYDPDPNPKNEEQAVARAHRIGQKREVKVIYMEAVVDKISSHQKEDELRSGGTIDLEDDLAGKDRYMGSIESLIRNNIQQYKIDMADEVINAGRFDQRTTHEERRMTLETLLHDEERYQETVHNVPSLQEVNRMIARSEDEVELFDQMDEDLDWTEEMTSYDQVPKWLRASTRDVNAAIANLSKKPSKNILYASSVGMESSEVETERKRGRPKGKKSPNYKEVDDDNGEYSEASSDERNGYCAHEEEGEIREFEDDESSGAVGAPPINKDQSEDDGPTCDGGYEYPRASTSARDNHILEEAGSSGSSSDNRRITRIVSPVSSQKFGSLSALDARPGSISKKLPDELEEGEIAVSGDSHLDHQQSGSWIHDREEGEDEQVLQPKIKRKRSIRLRPRHTMERPDEKSGIEVQRGDACLLPFQGDHKYQAQLRTDAEMKGFGEPNPSRHDQSDSSKNRRTIPSRRIANTSKLHASPKSSRLHMQAAPPEDAAEHSRESWDGKVTNASGSSVLGSKMSDVIQRRCKNVISKLQRRIDKEGQHIVPVLTDLWKRMESSGYMSGAGNNLLDLRKIETRVDRLEYNGVMELVVDVQFMLKGAMQFYTFSHEARSEARKVHDLFFDILKIAFPDTDFREARNALSFSNPLSTSSSAPSPRQAAVGQSKRHRLINEVEPDNGSAHKPIQRGSIPSGDDTRVKVHLPKETRHGTGSGSTREQYQQDDSPLHPGELVICKKKRKDRDKSMAKSRPGSSGPVSPPSMARTITSPVQGSASRETRMSQQNPHQQGWGNQPQPANNGRGGGGGSVGWANPVKRLRTDAGKRRPSHL

SEQ ID NO: 6667 - protein, 2238 aa, Vitis vinifera
  misc_feature (628)..(628): Xaa can be any naturally occurring amino acid
  misc_feature (1963)..(1963): Xaa can be any naturally occurring amino acid
MQSGGGPGRNPAVGPPGRATSTSSASPSSSSSAVSTPHLGFDSIQQQQQQQQQQSRQSLQQQLLRKPEGNEALLAYPGGGLQGVMGGGNFASSSGSMQLPQQPRKFIDLAQQHGASHIREDNQNKSQGVEQPVLNPVHQAYLQYAFQAAHQKSALGMQPQQQAKMGMVGPPSWKDQDARMGNLKMQDLISIQAANQAQASSSKKPAEHYARGEKQMEQVQAPISDQRSESKPPTMPTAVGQLMPGNVTRPMQSVQNQQSIQNMANNQLAVAAQLQAMQAWALERNIDLSLPANANLMAQLIPLMQTRMVTQPKPNESNMGAQPSPVQGPKQQVTSPPVASENSPHGNSSSDVSGQSGSAKARQTVPPSPFGSNPNAAIVNNTNNIPVQQFSVQGRESQVPPRQSVVIGNGMSPMHPPQPSVNMSQGVDHPLHAKNTLSGQESLQMQYLRQLNRSSPQSAVPPNDGGLGNHYQSQGGPLPQVPQQRFGFTKQQLHVLKAQILAFRRLKKGEGTLPQELLRSIAPPPLESQLQQAFLPSTAINQDKSAGKNVEDHGRQLESNEKDSQAVPSTNGHNFSKEEAFAGDDKATPSTVHMPGAPTVMKEPIPVLSAGKEEPQTTAFSVKSDQEXERGIQKTPIRSDFAPDRGKAVAPQVGVSDSLQVKKPVQTSSTPQQKDAGSTRKYHGPLFDFPFFTRKHDSFGSAMMVNNNSNLTLAYDVKDLLFEEGMEVLNKKRTENLKKISGLLAVNLERKRIRPDLVLRLQIEERKLRLLDLQARLRDEVDQQQQEIMAMPDRPYRKFVRLCERQRMELMRQVQVSQKAMREKQLKSIFQWRKKLLEAHWAIRDARTARNRGVAKYHERMLREFSKRKDDDRNRRMEALKNNDVERYREMLLEQQTSIPGDAAERYAVLSSFLTQTEEYLHKLGSKITAAKNQQEVEEAANAAAAAARAQACFGLSEEEVRTAATCAGEEVMIRNRFIEMNAPKESSSVNKYYTLAHAVNERVMRQPSMLRAGTLRDYQLVGLQWMLSLYNNKLNGILADEMGLGKTVQVMALIAYLMEFKGNYGPHLIIVPNAVLVNWKEVCAMKFNVLVTTYEFIMYDRSKLSKVDWKYIIIDEAQRMKDRESVLARDLDRYRCQRRLLLTGTPLQNDLKELWSLLNLLLPEVFDNRKAFHDWFSKPFQKEGPTHNAEDDWLETEKKVIIIHRLHQILEPFMLRRRVEDVEGSLPPKVSIVLRCKMSAIQGAIYDWIKSTGTLRVDPEDEKRRVQKNPIYQAKVYKTLNNRCMELRKACNHPLLNYPYFNDFSKDFLVRSCGKMWILDRILIKLQRTGHRVLLFSTMTKLLDILEEYLQWRRLVYRRIDGTTSLEDRESAIVDFNSAGSDCFIFLLSIRAAGRGLNLQSADTVVIYDPDPNPKNEEQAVARAHRIGQTREVKVIYMEAVVDKISSHQKEDEFRSGGTVDSEDDLAGKDRYIGSIESLIRNNIQQYKIDMADEVINAGRFDQRTTHEERRLTLETLLHDEERYQETVHDVPSLQEVNRMIARSEDEVELFDQMDEELNWIEDMTRYDQVPKWLRASTRDVNIAVANLSKKPSKNTFFAANIGLESSEKGSDLSPKTERKRGRPKGKPVYRELDDENGEFSEASSDERNGYSAHEEEGEIGEFEDEEFSGAVGAQPSNKDQSEEDGRICDGGYEYLRALESTRNKHILDEAGSSGSSSDSRRLTQMVSPSISSRKFGSLSALDARPSSLSKRLPDELEEGEIAVSGDSHMDHQQSGSWIHDRDEGEDEQVLQPKIKRKRSIRIRPRHTVERPEEKSSNEKSSLQRGDSSQLPMQVDHKYEAQLRSDPEAKLFGESNAFKHDQSDSSLKSRRNLPSRKIGNTSKLHASPKSGKLNCMSARAEDVAEHSREGWDGKVMNTGGPRMPEIMQRKCKNVISKLQRRIDKEGHQIVPLLTDWWKRVEXSGYISGPGNNILDLRKIDQRIDRLEYIGVMELVFDVQQMLKNSMQYYGLSHEVRVEARKVHELFFNILKIAFPDTDFREARNAISFSGPVSTPASAPSPRQAAVGQGKRHKPINEVEPDPSPPPKQLLRGAAAAAAAAAAASEDTRAKSHISQKESRLGSSSSRDQDDSPLLTHPGDLVISKKKRKDREKSAAKPRSGSSGPVSPPSMGRSIRSPGPGSMQKDGRSTQQATHQQAWASQPAQQANGGSGGGGTVGWANPVKRMRTDAGKRRPSHL

SEQ ID NO: 6668 - protein, 601 aa, Glycine max; identical to SEQ ID NO: 6647
  misc_feature (414)..(414): Xaa can be any naturally occurring amino acid

SEQ ID NO: 6669 - protein, 610 aa, Medicago truncatula; identical to SEQ ID NO: 6646

SEQ ID NO: 6670 - protein, 347 aa, Glycine max
MKLSTLFLFLFHLAHAALSDEATFIRDGLKSYSQLDLPHSVFGSESVAFDCHGKGPYVGVSDGRILKWHETKREWIDFAVTSPHRNKKLCDGLTNDKMESMCGRPLGLKFNTLTCELYIADAYFGLLVVGPGGGVAKQLATSAEGVPFRFTNALDIDTKTGEVYFTDSSIMFQRRVYISIILSGDRTGRLLKYVPSTQSVHVLVKGLAFPNGVALSKDNSFIIVAESTTFKILKIQVRDSKTNNNNIEPFAQVPRSPDNIKRNAKGEFWVALNSGRGLIQKLENEIETTLPWNADPVAIKFDEKGRAIEVLDGEYGRQLDSVSEVEEHEGSLWIGSAVQPYIGLIKA

SEQ ID NO: 6671 - protein, 349 aa, Glycine max
MKQSTLFLFLFLFPLVHALSYEAAYIRDGLKSYSQLDLPHSVFGSESVAFDCHGKGPYVGVSDGRILKWQETKREWIDFAVTSPHRNKKLCDGLQNDKMESMCGRPLGLKFNTVTCELYIADAYFGLLVVGPSGGVAKQLATSAEGVPFRFTNALDIDTKTGEVYFTDSSILFQRRVYISIILSGDRTGRLLKYVPSTQSVHVLVKGLAFPNGVALSKDNSFILVAESTTFKILKIQLRDSKTNNNNNIEPFAQVPRSPDNIKRNNKGEFWVAQNSGRGLIQKLGNEIETTLPWNADPVAIKFDEKGRAIVVLDGEYGRQLDSVSEVEEHEGSLWIGSAVQPFIGLIKA

SEQ ID NO: 6672 - protein, 349 aa, Glycine max
MKQSTLFLFLFLFPLVHALSYEAAYIRDGLKSYSQLDLPHSVFGSESVAFDCHGKGPYVGVSDGRILKWQETKREWIDFAVTSPHRNKKLCDGLQNDKMESMCGRPLGLKFNTVTCELYIADAYFGLLVVGPSGGVAKQLATSAEGVPFRFTNALDIDTKTGEVYFTDSSILFQRRVYISIILSGDRTGRLLKYVPSTQSVHVLVKGLAFPNGVALSKDNSFILVAESTTFKILKIQLRDSKTNNNNNIEPFAQVPRSPDNIKRNNKGEFWVAQNSGRGLMQKLGNEIETTLPWNADPVAIKFDEKGRAIVVLDGEYGRQLDSVSEVEEHEGSLWIGFAVQPFIGFIKA

SEQ ID NO: 6673 - protein, 495 aa, Glycine max
MFLFQKGSHLHRLLLSKKYYYHFPLPRNAVTIADSVEHPSDATIAKLVLESDPRTVSEALTKPTIQWTPDLVNKVMKRLWNHGPKALQFFKHLDRHHPSYTHSPSSFDHAVDIAARMRDFNSAWALVGRMRSLRLGPSPKTLAILAERYASNGKPHRAVRTFLSMAEHGIRQDLHSFNTLLDILCKSKRVETAHSLLKTLTSRFRPDTVTYNILANGYCLIKRTPMALRVLKEMVQRGIEPTMVTYNTMLKGYFRSNQIKEAWEFYLEMKKRKCEIDVVTYTTVIHGFGVAGDVKKAKRVFHEMVKEGVVPNVATYNALIQVLCKKDSVENAVVVFEEMAREGVCVPNVVTYNVVIRGLCHVGDMERALGFMERMGEHGLRACVQTYNVVIRYFCDAGEVEKALEVFGKMGDGSCLPNLDTYNVLISAMFVRKKSEDLVVAGKLLMDMVDRGFLPRKFTFNRVLNGLVITGNQDFAKEILRMQSRCGRIVRRLKL

SEQ ID NO: 6674 - protein, 492 aa, Glycine max
MFLFQKASASHVQLLIGSKKYFQFHLPRDAVNIAEASDATIAKLVLESDPRTLSEALTKPRIHWTPELVNKTLKRLWNHGPKALLFFKHLDRHLPSYTHSPSSFDHAVDIAARMRDFNSAWALVGRMRSLRLGPSPKTLAILAERYASIGKPHRAVRTFLSMHEHGLHQDLHSFNTLLDILCKSNRVETAHDLLRTLKSRFRPDTVSYNILANGYCLKKRTPMALRVLKEMVQRGIEPTMVTYNTMLKGYFRSNQIKEAWEFYLEMKKRKCEIDVVSYTTVIHGFGEAGEVKKAKRVFDEMVKEGVAPNVATYNALIQVFCKKDSVQNAVAVFEEMVREGVCSPNVVTFNVVIRGLCHVGDMERALGFMERMGEHGLRASVQTYNVVIRYFCDAGEIEKGLEVFGKMGDGLCLPNLDTYNVLISAMFVRKKSEDLVVAGKLLMEMVERGFLPRKFTFNRVLNGLVITGNQDFAKDILRMQSRCGRVVRRLKL

SEQ ID NO: 6675 - protein, 192 aa, Glycine max
MSHIPTAGYGTLAGATPTPTPTGITPSTAATSSVTPRPWREFLDLSALSRPYSYDDAMIRVRRNLSYFRFNYAAVTLLIVFLSLLWHPISMIVFLLVLVAWYYFYFSRDVPLVVFNQTLDDRTVLCVLGLLTVVSLVSTHVGLNVLLSLIVSVVLVGLHAAFRVTEDLFLDEESSLLSVVGTQPIRTNYTPI

SEQ ID NO: 6676 - protein, 190 aa, Glycine max
MSHIPTAGYGTLAGATPTGTTTTTTTTTTSLVTPRPWREFLDLSALSCPYSYDDAMIRVRRNLSHFRFNYAAITLLIVFLSLLWHPVSMIVFLLVLVAWYYLYFSRDGLLVVFNQTLDDRTVLCVLGLLTVAALVSTHVGLNVLLSLIVAVVLVGLHAAFRVTEDLFLDEESSLLSVVGTQPLRTNYTPI

SEQ ID NO: 6677 - protein, 656 aa, Glycine max
MKQKHAFFKSPNLNFCPFSHSHSVHRRLRVADIPLSDEDHDGDAVRETPSTKCFSPRRLVASLLAPLRPTKGLRLQQRRQNETGDLEAPSPSSPTNELKGSDESNNQIYEKLMFAFLLGMKKAKMLYTFTLSSTSGQLHESDTSFKLGVGCGLLYLIAASKNELSKMIELQKEMEMLLQNAKGELQSKDSLLKPLKQSDTLALSITDIQEVSSSSSHLSIHSNIQYVQPESKSDTVPNRFLEYNTSEQDECAEEINELRAEFEIELQRLQLYLDGEAGFDDAQQEGVKVTLEDSSSKSHSSSFGEIIMEPQGATYDVSFGVPPIELERRLHELLEARLEERISELESALECKTQKLIKKEIEVTWWKDTAQLISQHVPETSRFTFPLDPDISLKLSQLGGVQNGGKAEYNYTVDSARASLVRQEDTIIFGLIERARFPLNSPTYNQSYASIPQFRGTLLDFLVRDTEVIQAKAGRYTNLEENPFFPENLPPSVEPHYPFSQFLHPSAAMININNVIWKLYIDELLPIFVASGDDGNYAQTAATDLSLLQAISRRIHYGKFIAEAKFRESPKGYEPLIRAKDKEALMKLLTIESVEEMVVKRVKKKAMVLGQEVSLDRNVKGIKYKVDPSVVSFLYQKWLIPLTKNVEVEYLLSRLD

SEQ ID NO: 6678 - protein, 317 aa, Glycine max
MAMLAKTDSEVSSLTQSSPTRSPRRAVYYVQSPSRDSSHDGEKTTNSFHSSPLQSPLGSPPHSHSNSSLGHHSRESASTRFSGSRKSSSSGNNRKGPWRPWKDQFHAIEEEGLIDAHDNARGFPRCCYFPAFVIGFVLLFSAFSLILWGASRPQKPAISLKSITFDQFVIQAGADMSGVATSLVSMNSSVKMTFRNTATFFGVHVTSTPVDLNYYQLTLATGTMPKFYQSRKSQRSVRVMVIGSHIPLYGGGANLNSVNGKPVEPVPLTLSVMVRSRAYVLGKLVKPKFYKKIECSIVMDPKKMGKAISLVKKCTYQ

SEQ ID NO: 6679 - protein, 318 aa, Glycine max
MTMLAKTDSEVSSLTQSSPARSPRRDVYYVQSPSRDSSHDGEKTTNSFHSSPLQSPLGSPPHSHSNSSLGRHSRESASTRFSGSRKSSSSGNNRKGPWRPWKDQFHAIEEEGLLDPNDNAHHGFPRRCYFPAFVVGFVVLFSAFSLILWGASRPQKPAISLKSITFDQFVIQAGADMSGVATSLVSMNSSVKMTFRNTATFFGVHVTSTPVDLNYYQLTVATGTMPKFYQSRKSQRSVRVMVIGSHIPLYGGGANLNSVNGKPVEPVPLTLSVMVRSRAYVLGKLVKPKFYKKIECSIVMDPKKMGKAISLVKKCTYQ

SEQ ID NO: 6680 - protein, 321 aa, Populus trichocarpa
MSAQLSKTDSEVSSLTPSSPARSSPPRRPVYYVQSPSRDSHDGEKTTNSFHSTPVLSPMGSPPHSHSNSSLGPHSRESSSTRYSASLKPHKQHKIDGSGPKGRKPWKEFDAIEEEGLLDGDNGPHGMSRRCYFLAFIVGFWILFSLFSLILWGASRPQKPTITMKNIIFDQFIVHAGMDFSGVATEMVSMNCTVKLTFRNTATFFGVHVTSTPLDLSYSELTVATGTISKFYQSRKSQRTLTVMVKGSKIPLYGGGASLSSLNGAPTQPVPLILNFMVRSRAYVLGKLVKPKFYKRIECSVVMDPKKMNVPISLKNKCTYQ

SEQ ID NO: 6681 - protein, 326 aa, Ricinus communis
MSSTHLSKTDSEVSSLTPSSPARSSSPPPRRPVYYVQSPSRDSHDGEKTTNSFHSTPVLSPMGSPPHSHSNSSLGPHSRESSSTRFSGSLKPQHHHRKTDGSNRKGARKPWKEFDAIEEECLLDGDVPPHVLTRRYYFLAFVGGFIVLFTMFSLILWGASRPQKPIITVKSIAFDQFVVQAGADFSGVATEMVSMNCTVKLTFRNTATFFGVHVTATPVHLSYSQLTVATGTVQKFYQSRKSQRSLTVMVKGNSTPLYGGGSSLGSLNGAPTQPVPLALNFTVRSRAYVLGKLVKPKFYKRVECWVVMDSHKMNVPISLKNKCTYQ

SEQ ID NO: 6682 - protein, 318 aa, Glycine max; identical to SEQ ID NO: 6679

SEQ ID NO: 6683 - protein, 317 aa, Glycine max; identical to SEQ ID NO: 6678

SEQ ID NO: 6684 - protein, 507 aa, Glycine max
MDPQAPATGTTVRSAAEPSQPQPPKPSPPLPLPPPSTSSTPPHPPPIPNPNPSPGPGPGPGPIQAPSPKPPTPTPTPPQPRPPQPFNRALPPPSQPQFPHFSSPSPPSSAPSAAPPPRGGMAIGVPAHHQSPSPPFSSSFGQHFGGLGRTAVNVAESTSNSSTSQARTPVQGMGMLGSQMRPSGIGSHQQRSVQSSLRPPTSAPNNQPAGSQSFQGHGLMRPSSVGSTATPSPSSSQSMQSLNQPWLSSGSQGKPPLPSAAYRQQLNPQSMQQRSHIPPMQQSTPTSSQQQQQQPLLSNQSQEHFGQQVPPSRAPLHMPHQPQVTRLQGPGNQKPSSLVAAQSSAAQPGTQSRLTNSDTDESSNSILSKRSIHELVNQVDPLEKLEPEVADILVDIAENFLESITRSGCSLAKHRKSTTLESKDILLHLEKNWNMTLPGFGGDEIKSYRRPITSDIHKERLAVIKKSMASTEAAHGKGSAGQASGSAKGNQGKTPLNIIGSPNLKNS

SEQ ID NO: 6685 - protein, 507 aa, Glycine max
MDPQAPATATTARSAAAEPSQSQPPKPSPPLPLPPPSTSSTPPISAPPQPPPNTNPSPNPNPSPAPGPGPIQAPSPKPPTPTPTTTPTPPQPFNRALSPPSQPQFPHYSSPSPPSSAPGAAPPPRGGMAIGVPAHHQSPSPPFSSSFGQHFGGLGRTGVNVAESTSNSSTSQVRTPVQGTGMLGSQMRPSGIGAHQQRPVQSSLRPPPPSAPNNQPAGSQSFQGHGLMRSSSVGSPATPSPSSSLSMQSLNQPWLSSGPQGKPPLPSAAYRQQLNPQSMQQRPHIPLQQQSTPTPLLANQSQEHFGQQVLPPRAPLHVPHQPQIMRVHGPGNQKPSSLVAAQSSAAQPGTRSRLTNTDTDESSNSILSKRSIHELVNQVDPLEKLEPEVADILVDIAENFLESITRSGCSLAKHRKSTTLEAKDILLHLEKNWNMTLLGFGGDDIKSYRRPTTSDIHKERLTVIKKSMAATEAAHGKGSAGQASGSAKGNQGKTPLNIIGLPNLKNL

SEQ ID NO: 6686 - protein, 492 aa, Glycine max; identical to SEQ ID NO: 6674

SEQ ID NO: 6687 - protein, 495 aa, Glycine max; identical to SEQ ID NO: 6673

SEQ ID NO: 6688 - protein, 512 aa, Homo sapiens [sequence omitted]

SEQ ID NO: 6689 - protein, 546 aa, Glycine max
MQKLLRPSSVPFLSISVTVATPFLSLPPKVANQPMSAAAAGSSLKRQLSYSRYLALSSTNTCSVCRCLSLTHTHSHPKNNKTLLLLNHSRNRSLHSASEGSFITQPDPVEYGSLVDSKEKPFNSRLNRRQKGSTSSSPAPSNPDLLAIPGVGPRNFRKLVQKGIAGVAQLKQLYKDKFFGKSSDKMVEYLQNSVGIIHKNHAESITTFIKQSVDEEELEDNSSSSVQKKRLTFCVEGNISVGKTTFLQRIANETIELRDLVEVVPEPISKWQDVGPDHFNILDAFYAEPQRYAYTFQNYVFVTRVMQERESSAGIKPLRLMERSVFSDRMVFVRAVHEANWMNGMEISIYDSWFDPVVSSLPGLIPDGFIYLRASPDTCHKRMMLRKRTEEGGVSLDYLCDLHEKHESWLFPSQSGNHGVLSVNQLPHHIDNSLHPDIRDRVFYLEGGHMHSSIQKVPALVLDCEPNIDFSKDIEAKRQYARQVAEFFEFVKKRNEVSSKEGSSQAQPQVLLPHEGGLWLPDGKPFPREALKSLDFRQAATSFMSG

SEQ ID NO: 6690 - protein, 544 aa, Glycine max
MQKLLRPSSSPVAILSISVTVATPFLSLPPKVSNLVPMSAAFTSSSLNPQLSYSRYLALSTNTCSVCRCLSLTHSHTRNNNKTLLLLNPSRNLSLHSASEGSFITQHDPVEDAKEKKPFNFRLNRRQKGSSSSSPAPSNPDLLAIPGVGPRNFRKLVQKGIAGVAQLKQLYKDKFFGKSSDKMVEYLQSSVGIIHKNHAESITTFIKKSVDDDEEKLEDNSSSSVQKKRLTFCVEGNISVGKTTFLQRIANETIELRDLVEVVPEPISKWQDVGPDHFNILDAFYAEPQRYAYTFQNYVFVTRVMQERESSVGIKPLRLMERSVFSDRMVFVRAVHEANWMNGMEISIYDSWFDPVVSSLPGLIPDGFIYLRASPDTCHKRMMLRKRAEEGGVSLDYLRDLHEKHESWLFPSQSGNHGVLSVNQLPHHIDNSLHPDIRDRVFYLEGGHMHSSIQKVPALVLDCEPNIDFSKDIEAKRQYARQVAEFFEFVKKRNEVSSKEGSSQAQPQVLLPHEGGLWLPDGKPFPQEALKSLDFRRAASFMSG

SEQ ID NO: 6691 - protein, 507 aa, Glycine max; identical to SEQ ID NO: 6685

SEQ ID NO: 6692 - protein, 507 aa, Glycine max; identical to SEQ ID NO: 6684

SEQ ID NO: 6693 - protein, 531 aa, Glycine max
MVRNESSNKEKDKDLDQFLFDRNDDDLVDEEQQEIEGVKYESESSSDGDDANRRAQPDSFSSQQWPQSYKETTDSYTIAAAPNFESVLRGPSFIYSSFDNRSKSNLDIDGKTPFLSAAEGIRQSTWWEKASVQRLVSGELPIGYGCSFTQTIFNGINVMAGVGLLSTPYTVNQAGWMSMAVMLLFAVMCCYTATLLRYCFENREEIITYPDIGEAAFGRYGRIAVSIILYTELYSYCVEFITLEGDNLTSLFPGTSLDLGGFQLDSMHLFGVLTALIILPTVWLKDLRIISYLSAGGVIATVLIIICVFCVGTIDGVGFHHTGQLVKWNGIPFAIGVYGFCFAGHSVFPNIYQSMADKKQFTKALIICFVLCVLIYGGTAIMGYLMFGDGTLSQITLNMPPGTFASKVALWTTVINKYALLMNPLARSLEELLPDRISSSYWCFILLRTTLVASTVCVAFLVPFFGLVMALIGSLFSILVSAIMPSLCFLKIIGKKATRTQVVLSVAIAAFGVICGILGTYSSLLSIADSY

SEQ ID NO: 6694 - protein, 548 aa, Glycine max
MVRNDSSNKEKEKNLDDQPLFDLNYDGDEEDAVVDKEQQEIEGVKYQSESSSDGDDDDGGGRHAANGRAQPDSFSSQQWPQSYKETTDSYTIAAAPNFESVLRGPSFIYSSFDNRSKSNLDIDGKTPFLSAPEGIRQSTWWEKASVERLVSGELPIGYGCSFTQTIFNGINVIAGVGLLSTPFTVNQAGWMSLAVMLLFAVMCCYTATLLRYCFESREGIITYPDVGEAAFGRYGRIAVSIILYTELYSYCVEFITLEGDNLTSLFPGTSLDLGGFKLDSMHMFGVLTALIILPTVWLKDLRIISYLSGGGVVATILIMICVFCVGTIDSVGFHHTGQLVKWNGIPFAIGVYGFCFAGHSVFPNIYQSMADKKQFTKALIICFVLCVLIYGGTASMGYLMFGDGTLSQITLNMPPGAFASKVALWTTVISLYNKYALLMNPLARSLEELLPDRISSSYWCFMLLRTTLVASTVCVAFLVPFFGLVMALIGSLFSILVSAIMPSLCFLKIIGKKATKTQVALSVAIAAFGVICGILGTYSSLLSIADSY

SEQ ID NO: 6695 - protein, 534 aa, Glycine max
MASNTNTNNSNKKEKDLEFFFEEDINELGAQQMDAETAKLESESSSSDDEGNDTTRRHSFTSQQWPQSYKETTDSYTLAATPNFESILRVPSIIYSSFESRSKNNLDIDGKTPFLSGHEGITQSTSWKEGLVQKHLSGELPIGRECSFLQTVFNATNVMAGVGILSTPYTLKEAGWMSMVLMVLFAVICCYTATLMRYCFESREGITSYPDIGEAAFGKYGRIIVSIILYTELYSCCVEFITLEGDNLTGLFPGTSLDLGSFRLDSVHLFGILAALIIIPTVWLKDLRIISILSAGGVFATLLIVVCVFCVGTINGVGFHHTGQLVNWSGIPLAIGIHGFCFAGHSVFPNIYQSMADKRQFTKALIICFVLSITIYGGVAIMGFLMFGGETLSQITLNMPRDAFASKVALWTTVINPFTKYALLMNPLARSLEELLPDRISSTYRCFILLRTALVVSTVCAAFLIPFFGFVMALIGSLFSVLVSVIMPSLCFMKIVGKKATATQVALSVVITTFGVICGILGTYSSVQNIVNSY

SEQ ID NO: 6696 - protein, 550 aa, Glycine max
MGRVWTSMIALLLCLMTSSVRGEDPYIYYTWNVTYGTIAPLGVPQQGILINGQFPGPEINSTSNNNVVINVFNNLDEPLLFTWHGVQQRKNSWQDGTLGAQCPIAPGTNYTYRFQVKDQIGTYFYYPTTGLQRAVGGFGGLRIFSRLLIPVPYADPADEYWVLIGDWFGKSHTALKQTLDSGRSIGRPSGVHINGKNGGLEALYTMEPGKTYKYRICNVGLKEALNFRIQGHPMKLVETEGSHVVQNTYDSLDVHVGQCFTVLVTADQEPRDYFMVASTRFTKKVITATRVIRYSNGVGPASPLLPPAPHQGWAWSLNQFRSFRWNLTASAARPNPQGSYHYGQINITRTIKLVGTRSKIGGKLRYALNGVSHVDPETPLKLAEYYGVADKVFKYNLISDAPDAAIASRDPIIAPNVINATFRNFIEVILENPTKVTQSYNLDGYSFFAVAVEPGQWSPEKRKCYNLLDAVSRHTIQVFPKSWAAIMLTFDNAGMWNLRSEMAENRYLGQQLYVSVLSPNRSLRDEYNLPETQLVCGIVKDMPKPPPYSS

SEQ ID NO: 6697 - protein, 539 aa, Glycine max
MALMLCLMAASVRSEDPYIYYTWKVTYGTIAPMGVPQQGILINGQFPGPEINSTSNNNVVINVFNNLDEPLLFTWHGVQHRKNSWQDGTLGVQCPIAPGTNYTYHFQVKDQIGTYFYYPTTGLQRAIGGFGGLRIFSRLLIPVPYADPADEYWVLIGDWFGKSHTALKQKLDSGRSIGRPVGVHINGKNGGLEPLYTMEPGKTYKYRICNVGLKDSLNFRIQGHPLKLVETEGSHVVQNNYDSLDVHVGQCYTVLVTADQEPKDYFMVASTRFTKKVLTATRVIRYSNGVGPASGGLPPAPQGWAWSINQFRSFRWNLTASAARPNPQGSYHYGQINITRTIKLVNTVSRANGKLRYGLNGVSHVDTQTPLKLAEYYGVADKVFKYNLISDSPDTAFPDLTVAPNVINATFRDFIEVIFENPGKVIQSYNLDGYSFFALAVEPGKWTPEKRKNYNLLDAISRHTIQVFPNSWAAIMLTFDNAGMWNLRSEMAENRYLGQQLYVSVLSPNRSLRDEYNLPETQLLCGIVKDMPKPPPYSS

SEQ ID NO: 6698 - protein, 549 aa, Medicago truncatula
MGRGAVLAFMLCLLGVTVYGEDPYIYYTWKVTYGTISPLGTPQQGILINGQFPGPEINSTSNNNVVVNVFNNLDEPLLFTWHGVQQRKNSWQDGTAGVQCPILPGTNYTYKFQVKDQIGSYFYYPTTGLQRAVGGFGGLRIFSRLLIPVPYADPEDEYWVLIGDWYGKSHKTLKMELDSGRSIGRPAGVIINGKNAKGDGSDEPLYTMKPGKTYKYRICNTGLKDTLNFRFQGHGMKLVETEGSHVVQNVYDSLDVHVGQCYTVLVTADKEPRDYYMIASTRMTKYNLLGKGIIRYTNGKGPASPVLPPAPVGWAWSLNQFRSFRWNLTASAARPNPQGSYHYGQINITRTIKFVNSVSNVNGKLRYAINGVSHVDPETPVKLAEYYGVADKVFKYNIISDEPPTDLKAITIAPNVMQTTFRTFIEIIFENPEKVLQSYNLGGYSFFAVAGEPGTWTPEKRKGYNLLDAISRHTIQVFPKSWAAIMLTFDNAGMWQLRSEHAEHRYLGQQLYLSVESEEKSTRDEYNLPETQLVCGIVKDMPRPPPKYV

SEQ ID NO: 6699 - protein, 549 aa, Medicago truncatula
MGRGAVLAFMLCLLGVTVYGEDPYIYYTWKVTYGTISPLGTPQQGILINGQFPGPEINSTSNNNVVVNVFNNLDEPLLFTWHGVQQRKNSWQDGTAGVQCPILPGTNYTYKFQVKDQIGSYFYYPTTGLQRAVGGFGGLRIFSRLLIPVPYADPEDEYWVLIGDWYGKSHKTLKMELDSGRSIGRPAGVIINGKNAKGDGRDEPLYTMKPGKTYKYRICNTGLKDTLNFRFQGHGMKLVETEGSHVVQNVYDSLDVHVGQCYTVLVTADKEPRDYYMIASTRMTKYNLLGKGIVRYTNGKGPASPVLPPAPVGWAWSLNQFRSFRWNLTASAARPNPQGSYHYGQINITRTIKFVNSVSNVNGKLRYAINGVSHVDPETPVKLAEYYGVADKVFKYNIISDEPPTDLRAITIAPNVMQTTFRTFIEIIFENPEKVLQSYNLGGYSFFAVAGEPGTWTPEKRKGYNLLDAISRHTIQVFPKSWAAIMLTFDNAGMWQLRSEHAEHRYLGQQLYLSVESEEKSTRDEYNLPETQLVCGIVKDMPRPPPKYV

SEQ ID NO: 6700 - protein, 549 aa, Medicago truncatula
MGRGAVLAFMLCLLGVTVYGEDPYIYYTWKVTYGTISPLGTPQQGILINGQFPGPEINSTSNNNVVVNVFNNLDEPLLFTWHGVQQRKNSWQDGTAGVQCPILPGTNYTYKFQVKDQIGSYFYYPTTGLQRAVGGFGGLRIFSRLLIPVPYADPEDEYWVLIGDWYGKSHKTLKMELDSGRSIGRPAGVIINGKNAKGDGSDEPLYTMKPGKTYKYRICNTGLKDTLNFRFQGHGMKLVETEGSHVVQNVYDSLDVHVGQCYTVLVTADKEPRDYYMIASTRMTKYNLVGKGIVRYTNGKGPASPLLPSAPVGWAWSLNQFRSFRWNLTASAARPNPQGSYHYGQINITRTIKFVNSVSNVNGKLRYAINGVSHVDPETPVKLAEYYGVADKVFKYNIISDEPPTDLRAITIAPNVMQTTFRTFIEIIFENPGKVLQSYNLGGYSFFAVAGEPGTWTPEKRKGYNLLDAISRHTIQVFPKSWAAIMLTFDNAGMWQLRSEHAEHRYLGQQLYLSVESEEKSTRDEYNLPETQLVCGIVKDMPRPPPKYV

SEQ ID NO: 6701 - protein, 549 aa, Medicago truncatula
MGRGAVLAFMLCLLGVTVYGEDPYIYYTWKVTYGTISPLGTPQQGILINGQFPGPEINSTSNNNVVVNVFNNLDEPLLFTWHGVQQRKNSWQDGTAGVQCPILPGTNYTYKFQVKDQIGSYFYYPTTGLQRAVGGFGGLRIFSRLLIPVPYADPEDEYWVLIGDWYGKSHKTLKMELDSGRSIGRPAGVIINGKNAKGDGSDEPLYTMKPGKTYKYRICNTGLKDTLNFRFQGHGMKLVETEGSHVVQNVYDSLDVHVGQCYTVLVTADKEPRDYYMIASTRMTKYNLLGKGIVRYTNGKGPASPVLPPAPVGWAWSLNQFRSFRWNLTASAARPNPQGSYHYGQINITRTIKFVNSVSNVNGKLCYAINGVSHVDPETPVKLAEYYGVADKVFKYNIISDEPPTDLKAITIAPNVMQTTFRTFIEIIFENPEKVLQSYNLGGYSFFAVAGEPGTWTPEKRKGYNLLDAISRHTIQVFPKSWAAIMLTFDNAGMWQLRSEHAEHRYLGQQLYLSVESEEKSTRDEYNLPETQLVCGIVKDMPRPPPKYV

SEQ ID NO: 6702 - protein, 545 aa, Medicago truncatula
MTRGAIIALMVCLMATAVRSEDPYVYYTWKVTYGNIAPLGTPQKGILINGQFPGPEINGTSNNNIVVNVFNNLDEPLLFTWSGIQQRKNSWADGTSGVQCPIAPGTNYTYKFQVKDQIGSYFYYPTTGLMRAAGGIGGIRVYSRLLIPVPYADPADEYWVLMGDWYGKSHTQLQKFLDSGRSMGRPDGVHIMGKSNSAEPLYKMEPGKTYKYRLCNVGLKDSLNFRIQDHPMKLVEMEGSHTVQNVYDSLDVHVGQCFSVLVTADKEPKQYKMVASTRFTKTVLTTTAVISYTNGNGPASPVLPPAPVGWAWSLNQVRSFRWNLTASAARPNPQGSYHYGQINITRTIKLVNNPFNIDGKLRYTLNGVSHEDDETPLKLAEYYGVANKVFQYDLTSDNPPAVIGNLRVEANVLNVTFRTFVEIIFENPTKVIQSYNLDGYSFFAVAVEPGKWTPEKRKNYNLLDAVSRHTVQVFPKSWAAIMLTFDNAGMWNLRSEMAENRYLGQQMYMSVLSPEKSNRDEYNLPDTHQVCGIVKDMPRPALQYT

SEQ ID NO: 6703 - protein, 550 aa, Medicago truncatula
MGRGAMLAALMLCLLGVTVYGEDPYIYYTWKVTYGTISPLGTPQQGILINGQFPGPEINSTSNNNVVVNVFNNLDEPLLFTWHGVQQRKNSWQDGTLGVQCPILPGTNYTYKFQVKDQIGSYFYYPTTGLQRAVGGFGGLRIFSRLLIPVPYADPEDEYWVLIGDWYGKSHKTLKMELDSGRSIGRPAGVIINGKNAKGDGSDEPLYTMKPGKTYKYRICNTGLKDTLNFRFQGHGMKLVETEGSHVVQNVYDSLDVHVGQCYTVLVTADKEPKDYYMVASTRMTKYNLLGKGIIRYTNGKGPASPMLPPAPVGWAWSLNQFRSFRWNLTASAARPNPQGSYHYGQINITRTIKFVNSVSNVNGKLRYAINGVSHVDPETPVKLAEYYGVADKVFKYNIISDEPPIDLRAITIAPNVMQTTFRTFIEIIFENPGKVLQSYNLGGYSFFVVAGEPGTWTPEKRKGYNLLDAISRHTIQVFPKSWAAIMLTFDNAGMWQLRSEHAEHRYLGQQLYLSVESEEKSTRDEYNLPETQLVCGIVKDMPRPPPKYV

SEQ ID NO: 6704 - protein, 552 aa, Glycine max
MKRVMLLVLSCLWIESLLTVVRGEDPYLYFTWNVTYGTISPLGIPQQGIFINGQFPGPNINSTSNNNLVINVFNNLDEPFLFTWNGIQHRKNSWQDGVAGTNCPIPPGTNFTYRIQVKDQIGSYFYYPSTAMHRAAGGFGGLRVNSRLLIPVPYPDPEDEYTVLIGDWYTKSHTILRKLLDSGRSLGRPEGVLINGKTAKGDGKDEPLFTMKPAKTYKYRICNVGLKNSLNYRIQGHSMKLVEMEGSHVVQNMYDSLDVHVGECFSVLVTADKEPKDYYMVASTRFTKTVLIGKGIIRYTNGKGPASPDIPPAPVGWAWSLNQFHTFRWNLTASAARPNPQGSYKYGQINITRTIKLVNSVSKSNGKLRYALNGVSHVDPETPLKLAEYFGISDKVFKYDTIPDNPSPNIGNAVTVQPNVLNITHRNFIEIIFENPEKTIQSYHLDGYSFFVLGIEPGTWTPEKRKSYNLLDAVSRHTVHVFPKCWAAIMLTFDNAGMWNLRSDIAESRYLGQQLYISVLSPEHSLRDEYNMPDSNLLCGLVKNLPKPAPYS

SEQ ID NO: 6705 - protein, 553 aa, Populus trichocarpa
MAGVMFLVLLCISAGTMLGVRGEDPYLFFTWNVTYGTLSPLGVPQQVILINNQFPGPNINSTSNNNIVINVFNNLDEPFLLTWSGIQQRKNSWQDGVLGTNCPILPGTNYTYHFQVKDQIGSYIYYPTTGMHRATGGFGGLRINSRLLIPVPYADPEDDYTVILNDWYSKSHTALQKLLDSGRTLARPDGVLVNGKNAKGDGKDEPLFTMKPGKTYKYRICNAGLKNTLNFRIQGHTMKLVEMEGSHVVQNVYESLDVHVGQCFSVLVTANQDPKDYYMVASTRFNKQVLTGKGIIRYTNGKGPASPELPEAPVGWAWSLNQFRSFRWNLTASAARPNPQGSYHYGSINITRTIKLINSASQEGGKLRYALNGVSHVNPETPLKLAEYYGVADKVFKYDTILDSPQANVANAKIVTQPNVLNLTFRNFVEIIFENHEKSMQSYHLDGYSFFAVAVEPGTWTPEKRKHYNLLDAVSRTTVQVYPKSWAAILLTFDNAGLWNIRSEMWERAYLGQQLYASVLSPARSLRDEYNLPDNSLLCGIVKDMPKPAPYSI

SEQ ID NO: 6706 - protein, 706 aa, Lotus japonicus
MEESSSMKISPLDLMSAMIKGTLDPSNVSSTSGAGSVFLENREFVMVLTTSIAVLIGCVVVFIWRRSTGNKAKSIEPPKRVVEKLSDEAEVDDGTRKVTIFFGTQTGTAEGFAKAIAEEAKVRYEKAKFKIVDMDDYAQDDDEYEEKLKKETLALFFLATYGDGEPTDNAARFYKWFLEGDEKEEGWLRNLEYAVFGLGNRQYEHFNKVAIEVDDKLADFGGKRLVKVGLGDDDQCIEDDFTAWKEELWPALDELLRGDDDTTVSTPYTAAVLEYRVVIHDPLDASVDEKKWHNVNGHAIVDAQHPVRSNVAVRKELHTPVSDRSCTHLEFDISGTGVAYETGDHVGVYCENLSETVEEAVRLLGLSPDTYFSVHTDDEDGKPLSGSSLPPTFPPCTLRTAIARYADVLSSPKKSVLLALAAHASNPSEADRLRHLASPAGKDEYSEWVIASQRSLLEVMAEFPSAKPPIGVFFAAIAPRLQPRFYSISSSPRMAPSRIHVTCALVNDKMPTGRIHRGVCSTWMKNSVPLEKSQDCSWAPIFVRQSNFKLPADNKVPIIMIGPGTGLAPFRGFLQERLALKEDGAELGPSVLFFGCRNRQMDYIYEDELNHFVNSGALSELIVAFSREGPTKEYVQHKMMEKASDIWNMISQGAYIYVCGDAKGMARDVHRTLHTILQEQGSLDSSKAEGMVKNLQLNGRYLRDVW

SEQ ID NO: 6707 - protein, 707 aa, Glycine max
MQDSSSMKISPLDLMSAIFKGKLDPSNVSSSTNAAAAAFLLENRDFLMLLTTSVAVLIGCVVVFIWRRSSSPKAKPLEPPKRVVEKLPEIEVDDGTKKVTILFGTQTGTAEGFAKATAEEAKARYEKATFRVVDMDDYAADDDEYEERFKKETHVLFFLATYGDGEPTDNAARFYKWFTEGGEKGEGWLQNLHYGVFGLGNRQYEHFNKVAKVVDDMLVEQGGKRLVPVGLGDDDQCIEDDFTAWKEELWPALDELLRDEDDATVSTPYTAAVLEYRVVIHDPLEASVDEKKWHNVNGHAIVDAQHPVRANVAVRKELHTPASDRSCTHLEFDISGTGVTYETGDHVGVYCENLSETVEEAIRLIGLSPDTYFSIHTDDEDGKPRSGSSLPPTFPPCTLRTALTRYADVLSSPKKSALLALAAHASDPSEADRLRHLASPAGKDEYSEWVIASQRSLLEVMAEFPSAKPPIGVFFAAVAPRLQPRFYSISSSPRMVPNRIHVTCALVHEKMPTGRIHKGVCSTWMKNSVPLEKSQDCSWAPIFVRTSNFRLPSDNKVPIIMIGPGTGLAPFRGFLQERLALKEGGAELGPSVLFFGCRNRQMDYIYEDELSHFVNTGALDELILAFSREGPTKEYVQHKMMEKASEIWSMISQGAYIYVCGDAKGMARDVHRALHTILQEQGSLDSSKAESMVKNLQTTGRYLRDVW

SEQ ID NO: 6708 - protein, 704 aa, Pisum sativum
MQDSSTMKFSPLDLMTAIIKGKFNPSNDSSQAPASIIFENREFVMILTTSIAVLIGCVVVLIWRRSNSNKSKQIEVPKLVIKKLPELDVDDGKKKVTVFFGTQTGTAEGFAKAIAEEAKARYEKAKFRVVDMDDYAADDDEYLEKLKRETMALFFLATYGDGEPTDNAARFYKWFTEEYEGEEDSFKNLSYGVFGLGNRQYEHFNKVAKVVDDKLLEQGGKRLVPVGLGDDDQCIEDDFTAWKEELWPALDQLLRDEDDTPVATPYTAAVSEYRVVIHDPLDATVDEKKRHNVNGHAVVDAQHPVRANVAVRRELHTPASDRSCTHLEFDISGTGVVYETGDHVGVYCENLSDTVEEAERILGLSPDTYLSIHTDDEEGKPLGGSSLPPPFPPCTLRTALTKYADLLSSPKKSALVALAAHASDPSEADRLRHLASPAGKDEYAEWVISSQRSLLEVMAEFSSAKPPIGVFFAAVAPRLQPRYYSISSSPRMAPSRIHVTCALVHDKMPTGRIHKGVCSTWMKNSVPLEKNQDCSWAPIFVRQSNFRLPADNKVPVIMIGPGTGLAPFRGFLQERLALKEDGAELGPSVLFFGCRNRQVDYIYEDELNHFVNGGALSELIVAFSRDGPTKEYVQHKMMEKASDIWNMISQGAYVYVCGDAKGMARDVHRTLHTILQEQGSLDSSKTESMVKNLQMTGRYLRDVW

SEQ ID NO: 6709 - protein, 707 aa, Glycine max
MQDSGSMKISPLDLMSAIIKGKLDPSNVSSSSSNAAAAVLLENRQFLMLLTTSVAVLVGCFVVFIWRRSSSPKAKPLEPPKRVIEKLPEIEVDDGTKKVTIFFGTQTGTAEGFAKAIAEEAKARYDKATFRVVDMDDYAADDDEYEERFKKETHALFFLATYGDGEPTDNAARFYKWFTEGGEKGEGWLENLHYGVFGLGNRQYEHFNKVAKVVDDMLAEQGGKRLVPVGLGDDDQCIEDDFTAWKEELWPALDDLLRDEDDTTVSTPYTAAVLEYRVVIHDPLEASVDEKKWHNVNGHAIVDAQHPVRANVAVRKELHTPASDRSCTHLEFDISGTGVTYETGDHVGVYCENLSETVEEAIRLIGLSPDTYFSIHTDDEDGKPLGGSSLPPTFPPCTLRKALAQYADVLSSPKKSALLALAAHASDPSEADRLRHLASPAGKDEYSEWVITSQRSLLEVMAEFPSAKPPIGVFFAAVAPRLQPRFYSISSSPRMVPNRIHVTCALVHDKMPTGRIHKGVCSTWMKNSVPLEKSQDCSWAPIFVRTSNFRLPADNKVPIIMIGPGTGLAPFRGFLQERLALKGGGAELGPSVLFFGCRNRQMDYIYEDELNHFVNTGALSELILAFSREGPTKEYVQHKMMEKASEIWSMISQGAYIYVCGDAKGMARDVHRALHTILQEQGSLDSSKAESMVKNLQTTGRYLRDVW

SEQ ID NO: 6710 - protein, 701 aa, Medicago truncatula
MQDSSSMKFSPLDLMSALIKGKIDPSNGTVPASLILENREFVMILTTSIAVLIGCVVVLIWRRSNSQKPKPIEVPKRVIEKLPELEIDDGTKKVTVFFGTQTGTAEGFAKAIAEEAKARYEKAKFKVVDMDDYAADDDEYEEKLKKETMALFFLATYGDGEPTDNAARFYKWFEEFEGEEDSFKNLQYGVFGLGNRQYEHFNKVAKIVDDKLLEKGGNRLVPVGLGDDDQCIEDDFTAWKEELWPALDQLLRDEDDATVATPYTASVLEYRVVIRDQLDATVDEKKQLNGNGHAVVDAHHPVRANVAVRKELHTPASDRSCTHLEFDISGTGVVYETGDHVGVYCENLSDTVEEAERILGLSPDTYFSVHTDDEDGKPLGGSSLPPPFPPCTLRTALAKYADVLSSPKKSALLALAAHASDPSEADRLRHLASPAGKDEYAEWVIASQRSLLEVMAEFSSAKPPIGVFFASVAPRLQPRYYSISSSPRVAPSRIHVTCALVHDKMPTGRIHQGVCSTWMKNSAPLEKSQDCSWAPIFVRQSNFRLPADNKVPIIMIGPGTGLAPFRGFLQERLALKEEGAELGPSVLFFGCRNRQVDYIYEDELNHFVHGGALSELIVAFSREGPTKEYVQHKMIEKASDIWNMISQGAYIYVCGDAKGMAKDVHRTLHTILQEQGSLDNSKTESMVKNLQMTGRYLRDVW

SEQ ID NO: 6711 - protein, 705 aa, Vitis vinifera
MQSSSVKVSPFDLMSAIIKGSMDQSNVSSESGGAAAMVLENREFIMILTTSIAVLIGCVVVLIWRRSGQKQSKTPEPPKPLIVKDLEVEVDDGKQKVTIFFGTQTGTAEGFAKALAEEAKARYEKAIFKVVDLDDYAGDDDEYEEKLKKETLGFFFLARYGDGEPTDNAARFYKWFAEGKERGEWLQNLKYGVFGLGNRQYEHFNKVAKVVDDIITEQGGKRIVPVGLGDDDQCIEDDFAAWRELLWPELDQLLRDEDDATTVSTPYTAAVLEYRVVFHDPEGASLQDKSWGSANGHTVHDAQHPCRANVAVRKELHTPASDRSCTHLEFDISGTGLTYETGDHVGVYCENLPETVEEAERLLGFSPDVYFSIHTEREDGTPLSGSSLSPPFPPCTLRTALTRYADVLSSPKKSALVALAAHASDPSEADRLKYLASPSGKDEYAQWVVASQRSLLEIMAEFPSAKPPLGVFFAAVAPRLQPRYYSISSSPKMVPSRIHVTCALVCDKMPTGRIHKGICSTWMKYAVPLEESQDCSWAPIFVRQSNFKLPADTSVPIIMIGPGTGLAPFRGFLQERFALKEAGAELGSSILFFGCRNRKMDYIYEDELNGFVESGALSELIVAFSREGPTKEYVQHKMMEKASDIWNVISQGGYIYVCGDAKGMARDVHRTLHTILQEQGSLDSSKAESMVKNLQMTGRYLRDVW

SEQ ID NO: 6712 - protein, 710 aa, Gossypium hirsutum
MDSSSSSSSSGPSPLDLMSALVKAKMDPSNASSDSAAQVTTVLFENREFVMILTTSIAVLIGCVVILIWRRSASQKPKQIQLPLKPSIIKEPELEVDDGKKKVTILFGTQTGTAEGFAKALVEEAKARYEKATFNIVDLDDYAADDEEYEEKMKKDNLAFFFLATYGDGEPTDNAARFYKWFTEGKERGEWLQNMKYGIFGLGNKQYEHFNKVAKVVDELLTEQGAKRIVPLGLGDDDQCIEDDFTAWRELVWPELDQLLRDEDDATVSTPYTAAVLEYRVVFYDPADAPLEDKNWSNANGHATYDAQHPCRSNVAVRKELHAPESDRSCTHLEFDIAGTGLSYETGDHVGVYCENLDEVVDEALSLLGLSPDTYFSVHTDKEDGTPLGGSSLPSSFPPCTLRTALARYADLLSSPKKAALLALAAHASDPTEADRLRHLASPAGKDEYAQWIVANQRSLLEVMAEFPSAKPPLGVFFAAVAPRLQPRYYSISSSPRLAPSRIHVTCALVYEKTPTGRIHKGVCSTWMKNAVSSGKSDDCGWAPIFVRQSNFKLPSDTKVPIIMIGPGTGLAPFRGFLQERLALKEAGAELGPSVLFFGCRNRKMDFIYEDELNNFVNSGALSELVVAFSREGPTKEYVQHKMMEKAKDIWDMISQGGYLYVCGDAKGMARDVHRALHTIFQEQGSLDSSKAESMVKNLQMSGRYLRDVW

SEQ ID NO: 6713 - protein, 712 aa, Populus trichocarpa x Populus deltoides
MESSSSSIKVSPLDLMQAIIKGKVDPANVSSESGGSVAEVATLILENREFVMILTTSIAVLIGCVVVLIWRRSSGYQRPKVPVPPKPLIVKDLEPEVDDGKKKVTIFFGTQTGTAEGFAKALAEEAKARYDKATFKTVDMDDYAGDDDEYEEKLKKEDLVIFFLATYGDGEPTDNAARFYKWFTEGNERGEWLKDLPYAVFGLGNRQYEHFNKIAIVVDKIFADQGGKRLAPVGLGDDDQCMEDDFAAWRELLWPEMDQLLLDGDDPTAVSTPYAATVSEYRVVFHSPEDAPLEDDNWSNANGHAVYDAQHPCRANVAVRRELHTPASDRSCTHLEFEISGTGLAYGTGDHVGVYCENLSETVEEALQLLGLSPDTYFSIHNDNEDGTPLSGGALPPPFPPSTLKTALARYADLLSLPKKSALMALAAHATDPTEADRLRHLASPAGKDEYAQLLVANQRSLLEVMAEFPSAKPPLGVFFASVAPRLQPRYYSISSSPRMAPSRIHVTCALVLEKTLGGRIHKGVCSTWMKNAVPLEKSHDCSWAPVFVRQSNFKLPADAKVPIIMIGPGTGLAPFRGFLQERLALKEAGSELGSSVLFFGCRNRKMDFIYEDELNNFVESGALSELVVAFSREGPTKEYVQHKMMQKASDIWNMISQGGYLYVCGDAKGMAKDVHRALHTIVQEQGSLDNSKTESFVKSLQMNGRYLRDVW

SEQ ID NO: 6714 - protein, 660 aa, Vitis vinifera
MILTTSIAVLIGCVVVLIWRRSGQKQSKTPEPPKPLIVKDLEVEVDDGKQKVTIFFGTQTGTAEGFAKALAEEAKARYEKAIFKVVDLDDYAGDDDEYEEKLKKETLAFFFLATYGDGEPTDNAARFYKWFAEGKERGEWLQNLKYGVFGLGNRQYEHFNKVAKVVDDIITEQGGKRIVPVGLGDDDQCIEDDFAAWRELLWPELDQLLRDEDDATTVSTPYTAAVLEYRVVFHDPEGASLQDKSWGSANGHTVHDAQHPCRANVAVRKELHTPASDRSCTHLEFDISGTGLTYETGDHVGVYCENLPETVEEAERLLGFSPDVYFSIHTEREDGTPLSGSSLSPPFPPCTLRTALTRYADVLSSPKKSALVALAAHASDPSEADRLKYLASPSGKDEYAQWVVASQRSLLEIMAEFPSAKPPLGVFFAAVAPRLQPRYYSISSSPKMVPSRIHVTCALVCDKMPTGRIHKGICSTWMKYAVPLEESQDCSWAPIFVRQSNFKLPADTSVPIIMIGPGTGLAPFRGFLQERFALKEAGAELGSSILFFGCRNRKMDYIYEDELNGFVESGALSELIVAFSREGPTKEYVQHKMMEKASDIWNVISQGGYIYVCGDAKGMARDVHRTLHTILQEQGSLDSSKAESMVKNLQMTGRYLRDVW

SEQ ID NO: 6715 - protein, 712 aa, Populus trichocarpa
MESSSSSIKVSPLDLMQAIIKGKVDPANVSSESGGSVAEVATLILENREFVMILTTSIAVLIGCVVVLIWRRSSGYQRPKVPVPPKPLIVKDLEPEVDDGKKKVTIFFGTQTGTAEGFAKALAEEAKARYDKATFKTVDLDDYAGDDDEYEEKLKKEDLVIFFLATYGDGEPTDNAARFYKWFTEGNERGEWLKDLPFAVFGLGNRQYEHFNKIAIVVDKIFADQGGKRLAAVGLGDDDQCMEDDFAAWRELLWPEMDQLLLDGDDPTAVSTPYAATVSEYRVVVHDPEDAPLEDDNWSNANGHAVYDAQHPCRANVAVRRELHTPASDRSCTHLELEISGTGLAYGTGDHVGVYCENLSETVEEALQLLGLSPDTYFSIHNDNVDGTPLSGSALPPPFPPSTLKTALARYADLLSLPKKSALMALAAHATDPTEADRLRHLASPAGKDEYAQLLVANQRSLLEVMAEFPSAKPPLGVFFASVAPRLQPRYYSISSSPSMAPSRIHVTCALVLEKTPGGRIHKGVCSTWMKNAVPLEKSHDCSWAPVFVRQSNFKLPEDAKVPIIMIGPGTGLAPFRGFLQERLALKEAGSELGSSVLFFGCRNRKMDFIYEDELNNFVESGALSELVVAFSREGPTKEYVQHKMMQKASDIWNMISQGGYLYVCGDAKGMAKDVHRALHTIVQEQGSFDNSRTESFVKSLQMNGRYLRDVW

SEQ ID NO: 6716 - protein, 549 aa, Glycine max
MEIQQSLKLTIHKKWPSSPKKPPKETEPITTTPTTPKLKWKKIFFQTKTKTQTQTPPEEFLCPISHSLMFDPVIVSSGHSFERSSVEACINVNFTPQLPDGTTPDFSTLIPNLALKSAILKWCQSTHTPPPPHPNNNNNHLVQTLISSNPSLKISDQDLILNSLNENPPLTNLRHHAETEVPIRRTHLYTSSDESIATTSASTPPLQLSTRPSCCYYSSPSSSELEPATTPEEEEIMTKLKNPQHSIIEEALISLRKLTRIREETRLQLCTPRLLSALRSLVLSKHVNVQVNALASVVNLSLEKSNKVRIVRSGMVPPLIEVLKFGSSEAQEHGAGALFSLAMDDDNKTAIGVLGGLAPLLHMLRSESERTRHDSALALYHLSLVQSNRSKMVKLGSVPVLLSMVKSGHMMGRVMLILGNLGSGSDGRAAMLDAGVVECLVGLLSGPEPGTGSTRESCVAVMYALSHGGLRFKAVAKAAGVVEVLQKVEKMGSERARRKVRKILEIMRTKEVEEEDVDWEELLDSGLGCRTRSRLGGGLDESSANSAEF

SEQ ID NO: 6717 - protein, 557 aa, Glycine max
MEIQQSLKLTIHKKWPSSPKKPPKESEPITPTPNTPKLKWKKIFFQTKTKTQIQTPPEEFLCPISRSLMFDPVIVSSGHSYERSSVEACKNVNFTPQLPDGTTPDFSTLIPNLALKSAILKWCQSTHTPPPHPNNNPVQTLISSNPNLVHTINPSNTNLKISDKDLILNSLNENPPVKNLCHHAETEVPIRPTHLYTSSEESIATTSASTPPLQFSTRPSCCYYSSPSSSELEPATIPEEEEIMTKLKNPQLNAIEEALISLRKLTRIREETRLQLCTPRLLSALRSLVLSKHVNVQVNALASVVNLSLEKSNKVKIVRSGMVPPLIEVLKFGSSEAQEHGAGALFSLALDDDNKTAIGVLGGLAPLLHMLRSESERTRHDSALALYHLSLVQSNRSKMVKLGSVPVLLNMVKSGHMTGRVLLILGNLGSGSDGRATMLDAGMVECLVGLLSGAESRSGSTRESCVSVMYALSHGGLRFKAVAKVAGVMEVMQKVEKVGTERARNKVRKILEIMRAKEVEEEDHVDWEELLDSGLPCRTRTRLGAGLDDSTPNSAQF

SEQ ID NO: 6718 - protein, 302 aa, Glycine max
MTLLSSHLLVFSAVHHRAPPTTTTRNSPTTNHTVRFLCSPGVPPAVRLDQRLPRFVVPGAGAEDLLYNAGATVGVLGGGYALVRAFDELTRRNILQQGLSRKLVHILSGLLFLVSWPIFSNSPKARYFAAFVPLVNCLRLLVNGLSLASDEGLIKSVTREGDPLELLRGPLYYVLILILSALVFWRESPIGVISLAMMCAGDGIADIIGRRYGSMKIPYNEHKSLAGSMSMLVFGFLVSIGMLYYYSVLGHVQLDWASTLPRVAFISFVATLVESLPITKVVDDNISVPLATMAVAFFTFHH

SEQ ID NO: 6719 - protein, 298 aa, Glycine max
MTLLSSPLLVFSAVHRRAPPPSTTTPTTNHTVRFLCSPDVPAVRLDQRLPRFVVPVAAEDLLYNAGATVGVLGGGYALVRAFDELTRRNILQQGLSRKLVHILSGLLFLVSWPIFSNSPKARYFAAFVPLVNCLRLLVNGLSLASDEGLIKSVTREGDPLELLRGPLYYVLILIFCALVFWRESPVGVVSLAMMCAGDGIADIIGRRYGSLKIPYNQHKSLAGSMSMLVFGFLVSIGMLYYYSVLGHVQLDWASTVPRVAFISFVATLVESLPITKVIDDNISVPLATMVVAFFTFHH

SEQ ID NO: 6720 - protein, 755 aa, Glycine max
  misc_feature (533)..(539): Xaa can be any naturally occurring amino acid
MASSTVVPVPPVPVEGGKPSRGVSIRSRLSKLCQQGQPHLARHLLDTLPRASSAVWNTVIIGFICNHMPLEALHLYAEMKSSPDTPSDCYTFSSTLKACSLTQNLLAGKAIHSHFLRSQSNSRIVYNSLLNMYSVCLPPSTVQSQLDYVLKVFAFMRKRNVVAWNTLISWYVKTHRQLHALRAFATLIKTSITPTPVTFVNVFPAVPDPKTALMFYALLLKFGADYANDVFAVSSAIVMFADLGCLDYARMVFDRCSNKNTEVWNTMIGGYVQNNCPLQGIDVFLRALESEEAVCDEVTFLSVICAVSLLQQIKLAQQLHAFVLKSLAVTPVIVVNAIMVMYSRCNFVDTSLKVFDNMPQRDAVSWNTIISSFVQNGLDEEALMLVCEMEKQKFPIDSVTATALLSAASNIRSSYIGRQTHAYLIRHGIQFEGMESYLIDMYAKSRLVRTSELLFEQNCPSDRDLATWNAMIAGYTQNGLSDKAILILREALVHKVMPNAVTLASILPACSSMGSTTFARQLHAFAIRHSDDXXXXXXXALALYDSMLRCGIKPDAVTFVAILSACSYSGLVEEGLHIFESMDKVHQVKPSIEHYCCVADMLGRVGRVVEAYEFVQRLGEDGNAIEIWGSILGACKNHGYFELGKVIAEKLLNMETEKRIAGYHVLLSNIYAEEGEWENVDRVRNQMKEKGLQKEMGCSWVEIAGCVNFFVSRDEKHPQSGEIYYILDKLTMDMKDAGYKPCNNSNLNRILESSD

SEQ ID NO: 6721 - protein, 828 aa, Medicago truncatula
MNESNAITRIGTSPIIPLPISTTHPPNQIHTLPNQKQKQKQKQWNKAISTSIRSRLSKLCREGQPHLALHLLDSLPRPSTVVWNSVIIGFICNNLPHQALLLYAKMRSNSSCSTFDPYTFSSTLKACALTKDILTGKAIHSHFLRSHSNTNTGPSRIVYNSLLNMYASCQHEYALNVFDVMRRRNVVAWNTLILSFVKMNRYPQAVEAFANMINQSVMPSPVTFVNLFPALSKLGDSRTVKMFYGFMRKFGDQYVSDVFVVSSAILMFSDVGCMDYARMVFDRCLNKNTEIWNTMIVAYVQNNCPVEAIDVFIQALESEEGVCDDVTLLSVLTAVSQLQQIKLAEQFHAFVIKSLPGSLIIILNAVMVMYSRCNHVDTSLKVFDKMLERDAVSWNTIISAFVQNGFDEEALMLVCEMQKQKFLIDSVTATALLSAASNLRNLYVGKQTHAYLIRRGIQFEGMESYLIDMYAKSGSIRTAELLFEQNCSSDRDQATWNAIIAGYTQNGLNEKAILLLKQMLVQNVIPNAVTLASILPACSSMGSMGLARQLHGFSIRRFLEKNVYVGTSLTDTYSKCGAISYAENVFLRTPEKNSVTYTTMMMCYGQHGMGKRALTLYDSMLRSGIRPDAVTFVAILSACNYSGLVDEGLQIFESMEKVHKIKPSIEHYCCVADMLGRVGRVVEAYEFVKGLGEDANTMEIWGSLLGSCRNHGHFELGKAVAKKLLNMGMDKRMAGYHVLLSNIYAEEGEWEKVDRVRKQMKEKGLHKETGCSWVEIAGFVNCFVSRDEKHPQSSEIYYMLDMLTLDMKYAGYKPQYSLNLNTILDSDE

SEQ ID NO: 6722 - protein, 342 aa, Glycine max
MEFGENNMFSLNTHTKEENGNTGGNSNNNNIVNVWYSSWDATTTTNAPHTTTAAEGYAGGGHRLHHHQLYGGEGCHVQADPHLTCLHLGKRHYFEDATNGDDANNVTSLGNRHVCGGGGAGFVFAGNDKRARGYYGGGGGGAGGGGGGGKSAPFAMVPRCQVEGCHVALVNAKEYHRRHRVCDKHSKAPKAVVLGLEQRFCQQCSRFHVVSEFDDSKRSCRRRLAGHNERRRKSSHLSVTRNSRQGCALSLLSSGSSSENWLSHHADFSTRCSAALRELIAENRAALITRQQQLVYDRDWPHVVPHHDAAVEEEEEDFEDLQQQQQPPEPNYFPQQHMFPQT

SEQ ID NO: 6723 - protein, 342 aa, Glycine max
MDFGENNMFSLNTHTKEENENTPNNNNNIVNVWYSSWDATTTNSNTLHTSTTAAEGYAGGSHSHHHQQLYGGEGCHVQADPHLTCLHLGKRHYFEDVTTNGDVNNATPLGNRHVCSGGGAGYVFAGNDKRGRGYYRGGGAAGGGKTAPFAMVPRCQVEGCHVALVNAKEYHRRHRVCDMHSKAPKAVVLGLEQRFCQQCSRFHVVSEFDDSKRSCRRRLAGHNERRRKSSHLSVTRNSRQGCALSLLSSGSGSRDHHNWLSHHADFSTRCSAALRELIAENRAALMTRQQQQLVYDRVWPHLVVAPHHDADAAVEEEDFEDLQQQQQPESNYFPQHMFPQTQ

SEQ ID NO: 6724 - protein, 359 aa, Glycine max
MASDAKLSSSESLNGLKFGQKIYFEDVGLATPATSLTSSSSSSSAATVTSSSSSRKGRGGSVQPAQPPRCQVEGCKVDLSDAKAYYSRHKVCGMHSKSPSVIVAGLQQRFCQQCSRFHQLPEFDQGKRSCRRRLAGHNERRRKPPTSSLLTSRYARLSSSAFDNSGRGSNFLMELTSYPKLSLRNSLPTPRSSELAPGNQTSTLSWNGNSETSSDLFLQGSVGGTSFASPGHPPGESYIGVTDTSCALSLLSNQTWGSRNTAPSLGLSNMINFNGTPLTQLAASSHGASIHQLPNTSWFFKGIDSGNCSPEVVPDLGLGQISQPLNSQLHGELDLSQQGRRHYMDLEQSRAYESAHWSL

SEQ ID NO: 6725 - protein, 359 aa, Glycine max
MASDAKLSSSESLNGLKFGQKIYFEDVGFATPATSLTSSATTATTVTSSSSSSSRKGRGGSVQPAQPPRCQVEGCEVDLSNAKTYYSRHKVCGMHSKSPTVIVAGLQQRFCQQCSRFHQLPEFDQGKRSCRRRLAGHNERRRKPPPSSLLTSRYARLSSSAFDHSGRGGNFLMELASYPKLSLRNSLPTPRSSELAPGNQTSTLSWHGNSETSSDLFLQGSVGGTSFAGPGHPPGESYTGVTTSSCALSLLSNQTWGSRNPAPSLGLNNMVNFHGTPMTQPAASSHGASIHQLPNTPWCFKGIDSGNCSPEGVPDLGLGQISQPLSSQLHGELDLSQQGRRHYMDLEQSRAYESAHWSL

SEQ ID NO: 6726 - protein, 359 aa, Glycine max; identical to SEQ ID NO: 6725

SEQ ID NO: 6727 - protein, 359 aa, Glycine max; identical to SEQ ID NO: 6724

SEQ ID NO: 6728 - protein, 365 aa, Glycine max
MDWDGKEFAWDPRGLELLANGEGQKSEAASVDLRLGGEKIAPDVAKDTKESKTVSSPSGSSKRSRLQNGSQNMCCSVDGCNSDLSDCRDYHRRHRVCEKHSKTPVVLVGGKQQRFCQQCSRFHSLGEFDEVKRSCRKRLDGHNRRRRKPQPPSLFMAAEKFMYNYKGPRILHFGSPEAYANPIMRNMWPAAAKTGAESGYDPPRLLYRIDKHKQDKGHPLWQENDPKVGSGDEAMPGTPICQPIHGTIAPSTGGKSTRKLSTDAKPGSFDSGCALYLLSTLQSQSPELSMAQSSITCPMQSPSGSVHFDAVNEYSCSETEKDKPSGQVLVFDANTTNLHYNGMLQMGLDGLVENEDPLTLPFLWE

SEQ ID NO: 6729 - protein, 365 aa, Glycine max
MDWDGKEFAWDPRGLELANGEGQKSEAASVDLRLGEEKTAPDVVAKDTKDSKTVSSPSGSSKRSRLQNGLQNMCCSVDGCNSDLSDCREYHRRHRVCEKHSKTPVVMVGGKQQRFCQQCSRFHSLGEFDEVKRSCRKRLDGHNRRRRKPQPPSLFMAAEKFMYNYKGPRILHFGSPEAYANPIMRDMWPAAAKTGAESGHDSPRLLYRIDKHKQDKGHPLWQENDPKVGSGDEAMPGTPICQPIHGTIAPSMGGKSNRKLSTDAKPGSFDSGCALYLLSTLQSQSPELSMVQSSITCPVQSPSGSVHFDAVNEYACSETERDKPSGQVLVFDAKTTNLHYNGMLQMDLDGFVENEDPLALPFLWE

SEQ ID NO: 6730 - protein, 436 aa, Glycine max
MEWNAKSLGQWDWEHLFFNTKAAENPRLQPTDCSSEADPEINVGLLYPSGGSACSGSELIHASSSRSSKSASNNSSSNGDSRESILTLEGSQDDSTGKKELCNGEPVETSPAAVPSPVSGEPLLTLKLGKRLYFEDVCTGSDSKKPSSFEVPILSGKKYKTSSQTVQHPSCQVEGCGLDLSSAKDYHRKHRVCEAHSKSPKVVIAGLERRFCQQCSRFHALSEFDDKKRSCRQRLSDHNARRRKTQPDSIQLNPSALSSSPYDGRQIMSPFAFSRTATNLAWQDMHSSKHPQTKEFLPKPAKAFNKIPSIVSMLSDDSSGLLTSRGIATKSIRIIVAGMEVPNGTQDVNRALSLLSTNSSWCPYETKSLSLEHSTRTTHSITQHRLPLPSSEYWHTDQQNSSMCISFSDCDSSNRFQDFQLLSSPYESGFPCNQLD

SEQ ID NO: 6731 - protein, 443 aa, Glycine max
MECNAKSLGQWDWEHLFFFNTKAAENPRLQPTDCSSEADREINVGMLHPSGGSACSGSELIHASSSRSSKSASNNSSSNGDSKASILTLEGSHDDSTGKKELCNGEPIETSPAAVPSPVSGEPLLTLKLGKRLYFEDVCTGSDSKKPSSFDIPISSGKKHKTSSQTLQHPSCQVEGCGLDLSSAKDYHRKHRVCEAHSKSPKVVITGLERRFCQQCSRFHALSEFDDKKRSCRRRLSDHNARRRKPQPDSIQLNPSALSSSPYDGRQIVSPFAFSRTATNLAWQDMHPQTKEFLPKPAKAFNKIPSIVSMLSDDSSGLLTSRGIATKSTVPDVAGMEDPIRLSDPNGTQDVNRALSLLSTNSSSSWGAYETKSLSLEHSTRATHSITQHHLPLPSSAEYWHTDHQQHSSMCISFTDCDSSNRFQDFQLLSSPYESPFPCNQLD

SEQ ID NO: 6732 - protein, 443 aa, Glycine max
MECNAKSLGQWDWEHLFFFNTKAAENPRLQPTDCSSEADREINVGMLHPSGGSACSGSELIHASSSRSSKSASNNSSSNGDSKASILTLEGSHDDSTGKKELCNGEPIETSPAAVPSPVSGEPLLTLKLGKRLYFEDVCTGSDSKKPSSFDIPISSGKKHKTSSQTLQHPSCQVESCGLDLSSAKDYHRKHRVCEAHSKSPKVVITGLERRFCQQCSRFHALSEFDDKKRSCRRRLSDHNARRRKPQPDSIQLNPSALSSSPYDGRQIVSPFAFSRTATNLAWQDMHPQTKEFLPKPAKAFNKIPSIVSMLSDDSSGLLTSRGIATKSTVPDVAGMEDPIRLSDPNGTQDVNRALSLLSTNSSSSWGAYETKSLSLEHSTRATHSITQHHLPLPSSAEYWHTDHQQHSSMCISFTDCDSSNRFQDFQLLSSPYESPFPCNQLD

SEQ ID NO: 6733 - protein, 460 aa, Medicago truncatula
MEWNVKSPGQWDWENLFFLNSKAAETHRLQSTDWSMEEDREINVGMLIPSGGSGYSVSKLMHASSSRSSKSASNNSSSNEDSKTSMLTQEGSPDNSTGKKESSKGDPIETSPAAEPLLTLKLGKRLYFEDVSTGSHSKKASSSAVPLLCGKKGKSSSQNMLNPSCQVEGCGLDLSFAKDYHRKHRICDSHSKSPVVVVAGLERRFCQQCSRFHDLSEFDDKKRSCRRRLSDHNARRRKPQPEAVKLNPSALSSSPYGINIKSPSPKRSINGRQAMGPFAFPKNTSNLAWPDMPNSKLPQTKDFMLKTPKNFNKIVTMLSDDSSGHFISKGKGTNIAVPETTVIHIDRIHITGLEDPNTLSDPSATQDVNRALSLLSTNSWGAYDTKPPSFVHSNRTTGTPQYATAQRSPFSSPEYWHTDQHQASSSACISFSGYDNSNRYQDFQLFSEPYESSFPCNQLD

SEQ ID NO: 6734 - protein, 221 aa, Helianthus annuus
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDMAAQQQHEAELAAAASQPLPDDDDDAFE

SEQ ID NO: 6735 - protein, 260 aa, Vitis vinifera
MVPHPINTLALASSSLSRALSLSGPPSLRCSTEDCYDRYMALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVHIDLAAQQQHEAELAAAASQPLPDDDDDAFE

SEQ ID NO: 6736 - protein, 221 aa, Vitis vinifera
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVHIDLAAQQQHEAELAAAASQPLPDDDDDAFE

SEQ ID NO: 6737 - protein, 254 aa, Vitis vinifera
MFVFGFIIKPSRSCLSPSFSSHSLCGRIFTGVNMALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVHIDLAAQQQHEAELAAAASQPLPDDDDDAFE

SEQ ID NO: 6738 - protein, 267 aa, Vitis vinifera
MQSRQTKAKPQAHRFYLSTIKTLLSIYKRNSNSHSSLRLSFSLFIHMALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDMAAQQQHEAELMAAAAQPLPDDDDDAFD

SEQ ID NO: 6739 - protein, 221 aa, Arabidopsis thaliana
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDLAAQQQHEAELAAAASQPLPDDDDDTFE

SEQ ID NO: 6740 - protein, 221 aa, Glycine max
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLAAQQQHEAELLAAASQPLPDDDDESFE

SEQ ID NO: 6741 - protein, 221 aa, Dimocarpus longan
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDLAAQQQHEAELQAAASQPLPDDDDDAFE

SEQ ID NO: 6742 - protein, 221 aa, Arabidopsis lyrata subsp. lyrata
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDIAAQQQHEAELAAAASQPLPDDDDDTFE

SEQ ID NO: 6743 - protein, 221 aa, Vitis vinifera
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDMAAQQQHEAELMAAAAQPLPDDDDDAFD

SEQ ID NO: 6744 - protein, 396 aa, Glycine max
MDWNLKAPSWDLSEVDQANLPNMETMEGSSRYGMYRTKGEFSVDLKLGQVGNSGRESSVLTKSKDGGAVGVSKMISSSSSGSAKRARSLSNGTQTVSCLVDGCHSDLSNCRDYHRRHKVCEVHSKTAQVTIGGQKQRFCQQCSRFHSLEEFDEGKRSCRKRLDGHNRRRRKPQPEVVLTRSASFLSNYHQGTQLLSFSSSHVYPSTTVVNPTLGGVVTSGDVRLHGQNHHHHQMHLVDKQDLFLGSSPTGYKEGKHLAFMQGDHTLNNQSPHLPGASVGPAQMFLRTSPYSESGGLRCKMFCDSLTGSAHGNTSRALSLLSSPPQPHSPGNGLNQMVNPHSPLMQPLGLSLHDNSLGSVDPVLGPNGSDHSSSMHHIGSNGSQVNEAPPLFPFQWE

SEQ ID NO: 6745 - protein, 390 aa, Glycine max
MDWNLKALSWDLSEVDQANLPNMETMEGSSRYGMYRTKGEFSVDLKLGQVGNSGTESVLTKSKDAVGVSKMTSSSTSGSSKRARALSNGTQTVSCLVDGCHADLSNCRDYHRRHKVCEVHSKTAQVSIGGQKQRFCQQCSRFHSLEEFDEGKRSCRKRLDGHNRRRRKPQPESLTRSGSFLSNYQGTQLLPFSSSHEYPSTTVVNPTWGGVLTTSGDVRLHGHNQHHHQVHLADKQDLFLGSSPAGYKEGKQLAFMQGDHTLNNRSPHLPGASVGQAQMFLRTSLYSESDGLRCKMFCDSLTSSIQDNNTSRALSLLSSPPQPLSPGNGLNLMVNSHSPLMQPLGLSLHDNSLGSVDPVLGPNDSSSMYNIGSNGSQGNEAPPLFPFQWE

SEQ ID NO: 6746 - protein, 210 aa, Glycine max
MAAEKFMYNYKGPRILHFGSPEAYANPIMRNMWPAAAKTGAESGYDPPRLLYRIDKHKQDKGHPLWQENDPKVGSGDEAMPGTPICQPIHGTIAPSTGGKSTRKLSTDAKPGSFDSGCALYLLSTLQSQSPELSMAQSSITCPMQSPSGSVHFDAVNEYSCSETEKDKPSGQVLVFDANTTNLHYNGMLQMGLDGLVENEDPLTLPFLWE

SEQ ID NO: 6747 - protein, 358 aa, Glycine max
MGSASVTKAPPSSSSSPNSSSTESLDGLKFGQKIYFEEVSVAAAAATTTQGGNKTRGGVSASKKGRGGSVQAPRCQVAGCKVDLSGAKAYYSRHKVCAMHSKSPTVTVAGLEQRFCQQCSRFHLLSEFDQGKRSCRKRLAGHNERRRKPPPSSVLTSRYGRLSLPIFDNNGRDDGFLMEFASYPKLTLRNTLPTQRSTEPAPGNHAATLTWQGGSDTPSEFFLQGSGSSGGTSFLSSKHPLVESYTGVTDSNCALSLLSSQTWGSRNTAPATSFELNNNLFNFNGTSMTQFAVASLQAAAIHQLPNATSWLYLKGVDSGNCSPERVPNHGLAQISPPLHSHVHSELDVSQQGRRHYMI

SEQ ID NO: 6748 - protein, 373 aa, Glycine max
MSSGSVTKAPPPSSSSSPNSSSESLDGLKFGQKIYFEDVSVAATTTTQGAYKTSRVVSSPSSASKKGRGGSLQPPRCQVEGCKVDLSGAKAYYSRHKVCTMHSKFPTVIVAGLEQRFCQQCSRFHLLSEFDEGKRSCRRRLAGHNERRRKPPPSSTLASHYGRLSTPIFDNSGRAGGFLMEFASYPKVTLRNTLPTQRSAEPALGNHAATLTWQGSSDTPSEFFLQESGSGGTSFLGSKHPLLESYTGVTDSNCALSLLSRQTWGSRNTAPATSVELNNNLLNFNGTSMTQFSAASSQTAAIHQLPNATSWLYLKGVGSGDCSPEGVPDLGLGQISPPLDSHLHGELNVSQQGRRHYMDLGESRACESSHWSL

SEQ ID NO: 6749 - protein, 365 aa, Glycine max; identical to SEQ ID NO: 6729

SEQ ID NO: 6750 - protein, 365 aa, Glycine max; identical to SEQ ID NO: 6728

SEQ ID NO: 6751 - protein, 802 aa, Glycine max
MEGEGSIHVQVDELQRMRLSETISIGTTMFEPRGLSSIDKLDSNNSTANSVSSTTSAPEKKLTLFALQLAVLEKAATGLGTLGFIWATVVLLGGFAITLEKTDFWFITIILVVEGTRIFSRSHELEWQHQATWSITEVLVTPSTKVLREIFKNHHHQYVSTDTTPTRTRTRMWVSSDVPLLPYAKWFFLSRHVSRLLYWLQLLSATACVVLSLIKLVKHDYGEVAKGDTDKRNRKSALSIFYALALSEALLFLMEKAYWEWQVSYCKLLEEVNKECELGPSGMVSTRRLFYDAYSRCVNGSIFDGLKMDMVGFSMDLLASNSPDEQLIGARILRQFSISERFCDDTLQKIGIDISMVERLVEMLNWTDFKDEEIRLSAAEILSKLAGKKQNSLRIAGIPGAMESISSLLQTNRSVIPAADEIGEKKLVFDHQNYGFWTFNHLGLLILKKLARDLDNCGKIGNTRGLLPKIIDFTHAEEWLLKSENVTPSQVLTLKRSLQLVKMLASTVGTTGKHLRREIAEIVFTISNIRDILRHGEKHPLLQKLCIEILTSLALEEDATERIGGTGGVLKELFNIFFKHNIPENQKHVKIVAGEALAMLALESKSNCHRILKLKVLEKLAEALKDPLLRVNAARILRNLCTYSGSEWFIQLKGVTTAAPIILRAIMSEDNKIQEVMIGLAANVFRYMTSHESSIVFEEAGITEAELANKLVQILKKYQYPPTKIPRIRRFVIELAIWMMKDKAENIETFKGLGMEEVLEGVLETTSELESFNVFSGTVGLNRHTLTTQSLVEMALKLMEDS

SEQ ID NO: 6752 - protein, 787 aa, Glycine max
MEGEGSIHVQVDELQRVRLSETISIGTTMFEPRGLSSIDKLDSNNSTANSVSSTTSAPEKKLTLFALQLAVLEKAATGLGTLGFIWATVVLLGGFAITLEKTDFWFITIILVVEGTRIFSRSHELEWQHQATWSITEVNHQHQYVSTDTTPTRTPTRMWISSDVPLLPYAKWFFLSRHVSRLLYWLQLLSATACVVLSLIKLVKHDYGEVAKGDTDKRNRKSALSIFYALALAEALLFLMEKAYWEWQVSYCKLLEEVDKECELGSSGMVSTRRFFYDAYSRCVNGSIFDGLKMDMVGFSMDLLASNSPDEQLIGARILRQFSISERFSDDTLQKIGIDISMVERLVEMLNWTDPKEEEIRLSAAEILSKLAGKKQNSLRIAGIPGAMESISSLLQTNRSVIPAADEIGENKLLFDHQNYGFWTFNHLGLLILKKLARDLDNCGKIGNTRGLLPKIIDFTRAEEWLLKSENVTPSQVLTLKRSLQLVKMLASTDGTTGKHLRREISEIVFTISYIRDILRYGEKHPLLQKLSIEILTSLALEEDATERIGGTGGVLKELFNIFFKHNIPENQKHVKIVAGEALAMLALESKSNCHRILKLKVLERLVEALKDPLLRVNAARILRNLCTYSGSEWFIQLKGVTAAAPILQAIISEENKIQEVIVGLAGNVFRYMTSHESSIVFEEAGITEAELANKLVQILKKHQYPPTKVPRIRRFVIELAIWMMKDKAENIDTYKGLGMDEVLEGVLETTSELESFNVFSGTVGLNRHTLTTQSLVEMALKLMEDR

SEQ ID NO: 6753 - protein, 822 aa, Glycine max
MDRRLSVKIEGEGSVHIQVAELHRLSETSKTSTMFEPRGLSSIEKRDSDAADNYSFSSATARAPEKKLTLFALRLAVLEKAATSLGTLGFIWATVVLLGGFAITLDKTDFWFITIILLIEGTRIFSRSHELEWQHQATWSITEVGINSFRMLRSSPNLLLQSIKSLFRPIVIKKQRRDMVEANVTPRTPTRMWISSDVPLLPYARWFFLSRHISKLLYWLQLFSAMACVVLSSMKLIKHNYGEVAKGDTDKRNRESALNIFYALALAEALLFLMEKAYWEWKISYCKLLDEVNKECGLGPSGMVSIRRFFYDSYSRCVNGSIFDGLKMDIVCFAMDLLASNSPDEQLIGGRILRQFAVSERFSDDTLQKLGISISVVERLVEMLNWTDHKEEEIRLSAAEILSALAGKKQNSLRIAGIPGAMESISSLLQTNRNCIHAADEIGEKKLIFDHPNYGYWTFNHLGLLILKKLARDHDNCGKIGNTRGLLPKIIDFTHAEEGLLKNENVTPSQILTVKRSLQLVKMLTSTTGTYGKHLRREISEIVFTISNIRDILRHGEKHPLLQKLSIEILTSLALEEEATERIGGTGGVLKELFNIFFKDCIAENQKDVTTVAGEALAMLALESKNNCHRILKLKVLERLIEALKFPLLRVNAARILRNLCTYSGSEGFKQLMGVTAAAPTVLQAIMSQENKLQEVMIGLAASVFTFMTSSESSTVFEESGITEAELANKLIHILKKHRYPPTKVPRIRRFVIELAIWMMKEREENIHTFKDLGMEEVLEGVLETTSELESFNVFSGTVGLNRHNLTIHSLVETALKLLEDR

SEQ ID NO: 6754 - protein, 830 aa, Glycine max
MDHRLSVKKEGEGIVHIQVAELHRLSETSKTSTMFEPRGLSSIEKRDSDADNSFSAATARAPEKKLTLFALRLAVLEKAATSLGTLGFIWATVVLLGGFAITLDITDFWFITIILLIEGTRIFSRSHELEWQHQATWSITDAGINSFRMLRSSPNLLLQSIESLFRPIVTKKQRRDMMESNVTPRYRDNTTISIWTPTRMWISSDVPLLPYARWFFLSRHISKLLYWLQLFSATACVVLSSMKLVKHNYGEVDKGDTDKRNRESALNIFYALALAEALLFLMEKAYWEWKISYCKLLDEVSKECGLGPSGMVSIRRFFYDAYSRCVNGSIFDGLKMDIVCFAMDLLASNSPDEQLIGGRILRQFAVSERFSDDTLQKLGISISVVERLVEMLNWTDHKEEEIRLSAAEILSALAGKKQNSLRIAGIPGAMESISSLLQTNRNCIHAADEIGEKKLIFDHPNYGYWTFNHLGLLILKKLARDHDNCGKIGNTRGLLPKIIDFAHAEERLLKNENATPSQILTVKRSLQLVKMLASTTGTYGKHLRREISEIVFTISNIRDILRHGEKHPLLQKLSIEILTSLALEEEATERIGGTGGVLKELFNIFFKDYIAENRKDVTTVAGEALAMLVLESKSNCHRILKLKVLERLIEALKVPPLHINAARILRNLCTYSGSECFKQLWGVTAAAPTVLQAIMSQENKLQEVMIGLAASVFSFMTSSESSTVFEESGITEAELANKLIHILKKHRYPPTKVPRIRRFVIELAIWMMKEREENIHTFKDLGMEEVLEGVLETTSELESFNVFSGTVGLNRHNLTIHSLVETALKFLEDR

SEQ ID NO: 6755 - protein, 837 aa, Medicago truncatula
MDHKICVDGEGGGSIHLEVGELRRLSETTSKCATMFEPRRGLSSLEKRDSGEGDKEDSNESSTTVRAPEKKLTLFALRLAVLEKAATGLGTLGFIWATVVLLGGFAITLDKTDFWFITIILLIEGTRIFSRSHELEWQHQATWSITESGMHSFRMLRSSSNSILQSIKNLCRPINAAVKKHRKDTVEANVIVPRFLDNRITRTTTRTWISSDVPLLPYAKWFFISGHISKVLYWLQLLSATACVVLSSTKLIRHNYGVIAKGDTDKRNRESALDIFYALALAEALLFLTEKAYWEWKLSYCELLDEVNKECELGPSGMVSIRRFFYDAYSRCVNGSIFDGLKMDMVSFAMDLLASNSPDEKLIGARILRQFANSERFSDDTLQKIGISISLVERLVEMLNWTDHKEEEIRMSAAEILSKLAGKKQNSLRIAGIPGAMESISSLLQTNRNCMHAADEVAEKKLIFDHPNYGFWTFNHLGLLILKKLAHDHDNCGKIGNTRGLLPKIVDFTHAEESLLKNENVTPSQILTVKRSLQLVKMLASTTGTYGKHLRKEISEVVFTISNIRDILRHGEKHPLLQKLSIEILTSLALEDEASERIGGTGGVLKELFNIFFRQNIPENQKDVTTVAGEALSMLALESKSNCHRILKLRVLERLIEALKVPLIRVSAARILRNLCNYSGSECFNQLKGVTAAAPTILQAIMSQENKLQEVMVGLAANVFTFMASSESRTVFKEAGITEVELAKKLVQILKKHQYPATKVPRIRRFVIELAIWMMIDKEENISNFKDLQMEEVLEGVLETTSELESFNVFSGTVGLNRHSLTIHSLVETALMLLEDK

SEQ ID NO: 6756 - protein, 829 aa, Vitis vinifera
MDKEEEDGGSVHLQVSELTKLSGACSSGDTMFTPQSRIEKGDSNNSNSVSEIRPAVSAPEKQLTIFALRLAVLEKVATSLGTLGFIWATVVLLGGFAITLAKTDFWFITIILLIEGTRIFSRSHELEWQHQATWSVTDAGINSFRALRSSSHFLFETVKSICRPIAVRKQSQHSREVSGRNNPEASPGNWGTRKMPSRTWKTSDVPLLPYAPWVFLSRNISKLLYWLQLLSATACVVLSLLKLIKHDYGEVAKGDSDKRNRKSALTIFYALALAEALMFLVEKAYWEWKLSFCRLLEKVNKECDLGDTGMVSIRRFFYDAYSKCVNGSIFDGLKMDMVSFAMDLLASNSPDEQLIGARILRQFAMSERYSDDTLQKIGINLPVIERLVEMLNWKDPQEEEIRQSAAEILSKLAGKKQNSLRVAGIPGAMESISSLLQTHRNPSSAPDEICEKKIIFDQGNYGYWTFNHLGLLILKKLARDHDNCGKIGNTRGLLPKIVDFTHAEDRLLKDENVTQSQILTVKRSLQLVKMLASTTGSTGKLLRSEISEVVFTISNIREILRNGEKHPKLQKLGIEILTSLALEENATERIGGTGGVLKGLFNIFFKQGMAGDQNHVKIAAGQALAMLTMDSKSNCHRILKLKVLEKLVGALEVPLLSVNAARILRNLCAFSGSECFNQLTGVRAAAPTVLKAIMSEENKLQEVMLGLAAHGFKFMTSEESSVFFEKTGIKEVHLAHELVEILRKYKYPPIKVPRIRRFTIELAIWMMRDKETNVHIFKDLGMEKELEGVLETTSEIESFNIFSGTVGLNRHGTSMHSLVETALKLLEEQ

SEQ ID NO: 6757 - protein, 829 aa, Vitis vinifera
  misc_feature (648)..(648): Xaa can be any naturally occurring amino acid
  misc_feature (819)..(819): Xaa can be any naturally occurring amino acid
MDKEEEDGGSVHLQVSELTKLSGACSSGDTMFTPQSRIEKGDSNNSNSVSEIRPAVSAPEKQLTIFALRLAVLEKVATSLGTLGFIWATVVLLGGFAITLAKTDFWFITIILLIEGTRIFSRSHELEWQHQATWSVTDAGINSFRALRSSSHFLFETVKSICRPIAVRKQSQHSREVSGRNNPEASPGNWGTRKMPSRTWKTSDVPLLPYAPWVFLSRNISKLLYWLQLLSATACVVLSLLKLIKHDYGEVAKGDSDKRNRKSALTIFYALALAEALMFLMEKAYWEWKLSFCRLLEKVNKECDLGDTGMVSIRRFFYDAYSKCVNGSIFDGLKMDMVSFAMDLLASNSPDEQLIGARILRQFAMSERYSDDTLQKIGINLPVIERLVEMLNWKDPQEEEIRQSAAEILSKLAGKKQNSLRVAGIPGAMESISSLLQTHRNPSSAPDEICEKKIIFDQGNYGYWTFNHLGLLILKKLARDHDNCGKIGNTRGLLPKIVDFTHAEDRLLKDENVTQSQILTVKRSLQLVKMLASTTGSTGKLLRSEISEVVFTISNIREILRNGEKHPKLQKLGIEILTSLALEENATERIGGTGGVLKGLFNIFFKQGMAGDQNHVKIAAGQALAMLTMDSKSNCHRILKLKVLEKLXGALEVPLLRVNAARILRNLCAFSGSECFNQLMGVRAAAPTVLKAIMSEENKLQEVMLGLAAHGFKFMTSEESSIFFEKTGIKEVYLAHELVEILRKYKYPPIKVPRIRRFTIELAIWMMRDKETNVHIFKDLGMEKELEGVLETTSEIESFNIFSGTVGLNRHGTSMHSLXETALKLLEEQ

SEQ ID NO: 6758 - protein, 826 aa, Populus trichocarpa
MDRGESEEDGSIRFPVDELRRLSETYGSATIFEPQSDIGKRDSSTGNSVSPTLPAPEKKLTLFALRLAIFEKAATCLGTLGFIWATVVLLGGFAITLDKTDFWFITIILLIEGTRIYSRSHELEWQHQATWSITDAGINSFRALRSSSHFIIETVKALFRPITRVQKQSLHTREIRKNPDAEISGNWGVQRKLTRTWTSSDVPILPYAQWFFLSKNVSKLLYWLQLASASACVVLSLMKLIKHNYGEVEKGNTDKRNRQSALNIFYSLALAEALLFLMERAYWEWKASYCKLLEEVSRECDLGLSGIVSIRRFFYDAYSRCLEGSIFDGLKMNMVTFAMDLLASNSPDEQLIGARILRQFVMNPQFSDDTLKNIGTNISMIDRLVEVLNWKDPQEEEIRRSAAEILSKLAGKKQNSLRVAGIPGALKSISSLLQTNRSCSTTADEIGEKTIICDHAHYGFWTFNHLGLLILKKLARDHDNCGKIGNTRGLLPKIIDFTHVEERLLKDENVTPSQILTVKRSLQLVKMLASTTGTTGNNLRREISEIVFTISNIRDILRHGEKHPMLQKLSIEILTSLALEEDAKERIGGTGGVLKELFNIFFSQGIPENQNHARIAAGDALAMLALESRRNCLRILKLKVLERLVGALEVPLLRVNAARILRNLCTYSRVDCFDQLKGVAAAVPTVLEAVMSEENKLQEVMVGLAAEAFKFMTPQESNIMFERTGIKEAELANKILQILKKYENPPVKVPRIRRFSIELAIWMMRNNTANVRTFKDLGLEKELEGVLESTAEVESFNIFSGTSGLSRHSTTIHSLVETALQLLEDR

SEQ ID NO: 6759 - protein, 839 aa, Ricinus communis
MDGGKPVGDGDGSICLQVVELRRLSETYGSSATIFEPRSSIEKRDSTTTSASPTTPTTPGIHAPEQKLTLFALRLAVFEKAATGLGTLGFIWATVVLLGGFAITLDPTDFWFITVILLIEGTRIFSRSHELEWQHQATWSIADAGINSFRAIRSSSHFVIEAVKSLFRSISLVRKQSQHSRELTGSCHSANARNWDYRRNTTRTWTSSDVPILPYARWVFLSRNVSKLLYWLQLASATACVALSLMKLIIHNYGEVAKGDTDKRNRRAALTIFYALALAEALLFLTEKAYWEWKVIYYRLLEEVNRECELGPSGMISIRRFFYDAYSKCVNGSIFDGLKMDLVAFAMDLLDSNSPDEQLIGVQILRQFSMNGRFSDDTLQKIGTNISVIERLVEMLNWKDPQEEAIRRSAAEILSELAGKKQNSLRVAGISGAMESISSLLQTNRSSNTTADEIGEKKIITDHAHYGFWTFNHLGLLILKKLAHDHDNCGKIGNTRGLLPKIIDLTHAGERMLNDESLAHSQILTVKRSLQVVKMLASTTGATGSHLRREISEVVFTISNIRDILRHGEKHPILQKLSIEILTNLALEADATERIGGTGGILKELFNIFFNHGAPESPNHVKTAAGEALAMLALESRSNCHRILKLKVLEKLVEALEDPLLRVNAARILRNLCAYSGPDCFSRLKEVTASVPTVLKAIRSEENKLQEVMVGLAAEVFKFLTSEESSIMFERPGIKEAELASTILQILQKYEKPSTKVPRIRRFAIELAIWMMRQNRANVHILRDLGLEKELEHVLETTAELESFNIFSGTVGLSRHSTTIHSLIETALKLLAESNISTP

SEQ ID NO: 6760 - protein, 827 aa, Populus trichocarpa
MDRGVSAEDGSIRLPVDELRRLSESYGSATIFEPQSGIENRDSGNGDFLSPTLPAVRAPEKKLTLFALRVAIFEKAATGLGALGFIWATVVLLGGFAITLDKTDFWFITIILLIEGTRICGRSHELEWQHQATWSIADAGIKSFWALRSSSHFIVEIVKALFRSITRVRKQSPHGREIRENPDAARNWDGRRKLSRTWTSSDVPILPYAQWVFLSRNVSKVLYWLQLASASACVVLSLMKLIKHNYGEIEKGDTDKRNLKAALDIFYSLALAEALLFLMEKAYWEWKVSYCKLLEEVRNECDLGLSGSVSIRRFLYDAYSRCVEGSIFDGLKMDMVTFATDLLASNSADEQLIGARVLCQFTMNPRFSDDTLQKIGTNISVIERLVEILNWKDPQEEEIRRSAAEILSKLAGKKQNSLRVAGIPGALESISSLLQTNRTFSTTADEIGEKTTIRDHARYRFWTFNQLGLLILKKLARDLDNCGKIGNTRGLLPKIIDFTHAEERLLKDENVTPSQILTVKSSLQLVKMLASTIGTTGNHLRREISEMVFTVSNIRDILRHGEKHPMLQKLGIEILTSLALEEDATERIGGAGGVLKELFNIFFSQRIPENQNHVRIAAGEALAMLALESRRNCLRILKLRVLERLVGALEVPLLRVNAARILRNLCTYSGADCFDQLKGITAAVPTVLNAVMSEENKLQEVMVGLAAEAFKFMTSQESNTMFNRAGIKEAELANKILQILRRYQNPSVKVPRIRRFSIELAIWMMQNNAANVRTFKDLGLEKELEWVLESTAEVESFNIFSGTFGLSRHSTTIHSLVETAMQLLEDR

SEQ ID NO: 6761 - protein, 390 aa, Glycine max; identical to SEQ ID NO: 6745

SEQ ID NO: 6762 - protein, 396 aa, Glycine max; identical to SEQ ID NO: 6744

SEQ ID NO: 6763 - protein, 443 aa, Glycine max; identical to SEQ ID NO: 6731

SEQ ID NO: 6764 - protein, 436 aa, Glycine max; identical to SEQ ID NO: 6730

SEQ ID NO: 6765 - protein, 553 aa, Glycine max
MESWSYVPEEKECVSNEALSPPNTLGRSKNSFLGWELKTPCGFSNDMLGLGHHSIENQGFEELGFPEMLGKHMSDDLIGSVPTRKVNGNRQQQHSDRITGTVVDAPSGFSQRGDSNSKLSNSNSLIDLKLGRFADHGDFTDRAFSKVLSSSESSTPPKRVRASGLHSQTAYCQVYGCNKDLSSCKDYHKRHKVCEVHSKTAIVIVNGIEQRFCQQCSRFHLLAEFDDGKRSCRKRLAGHNERRRKPQMGIHPGKSGRLLQPCGGNYTYSRFQGSMLTSSFICPEMLPSGVTCSEKYGMSDFWRPIKAEHGTGFRNLSSMAATNGHPPSRSLFPSYNGNQFPFLHENSATSTTGSIFCESNSPYPSALGAQNSGLRPLFQDTVGNENFNVFDTSSTVQGLSGISDSCCALSLLSSQSQNSSSQSSGIPLAHSLVIPSSHSHNYNMSQVSEKIGISSQTSSSRVSDSFPSELNHADGSHLSPVLISDNNCIVNFDMADGIFQASDYLNVKDHLSGEDGATIDLLQLSSQLQRVEHERQSLQVKQENDSSCTLRIT

SEQ ID NO: 6766 - protein, 542 aa, Glycine max
MESWSYIPEEKECVSNEAPSPPNTLGRSKNSFLGWELKTPCGFSTDMLGLGHHSIENQGFEELGFPEMLGKHMSDDLVASVPTRKVDGNRQQQQHHSDRITGTVVDAPSGFSQRGDSNSLIDLKLGRFAEHGDFTDPAFSKVLSSSESSTPPKRVRTSGLHSQTAYCQVYGCNKDLSSCKDYHKRHKVCEVHSKTAIVIVNGIEQRFCQQCSRFHLLAEFDDGKRSCRKRLAGHNERRRKPQMGIHPGKSGTLLQPYSRFQGSMLTSSFIRPEMLPSGVMCSEKYGMSDFWRPIKAEHGTGFRNLSSMAATNGHPLPRSLFSSYNGKQFPFLHENSSTSTTGSIFCESNSHYPSALGAQNSGLRPLFQDTVGNEDFSVFDTSPNVQGLSGISDSCCALSLLSSQSQNSSSQSSGIPLAHSLVIPSSHSHHYNMSQVSDKIGISSQTSSSRVSDSFPPELNHADGSHLSPVLISGNNDIINFDMADGIFQGSDYLNVKDRLSDEDGATIDLLQLSSQLQRVEHERQSLQVKQENDSSCTLRIT

SEQ ID NO: 6767 - protein, 567 aa, Glycine max
MESWSYVAEEKGYVSSEALSPPNTLERSKGSCFGWELKTPCSFSNDMLGLGQQNVEDQGFGELGFPGMLGKQLCGDDPNPIGAVQSRKVDDVVVDCRITSPSPVVAAPNGFSSREDFNSKLSNALVDSNGGNSLIDLKLGWFADHGDAMVPTFSKGAPILSSSELSTPPKRVRASGAHSQTAYCLVYGCNKDLSGCKDYHKRHKVCEVHSKTSKVIVNGIEQRFCQQCSRFHLLAEFDDGKRSCRKRLAGHNERRRKPQVGIHSGKAGRLLQPYAGIADSRFQETMLTSSFICQEILPSGVLSSEKYGASDMWRPIKAEDSTGFTFRPLSSIPITNGHPQSRSLFPSYSGKQLPFLHENGATSATGNIFSENNNQYNPPSLGGQSSGSQSLFQDSSLGREDFNVFDTESAVQGLSGISDSGCALSLLSSQSQNSSGQSSGIPIAHPMVIPSSHSHYNMSRVSEKMIGISSQASSGVSDRFPPEFNPVDGSHLSPILISDNNEIINFEMANGIFQGSDFVNVKDRLSCEDSLTIDLLQLSSQLQRVENQRLSLQVKQENDSSCSLRIT

SEQ ID NO: 6768 - protein, 542 aa, Glycine max; identical to SEQ ID NO: 6766

SEQ ID NO: 6769 - protein, 553 aa, Glycine max; identical to SEQ ID NO: 6765

SEQ ID NO: 6770 - protein, 482 aa, Glycine max
MESWSYVPEEKGYLFSDEMDFSLDAFMRSRKALVEWDNKSNFVEKDGFNSDREVVRSMEFVDLGFPDLLQKSFHGSQPLETSSYELDSNNSSKRGNSSPHVIALDSSMGEEESDSKHLSSLVESKTHDSSLIDLKLGRLADCKGASSDKVAKEGFTLTSIHPTTLWKRARTSSLPAQAPVCQVYGCNMDLSSSKDYHKRHKVCDAHSKTAKVIVNGIEQRFCQQCSRFHLLAEFDDGKRSCRRRLAGHNERRRKPQFDYVTGKQHKILQSYQGTKYLGSSLQNKPQFPFQDIFQSSILFPGKHAQFSQSGRVKLEEDSIYGSQLAAPVTLDQESSSCALSLLSDQSQYPSCHAAGNPLASPQVFSGIRIPDRDSRVSKKPLRISPADKLAPNESFPCDTISKEVIKNRSAATFSSVGHALEVHNGDDICQPSELFSIKHSLSSEHAATVDLFQLSSHLQRVEQQRNSVLVKWENEDYCFPTV

SEQ ID NO: 6771 - protein, 482 aa, Glycine max
MESWSYVPEEKGYLFSDEMEFSLDAFMRSRKALVEWDNKSNFVERDGFNSDREVVKSMEFVDLGFPDLLQKSFHGSLPLETSSYELDSNNSSKRGNSSTHVIALDSSMGEEESNSKHLSSLVESKTQDSSLIDLKLGRLADCKGASSDKVEKEGFTLTSIHPTTLSKRARTSSLPAQAPVCQVYGCNMDLSSSKDYHKRHKVCDAHSKTAKVIVNGIEQRFCQQCSRFHLLVEFDDGKRSCRRRLAGHNERRRKPQFDYMTGKQHKILQSYQGTKYLGSSLQNKPMFPFQDIFQSSILFPGKHAQISQSGRVKLEEDSIYSSQLTAPITLDQESSSCALSLLSDQSQYLSHHAACNPLTSHRVFSGICIPNRDGQISETPLRISSADKHAPNESFPCNTTSKEVIKNRSAATFSNTGHALRVHHGDDICQPSELLDVKHHFSSEHAATVDLFQLSSHLQRVEQQRNSVLVKWENEDYCFPTV

SEQ ID NO: 6772 - protein, 397 aa, Glycine max
MDWNLKAPSWDLVDVDKATLQQHRGAMEEQNRFGVYRMKGEFSVDLKLGHHVGNSGTESALANKSKDAAAAGVSKMASSPSGSSKRARAINSTSLTVACLVDGCNSDLSNCRDYHRRHKVCELHSKTPEVTIGGFKQRFCQQCSRFHSLEQFDERKRSCRKRLDGHNRRRRKPQPEPLSRPGSFLSNYQGTQLLPFSSPHVYPSTAIVSPAWSASLVTSSADARLHNHNQQQHHHHQQDLFLGSSHKEGKQVAFLHNNHPSTAAALSSQTPPPFPSSSVRHTLLRTDPLSETCGGARSKMFCESLTTTTTNNNSVHDTTPCALSLLSSSQTHTPGNGLNQMVQPPPSMSLMQPLGLSLQDNNSLESVDHCSSMYSLASDHGSQCNEAAPQLFPFQWE

SEQ ID NO: 6773 - protein, 373 aa, Glycine max; identical to SEQ ID NO: 6748

SEQ ID NO: 6774 - protein, 358 aa, Glycine max; identical to SEQ ID NO: 6747

SEQ ID NO: 6775 - protein, 365 aa, Glycine max; identical to SEQ ID NO: 6729

SEQ ID NO: 6776 - protein, 365 aa, Glycine max; identical to SEQ ID NO: 6728

SEQ ID NO: 6777 - protein, 142 aa, Glycine max
MDTSRSEGKRVMRYKEEDDDNDDEEEEEAVSEMGFEEDGRRNKRVIRDLYGKRGSKGGGSITPSCQVDNCDADLSEAKQYHRRHKVCEYHAKAPSVHMAGLQQRFCQQCSRFHVLSEFDDSKRSCRTRLAGHNERRRKYAVD

SEQ ID NO: 6778 - protein, 146 aa, Glycine max
MDTSRYEGKRVLRYKEEDENDDDEEEEEVSEVGFGADRRRNKRVMRDLHGKRSGSKGGGSMPPSCQVDNCDADLSEAKQYHRRHKVCEYHAKAPSVHMAGLQQRFCQQCSRFHELSEFDDSKRSCRTRLAGHNERRRKNAVDYHGE

SEQ ID NO: 6779 - protein, 69 aa, Glycine max; identical to SEQ ID NO: 6315

SEQ ID NO: 6780 - protein, 415 aa, Glycine max; identical to SEQ ID NO: 6357

SEQ ID NO: 6781 - protein, 524 aa, Glycine max; identical to SEQ ID NO: 6326

SEQ ID NO: 6782 - protein, 492 aa, Glycine max; identical to SEQ ID NO: 6328

SEQ ID NO: 6783 - protein, 698 aa, Glycine max; identical to SEQ ID NO: 6355

SEQ ID NO: 6784 - protein, 696 aa, Glycine max; identical to SEQ ID NO: 6356

SEQ ID NO: 6785 - protein, 415 aa, Glycine max; identical to SEQ ID NO: 6357

SEQ ID NO: 6786 - protein, 524 aa, Glycine max; identical to SEQ ID NO: 6326

SEQ ID NO: 6787 - protein, 510 aa, Glycine max; identical to SEQ ID NO: 6339

SEQ ID NO: 6788 - protein, 510 aa, Glycine max; identical to SEQ ID NO: 6340

SEQ ID NO: 6789 - protein, 651 aa, Glycine max
MNTITLIRNRAINSARRILTGSRTSLFFGSTPAKSDHTLSIANNSLKPRFNHDRANHHPFQIHRTKGIDVAQKVFGLPSSNFAPPSMHFSLSTSSRDVSTFKVRNFSTSVETRVKDNNNFERIYVQGGMNNVKPLVVESVHKEDERDLGGDVNVSVGKTKGEEDSEVEKEAWKLLQGAVVTYCGNPVGTMAANDPGDKIPLNYDQVFIRDFIPSALAFLLRGESEIVKNFLLHTLQLQSWEKTVDCYSPGQGLMPASFKVRTVALDEDNHEEVLDPDFGESAIGRVAPVDSGLWWIILLRAYGKLTGDCSLQERADVQTGLKMILNLCLTDGFDMFPSLLVTDGSCMIDRRMGIHGHPLEIQALFYSALRCSREMLVATDGTNNLIRAINNRLSALSFHIREYYWVDMKKMNEIYRYKTEEYSTDAINKFNIYPEQIPLWLMDWIPEEGGYLIGNLQPAHMDFRFFSLGNLWSIVSSLGTPRQNQAILNLIEAKWDDLVGHMPLKICYPALDNEEWRIVTGCDPKNTPWSYHNGGSWPTLLWQFTLACIKMGRIELAQKAVALAEKRLPVDSWPEYYDTRTGKFIGKQARMYQTWTIAGFLTSKMLLKNPEMASMLFWEEDYELLDICVCGLSKSGRKRCSRGAARSQILV

SEQ ID NO: 6790 - protein, 652 aa, Glycine max
MNIITLIRNRAMNSARRILIGSRNSSFSGSTPAKSDHTLSIANNSLKPRFYHDHSNHHLFQIHRTKGIAQKFFGLPSSNFAPSPMHFSFSTFNSDVSTFKVRNFSNSVETRINDNNFERIYVQGGMNNVKPLVVEGVHKDDESVAGEKNLGGDVNASVGKSKGEDSEVEKEAWKLLQGAVVTYCGNPVGTMAANDPGDKLPLNYDQVFIRDFIPSALAFLLRGESEIVKNFLLHTLQLQSWEKTVDCYSPGQGLMPASFKVRTVALDEDNHEEVLDPDFGESAIGRVAPVDSGLWWIILLRAYGKLTGDCSLQERADVQTGLKMILNLCLTDGFDMFPSLLVTDGSCMIDRRMGIHGHPLEIQALFYSALRCSREMLVATDGTKNLIRAINNRLSALSFHIREYYWVDMKKMNEIYRYKTEEYSMDAINKFNIYPEQIPLWLMDWIPEEGGYLIGNLQPAHMDFRFFSLGNLWSIVSSLGTPRQNHAILNLIEAKWDDLVGHMPLKICYPALDNEEWRIVTGCDPKNTPWSYHNGGSWPTLLWQFTLACIKMGRIELAQKAVALAEKRLPVDSWPEYYDTRTGKFIGKQARMYQTWTIAGFLTSKMLLKNPEMASMLFWEEDYELLDICVCGLSKSGRKRCSRGAARSQIRV

SEQ ID NO: 6791 - protein, 594 aa, Medicago truncatula
MNTIILIRNRAINSARRILTSSSNSSIFRPPLLPHANDFLQPRLNLNHTNNHNPFRILGFQGFNVQCFSTSVETRVNENNFERIYIQGGVNVKPLVVESVVVKEEEESHVEKQAWKLLKDAVVTYCGNPVGTVAANDPGDKLPLNYDQVFIRDFVPSALAFLLKGDTEIVKYFLLHTLQLQSWEKTVDCYSPGQGLMPASFKVRTVALDGDTREEVLDPDFGESAIGRVAPVDSGLWWIILLRAYGKITGDYSLQERVDVQTGLKMILKLCLTDGFDMFPSLLVTDGSCMIDRRMGIHGHPLEIQALFYSALRCSREMLVVTDGTNDLVRAINNRLSALSFHIRQYYWVDMKKINEIYRYNTEEYSMDAINKFNIYPEQIPFWVMDWIPEKGGYLIGNLQPAHMDFRFFTLGNLWSIISSLSTPRQNEAILNLIEAKWDELVGHMPLKICYPALDNEEWRIITGSDPKNTPWSYHNGGSWPTLLWQFTLACIKMGRIELAQKAVDLAEKRLPVDSWPEYYDTRSGKFIGKQSRLYQTWTIAGFLTSKLLLKNPKMASMLFSEEDYDLLDICVCGLSKRGRKKCSRGAAKSQILV

SEQ ID NO: 6792 - protein, 685 aa, Ricinus communis
MNTLGFLSNSTMKPSCRFLIARKSSFLFGSAEKLHTLTNNISRNHFFSFEHNKRFSTYPFRILGSRSIIKSSPKSFCIANINLGQSRLISGSPSGPCRTIRGRDLSFIASFASEVRDYSTSIETRINDKNFERIYVQNGIGVGVKPLAVEKIDKDENVVGEEASRIGIAVPDDVESPINREDLEGVKGVDIVSPRREESNIEKEAWKLLNDAVVRYCGSPVGTVAANDPGDKQPLNYDQVFIRDFVPSALAFLLRGEGEIVRNFLLHTLQLQSWEKTVDCYSPGQGLMPASFKVRTVPLDENKSEEILDPDFGESAIGRVAPVDSGLWWIILLRAYGKITCDYTLQERVDVQTGIKLILNLCLADGFDMFPSLLVTDGSCMIDRRMGIHGHPLEIQALFYSALRCSREMLTVNDGSKNLVRAINNRLSALSFHIREYYWVDIKKINEIYRYKTEEYSMDATNKFNIYPEQIPAWLMDWIPEEGGYLIGNLQPAHMDFRFFTLGNLWSVVSSLGTPKQNEAILNLIEAKWDDLVGCMPLKICYPALEHEDWRIITGSDPKNTPWSYHNGGSWPTLLWQFTLACIKMGRLELAHRAVAMAEKRLSVDRWPEYYDTRTGKFIGKQSRLYQTWTIAGFLTSKVLLENPEMASLLLWEEDYELLEICVCALSKTGRKKCSRGAAKSQILV

SEQ ID NO: 6793 - protein, 647 aa, Vitis vinifera
MITIHCFANSTMKSSSRILLFRRNLPFSGCPLPKSHHFLASNLSNFRINSDHTCKFRSCPLQNLGFRRVIDHTQKFSRVPSPGFGQSRVISSGNVRRLSVISSVSSDVRSFSTSVETRVNDKNFEKIYVQGGMNVKPLVVERIDIDETIENNEESRIESEAEKEAWKLLQDSVVMYCGSPIGTMAANDPGDKTPLNYDQVFIRDFVPSALAFLLKGEGEIVRNFLLHTLQLQSWEKTVDCYSPGQGLMPASFKVRTVPLDGNNEAHEEVLDPDFGESAIGRVAPVDSGLWWIILLRAYGKITGDYTLQERVDVQTGIKLILNLCLTDGFDMFPSLLVTDGSCMIDRRMGIHGHPLEIQALFYSALRCSREMLTQNDASINLVRAINNRLSALSFHIREYYWVDMKKINEIYRYKTEEYSTDATNKFNIYPDQIPSWLMDWVPEEGGYLIGNLQPAHMDFRFFTLGNLWSIISSLGTPKQNQGILDTIQAKWDDLVGHMPLKICYPALEYEEWRIITGSDPKNTPWSYHNGGSWPTLLWQFTLACIKMGRPELARKAVADAEKRLAVDRWPEYYDTRNGRFIGKQSRLFQTWTIAGYLTSKMLLENPEMAALLFWEEDYDLLEICVCGLSKTGRRKCSRFAARSQILV

SEQ ID NO: 6794 - protein, 674 aa, Vitis vinifera
MITIHCFANSTMKSSSRILLFRRNLPFSGCPLPKSHHFLASNLSNFRINSDHTCKFRSCPLQNLGFRRVIDHTQKFSRVPSPGFGQSRVISSGNVRRLSVISSVSSDVRSFSTSVETRVNDKNFEKIYVQGGMNVKPLVVERIDIDETIENNEESRIEVDGNFLNGENVKGVDESEVLITKREESEAEKEAWKLLQDSVVMYCGSPIGTMAANDPGDKTPLNYDQVFIRDFVPSALAFLLKGEGEIVRNFLLHTLQLQSWEKTVDCYSPGQGLMPASFKVRTVPLDGNNEAHEEVLDPDFGESAIGRVAPVDSGLWWIILLRAYGKITGDYTLQERVDVQTGIKLILNLCLTDGFDMFPSLLVTDGSCMIDRRMGIHGHPLEIQALFYSALRCSREMLTQNDASINLVRAINNRLSALSFHIREYYWVDMKKINEIYRYKTEEYSTDATNKFNIYPDQIPSWLMDWVPEEGGYLIGNLQPAHMDFRFFTLGNLWSIISSLGTPKQNQGILDTIQAKWDDLVGHMPLKICYPALEYEEWRIITGSDPKNTSPWSYHNGGSWPTLLWQFTLACIKMGRPELARKAVADAEKRLAVDRWPEYYDTRNGRFIGKQSRLFQTWTIAGYLTSKMLLENPEMAALLFWEEDYDLLEICVCGLSKTGRRKCSRFAARSQILV

SEQ ID NO: 6795 - protein, 662 aa, Vitis vinifera
MKSSSRILLFRRNLPFSGCPLPKSHHFLASNLSNFRINSDHTCKFRSCPLQNLGFRRVIDHTQKFSRVPSPGFGQSRVISSGNVRRLSVISSVSSDVRSFSTSVETRVNDKNFEKIYVQGGMNVKPLVVERIDIDETIENNEESRIEVDGNFLNGENVKGVDESEVLITKREESEAEKEAWKLLQDSVVMYCGSPIGTMAANDPGDKTPLNYDQVFIRDFVPSALAFLLKGEGEIVRNFLLHTLQLQSWEKTVDCYSPGQGLMPASFKVRTVPLDGNNEAHEEVLDPDFGESAIGRVAPVDSGLWWIILLRAYGKITGDYTLQERVDVQTGIKLILNLCLTDGFDMFPSLLVTDGSCMIDRRMGIHGHPLEIQALFYSALRCSREMLTQNDASINLVRAINNRLSALSFHIREYYWVDMKKINEIYRYKTEEYSTDATNKFNIYPDQIPSWLMDWVPEEGGYLIGNLQPAHMDFRFFTLGNLWSIISSLGTPKQNQGILDTIQAKWDDLVGHMPLKICYPALEYEEWRIITGSDPKNTPWSYHNGGSWPTLLWQFTLACIKMGRPELARKAVADAEKRLAVDRWPEYYDTRNGRFIGKQSRLFQTWTIAGYLTSKMLLENPEMAALLFWEEDYDLLEICVCGLSKTGRRKCSRFAARSQILV

SEQ ID NO: 6796 - protein, 673 aa, Vitis vinifera
MNSSSYIGITTMKPYCRVLTSCRNSSIFKFPSSKSNHFIADNSSKFQSKLIHSRRFHCCSAQILGKKCGINSNRRAFRLSDPNWGQIRVYRSCSGAHGGRRGVLVISNVASDFRKHSTSVESHVNEKGFESIYINGGLNVKPLVIERIERGHVEEESGLEFKDPDVNFDHSEGLNKEKVEREVPEIEKEAWRLLRSAVVDYCGNPVGTVAANDPGDKQPLNYDQVFIRDFVPSALAFLLKGEGEIVKNFLLHTLQLQSWEKTVDCYSPGQGLMPASFKVRTVPLDGGNGAFEEVLDPDFGESAIGRVAPVDSGLWWIILLRAYGKITGDYALQERVDVQTGIRLILNLCLTDGFDMFPSLLVTDGSCMIDRRMGIHGHPLEIQALFYSALRCSREMITVNDGTKNLVRAINNRLSALSFHIREYYWVDMKKINEIYRYKTEEYSTDAINKFNIYPDQIPTWLVDWIPDQGGYLIGNLQPAHMDFRFFTLGNLWSIISSLGTAKQNEGILNLIEAKWDDLVAHMPLKICYPALENEEWRIITGSDPKNTPWSYHNGGSWPTLLWQFTLACIKMGRPELARKAVALAEERLSVDHWPEYYDTRNGRFIGKQSRLYQTWTIAGFLTSKMLLENPEMASLLAWEEDYELLEICVCALSKTGRKKCSRSAARSQIPVQ

SEQ ID NO: 6797 - protein, 674 aa, Vitis vinifera
MITIHCFANSTMKSSSRILLLRRNLPFSGCPLPKFHHFLASNLSNFRINSDHTCKFRSCPLQNLGFRRVIDHTQKFSRVPSPGFGQARVISSGNVRRLSVISSVSSDVRSFSTSVETRVNDKNFEKIYVQGGMNVKPLVVERIDIDETIENNEESRIEVDGNFLNGENVKGVDESEVLITKREESEAEKEAWKLLQDSVVMYCGSPIGTMAANDPGDKTPLNYDQVFIRDFVPSALAFLLKGEGEIVRNFLLHTLQLQSWEKTVDCYSPGQGLMPASFKVRTVPLDGNNEAHEEVLDPDFGESAIGRVAPVDSGLWWIILLRAYGKITGDYTLQERVDVQTGIKLILNLCLTDGFDMFPSLLVTDGSCMIDRRMGIHGHPLEIQALFYSALRCSREMLTQNDASINLVRAINNRLSALSFHIREYYWVDMKKINEIYRYKTEEYSTDATNKFNIYPDQIPSWLMDWVPEEGGYLIGNLQPAHMDFRFFTLGNLWSIISSLGTPKQNQGILDTIQAKWDDLVGHMPLKICYPALEYEEWHIITGSDPKNTSPWSYHNGGSWPTLLWQFTLACIKMGRPELARKAVADAEKRLAVDRWPEYYDTRNGRFIGKQSRLFQTWTIAGYLTSKMLLENPEMAALLFWEEDYDLLEICVCGLSKTGRRKCSRFAARSQILV

SEQ ID NO: 6798 - protein, 673 aa, Vitis vinifera
  misc_feature (51)..(52): Xaa can be any naturally occurring amino acid
  misc_feature (79)..(79): Xaa can be any naturally occurring amino acid
  misc_feature (397)..(397): X can be leucine or Isoleucine
MNSSSYIGITTMKPYCRVLTSCRNSSIFKFPSSKSNHFIADNSSKFQSKLXXSRRFHCCSAQILGKKCGINSNRRAFRXSDPNWGQIRVYRSCSGAHGGRRGVLVISNVASDFRKHSTSVESHVNEKGFESIYINGGLNVKPLVIERIERGHVEEESGLEFKDPDVNFDHSEGLNKEKVEREVPEIEKEAWRLLRSAVVDYCGNPVGTVAANDPGDKQPLNYDQVFIRDFVPSALAFLLKGEGEIVKNFLLHTLQLQSWEKTVDCYSPGQGLMPASFKVRTVPLDGGNGAFEEVLDPDFGESAIGRVAPVDSGLWWIILLRAYGKITGDYALQERVDVQTGIRLILNLCLTDGFDMFPSLLVTDGSCMIDRRMGIHGHPLEIQALFYSALRCSREMXTVNDGTKNLVRAINNRLSALSFHIREYYWVDMKKINEIYRYKTEEYSTDAINKFNIYPDQIPTWLVDWIPDQGGYLIGNLQPAHMDFRFFTLGNLWSIISSLGTAKQNEGILNLIEAKWDDLVAHMPLKICYPALENEEWRIITGSDPKNTPWSYHNGGSWPTLLWQFTLACIKMGRPELARKAVALAEERLSVDHWPEYYDTRNGRFIGKQSRLYQTWTIAGFLTSKMLLENPEMASLLAWEEDYELLEICVCALSKTGRKKCSRSAARSQIPVQ

SEQ ID NO: 6799 - protein, 595 aa, Glycine max; identical to SEQ ID NO: 6331

SEQ ID NO: 6800 - protein, 553 aa, Glycine max; identical to SEQ ID NO: 6332

SEQ ID NO: 6801 - protein, 492 aa, Glycine max; identical to SEQ ID NO: 6328

SEQ ID NO: 6802 - protein, 524 aa, Glycine max; identical to SEQ ID NO: 6326

SEQ ID NO: 6803 - protein, 806 aa, Glycine max; identical to SEQ ID NO: 6336

SEQ ID NO: 6804 - protein, 825 aa, Medicago truncatula; identical to SEQ ID NO: 6337

SEQ ID NO: 6805 - protein, 847 aa, Medicago truncatula; identical to SEQ ID NO: 6338

SEQ ID NO: 6806 - protein, 553 aa, Glycine max; identical to SEQ ID NO: 6332

SEQ ID NO: 6807 - protein, 595 aa, Glycine max; identical to SEQ ID NO: 6331

SEQ ID NO: 6808 - protein, 510 aa, Glycine max; identical to SEQ ID NO: 6340

SEQ ID NO: 6809 - protein, 510 aa, Glycine max; identical to SEQ ID NO: 6339

SEQ ID NO: 6810 - protein, 365 aa, Glycine max; identical to SEQ ID NO: 6729

SEQ ID NO: 6811 - protein, 365 aa, Glycine max; identical to SEQ ID NO: 6728

SEQ ID NO: 6812 - protein, 436 aa, Glycine max; identical to SEQ ID NO: 6730

SEQ ID NO: 6813 - protein, 443 aa, Glycine max; identical to SEQ ID NO: 6731

SEQ ID NO: 6814 - protein, 443 aa, Glycine max; identical to SEQ ID NO: 6732

SEQ ID NO: 6815 - protein, 460 aa, Medicago truncatula; identical to SEQ ID NO: 6733

SEQ ID NO: 6816 - protein, 390 aa, Glycine max; identical to SEQ ID NO: 6745

SEQ ID NO: 6817 - protein, 396 aa, Glycine max; identical to SEQ ID NO: 6744

SEQ ID NO: 6818 - protein, 187 aa, Glycine max
MEIKSRERIQVSIEKVRRDSTVEVEDEEEEDESVVGGEGGLAEDEKKKGGGGSGRRGSSGVSPPSCQAEMCGADLTVAKRYHRRHKVCELHSKAPSVMVAGLRQRFCQQCSRFQELAEFDEAKRSCRRRLARHNERRRKSNAETCNEGCSGSKGQHPTESHCRNADVWGRIQMNIAKNSGYNSFHIR

SEQ ID NO: 6819 - protein, 187 aa, Glycine max
MEIKSGERRQVSIEKVRRDNTVEVEDEEEEDESVVGGEGGLAEDERKKIGGGSGRRGSSGVSPPSCQAEICGADLTVAKRYHRRHKVCELHSKAPSVMVAGLRQRFCQQCSRFHELAEFDEAKRSCRRRLARHNERRRKSNAETCNEGCSGSKGQHPAETHCRNTDDWGRIQMNIAKNSGYKFFHIR

SEQ ID NO: 6820 - protein, 187 aa, Glycine max
MEIKSGERRQVSIEKVRRDNTVEVEDEEEEDESVVGGEGGLAEDERKKIGGGSGRRGSSGVSPPSCQAEICGADLTVAKRFHRRHKVCELHSKAPSVMVAGLRQRFCQQCSRFHELAEFDEAKRSCRRRLARHNERRRKSNAETCNEGCSGSKGQHPAETHCRNTDDWGRIQMNIAKNSGYKFFHIR

SEQ ID NO: 6821 - protein, 553 aa, Glycine max; identical to SEQ ID NO: 6765

SEQ ID NO: 6822 - protein, 542 aa, Glycine max; identical to SEQ ID NO: 6766

SEQ ID NO: 6823 - protein, 567 aa, Glycine max; identical to SEQ ID NO: 6767

SEQ ID NO: 6824 - protein, 342 aa, Glycine max; identical to SEQ ID NO: 6722

SEQ ID NO: 6825 - protein, 342 aa, Glycine max; identical to SEQ ID NO: 6723

SEQ ID NO: 6826 - protein, 359 aa, Glycine max; identical to SEQ ID NO: 6724

SEQ ID NO: 6827 - protein, 359 aa, Glycine max; identical to SEQ ID NO: 6725

SEQ ID NO: 6828 - protein, 542 aa, Glycine max; identical to SEQ ID NO: 6766

SEQ ID NO: 6829 - protein, 553 aa, Glycine max; identical to SEQ ID NO: 6765

SEQ ID NO: 6830 - protein, 443 aa, Glycine max; identical to SEQ ID NO: 6731

SEQ ID NO: 6831 - protein, 436 aa, Glycine max; identical to SEQ ID NO: 6730

SEQ ID NO: 6832 - protein, 142 aa, Glycine max; identical to SEQ ID NO: 6777

SEQ ID NO: 6833 - protein, 146 aa, Glycine max; identical to SEQ ID NO: 6778

SEQ ID NO: 6834 - protein, 169 aa, Vitis vinifera
MEAKKMVKKEMEGTEEVDEDDQLGCSEDDKKKKAAAGGSGKKAAAAMRCCQAERCTADLTDAKQYHRRHKVCEHHAKAQVVVVGGIRQRFCQQCSRFHELSEFDEAKRSCRRRLAGHNERRRKNSADHAEGSSRKGTQLKEIVCGQVDDRGRIQITIQENAAYKHFQIR

SEQ ID NO: 6835 - protein, 175 aa, Betula platyphylla
MNLGKVDGSCYQKMVKKEAEEDQVSDEELVESGVEEEKKKKGVVGSGGKRCCQAEKCTADLSDGKQYHKRHKVCEHHAKAQVVLVGGMRQRFCQQCSRFHELSEFDETKRSCRRRLAGHNERRRENTAESHAEGSSRKGTGTHQLKDIVCGQVDDRGRIQITIHENSTYKHFQIR

SEQ ID NO: 6836 - protein, 567 aa, Glycine max; identical to SEQ ID NO: 6767

SEQ ID NO: 6837 - protein, 482 aa, Glycine max; identical to SEQ ID NO: 6770

SEQ ID NO: 6838 - protein, 482 aa, Glycine max; identical to SEQ ID NO: 6771

SEQ ID NO: 6839 - protein, 397 aa, Glycine max; identical to SEQ ID NO: 6772

SEQ ID NO: 6840 - protein, 342 aa, Glycine max; identical to SEQ ID NO: 6722

SEQ ID NO: 6841 - protein, 359 aa, Glycine max; identical to SEQ ID NO: 6724

SEQ ID NO: 6842 - protein, 359 aa, Glycine max; identical to SEQ ID NO: 6725

SEQ ID NO: 6843 - protein, 359 aa, Glycine max; identical to SEQ ID NO: 6724

SEQ ID NO: 6844 - protein, 365 aa, Glycine max; identical to SEQ ID NO: 6728

SEQ ID NO: 6845 - protein, 436 aa, Glycine max; identical to SEQ ID NO: 6730

SEQ ID NO: 6846 - protein, 396 aa, Glycine max; identical to SEQ ID NO: 6744

SEQ ID NO: 6847 - protein, 390 aa, Glycine max; identical to SEQ ID NO: 6745

SEQ ID NO: 6848 - protein, 142 aa, Glycine max; identical to SEQ ID NO: 6777

SEQ ID NO: 6849 - protein, 210 aa, Glycine max; identical to SEQ ID NO: 6746

SEQ ID NO: 6850 - protein, 358 aa, Glycine max; identical to SEQ ID NO: 6747

SEQ ID NO: 6851 - protein, 373 aa, Glycine max; identical to SEQ ID NO: 6748

SEQ ID NO: 6852 - protein, 365 aa, Glycine max; identical to SEQ ID NO: 6729

SEQ ID NO: 6853 - protein, 390 aa, Glycine max; identical to SEQ ID NO: 6745

SEQ ID NO: 6854 - protein, 318 aa, Glycine max
MNKSGGGEMSKWPFTMSQWQELEHQALIYKYMVAGLPVPPDLVLPIQNSFHSISQTFLHHPSTTMSYCSFYGKKVDPEPGRCRRTDGKKWRCSKEAYPDSKYCERHMHRGRNRSRKPVESQTMTQSSSNVSSLTVTAGSSSSATGNFHNLTTTNAYGNPQGTGSGSDQTHYHMDSIPYGIPSKEYRYFQGPKSEGGEHSFLSKTLGSNKVLHMESQMDNTLMPTSGVASFSTLRSNNNSMLQGDYLQPSFLSSEYASAETVKQEGQFLRPFFDEWPKRRDSWSGLEDEGSNHTQLSISIPMSASNFSTTSSHSPHGEI

SEQ ID NO: 6855 - protein, 308 aa, Glycine max
MSKWPFTISQWQELEHQALIYKYMVAGLPVPPDLVIPIQNSFHSISQTFLHHPSTTMSYCSFYGKKVDPEPGRCRRTDGKKWRCSKEAYPDSKYCERHMHRGRNRSRKPVESQTMTQSSSNVSSLTVTAGSSTSATGNFQNLSTTNAYGNPQGTASGTDQTHYHMDSIPYGIPSKEYRYFQGSKSEEHSFLSKTLGSNRVLHMEPQMDNTLMPTGGVASFSTLRSNNNSMLQGDYLQPSFLSSEYASAETVKQEGQSLRPFFDEWPKSRDSWSGLEDERSNHTQLSISIPMSSSNFSATSSHSPHGEI

SEQ ID NO: 6856 - protein, 341 aa, Glycine max
MNNSSGGGGRGTLMGLSNGYCGRSPFTVSQWQELEHQALIFKYMLAGLPVPLDLVFPIQNSFHSTISLSHAFFHHPTLSYCSFYGKKVDPEPGRCRRTDGKKWRCSKEAYPDSKYCERHMHRGRNRSRKPVESQTMTHSSSTVTSLTVTGGSGASKGTVNFQNLSTNTFGNLQGTDSGTDHTNYHLDSIPYAIPSKEYRYVQGLKSEGGEHCFFSEASGSNKVLQMESQLENTWPLMSTRVASFSTSKSSNDSLLHSDYPRHSFLSGEYVSGEHVKEEGQPLRPFFNEWPKSRESWSGLEDERSNQTAFSTTQLSISIPMSSNFSATSSQSPHGEDEIQFR

SEQ ID NO: 6857 - protein, 327 aa, Glycine max
MNISGGGGTVMGFSSNGRSPFTVSQWQELEHQALIFKYMVAGLPVPPDLVLPIQKSFDSTLSHAFFHHPTLSYCSFYGKKVDPEPGRCRRTDGKKWRCSKEAYPDSKYCERHMHRGRNRSRKPVESQTMTHSSSTVTSLTVTGGGDSNGTVNFQNLPTNAFGNLQGTDSGTDRTNYHLDSIPYAIPSKEYRCLQGLKSEGGEHCFFSEASGSNKVLQMESQLENTWPSMSTRVASFSTSKSSTDSLLHSDYPQHSFLSGEYASGEHVKEEGQPLRPFSNEWPKSRESWSGLEDDISNQTAFSTTQLSISIPMSSDFSATSSQSPHDN

SEQ ID NO: 6858 - protein, 443 aa, Glycine max; identical to SEQ ID NO: 6731

SEQ ID NO: 6859 - protein, 553 aa, Glycine max; identical to SEQ ID NO: 6765

SEQ ID NO: 6860 - protein, 185 aa, Glycine max
MERERALFERVRKNSTVEEEVENEVEEEDESGVSITEEEKKKGVGSSGGRRGSSGGSGGVSPPSCQAERCGADLTDAKRYHRRHKVCEFHSKAPVVVVAGLRQRFCQQCSRFHDLAEFDESKRSCRRRLAGHNERRRKSNPEASNEGSTKGHHPKETTHCRLANERERIQMNLPGSSGYKSFNIR

SEQ ID NO: 6861 - protein, 190 aa, Glycine max
MEGRRVERKKTLFERVRKNSTVDEEVENEGEEEDESGVNITEEEKKIGVSSGGGRRGSSGGGGGVSPPSCQAERCGADLTDAKRYHRRHKVCEFHSKAPVVVVAGLRQRFCQQCSRFHDLAEFDESKRSCRRRLAGHNERRRKTNPEAANEGNSKGQHPKETTHCRLADERGRIQMNLTGSSEYKSFNIR

SEQ ID NO: 6862 - protein, 482 aa, Glycine max; identical to SEQ ID NO: 6770

SEQ ID NO: 6863 - protein, 542 aa, Glycine max; identical to SEQ ID NO: 6766

SEQ ID NO: 6864 - protein, 190 aa, Glycine max; identical to SEQ ID NO: 6861

SEQ ID NO: 6865 - protein, 185 aa, Glycine max; identical to SEQ ID NO: 6860

SEQ ID NO: 6866 - protein, 688 aa, Glycine max
MDWASEVNLYKRTAQHSTGDLGAFGRRENTNGSCRSPLFATGQREHSFTRSAKENKNALDRANVKKGRAEETPRSLLLLEVEGKNSEMEFLPIFSFISLLLCLVLWQVSGEPVEDKEALLDFVSKFPPSRPLNWNESSPMCDSWTGVTCNVDKSKVIAIRLPGVGFHGTIPPDTISRLSALQTLSLRSNVITGHFPSDFSNLKNLSFLYLQFNNISGPLPDFSAWKNLTVVNLSNNHFNGTIPSSLNNLTQLAGLNLANNSLSGEIPDLNLSRLQVLNLSNNSLQGSVPNSLLRFPESAFIGNNISFGSFPTSRKRGRLSEAALLGVIIAAGVLGLVCFVSLVFVCCSRRVDEDEETFSGKLHKGEMSPEKAVSRNQDANNKLVFFEGCNYAYDLEDLLRASAEVLGKGTFGTAYKAILEDATMVVVKRLKEVAAGKKDFEQHMEIVGSLKHENVVELKAYYYSKDEKLMVYDYHSQGSISSMLHGKRGEDRVPLDWDTRLKIALGAARGIARIHVENGGKLVHGNIKSSNIFLNTKQYGCVSDLGLATISSSLALPISRAAGYRAPEVTDTRKAAQPSDVYSFGVVLLELLTGKSPIHTTGGDEIIHLVRWVHSVVREEWTAEVFDLELMRYPNIEEEMVEMLQIAMSCVVRMPDQRPKMSEVVKMIENVRQIDADTHSSSGNQVST

SEQ ID NO: 6867 - protein, 618 aa, Glycine max
MSPDLDSDKEALLDFVNKFPPSRPLNWNESSPLCDSWTGVTCNVDKSKVIAIRLPGVGFHGSIPPDTISRLSALQTLSLRSNVITGHFPSDFFNLKNLSFLYLQFNNISGPLPDFSAWKNLTVVNLSDNHFNGTIPSSLSKLTQLAGLNLANNTLSGEIPDLNLSRLQVLNLSNNNLQGSVPKSLLRFSESAFSGNNISFGSFPTVSPAPQPAYEPSFKSRKHGRLSEAALLGVIVAAGVLVLVCFVSLMFVCCSRRGDEDEETFSGKLHKGEMSPEKAVSRNQDANNKLVFFEGCNYAFDLEDLLRASAEVLGKGTFGTAYKAILEDATTVVVKRLKEVAVGKKDFEQHMEIVGSLKHENVVELKAYYYSKDEKLMVYDYHSQGSISSMLHGKRGEDRVPLDWDTRLKIALGAARGIARIHVENGGKLVHGNIKCSNIFLNSKQYGCVSDLGLATISSSLALPISRAAGYRAPEVTDTRKAAQPSDVYSFGVVLLELLTGKSPIHTTGGDEIIHLVRWVHSVVREEWTAEVFDLELMRYPNIEEEMVEMLQIAMSCVVRMPDQRPKMSEVVKMIENVRQTDAQTHSSSGNQAEQLKFSQRDNGNSPSTPSYFQRGSE

SEQ ID NO: 6868 - protein, 397 aa, Glycine max; identical to SEQ ID NO: 6772

SEQ ID NO: 6869 - protein, 373 aa, Glycine max; identical to SEQ ID NO: 6748

SEQ ID NO: 6870 - protein, 358 aa, Glycine max; identical to SEQ ID NO: 6747

SEQ ID NO: 6871 - protein, 334 aa, Glycine max
MANKQHNHNDNNKELQPLLVLGPPFMFPTFEAQNLHNYRFLNAFSSQIPLHQFLAEQNVDPSSIQAILCSPRQKISADAIRLLPSLSLIVTTSNGTRHIDLAECSYRGIQVASIPGDQLAVDVADMTVGLLIDVMWNISAADRHLRKWGPSKPCNLSSGSKLEGKRVGIVGLGKIGREVAKRLEAFGCRIMYNSRNQKPFVSYPFYSNVVELAGNSDVLVLSCSLNEQTRHIVKREVMLALGKEGVIVNIGRGDLIDEKELVRCLMEGEIKGAGLDVFENEPNVPKELFPLDNVVLSPHAASLTSHRIYDVCERVAECLEAFFSSKLPEYPGLG

SEQ ID NO: 6872 - protein, 334 aa, Glycine max
MANKQHNHNDSNKELQPLLVLGPPFMFPTFEAQNLHNYRFLNAFSSQIPLHQFLAEQSVDPSSIQAILCSPRQKISADAIRLLPSLSLIVTTSNGTRHIDLAECSYRGIQVASIPGDRLAVDVADMTVGLLIDVMWNISAADRHLRKRGPSKPCNLSSGSKLEGKRVGIVGLGKIGREVAKRLEAFGCRIMYNSRNQKPFVSYPFYSNVVELAGNSDVLVLSCSLNEQTRHIVKREVMLALGKEGVIVNIGRGDLIDEKELVRCLMEGEIKGAGLDVFENEPNVPKELFPLDNVVLSPHAASLTSHRIYDVCERVAECLEAFFSSKLPEYPGLG

SEQ ID NO: 6873 - protein, 332 aa, Glycine max
MAEKHNHIDNKEIQPLLVFGPPLIFPTFEARNFHKYRFLKAFSSQLPLHQFLTEQNVDPSSIQAILCSPSQQVSTDVIQLLPSLCVIVTSSAGTDHIDLVECSHHGIQVVSVPGDQAKDVADMAVGLLIDVLWKISAADRHVRKWGPSMHRNLSFGSKLKGKRVGIVGLGKIGKEVAKRLEPFGCRIMYHSRNQKPFISYPFYSKVVELAGNSDVLVLCCPLNEQSRHLINREVMLALGKDGAIVNVGRGALIDEKELVRCLMEDEIRGAGLDVFENEPNVPNELFPLDNVVLSPHAASLTSDGFTEVCELAAEALELFFSSKLPSIRLLDG

SEQ ID NO: 6874 - protein, 329 aa, Glycine max
  misc_feature (162)..(162): Xaa can be any naturally occurring amino acid
MADKPHKNHNDNNKEHQPLLVLGPPFMFPIFEAQNLHNYHFLNAFSSFKLPLFQFLPTQSIQTILCSPRQKISADFIGLLPLLSLIVTSSAGTDHIDLVECSRHDIQVVSVPGDQAKDVADMAVGLLIDVLWKISAADRHVRKWGLSMPQNLSFGSKLKGKXVGIVGLGKIGKEVAKRLEAFDCRIMYHSRNEKPFILYPFYSNVVELAGNSDVLVFCCPLNEQTRHIINREVMLGKDGVIVNVGRGSLIDEKELVWCLMEEEIRDAGLDLFENEPNVPNELFPLDNVVLSPHAASLTSDGFTEVCELAAEALEVFFSSKLPSTQVLDD

SEQ ID NO: 6875 - protein, 313 aa, Glycine max
MVGVISLVTGMAGPSGFGSASTAEQVTDGIDASNLTAIITGGASGIGLETARVLALRKVHVIIAVRNMVSAKEAKQQILEENESARVDVMKLDLCSVNSITSFVDNFIALDLPLNILINNAGVMFCPFKLSEDGIEMQFATNHLDKMQQTAKATGIEGRIINLSSIAHNYTYRKGIRFNKINERKGYGNKKAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 6876 - protein, 313 aa, Glycine max
MVGVISLVTGMAGPSGFGSASTAEQVTEGVDASNLTAIITGGASGIGLETARVLALRKVHVIIAVRNMVSAKEAKQQILEENESARVDIMKLDLCSVNSIRSFVDNFIALDLPLNILINNAGVMFCPFKLSEDGIEMQFATNHLDKMKQTAKATGIEGRIINLSSIAHNYTYRKGIRFNKINERKGYGNKKAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 6877 - protein, 323 aa, Glycine max
MVGVISLVTGMAGPSGFGSASTAEQVTDGIDASNLTAIITGGASGIGLETARVLALRKVHVIIAVRNMVSAKEAKQQILEENESARVDVMKLDLCSVNSITSFVDNFIALDLPLNILINNAGVMFCPFKLSEDGIEMQFATNHLGHFHLTNLLLDKMQQTAKATGIEGRIINLSSIAHNYTYRKGIRFNKINERKGYGNKKAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 6878 - protein, 323 aa, Glycine max
MVGVISLVTGMAGPSGFGSASTAEQVTEGVDASNLTAIITGGASGIGLETARVLALRKVHVIIAVRNMVSAKEAKQQILEENESARVDIMKLDLCSVNSIRSFVDNFIALDLPLNILINNAGVMFCPFKLSEDGIEMQFATNHIGHFHLSNLLLDKMKQTAKATGIEGRIINLSSIAHNYTYRKGIRFNKINERKGYGNKKAYGQSKLANILHTNELSRRLQEEGVNITANSVHPGVIMTPLMRHSSYLMHFLKVFTFYIWKNVPQGAATTCYVALHPSVKGVTGKYFVDCNQCKPSSHAKNKQLAKKLWDFSNDLIKSISKA

SEQ ID NO: 6879 - protein, 324 aa, Medicago truncatula
MVGVISLITGMAGPSGFGSASTAEQVTQGIDASNLTAIITGGASGIGLETTRVLALRKVHVIIAARNIESAEEAKQQITQENKSARVDIMKLDLCSTKSVRSFVDNFIALDLPLNILINNAGIMFCPFKISEEGIEMQFATNHLGHFLLTNLLLDKMKQTAKTTGIEGRIINLSSIAHRYTYFRKGIKFEKINDKKGYSSKKAYGQSKLANILHANELSRRLQEEGVNITVNSVHPGVIMTPLMRYSSYTMHLLKIFSFYIWKNVPQGAATTCYVALHPSVKGVTGKYFVDCNEFKPSAYAKNKLLAKKLWDFSNKLINSISKA

SEQ ID NO: 6880 - protein, 324 aa, Medicago truncatula
MVGVISLITGMAGPSGFGSASTAEQVTQGIDASNLTAIITGGASGIGLETTRVLALRKVHVIIAARNIESAEEAKQQITQENKSARVDIMKLDLCSTKSVRSFVDNFIALDLPLNILINNAGIMFCPFKISEEGIEMQFATNHLGHFLLTNLLLDKMKQTAKTTGIEGRIINLSSIAHRYTYFRKGIKFEKINDKKGHSSKKAYGQSKLANILHANELSRRLQEEGVNITVNSVHPGVIMTPLMRYSSYTMHLLKIFSFYIWKNVPQGAATTCYVALHPSVKGVTGKYFVDCNEFKPSAYAKNKLLAKKLWDFSNKLINSISKA

SEQ ID NO: 6881 - protein, 321 aa, Medicago truncatula
MVGVISLITGMAGPSGFGSASTAEQVTQGIDASNLTAIITGGASGIGLETTRVLALRKVHVIIAARNIESAEEAKQQITQENKSARVDIMKLDLCSTKSVRSFVDNFIALDLPLNILINNAGIMFCPFKISEEGIEMQFATNHLGHFLLTNLLLDKMKQTAKTTGIEGRIINLSSIAHRYTYFRKGIKFEKINDKKGYSSKKAYGQSKLANILHANELSRRLQEEGVNITVNSVHPGVIMTPLMRYSSYTMHLLKIFSFYIWKNGAATTCYVALHPSVKGVTGKYFVDCNEFKPSAYAKNKLLAKKLWDFSNKLINSISKA

SEQ ID NO: 6882 - protein, 323 aa, Medicago truncatula
MVGIFSLVTGMAGPSGFGSSTTAEQVTQGIDASNLTAIITGGASGIGLETARVLALRKVHVIIAARNMESAKEAKQIILQDNESARVDIMKLDLCSVKSVRSFVENFLALDLPLNILINNAGVMFCPFQLTQDGIEMQFATNHLGHFLLTNLLLEKMKQTAKATGIEGRIINLSSIAHTYTYEEGIRLDNINDQIGYSDKKAYGQSKLANILHANELSRRLKEEGVNITANSVHPGVIMTPLMRHSSLLMNFLKMFTFYIWKNVPQGAATTCYVALHPSLKGVTGKYFLDCNEFQPSAFASNGLLGRKLWDFSNKLINSISKS

SEQ ID NO: 6883 - protein, 313 aa, Glycine max
MVGIFSLITGRPGCSGFGSSSTAEQVIEGIDASNLTAIITGGASGIGLETARVLAIRKAHVIIAARNMESAKEAKQLILEEDESARVDIMKLDLCSVKSVGTFVDNFIALGVPLNILINNAGVMFCPYQQTEDGIEMQFATNHLDKMKQTAKDTGIEGRIINLSSIAHVYTYEEGIRFDNINDEDGYSDKKAYGQSKLANILHTNELSRRLQAEGVNITANSVHPGVIMTPLMRHSSLLMNFLKMFTFFAWKNIPQGAATTCYVALHPSLKGVTGKYFRDCNECQPSTHASNELLGRKLWDFSNKMINSLSKA

SEQ ID NO: 6884 - protein, 323 aa, Glycine max
MVGIFSLITGRPGCSGFGSSSTAEQVIEGIDASNLTAIITGGASGIGLETARVLAIRKAHVIIAARNMESAKEAKQLILEEDESARVDIMKLDLCSVKSVGTFVDNFIALGVPLNILINNAGVMFCPYQQTEDGIEMQFATNHLGHFLLTKLLLDKMKQTAKDTGIEGRIINLSSIAHVYTYEEGIRFDNINDEDGYSDKKAYGQSKLANILHTNELSRRLQAEGVNITANSVHPGVIMTPLMRHSSLLMNFLKMFTFFAWKNIPQGAATTCYVALHPSLKGVTGKYFRDCNECQPSTHASNELLGRKLWDFSNKMINSLSKA

SEQ ID NO: 6885 - protein, 1288 aa, Medicago truncatula
MSIGDAFLCLLFLTTYSISVASADSIYGCGGFVQASSWLVKSRKQTDAKLDYSHVTVELQTVDGLVKDRTQCAPNGYYFIPVYDKGSFVIKVNGPDGWSWDPEKVPVVVDNQGCNNNEDINFRFTGLVINLFSISGRVVGAAGGDSCPVKNGGPSNVKVELLSPSGDLVSSVLTSSSGSYLFTNVIPGFFLPTQFILRSTTRYIKHKFSKGQSIMHNMEIEEDVNENLSRVDEMENALGVIYSRKLLLKFERKVYYTSIRPTILYGKYELRASNRDMKVEVKGSTQVELGFGNGVIDDIFFVPGYSISGSVVAQGNPILGVHIFLYSEDVSEVECLQGSANGPRQEVALCHAVSDADGKFAFNLIPCGSYELVPYYKGENTVFDVSPSSVPVNVKHQHVTVPQKFQVHYIMGKHVVTGFSVGGRVVDGNDMGVEGVKIIVDGHERSITDNQGYYKLDQVTSTHYTIEARKKHYKFKKLENYMVLPNMASIEDIVAVSYDLCGLVRMVSSGQKATVALTHGPDNVKPQKKQTDGNGNFCFEVLPGEYRLSAIAATPDNAAGLMFAPSYIDVAIKSPLLNVEFSQALVNVRGAVVCKEKCDPSVSVTLVKQADKHNEERKTISLTSERSEFLFSDVIPGKYRLEVKHSSPESVTMEDNWCWEKSFIDVNVGAEDFEGIVFVQKGYWVNVISTHDVDGYINQPDGSTVNLKIRKGSQHICVEFPGIHEFSFIDSCVFFGSSSVKIDTSNLLPIHLKGEKHLIKGQINVHSGFHDALPEKIVVDIYHDGAGVGDNAMAILKSHGKDETNTSVFEYSVWANPGEKLTFVPRDSRNDGDKKLLFYPREHHVSVTDDNCQAHIPTFSCRLGVYIEGSVSPPLSGVHIRIFAAGDSSITGLKSGELILETTTGTDGSFVAGPLYDDVGYNVQASKPGYHLKQVGSHSFSCQKLGQISVHIHHKDDNNELIPSVLLSLSGDNGYRNNSVSGAGGAFLFDSLFPGMFYLRPVLKEYAFSPPAQAIELESGEFKEVTFQATRVAYSAIGLVTLLSGQPKGGVSVEARSVSKGYFEETVTDSSGNYRLRGLLPDTVYAIKVSKRDVMGSSNIERASPDSLSVKVGTEDIKGLDFIVFEEPDMTIVSCHVEGNGTDELRKHLMVEIRSASETSKIESVFPLPISNFFQVKGLSKGRHLLQLRSGLPSSSLRFDSDIIEVDLDKNVQTHVGPLRYRIDDQLKQELTPAPVFPLIIAFLVVALFISIPRLNDLYQATIDIPAPGTTSTSRKDVRKPTLRKKTY

SEQ ID NO: 6886 - protein, 1288 aa, Medicago truncatula; identical to SEQ ID NO: 6885

SEQ ID NO: 6887 - protein, 1195 aa, Glycine max
MSIGDAFLCLLFIATCWISAASADSIYGCGGFVEASSSLVKSRKQTDAKLDYSDVTVELQTVDGLVKDRTQCAPNGYYFIPVYDKGSFVIKINGPPGWTWDPEKVPVVVDNNGCNGNEDINFRFTGFTISGRVVGAVGGESCSVKNGGPSNVKVELLSLSGDLVSSVLTSSSGSYLFTNIIPGKYELRASNPDMKVEVKGSTQVELGFGNGVVDDIFFVPGYSIGGFVVAQGNPILGVHIFLYSDDVSEVECLQGSANGPRQEVALCHAVSDADGKFTFNSIPCGSYELVPYYKGENTVFDVSPPSVSVNVKHQHATVPQKFQVTGFSVGGCVVDGNGMGVEGVKIIVDGHERSITDNQGYYKLDQVTSTHYTIEAQKEHYKFKKLENYMVLPNMASIEDINAISYNLCGLVRMASGDLKVKVALTHGPDNVKPQKKQTDENGNFCFEVLPGEYRLSAIAATPENAAGLMFAPSYIDVVVKSPMLNIEFSQALVNIHGDVSCKEKCGPFVSVTLVRQADKHNEERKTISLTTKSSEFLFSNVIPGKYRLEVKHSSPESVTLEDNWCWEQSFIDVNVGAEDLEGILFVQKGYWVNVISTHNVDGYLTQPDGSNVNLKIRKGFQHICVEQPGVHEFSFVDSCIFFGSSSVKINTSDQLPIHLIGEKYLLNGQINVQSGSLDALPDNIVVDIKHDGAGVIDYATATFKSHSKDQMEAAIFEYSVWTNLGEKLTFIPRDSRNDGQKKLLFYPREHQVSVTDDNCQVYIPTFSCQLGVYIEGSVSPPLSGVHIRVFAAGDSSFTTLKSGELVLETTTGIDGSFVAGPLYDDIGYNVEASKPGYHLKQVAPHSFTCQKLSQISVHIHHKDDSKEPIPSVLLSLSGDNGYRNNSVSGAGGTFLFDNLFPGMFYLRPVLKEYAFSPPAQAIDLGAGEFKEVVFQATRVAYSATGIVSLLSGQPKGEVSVEARSESKGYFEETVTDSSGNYRLRGLLPDTDYVVKVAKRDVGSSNIERASPDSIAVKVGTEDIKGLDFIVFEEPEMTIISCHVEGNGTDELHKHLMVEIRSASDLNKIESVFPLPISNFFQVKGLSKGRHLLKLQSGLPSSSLKFESDIIEVDLEKNVQIHVGPMRYRIEDQLKQELTPAPVFPLIVAFLVVALFLSMPRLKDLYQATVDIPTPGLTAASRKDVKKPLLRKKTY

SEQ ID NO: 6888 - protein, 1195 aa, Glycine max
MSIGDAFLCLLFIATCSISAASADSIYGCGGFVEASSSLVKSRKQTDVKLDYSDVTVELQTVDGLVKDRTQCAPNGYYFIPVYDKGSFVIKINGPPGWTWDPEKVPVVVDNNGCNGNEDINFRFTGFTISGRVVGAVGGESCSVKNGGPSNVKVELLSLSGDLVSSVLTSSSGSYLFTNIIPGKYELRASNPDMKVEVKGSTQVELGFGNGVVDDIFFVPGYSISGFVVAQGNPILGVYIFLHSDDVSEVECLKGSANGPRQGVALCHAVSDADGKFTFNSIPCGSYELVPYYKGENTVFDVSPPSVSVNVKHQHATVPQKFQVTGFSVGGRVVDGNGMGVEGVKIIVDGHVRSIADNQGYYKLDQVTSTHYTIEAQKEHYKFKKLENYMVLPNMASIEDINAISYNLCGLVRMASGGLKAKVALTHGPDNVKPQKKQTDENGNFCFEVPPGEYRLSAIAATPENGAGLMFAPSYIDVVVKSPLLNIEFSQALVNIHGAVSCKEKCGPFVSVTLVRQVDKHNEERKTISLTTESSEFLFSDVIPGKYSLEVKHSSPESVTLEDNWCWEQSFIDVNVGAEDLEGILFVQKGYWVNIISTHNVDGYLTQPDGSNVNFKIQKGSQHICVEQPGVHEFHFVDSCIFFGSSSVKINTSDQSPIHLTGEKYLLNGQINVQSGSLDALPDSIVVDIKHDRTGVIDYATAILKSHVKDETGAAIFEYSVWANLGEKLTFVPQDSRSDGQKKLLFYPREHQVSVTDDNCQVYIPTFSCQLGAYIEGSVSPPLSGVHIRIFAAGDSSISTLKSGELVLETTTGTDGSFVAGPLYNDIGYNVEASKPGYHLKQVAPHSFTCQKLSQISVHIHHKDDAKEPIPSVLLSLSGDNGYRNNSVSGAGGTFLFDNLFPGMFYLRPVLKEYAFSPPAQAIELGAGEFKEVVFRATRVAYSATGIVTLLSGQPKGEVSVEARSESKGYFEETVTDSSGNYRLRGLLPDTDYVVKVAKRDVGSSNIERASPDSIAVKVGTEDIKGLDFIVFEEPEMTIISCHVEGNGTDELRKHLMVEIRSASDLNKIESVFPLPISNFFQVKGLSKGRHLLKLQSGLPSSSLKFESDLIEVDLEKNVQIHVGPLRYWIEDQLKQELTPAPVFPLIVAFLVVALFLSMPRLKDLYQATVDIPTPGLTAVSRKDVKKPMLRKKTY

SEQ ID NO: 6889 - protein, 1195 aa, Glycine max; identical to SEQ ID NO: 6888

SEQ ID NO: 6890 - protein, 1199 aa, Vitis vinifera
MAIREALIFSLTVIYITSLAAADSIQGCGGFVEASSDLIKSRKPTDGKLDYSHITVELRTIDGLVKDRTQCAPNGYYFIPVYDKGSFVVQIKGPEGWSLDPDKVPVVVDHAGCNANEDINFRFTGFTISGRVVGAVGGESCSLKNGGPSNVNIELLSPSGDLISSVLTSSEGSYSFNNIIPGNYKLQASHPDLTVEVRGSTEVELGFGNGLVDDIFFVPGYDINGFVVAQGNPILGVHIYLYSNDVSEVDCPQGSGNAPGQGKSLCHAVSDADGMFTFKSLPCGVYELIPFYKGENTIFDVSPLSVSVSVEHHHVTVAQKFQVTGFSVGGRVVDGNDAGVDGVKIIVDGQERSITDTQGYYKLDQVTSNRYTIEAKKEHYTFTTLKDFLVLPNMASIEDIRAASYDVCGVVRMVSAGYKAKVALTHGPENVKPQVKQTDETGNFCFEVPPGEYRLSALAATPESAPGLLFLPSYVDVAVKSPLLKVEFSQALVNIHGAVVCKEKCGPSVSVTLVRLAGKHNEERKTVSLTDESSEFLFSSVFPGKYRLEVKHLSPGAVSGEDSWCWEQSFIDVDVGADGIKGIVFVQKGYWINIVSSHDVDAYMTQPDGSSVNLKIKKGLQHICVESPGVHELHFVDSCIFFGSSSMKIDTSDTLPIHLKGDKYLLKGHIHVQSSSLSGEYELPESFIVEVLNSDGTVFGGSPARLISSENDQTSASVYEYSVWANLGEKLTFVPSDARNNGEKKILFYPRQQHVLVTNDGCQASIPPFSGRLGLYVEGSVSPPLSGVNIRIIAAGDSPNALFKKGDLALGTTTGTDGFFVGGPLYDDITYSIEASKTGYHLKQVGPNSFSCQKLSQISVHIYSKDDAEEPIPSVLLSLSGDDGYRNNSVSGTGGVFLFDHLFPGSFYLRPLLKEYAFSPPAQAIELGSGESREVVFQATRVAYSATGTVTLLSGQPKEGVSVEARSDSKGYYEETVTDSSGSYRLRGLLPDTTYLIKVVKKDDLSSSRIERASPESVSVKVGSEDIKALDFLVFEQPEMTILSCHVEGSRIEELHSHLRVEIKSASDPSKIESVFPLPLSNFFQVKDLPKGKHLLQLQSGFPSTTHKFESEIIEVDLEKNTQIHVGPLRFKVEEDHHKQELTPAPVFPLIVGVSVIALFISMPRLKDLYQTTMGMSMSGATSTAKKEVRKPILRKKTY

SEQ ID NO: 6891 - protein, 1198 aa, Ricinus communis
MKIRDALLYFSILLYSFSFASADSIHGCGGFVEASSSLIKSRKSTDTKLDYSDITVELRTVDGLVKERTQCAPNGYYFIPVYDKGSFVIKISGPEGWSWDPESVPVIVDDTGCNHNEDINFRFTGFTLSGRVMGAVGGESCLVKSGGPSNVNVELLSPSDDFISSVLTSATGSYSFNNIIPGKYKIRASHPDLKVEVKGSTEVHLGFENGIVDDIFFVPGYDLHGYVVAQGNPILGVHIFLYSEDVVELDCPQGSGDATGQRNPLCHAISDADGMFSFKSLPCGRYELVPYYKGENTLFDVSPPLVSVSVEHQHVTVPQKFQVTGFSVGGRVADGNDMGVEGVKIIVDGHERSMTDKEGYYKLDQVTSNHYTIEARKEHYRFNSLKEYMVLPNMASVADIKAISYDVCGVVRMVNSGYKAKVTLTHGPENVKPQARQTDGDGKFCFEVAPGEYRLSAFAATPESAPGLLFLPPYVDLVVKSPLMNVEFSQALVNVLGSVTCKEKCGPSVSVTLMRLGGKRNEERKSITLTDESDEFLFANVLPGKYRIEVKHSSHGATPDKDNWCWEQSFIDVVVGAEDVKGNLFVQKGYWVNVVSTHDIDAYLTQPDHSIINLKIKKGSQHICVESPGVHELHFINSCILFASSPMKIDTSNPSPVYLRGEKYLLKGQIKVELSSADGLYEPPNNFVVDILNGDSSVIDGASANLASGASDHTSTGIYEYSIWANLGEKLTFVPRDSRVNGEKRILFYPKEHNVLVANDGCQASIPVFSGRPGLYIEGSVSPPLSGVYIKISAAEDSHVTLLKKDDLALETVTGMDGSFVGGPLYDDISYSVEASKPGYHLKRMGPHSFSCQKLGQISIHIYSKDDANEPIPSVLLSLSGDDGYRNNSVSGAGGTFLFDNLFPGTFYLRPLLKEYAFSPPAQAIELGSGDTREVTFEATRVAYSATGMITLLSGQPKEGVSVEARSESKGYYEETVTDSSGNYRLRGLVPDTTYVIKVVEKHGLGSAFERASPESYTVKVGHGDIKALDFVVFEQLEMTILSCNVEGKRTEEFHSHLLVEIKSASDTSKIESVFPLPLSNFFQVKNLPKGKHLLQLRSSLQSSTLKFESDIIEVDLEKTAQIHVGPLRYNFEEDHQKQELTVAPVLPLVVGVSVIALFISMPRLKDLYQSTTGIPTPGFVTTAKKETRKPVVRKKTY

SEQ ID NO: 6892 - protein, 300 aa, Glycine max
MGAKKWFKIIVKLKKSKKDKSKEEKVISFEQTTDENSNEYSNGKQSTREESSSNANEGLMMDRTVPSRLMDDIAATRIQNAFRSFMARRTLHHLRGAEKFEALIQDHLAREQTATALSYIHSWSRTQEQIRARRICMITEARIKQKKLETQLKIEAKIQELEVEWCNGSETMEEIISRLHQREEAAIKRERAMAYAFSHQWRPNCSQYFGQASYSLGKESWGWSWTERWVAARPWEVRVRGQTTKTTKLNGHGQVQKTKLDKMNQNESKVALAKPTLSNGKERKTVLQGCQRTMYPNSPF

SEQ ID NO: 6893 - protein, 336 aa, Glycine max
MYHVSYHYHPPLSILSKQNPCVFFSHPGLLLAAFHSYLKRNKRMGAKKWFKIIVKLKKSKKDKSKEEKITDENSNEYSNGKQSTREESSSIPNEGLMMDRTVPSKLMDDIAATRIQNAFRSFMARRTLHHLRGAEKFEALIQDHLAREQTATALSYIHSWSRIQEQIRVRRICMITEARIKQKKLETQLKIEAKIHELEVEWCNGSETMEEIISRLHQREEAAIKRERAMAYAFSHQWRPNCSQYFGQASYSLGKESWGWSWTERWVAARPWEVRVRVQTTKTKNLNGQVQKTKLDKMNHNESKVALAKPTLSNGKETGKGKENGTSGLSKNNVSK

SEQ ID NO: 6894 - protein, 324 aa, Medicago truncatula; identical to SEQ ID NO: 6879

SEQ ID NO: 6895 - protein, 313 aa, Glycine max; identical to SEQ ID NO: 6875

SEQ ID NO: 6896 - protein, 323 aa, Glycine max
MAGIFSLVTGRPGLSGFGSSSTAEQVTEGIDASNLTAIITGGASGIGLETARVLAIRKVHVIIAARNMESAKEAKQLILQEDESACVDIMKLDLCSLKSVRTFVDNFIALGLPLNILINNAGVMFCPYQQTEDGIEMQFATNYLGHFLLTNLLLDKMKQTAKDTGIEGRIVNLSSIAHLYTYEEGIRFDTINDEDGYHEKKAYGQSKLANILHTNELSRRLQAEGVNITANSVHPGVIMTPLMRHSSLLMNFLKMFSFMIWKNVPQGAATTCYVALHPSLKGVTGKYLQDCNESPPSAHASNELLGRKLWDFSNKMINSLSKA

SEQ ID NO: 6897 - protein, 532 aa, Glycine max; identical to SEQ ID NO: 6401

SEQ ID NO: 6898 - protein, 511 aa, Glycine max; identical to SEQ ID NO: 6400

SEQ ID NO: 6899 - protein, 478 aa, Glycine max; identical to SEQ ID NO: 6395

SEQ ID NO: 6900 - protein, 468 aa, Glycine max; identical to SEQ ID NO: 6394

SEQ ID NO: 6901 - protein, 511 aa, Glycine max; identical to SEQ ID NO: 6400

SEQ ID NO: 6902 - protein, 524 aa, Glycine max; identical to SEQ ID NO: 6326

SEQ ID NO: 6903 - protein, 492 aa, Glycine max; identical to SEQ ID NO: 6328

SEQ ID NO: 6904 - protein, 372 aa, Glycine max; identical to SEQ ID NO: 6378

SEQ ID NO: 6905 - protein, 370 aa, Glycine max; identical to SEQ ID NO: 6379

SEQ ID NO: 6906 - protein, 441 aa, Glycine max; identical to SEQ ID NO: 6380

SEQ ID NO: 6907 - protein, 443 aa, Glycine max; identical to SEQ ID NO: 6381

SEQ ID NO: 6908 - protein, 439 aa, Cucumis melo subsp. melo; identical to SEQ ID NO: 6382

SEQ ID NO: 6909 - protein, 432 aa, Ricinus communis; identical to SEQ ID NO: 6383

SEQ ID NO: 6910 - protein, 440 aa, Vitis vinifera; identical to SEQ ID NO: 6384

SEQ ID NO: 6911 - protein, 438 aa, Arabidopsis lyrata subsp. lyrata; identical to SEQ ID NO: 6385

SEQ ID NO: 6912 - protein, 439 aa, Arabidopsis thaliana; identical to SEQ ID NO: 6386

SEQ ID NO: 6913 - protein, 439 aa, Arabidopsis thaliana; identical to SEQ ID NO: 6387

SEQ ID NO: 6914 - protein, 436 aa, Populus trichocarpa; identical to SEQ ID NO: 6388

SEQ ID NO: 6915 - protein, 436 aa, Populus trichocarpa; identical to SEQ ID NO: 6389

SEQ ID NO: 6916 - protein, 524 aa, Glycine max; identical to SEQ ID NO: 6326

SEQ ID NO: 6917 - protein, 443 aa, Glycine max; identical to SEQ ID NO: 6381

SEQ ID NO: 6918 - protein, 441 aa, Glycine max; identical to SEQ ID NO: 6380

SEQ ID NO: 6919 - protein, 468 aa, Glycine max; identical to SEQ ID NO: 6394

SEQ ID NO: 6920 - protein, 478 aa, Glycine max; identical to SEQ ID NO: 6395

SEQ ID NO: 6921 - protein, 510 aa, Glycine max; identical to SEQ ID NO: 6339

SEQ ID NO: 6922 - protein, 510 aa, Glycine max; identical to SEQ ID NO: 6340

SEQ ID NO: 6923 - protein, 478 aa, Glycine max; identical to SEQ ID NO: 6395

SEQ ID NO: 6924 - protein, 511 aa, Glycine max; identical to SEQ ID NO: 6400

SEQ ID NO: 6925 - protein, 595 aa, Glycine max; identical to SEQ ID NO: 6331

SEQ ID NO: 6926 - protein, 553 aa, Glycine max; identical to SEQ ID NO: 6332

SEQ ID NO: 6927 - protein, 492 aa, Glycine max; identical to SEQ ID NO: 6328

SEQ ID NO: 6928 - protein, 524 aa, Glycine max; identical to SEQ ID NO: 6326

SEQ ID NO: 6929 - protein, 806 aa, Glycine max; identical to SEQ ID NO: 6336

SEQ ID NO: 6930 - protein, 825 aa, Medicago truncatula; identical to SEQ ID NO: 6337

SEQ ID NO: 6931 - protein, 847 aa, Medicago truncatula; identical to SEQ ID NO: 6338

SEQ ID NO: 6932 - protein, 532 aa, Glycine max; identical to SEQ ID NO: 6401

SEQ ID NO: 6933 - protein, 510 aa, Glycine max; identical to SEQ ID NO: 6340

SEQ ID NO: 6934 - protein, 510 aa, Glycine max; identical to SEQ ID NO: 6339

SEQ ID NO: 6935 - protein, 553 aa, Glycine max; identical to SEQ ID NO: 6332

SEQ ID NO: 6936 - protein, 595 aa, Glycine max; identical to SEQ ID NO: 6331

SEQ ID NO: 6937 - protein, 524 aa, Glycine max; identical to SEQ ID NO: 6326

SEQ ID NO: 6938 - protein, 492 aa, Glycine max; identical to SEQ ID NO: 6328

SEQ ID NO: 6939 - protein, 415 aa, Glycine max; identical to SEQ ID NO: 6357

SEQ ID NO: 6940 - protein, 524 aa, Glycine max; identical to SEQ ID NO: 6326

SEQ ID NO: 6941 - protein, 510 aa, Glycine max; identical to SEQ ID NO: 6339

SEQ ID NO: 6942 - protein, 510 aa, Glycine max; identical to SEQ ID NO: 6340

SEQ ID NO: 6943 - protein, 595 aa, Glycine max; identical to SEQ ID NO: 6331

SEQ ID NO: 6944 - protein, 553 aa, Glycine max; identical to SEQ ID NO: 6332

SEQ ID NO: 6945 - protein, 492 aa, Glycine max; identical to SEQ ID NO: 6328

SEQ ID NO: 6946 - protein, 806 aa, Glycine max; identical to SEQ ID NO: 6336

SEQ ID NO: 6947 - protein, 825 aa, Medicago truncatula; identical to SEQ ID NO: 6337

SEQ ID NO: 6948 - protein, 847 aa, Medicago truncatula; identical to SEQ ID NO: 6338

SEQ ID NO: 6949 - protein, 510 aa, Glycine max; identical to SEQ ID NO: 6340

SEQ ID NO: 6950 - protein, 510 aa, Glycine max; identical to SEQ ID NO: 6339

SEQ ID NO: 6951 - protein, 553 aa, Glycine max; identical to SEQ ID NO: 6332

SEQ ID NO: 6952 - protein, 595 aa, Glycine max; identical to SEQ ID NO: 6331

SEQ ID NO: 6953 - protein, 139 aa, Arachis hypogaea
MANAASGMAVHDDCKLRFLELKAKRTHRFIVFKIEENQKQVIVEKLGEPAQGYEDFTACLPPNECRYAVYDFEYLTEGNVPKSRIFFIAWSPDTSRVRNKMIYASSKDRFKRELDGIQVELQATDPTEMDLDVFKSRAN

SEQ ID NO: 6954 - protein, 139 aa, Glycine max
MANAASGMAVHDDCKLRFLELKAKRTHRFIVFKIEEQQKQVIVEKLGEPAQGYEDFTASLPADECRYAVYDFEYLTEGNVPKSRIFFIAWSPDTSRVRSKMIYASSKDRFKRELDGIQVELQATDPTEMGLDVFKSRAN

SEQ ID NO: 6955 - protein, 139 aa, Glycine max
MANAASGMAVHDDCKLRFLELKTKRTHRFIVFKIEEQQKQVIVEKLGEPAQGYEDFTASLPADECRYAVYDFEYLTEGNVPKSRIFFIAWSPDTSRVRSKMIYASSKDRFKRELDGIQVELQATDPTEMGLDVFKSRAN

SEQ ID NO: 6956 - protein, 139 aa, Medicago truncatula
MANAASGMAVHDDCKLKFMELKAKRTHRFIVYKIEEKQKQVIVEKLGEPAQGYEDFTACLPADECRYAVYDFEYLTEENVPKSRIFFIGWSPDTARVRSKMIYASTKERFKRELDGIQIELQATDPTEMGLDVFKSRAN

SEQ ID NO: 6957 - protein, 139 aa, Medicago truncatula
MANAASGMAVHDDCKLKFMELKAKRTHRFIVYKIEEKQKQVIVEKLGEPAQGYEDFTACLPADECRYAVYDFEYLTEENVPKSRIFFIGWSPDTARVRSKMIYASTKERFKGELDGIQIELQATDPTEMGLDVFKSRAN

SEQ ID NO: 6958 - protein, 139 aa, Medicago truncatula
MANAASGMAVHDDCKLRFMELKAKRTHRFIIYKIEEKQKQVIVEKLGEPVQGYEEFAACLPADECRYAVFDYEFMTEGNVPKSRIFFIAWSPDTSRVRSKMIYASSKDRFKRELDGIQIELQATDPTEIGLDVFKSRAS

SEQ ID NO: 6959 - protein, 139 aa, Gossypium hirsutum
MANAASGMAVHDDCKLKFLELKAKRTHRFIVFKIEEKQKQVIVEKLGEPTESYEDFTKCLPADECRYAVYDFDFLTAENVPKSRIFFIAWSPDTSRIRSKMIYASSKDRFKRELDGIQVELQATDPTEMGLDVFKSRAN

SEQ ID NO: 6960 - protein, 139 aa, Gossypium hirsutum
MANAASGMAVHDDCKLKFLELKTKRTHRFIVFKIEEKQKQVIVEKLGEPTESYEDFTKCLPADECRYAVYDFDFLTAENVPKSRIFFIAWSPDTSRIRSKMIYASSKDRFKRELDGIQVELQATDPTEMGLDVFKSRAN

SEQ ID NO: 6961 - protein, 139 aa, Cucumis melo subsp. melo
MANAASGMAVHDDCKLKFLELKTKRTYRFIVYKIEEKQKQVTVEKVGEPGQSYEDFTACLPADECRYAVYDFEFLTEGNVPKSRIFFIAWSPDTSKVRSKMIYASSKDKFRRELDGIQIELQATDPSEMDLDVFKSRAK

SEQ ID NO: 6962 - protein, 139 aa, Gossypium hirsutum
MANAASGMAVHDDCKLKFQELKAKRTHRFIVFKIEEKQKQVIVEKLGEPTESYEDFTKCLPADECRYAVYDFDFLTAENVPKSRIFFIAWSPDTSRIRSKMIYASSKDRFKRELDGIQVELQATDPTEMGLDVFKSRAN

SEQ ID NO: 6963 - protein, 139 aa, Glycine max; identical to SEQ ID NO: 6955

SEQ ID NO: 6964 - protein, 139 aa, Plantago major
MANAASGMAVHDDCKLKFMELKTKRTHRFIVYKIEEKQKQVMVETLGEPVQTYEDFTASLPADECRYAVFDFDYMTVDNVPKSRIFFVAWSPDTARVRNKMIYASSKDRFKRELDGIQVELQATDPTEMGLDVFKSRAN

SEQ ID NO: 6965 - protein, 139 aa, Populus trichocarpa
MANAASGMAVHDDCKLKFLELKAKRTYRFIVYKIEEKQKQVIVEKLGEPAQSYEDFTASLPADECRYAVYDFDFVTEENVQKSRIFFIAWSPDTSRVRSKMIYASSKDRFKRELDGIQVELQATDPTEMGLDVIKSRAS

SEQ ID NO: 6966 - protein, 181 aa, Glycine max
MASIPNLSSFLPTLSHSNPNNQCTLPPTSLFGTRITLLRATSSSRSLPNTSCSATSATVSFSLPTPKPLSDTPDKTPKWSERAIKSYAMGELEARKLKYPNTGTEAILMGILVEGTSNAAKFLRANGITLLKAREETVELLGKSDLFFFSPEHPPLTEPAQKALDWAIEEKLKSDLGYSRF

SEQ ID NO: 6967 - protein, 385 aa, Glycine max
MHRCHYPCAPTSWIMMTYLTASFYLYKCLKRHTLSLLTVMDNNTISDLIQFNDLIPKLPSELGLECLTRLPHSAHRVALRVCSQWHCLLQSDAFYSHRKKTGHTRKVTCLVQAREDQPLQEKNNASVASVYGISVFDPESMTWDRVDPVPDYPSGLPLFCQLASCDGKLVLMGGWDPASYEPLTAVFVYDFRTSEWRRGKDMPEKRSFFAIGAGVGRVYVAGGHDENKNALSTAWAYDPRSDEWAGLDPMGRERDECEGVVIGDEFWVVSGYSTERQGMFDGSAEVLDIGSGGWREENGFWEEGQCPRSCVGVGKDGRLVNWRGWDPGLRVGVCGVAVGSRVVLSGSDYEGAPHGFYLVDNRKLTKINVPEGFSGFVQSGCCVEI

SEQ ID NO: 6968 - protein, 1114 aa, Glycine max
MESWMWCFLLCSHLLILYFSPSHSLCHPHDNSALLHFKNSFTIYEDPYYSYYCDHGYSKTTTWENGRDCCSWAGVTCHPISGHVTELDLSCSGLHGNIHPNSTLFHLSHLHSLNLAFNHLYTSHLSSLFGGFVSLTHLNLSHSEFEGDIPSQISHLSKLVSLDLSKNATVLKVLLLDFTDMSSISIRTLNMSSSLVTLGLLANGLSGKLTDGILCLPNLQYLYLSFNEDLHGQQLPEMSCSTTSLGFLDLSGCGFQGSIPPSFSNLTHLTSLDLSANNLNGSVPSSLLTLPRLTFLNLNNNQLSGQIPNIFPKSNNFHELHLSYNNIEGEIPSTLSNLQHLIILDLSLCDFQGSIPPSFSNLILLTSLDLSYNHLNGSVPSSLLTLPRLTFLNLNANCLSGQIPNVFLQSNNIHELDLSNNKIEGELPSTLSNLQRLILLDLSHNKFIGQIPDVFVGLTKLNSLNLSDNNLGGPIPSSLFGLTQFSYLDCSNNKLEGPLPNKIRGFSNLTSLRLYGNFLNGTIPSWCLSLPSLVDLYLSENQFSGHISVISSYSLVRLSLSHNKLQGNIPDTIFSLVNLTDLDLSSNNLSGSVNFPLFSKLQNLERLNLSHNNQLSLNFKSNVNYSFSSLWSLDLSSTGLTEFPKLSGKVPILKLLHLSNNTLKGRVPNWLHDTNSSLYLLDLSHNLLTQSLDQFSWNQHLVYLDLSFNSITAGSSSICNATAIEVLNLSHNKLTGTIPQCLINSSTLEVLDLQLNKLHGPLPSTFAKNCQLRTLDLNGNQLLEGFLPESLSNCINLEVLNLGNNQIKDVFPHWLQTLPELKVLVLRANKLYGPIEGSKTKHGFPSLVIFDVSSNNFSGSIPNAYIKKFEAMKNVVLYPDWQYMEISISFAETNYHDSVTITTKAITMTMDRIRNDFVSIDLSKNRFEGGIPNAIGELHSLRGLNLSHNRLIGPIPQSMGNLRYLESLDLSSNMLIGGIPTELSNLNFLEVLNLSNNHLVGEIPRGQQFNTFPNDSYKGNSGLCGLPLTIKCSKDPEQHSPPSTTFRREPGFGFGWKPVAIGYGCGVVFGVGMGCCVLLIGKPQWLVRMVGGKLNKKVKRKTRMRSNENGSRMN

SEQ ID NO: 6969 - protein, 1102 aa, Glycine max
MESWMWCFLLCSHLLILYFSPSHSLCHPHDTSALLHFKNSSIIDEDPYYYSKTRTWENGTDCCSWAGVTCHPISGHVTELDLSCSGIVGYIDPNSTLFHLSHLHSLNLAFNYFDESPLSSLFGGFVSLTHLNLSNSEFEGDIPSQISHLFKLVSLDLSYNFLKLKEDTWKRLLQNATVLRVLLLNDGTDMSSVSIRTLNMSSSLVTLSLGWTWLRGNLTDGILCLPNLQHLDLSFNPALNGQLPEVSYRTTSLDFLDLSHCGFQGSIPPSFSNLTHLTSLYLSHNKLNGSIPPSFSNLTHLTSLYLSHNDLNGSIPPSFSNLTHLTSLYLSHNDLNGSIPPSFSNLTHLTSMDLSYNSLNGSVPSSLLTLPRLTFLNLDNNHLSGQIPNAFPQSNNFHELHLSYNKIEGELPSTFSNLQHLIHLDLSHNKFIGQIPDVFARLNKLNTLNLEGNNFGGPIPSSLFGSTQLSELDCSNNKLEGPLPNNITGFSSLTSLMLYGNLLNGAMPSWCLSLPSLTTLNLSGNQFTGLPGHISTISSYSLERLSLSHNKLQGNIPESIFRLVNLTDLDLSSNNFSGSVHFPLFSKLQNLKNLDLSQNNQLLLNFKSNVKYNFSRLLWRLDLSSMDLTEFPKLSGKIPFLESLHLSNNKLKGRVPNWLHEASSWLSELDLSHNQLMQSLDQFSWNQQLRYLDLSFNSITGGFSSSICNASAIQILNLSHNKLTGTIPQCLANSSSLQVLDLQLNKLHGTLPSTFAKDCRLRTLDLNGNQLLEGFLPESLSNCNDLEVLDLGNNQIKDVFPHWLQTLPELKVLVLRANKLYGPIEGSKTKHGFPSLVIFDVSSNNFSGPIPNAYIKNFQAMKKIVVLDTDRQYMKVPSNVSEYADSVTITSKAITMTMDRIRKDFVSIDLSQNRFEGKIPSVIGELHSLRGLNLSHNRLRGPIPNSMGNLTNLESLDLSSNMLTGRIPTGLTNLNFLEVLNLSNNHFVGEIPQGKQFSTFSNDSYEGNLGLCGLPLTTECSKDPKQHSPASLTFRGEQGFGFGWKPVAIGYGCGMVFGVGMGCCVLLIGKPQWIVRMVGGQLNKKVKRKTRMRSNENGSRMN

SEQ ID NO: 6970 - protein, 1056 aa, Glycine max
MESWMWCFLLCSHLLILYFSPSHSLCHPHDTSALLHFKNSFTINTSYGHNEYPYYYHKCDTGYSKTRTWENGTDCCSWAGVTCHPISGHVTDLDLSCSGLHGNIHPNSTLFHLSHLHSLNLAFNHLYQSHWSSLFGGFVSLTHLNLSYSEFEGDIHSQISHLSKLVSLDLSGNDLLEWKEDTWKRLLQNATVLRVLVLDGADMSSISIRTLNMSSSLVTLSLRYSGLRGNLTDGILCLPNLQHLDLSGNWVRGGQLAEVSCSTTSLDFLALSDCVFQGSIPPFFSNLTHLTSLDLSYNNLNGPIPPSFFNLTHLTSLDLSGINLNGSIPSSLLTLPRLNFLKLQNNQLSGQIPDVFPQSNSFHELDLSDNKIEGELPSTLSNLQHLIFLDLSYNKLDLSGNKIEGELPSTLSNLQHLLHLDLSYNKLEGPLPNNITGFSNLTSLRLNGNLLNGTIPSWCLSLPSLKQLDLSGNQLSGHISAISSYSLETLSLSHNKLQGNIPESIFSLLNLTLLDLSSNNLSGSVKFHHFSKLQNLKELQLSRNDQLSLNFKSNVKYNFSRLWRLDLSSMDLTEFPKLSGKVPFLESLHLSNNKLKGRVPNWLHETNSLLLELDLSHNLLTQSLDQFSWKKPLAYLDLSFNSITGGFSSSICNASAIEILNLSHNMLTGTIPQCLVNSSTLEVLDLQLNKLHGPLPSTFAQDCWLRTLDLNGNQLLEGFLPESLSNCIYLEVLNLGNNQIKDVFPHWLQTLPELKVLVLRANKLYGPIEGSKTKHGFPSLVIFDVSSNNFSGPIPKAYIKKFEAMKNVVLDAYSQYIEVPFNLFYGPNDRPNDRPNYADSVTITTKAITMTMVRIRNDFVSIDLSQNRFEGEIPGVIGELHSLRGLNLSHNRLIGPIPQSMGNLRNLESLDLSSNMLTGRIPTELSNLNFLEVLNLSNNHLVGEIPQGKQFGTFSNDSYEGNSGLCGLPLTIKCSKDPEQHSPPSTTFRKEGGFGFGWKAVAIGYGCGMVFGVGMGCCVLLIGKPQWLVRMVGGKLNKKVKRKTRMRSNENGSRMN

SEQ ID NO: 6971 - protein, 813 aa, Glycine max
MEFMSFGLGIDVNLCSWENGTDCCSWAGVTCHPISGHVTQLNLSCNGLYGNIHPNSTLFHLSHLHSLNLAFNDFDESHLSSLFGGFVSLTHLNLSNSYFEGDIPSQISHLSKLVSLDLSDNNLNGSIPSSLLTLTHLTFLDLSYNQLSGQIPDVFPQSNSFHELHLNDNKIEGELPSTLSNLQHLILLDLSDNKLEGPLPNNITGFSNLTSLRLNGNLLNGTIPSWCLSLPSLKQLDLSGNQLSGHISAISSYSLETLSLSHNKLQGNIPESIFSLLNLYYLGLSSNNLSGSVKFHRFSKLQYLEELHLSWNDQLSLNFESNVNYNFSNLRLLNLSSMVLTEFPKLSGKVPILESLYLSNNKLKGRVPHWLHEISLSELDLSHNLLTQSLHQFSWNQQLGSLDLSFNSITGDFSSSICNASAIEILNLSHNKLTGTIPQCLANSSSLLVLDLQLNKLHGTLPSIFSKDCQLRTLDLNGNQLLEGLLPESISNCIHLEVLDLGNNQIKDVFPHWLQTLPELKVLVLRANKLYGPIAGLKIKDGFPSLVIFDVSSNNFSGPIPKAYIQKFEAMKNVVIDTDLQYMEISFSYGGNKYSDSVTITTKAITMTMDRIRNDFVSIDLSQNGFEGEIPNAIGELHSLRGLNLSHNRLIGPIPQSMGNLTNLESLDLSSNMLTGRIPTELTNLNFLEVLNLSNNHLAGEIPRGQQFNTFSNDSYKGNLGLCGLPLTTECSKGPEQHSPPSTTLRREAGFGFGWKPVAIGYGCGVVFGVGMGCCVLLIGKPQWLVRMVGGKLNKKVKRKTRMRSNENGSRMN

SEQ ID NO: 6972 - protein, 981 aa, Glycine max
MDVVFPSLFPFAHPLFFTLSFLMPPHDTSALLHFKNSFTIYEDPYYSYFCDHGYSKTTTWENGRDCCSWAGVTCHPISGHVTQLDLSCNGLYGNIHPNSTLFHLSHLHSLNLAFNDFDESNLSSLFGGFESLTHLNLSSSDFEGDIPSQISHLSKLVSLDLSYNILKWKEDTWKRLLQNATVLRVIVLDGNDMSSISIRTLDMSSSLVTLSLRQTGLRGNLTDGILCLPNLQHLDLSLNWDLKGQLPEVSCRTTSLDFLHLSCCDFQGSIPPSFSNLIHLTSLYLSLNNLNGSIPPFFSNFTHLTSLDLSENNLNGSIPPSFSNLIHLTFLDLSHNNLNGSIPPSFSNLIHLTSLDLSGNNLNGSIPPFFSNFTHLTSLDLSENNLNGTIPSWCLSLPSLVGLDLSGNQFSGHISAISSYSLERLILSHNKLQGNIPESIFSLLNLTDLDLSSNNLSGSVKFHHFSKLQNLKELQLSQNDQLSLNFKSNVSYSFSNLLSLDLSSMGLTEFPKLSGKVPILESLYLSNNKLKGRVPNWFHEISLYELDLSHNLLTQSLDQFSWNQQLGYLDLSFNSITGDFSSSICNASAIEILNLSHNKLTGTIPQCLANSSSLQVLDLQLNKLHGTLPSTFAKDCWLRTLDLNGNQLLEGFLPESLSNCINLEVLDLGNNQIKDVFPHWLQILPELKVLVLRANKLYGPIAGLKTKHGFPSLVIFDVSSNNFSGPIPKAYIKTFEAMKNVALHAYSQYMEVSVNASSGPNYTDSVTITTKAITMTMDRIRNDFVSIDLSQNRFEGEIPSVIGELHSLRGLNLSHNRLIGPIPQSVGNLRNLESLDLSSNMLTGGIPTELINLNFLEVLNLSNNNLVGEIPQGKQFGTFSNDSYEGNSGLCGLPLTIKCSKDPEQHSPPSTTFRREGGFGFGWKPVAIGYGCGMVFGVGMGCCVLLMGKPQWLVRMVGGQLNKKVKRKTRMKSNENGSIMN

SEQ ID NO: 6973 - protein, 846 aa, Glycine max
MRETRTWENGTDCCSWAGVTCHPISGHVTELDLSCSGLVGKIHPNSTLFHLSHLHSLDLAFNDFDESHLSSLFGGFVSLTHLNLSATYSEGDIPSQISHLSKLVSLDLSYNMLKWKEDTWKRLLQNATVLRVLLLDENDMSSISIRTLNMSSSLVTLSLVWTQLRGNLTDGILCLPNLQHLDLSINWYNSYNRYNRYNRYNKGQLPEVSCRTTSLDFLDISNCGFQGSIPPSFSNLIHLTSLYLSSNNLKGSIPPSFSNLTHLTSLDLSYNNLNGSIPSFSSYSLKRLFLSHNKLQGNIPESIFSLLNLTDLDLSSNNLSGSVKFHHFSKLQNLGVLYLSQNDQLSLNFKSNVKYNFSRLWRLDLSSMDLTEFPKLSGKVPFLESLHLSNNKLKGRLPNWLHETNSLLYELDLSHNLLTQSLDQFSWNQQLAIIDLSFNSITGGFSSSICNASAIAILNLSHNMLTGTIPQCLTNSSFLRVLDLQLNKLHGTLPSTFAKDCWLRTLDLNGNQLLEGFLPESLSNCIYLEVLDLGNNQIKDVFPHWLQTLPYLEVLVLRANKLYGPIAGSKTKHGFPSLVIFDVSSNNFSGPIPKAYIKKFEAMKNVVQDAYSQYIEVSLNFSYGSNYVDSVTITTKAITMTMDRIRNDFVSIDLSQNRFEGEIPSVIGELHSLRGLNLSHNRLIGPIPQSMGNLRNLESLDLSSNMLTGGIPTELSNLNFLEVLNLSNNHLVGEIPQGKQFGTFSNDSYEGNLGLCGLPLTTECSKDPEQHSPPSTTFRREPGFGFGWKPVAIGYGCGMVFGVGMGCCVLLIGKPQWLVRMVGGQLNKKVKRKTRMRSNENGSRMN

SEQ ID NO: 6974 - protein, 863 aa, Glycine max
MKNVVIYANPQYMETSVIVSDTNNIDHETNYADSVTTTTWENGTDCCSWAGVSCNPISGHVTELDLSCSRLYGNIHPNSTLFHLSHLHSLNLAFNDFNYSHLSSLFGGFVSLTHLNLSNSHFEGDIPSQISHLSKLVSLDLSYNGLKWKEHTWKRLLQNATVLRVLVLDQTDMSSISIRTLNMSSSLVTLSLRENGLRGNLTDGSLCLPNLQHLDLSYNRALKGKLPEVSCRTTSLDFLDLSLCGFQGSIPPSFSNLIHLTSLDLSGNNLNGSIPPSFSNLIHLTSLDLSYNNLNGSIPSFSSYSLETLFLSHNKLQGNIPESIFSLLNLTHLDLSSNNLSGSVKFHRFSKLQNLEKLHLSWNDQLSLNFESNVNYSFSNLKLLNLSSMVLTEFPKLSGKVPILESLYLSNNKLKGRVPHWLHEVSLSELNLSHNLLTQSLDQFSWNQQLGYLDLSFNSITGDFSSSICNASAIEILNLSHNKLTGTIPQCLANSSSLLVLDLQLNKLHGTLPSIFSKDCRLRTLDLNGNQLLEGLLPESLSNCIDLEVLDLGNNQIKDVFPHWLQTLPELKVLVLRANKLYGPIVGLKIKHGFPRLVIFDVSFNNFSGPIPKAYIQKFEAMKNVVIDTDLQYMEISIGAKKMYSDSVTITTKAITMTMDKIPKGFVSIDLSKNGFEGEIPNAIGELHALRGLNLSHNRIIGPIPQSMGNLTNLESLDLSSNMLTGGIPTELSNLNFLEVLNLSNNHLAGEIPRGQQFSTFTNDSYEGNSGLCGLPLTIKCSKDPEQHSPTSTTLRREGGFGFGWKPVAIGYGCGMVFGVGMGCCVLLIGKPQWLVRMVGGKPNKKVKRKTRMRSNENGSRMN

SEQ ID NO: 6975 - protein, 1036 aa, Medicago truncatula
MRMFLLCLHLLLFLFSSFSSCSSSNLLCHPEDSYSLLQFKSSFTTYTNYACLEQPQKTSTWKIETNCCSWHGVTCDAVSGRVIGLDLGCECLQGKIYPNNTLFHLAHLQSLNLSHNDFFNSNLHSQFGGFKSLTHLDLSSCNFQGEVPPQISYLLQLTSLRLSKNDELSWKETTLKRLVQNATILQELYLDETDMTSINPNLLNSIFNKSSSLISLSLQRTGLSGNWKNNILCLPNIQELDMSKNDNLEGQLPDLSCSTSLRILDLSYCLFKGPIPLSFSNLTYFTSLSLIENNLNGSIPSFLLILPNLTFLSLKDNSLISGLIPNVFPESNRFQELDLSGNKIGGDLPTSLSNLQHLVNLDLSSNSFSGQIPDVFYKLTKLQELRLDNNRLDGQIPPSLFNLSQLDYFDCSYNKLKGPLPNKITGFQNLGYLLLNNNLLSGKIPSWCLSIPSLTMLDLSNNQFTGNISAVSSYSLWYLKLCSNKLQGDIPESIFNLVNLTTLCLSSNNLSGIVNFKYFSKLQNLNSLSLSHNSQLSPNFESNVSYNFSILSILELSSVGLIGFSKLSSGKFPSLRYLDLSNNKLYGRVPNWLLEIDSLQFLGLSHNLFTSMDQFSSNHWHDLYGLDLSFNLLAGDISSSICNRTSLQLLNLAHNKLTGTIPHCLANLSSLQVLDLQMNKFYGTLPSNFSKYCDLRTLNFNGNLLEGLLPKSLSNCEYLEALNLGGNKIKDYFPSWLQTMQYLEVLVLRENNLYGPIAGVNIKHPFPSLIIFDISSNNFSGPLPKAYIQNFKAMKNVIQVGEGSSSQYMERMEVGDMTYYDSVTMTVKGNSIVMVKIPIVFVNIDFSHNNFEGEILNVIGELHSLKGLNLSHNRLTGPIPQSVGNLSNMESLDLSSNILTGVIPSELINLNGIGVLNLSHNHLVGEIPQGKQFNTFSNDSYEGNLGLCGFPLSKKCEPEQHSPLPPNNLWSEEKFGFGWKPVAIGYGCGMVIGIGLGCFVLLTGKPRWLVMMVGGQPKQRVTRRIRVRRIHGSTMN

SEQ ID NO: 6976 - protein, 1347 aa, Medicago truncatula
MEQLLNCTQADRFQKLTTVKSPMLLQFWTNSSMRLEECEVECLKDCFCNTYANSLINGGSHGCMLWFGDLIDIRLLISEDSEVTSQEELCDVAKKYFDELFRPNDGVHKPVLELIHSRVTLEYNQSLIPITKKGLKQDLFQMHQDKSLGPDSFNPTFFLMFLVSLLKCCLDKCISHEEYAFVEAIEVIHASKRVEWRCKGGVAWRIGDGSNVRIMMDSLLRGDKGKWLQSHQNQDHDLDVEFHIFFHCTNIRPVDISREERPREGWIKCNVNATFIATFSCSNKLEICEMSTIKGEAKTLLEAIQMAINKGLERVVFERDSQLKLSMEKCLLLSLILLFFHFPSFSSSSSFNSSLCHHDESFALLQFKSSFTIDTPCVKSPMKTATWKNGTDCCSWHGVTCDTVSGHVIGLNLGCEGFQGILHPNSTLFHLAHLQMLNLSNNYFSNDFSGSHFHSKFGGFMSLTHLDLSSCFFQDEIPSQISDLSKLQSLHLSGNDKLVWKETTLKRLVQNATSLRELFLDYTDMSLIRPNSINLLFNRSFSLVTLNLRETILSGKLKKSILCLPSIQELDMSYNDHLEGQLPELSCSTSLITLDLSGCGFQGSIPLSFSNLTRLASLRLSGNHLNGSIPSTILTFSHLTFLYLDDNVLNGQIPDSFHLSNKFQIIDLSGNKIGGELPTSLSNLRHLINLDLSYNSLSGQIPDVFGGMTKLQELRLYSNNLVGQIPLSLFKLTQLVRFDCSYNKLRGPLPNKITGFQQLVRFRLNDNRLNGTIPSSLLSLPRLLNLYLSNNQLTGHISAISSYSLEALNLGGNKLQGNIPESIFNLVNLAVLDLSSNNLSGVVNFQHFGKLQNLYSLSLSQNTQLSLTFESNVSYNFSHLRELDLSSINLTNFPILSEKFLSLDYFDLSNNNLNGRVPNWLFETAESLNLSQNCFTSIDQISRNVDQLGSLDLSSNLLEGDISLSICSMKSLRFLNLAHNKLTGIIPQYLANLSSLQVLDLQMNRFYGALPSNFSKYSDLRSLNLNGNHIEGHLPKSLSHCKTLEFLNLGSNKIEDKFPDWIQTLQDLKVLVLRDNKLHGHIANLKIKNPFPSLVIFDISGNNFSGPLPPKDYFKKYEAMKAVTQVGENTSLLYVQDSAGSYDSVTVANKGINMTLVKIPINFVSIDFSRNKFNGGIPNDIGELHALKGLNLSHNRLTGPIPQSIQNLTNLESLDLSSNMLTGMIPAELTNLNSLEVLDLSNNHLVGEIPQGKQFNTFTNDSYKGNLGLCGLPLSKKCGPEQHSPPSANNFWSEEKFGFGWKPVAIGYGCGFVFGIGLGYYMFLIGKPRWFVMIFGGHPKRRVNRRT

SEQ ID NO: 6977 - protein, 374 aa, Glycine max
MLKLSCNGLDRAHSLAQCGFAGRPACAVPRRRRSGVSGFRLPEGRSIRVSAAVSAKDGAVATRVEADPGTLADRLRVGSLTEDGLSYKEKFIVRSYEVGINKTATVETIANLLQEVGCNHAQSVGYSTDGFATTPTMRKLRLIWVTARMHIEIYKYPAWSDIVEIETWCQGEGRVGTRRDFILKDYATDEVIGRATSKWVMMNQDTRRLQKVSDDVKEEYLVFCPREPRLAIPEADSNSLKKIPKLEDPAQYSRLGLVPRRADLDMNQHVNNVTYIGWVLESMPQEIIDSHELQSITLDYRRECGQHDIVDSLTSVEAIQGGAEAVPELKGTNGSATAREDKHEHQQFLHLLRLSTEGLEINRGRTEWRKKAPR

SEQ ID NO: 6978 - protein, 375 aa, Glycine max
MLKLSCNGLDRAHSLAQCGFAGRPACVVPRRRISGVSGFWSPGGRAIRVSAAVVSAKDGAVATRVEAESGTLADRLRVGSLTEDGLSYKEKFIVRSYEVGINKTATVETIANLLQEVGCNHAQSVGYSTDGFATTPTMRKLRLIWVTARMHIEIYKYPAWSDVVEIETWCQGEGRVGTRRDFILKDYASDAVIGRATSKWVMMNQDTRRLQKVSDDVKEEYLVFCPREPRLAIPEADSNNLKKIPKLEDPAQYSRTGLVPRRADLDMNQHVNNVTYIGWVLESMPQEIIDSHELQSITLDYRRECGQHDIVDSLTSVEEIQGGAEAVSELKSTNGSAMAREDKHEHQQFLHLLRLSTEGLEINRGRTEWRKKAPR

SEQ ID NO: 6979 - protein, 372 aa, Arachis hypogaea
MLKVSCNGSDRVQFMAQCGFAGQPASVLVRRRSVSAVGFGYPMNRVLSVRAIVSDRDGAVVNRVGAEAGTLADRLRLGSLTEDGLSYKEKFIVRSYEVGINKTATVETIANLLQEVGCNHAQSVGYSTDGFATTPTMRKLGLIWVTARMHIEVYKYPAWSDVVEIETWCQGEGRVGIRRDFILKDYATDQVIGRATSKWLMMNQETRRLQKVSDDVREEVLIYCPREPRLAIPEEDSNCLKKIPKLEDPGQYSRLRLMPRRADLDMNQHVNNVTYIGWVLESMPQEIIDSHELHSITLDYRRECQRDDIVDSLTSIEGDGVLLEVNGTNGSSVAWEHGHAYQQFLHLLKLSTDEGLEINRGRTAWRKKASRL

SEQ ID NO: 6980 - protein, 376 aa, Vitis vinifera
MSVSMLKAPCNAADQLQALAQCRAHVAPRRLPRRRISGVSFSAPPRTPVVAVLDRVAAADGEQSRLAVAGSGSLADRLRMGSLTEDGLSYKERFIVRCYEVGINKTATVETIANLLQEVGCNHAQSVGFSTDGFATTHTMRKLHLIWVTARMHIEIYKYPAWSDVIEIETWCQGEGRIGTRRDWILKDYATGQVIGRATSKWVMMNQDTRRLQKVSDDVRDEFLIYCPRELRLAFPDENNSSLQKIAKLEDPSQYSRLGLVPRRADLDMNQHVNNVTYIGWVLESMPQEIIDTHELQTITLDYRRECQHDDIVDSLTSSESTEDAKTIPELRGTNGSATATKGQQDCCQFLHLLRLSGEGLEINRGRTEWRKKTAR

SEQ ID NO: 6981 - protein, 369 aa, Jatropha curcas
MMLKVPCTAPDQIQSLAPQCRFLNQHRSSSHFTRRRANAVVYSSPVAKISTQPVVSDGVTKVESGCESLADRLRLGHLTEDGFSYKEKFIVRSYEVGINKTATVETIANFLQEVGCNHAQSVGFSTDGFATTPTMRKLHLIWVTARMHIEIYKYPAWSDVVEIETWCQSEGRIGTRRDWILKDYATGQVIGRATSKWVMMNQDTRRLQKVTDDVRDEYLVFCPRELRLAFPEENNRSLKKISKLEDTTQYSKLGLVPRRADLDMNQHVNNVTYIGWVLESMPQEIIDTHELQTITLDYRRECQHDDVVDSLTSAESLEGAGLDLHATNGSATAIAGEQDSRNFLHLLRFSSDGLEINRGRTEWRKKPSR

SEQ ID NO: 6982 - protein, 371 aa, Ricinus communis
MLKVPCCNATDPIQSLSSQCRFLTHFNNRPYFTRRPSIPTFFSSKNSSASLQAVVSDISSVESAACDSLANRLRLGKLTEDGFSYKEKFIVRSYEVGINKTATVETIANLLQEVGCNHAQSVGFSTDGFATTTSMRKMHLIWVTARMHIEIYKYPAWSDVVEVETWCQSEGRIGTRRDWILTDYATGQIIGRATSKWVMMNQDTRRLQKVTDDVREEYLVFCPRELRLAFPEENNRSSKKISKLEDPAQYSKLGLVPRRADLDMNQHVNNVTYIGWVLESIPQEIIDTHELQTITLDYRRECQHDDIVDSLTSVEPSENLEAVSELRGTNGSATTTAGDEDCRNFLHLLRLSGDGLEINRGRTEWRKKSAR

SEQ ID NO: 6983 - protein, 367 aa, Arabidopsis lyrata subsp. lyrata
MLKLSCNVTDHVHNFFSDSRRIFVPVHRRTGPISCFQLKKEPLRAILSADHGNSSLRVTDFVSVTSPADRLRFGRLMEDGFSYKEKFIVRSYEVGINKTATVETIANLLQEVACNHVQKVGFSTDGFATTLTMRKLHLIWVTARMHIEIYKYPAWSDVVEIETWCQSEGRIGTRRDWILKDCATGEVIGRATSKWVMMNQDTRRLQRVTDEVRDEYLVFCPREPRLAFPEENNSSLKKIPKLEDPAQYSMLGLKPRRADLDMNQHVNNVTYIGWVLESIPQEIIDTHELKVITLDYRRECQQDDIVDSLTTSETPNEAVSKLTGTNGSTTSSKQEHTESQFLHILRLSENGQEINRGRTQWRKKSSR

SEQ ID NO: 6984 - protein, 362 aa, Brassica rapa
MLKLSCNATDKLQTLFSHSHQPDPAHRRTVSSVSCSHLRKPVLDPLRAIVSADQGSVIRAEQGLGSLADQLRLGSLTEDGLSYKEKFIVRSYEVGSNKTATVETVANLLQEVGCNHAQSVGFSTDGFATTPTMRKLHLIWVTARMHIEIYKYPAWGDVVEIETWCQSEGRIGTRRDWILKDVATGEVTGRATSKWVMMNQDTRRLQKVSDDVRDEYLVFCPKELRLAFPEENNRSLKKIPKLEDPAQYSMIGLKPRRADLDMNQHVNNVTYIGWVLESIPQEIVDTHELQVITLDYRRECQQDDVVDSLTTTTSEIGGTNGSASSGTQGQNDSQFLHLLRLSGDGQEINRGTTLWRKKPSNL

SEQ ID NO: 6985 - protein, 637 aa, Glycine max
MGSNEEMGLDQLPSALVATIMSKLDIASICSLASTSSTFRSCARHILSFLPTFHLLDIAPSGELLRPLLPPNPYLTNLKLDCAGLDDSAIGFLLKPSLHDLSLHNCADFSGRLLSEIGNRCNHLRSLYLGSVAEKRGRAIHISDLQELLTGCSHLEALILMFDVSLFLRHNFARVWASASEKLTSLEIGYISSVTVTELLSPNLGSQLPSNPAQPSILPSIQKLCLNVDYITDAMVGTISKGLMLLTHLDLQDAPLIEPRITFDLTNAGLQQINQLGRLKHLSLVRSQEFQITYFRRVNDLGLLLMADKCANMESICLGGFCRVTDTGFKTILHSCTRLYKLKVTHGTHLTDLVFHDISATSLTLTHVSLRRCNLLTNHAVLSLASNKVLKILDLRDCRSLGDEALQAIGTLPRLKILLLDGSDITDAGLLYLRPSVISSLYALSLRGCKRLTDKCITALFNGCCVLELRELDLSNLPNLSDNGVLLLAKSRIPFFELRMRQCPLIGDTSVMALASMLVDEAKHGSSLRLLDLFNCGGITPLAFRWLKKPYFPRLKWLGVTGSVNRDMVDALARSRPFLHVACHGEELGADPYGTSDGLYTHDYDDVDEFEQWLLEADIDSDYEEMGDAENNDEMVM

SEQ ID NO: 6986 - protein, 643 aa, Medicago truncatula
MASPEEVRLDQLPHALLATIMTKLDVASICSLATTASTFRSCAKHILSFLPNFHLIDVAPSGNLLTPLLPRNPYLKSLKVDCDRLDDSSISLLVKPSLHELSLYNCSDFSGKLLSEIGTQCKDLRSLYLGSVAEKRGRSIHISDLEELLTGCSQLEVLILMFDVSLFLRHNLARVWASASEKLTSLEIGYISSVTVIELFSSNLGSHQPLNPIQPSILPGIQKLCLSVNYITDAMVNTISKGLVFLTHLDLRDAPFVEPRITFDLTNAGLQQINQHGRLKHLSLIRSQEFIICYFRRVNDLGLLLMADKCANMESICLGGFCRVTDTGIKTILHSCSRLYKLKVTHGTQLTDLVFHDISATSLTLTHVSLRWCKLLTNHSVFSLTSNKELKVLDLRDCRSLGDEALRAIGILLRLKILLIDGSDITDAGLSYLRSTVINSLYALSLRGCKRLTDKCITVLFDGCGKLELRDLDLSNLPNLSDNGVLELAKSRIPFLDLRMRQCPLIGDTSIMALASMMTDDAGWYESGLRLLDMYNCGGITPLAFRWLKKPYFPRLKWLGVTGSVNRDMVDALARSRPFLYVACNGEELGPDPCDMSDGLYTHDYDEVDEFEQWLLEADIDEADIENDDEEMVDAENEEEPIM

SEQ ID NO: 6987 - protein, 643 aa, Ricinus communis
MANVDGSEEEKVSESLDQLPAALIATVMTKLDVASICSFASTCKTFSACACHILTFIPNFQLSDIALPNELLRPLLPPNPYLNSLKIDCGRLDDSAIDLLIRPSLQELCLLNCADFSGKLLSEIGSKCGNLRYLYVGSVAEKRGRPIHISDLEELLTGCTQLEALTLMFDVSLFLRHNFTRVWALASEKLTSLEIGYISSVMVTELLTPSVGPHQSLNHIRPSILPGIQKLSLSVDYITDTMVGTISKGLMFLTHLDLRDTPLIEPRITFDLTNSGLQQINQYGKLRHLSLFRSQEFVITYFRRVNDLGILLMADNCASMESICLGGFCQVTDTGFKTILHSCSSLHRLRVSRGIHLTDLVFHDMSATSLCLSHVCLRWCNLLTNYAIKNLVANTHLKVLDLRDCKNLGDESLRAISTLFELKILLLDGSGISDSGLSNLRGRVISSLVSLSVRGCKRLTDKCISALFEGASKLELQELDISNLPNLSDNGILCLAKSRLPISALRMRQCPLIGDTSVMALASMQVDEDRGHGSSLRLLDIYNCGGITQLAFRWLKKPYFPRLRWLGVTGSVNRDIIDALARNRPFLHVACHAEELGIDQWDNSDSLYMHDYDEVDELEQWLLEGEFENNDEEMVDAEINQVM

SEQ ID NO: 6988 - protein, 643 aa, Populus trichocarpa
MASTEEEEEEQKEEEDSLDQLPGTVLATIISKLDVASICSVASTCKTFNACASHILTFIPSFQLLDIAPSIDLLKPLMPPNPYLKSLKLDCARLDDSAINVFVRDSLHELYLRNCANFSGKLLSEIGGKCADLRYLYLGSVAEKRGRPIHISDLEELLRGCTQLEELILMFDVPLFLRHKFAQVWALASEKLTSLEIGCVSSVMVTELLSPSLGHHRSPNHVRPPILPGIQKLCLSVDYITDTMVSTISNVLMSLTHLDLRDAPLIEPSSAYDLTNSGLQQINQHGKLKHLSLVRSQEFLITYFRRVNDLGMLLMADKCANMESICLGGFCRVTDTGFKTILHSCSSLYKLRVSYGTHLTDLVFHDISATSLSLTHVSLRWCNLLTNHAIKNLVSNTCLKILDLRDCKHLGDGALRSISTLPELKILLLDGSDISDFGLSYLRGVINSLVSLSVRGCKRLTDKCISALFEGSSKLELQQLDLSNLPNLSDNGVLTLAKCRVPISELRMRQCPLIGDASVMALASMQVDEDRWHGCRLRLLDLYNCGGITQLSFWWLKKPYFPRLRWLGVTGSVSRDIVDALARNRPFLRVACHAEELGSNQWDNSHGLYMHDYDEMDELEQLLEEGEYIDEEMMDVDNDAELL

SEQ ID NO: 6989 - protein, 637 aa, Vitis vinifera
MANSEAAGGALEQLPAALLATIMTKLDVSSIRSLASTCTTIRSCASQIFHFLPNFHLLDVALSINLLRPLLPPNPYLRSLKVDCSKLDDSSIEHLVRPSLHEISLLNCADFSGRLLSLIGGQCKDLRSLYLGCVAEKRGRAVHISNLEELLCGCTELKTLSLMFDISLFPRYNFARAWSLASENLTSLEIGYVSSVMVTELLSPNVGPHQPPNHLQPSILPSLQRLCLSVDYITDTMVETVSKCLINLTHLDLRDAPIIEPRVTFDLTNSGFQQINQRGKLKHLSLVRSQEFLITYFKRVNDLGILLMADRCSSMESICLGGFCRVTDSGFKTILHSCSTLYKLRVSHGMLLTNLVFLDISATSLSLTHVSLRWCNLLRNQAVISLASNLDLRVLDLRDCRNLGDEALQAISTLHKLKILLLDGSDITDAGLSYLREGVIGSLVSLSIRGCKRLTDKCISALFDPSSKQELQELDLSNLPNLSDNGIFSLAKSRVPILELRMRQCPLIGDTSIMALASMQVDDHRSHGSSLRVLDLYNCGGITSLSFRWLKNPYFPRLRWLGVTGSVNRDMVDALARSRPFLHVACHGEELGTDHWDGLYMHDNEEMDELEQWLLEGGDESDDEEMEEVENNGEMVE

SEQ ID NO: 6990 - protein, 637 aa, Vitis vinifera
MANSEAAGGALEQLPAALLATIMTKLDVSSIRSLASTCTTIRSCASQIFHFLPNFHLLDVALSINLLRPLLPPNPYLRSLKVDCSKLDDSSIEHLVRPSLHEISLLNCADFSGRLLSLIGGQCKDLRSLYLGCVAEKRGRAVHISNLEELLCGCTELKTLSLMFDISLFPRYNFARAWSLASENLTSLEIGYVSSVMVTELLSPNVGPHQPPNHLRPSILPSLQRLCLSVDYITDTMVETVSKCLINLTHLDLRDAPIIEPRVTFDLTNSGFQQINQRGKLKHLSLVRSQEFLITYFKRVNDLGILLMADRCSSMESICLGGFCRVTDSGFKTILHSCSTLYKLRVSHGMLLTNLVFLDISATSLSLTHVSLRWCNLLRNQAVISLASNLDLRVLDLRDCRNLGDEALQAISTLHKLKILLLDGSDITDAGLSYLREGVIGSLVSLSIRGCKRLTDKCISALFDPSSKQELQELDLSNLPNLSDNGIFSLAKSRVPILELRMRQCPLIGDSSIMALASMQVDDHRSHGSSLRVLDLYNCGGITSLSFRWLKNPYFPRLRWLGVTGSVNRDMVDALARSRPFLHVACHGEELGTDHWDGLYMHDNEEMDELEQWLLEGGDESDDEEMEEVENNGEIVE

SEQ ID NO: 6991 - protein, 644 aa, Populus trichocarpa
MADPDEEEEGSLDQLPATVLETIVSKLDVASICSVSSTCKTFNACASHILTFIPSFDLLDIAPSIDLLRPLLPPNPYLKSLKLDCGRLDDSAINVVVRDSLHELYLHNCADFSGKLLSEIGGKCADLRYLYLGSVAEKRGRAIHISDLEELLRGCTRLEALILMFDVSLFLRHNFALVWALVSEKLTSLEIGYVSSVMVTELVGPSLGPHQSPNHVRPSILPGIQKLCLSVDYITDTMVSTISKGLMSLTHLDLRDAPLIEPTITFDLTNSGLQQINQHGKLKHLSLVRSQEFAITYFRRVNDLGMLLMADKCENMESICLGGFCRVTDTGFKTILHSCSSLYKLQVSYGIHLTDLVFHDISATSLSLIHVSLRWCNLLTNHAIKNLVLNTRLRVLDLRDCKHFGDEALRAISALLELKILLLDGSNISDFGLSYLRGIINSLVSLSVRGCKRLTDKCISALFEGSSKLKLQQLDLSNLPNLSDNGVLALAKCRVPISELRMRQCPLIGDTSVMALASMRVDEDRLHGCSLRLLDLYNCGGITQLSFRWLKKPYFPRLRCLGVTGSASRDIIDALARSRPFLHVACHAEELGSNQWDNLHGLYMHDNDEVDELEQWLLEEEGGYNDEEMMDADDDAELLDHLAL

SEQ ID NO: 6992 - protein, 1076 aa, Glycine max
MDRRWPWKKKSSDKAVLEKAAAELDSAAGAAATQVCVFTVKPSYIQISVESYSHLTGLEDQVKTYEEKVQTLEDEIKELNEKLSAANSEINTKESLVKQHAKVAEEAVSGWEKAEAEALALKNHLETVTLAKLTAEDQASQLDGALKECMRQIRNLKEEHEQKIQEVTLTKTKQLDKIKGEFEAKIANFEQELLRSAADNAALSRSLQERSNMIINLSEEKAHAEAEIELLKGNIESCEREINSLKYELHVISKELEIRNEEKNMSMRSAEAANKQHMEGVKKIAKLEAECQRLRGLVRKKLPGPAALAQMKLEVESLGREYGETRLRKSPVKPASSHMSTLAGFSLDNAQKFHKDNEFLTERLLAMEEETKMLKEALAKRNSELQASRSSFAKTLSKLQILEAQVQTNNQQKGSPQSIIHINHESIYSQNASNAPSFVSLSEDGNDDVGSCAESWSTAFLSELSQFPKEKNTEELSKSDATKKLELMDDFLEVEKLAWLSNESSGVSVTSNNITNEIVVNDLSEVSAGKDVPSNTQENSEPNPLPSEVSSAEELSAPDPQSDVPAGLSLAELQSRISSVFESLAKDADMEKILKDIKHALEEACGTSIQDSVSAIPHDVKPSDTTCDELGNAEDAGSNAEKEISSQKPTEFVQMTSDLEAATSQIHDFVLFLAKEAMTAHDISSDGDGISQKMKEFSVTFNKVTCNEASLLQFVLDLSNVLAKASEFRFNILGYKGREAETNSPDCIDKIALPENKLVQDNSSGERFQNGRSHILNPCSDPEIPDDGNLAPGYESNATSQKFSMENFEELKLEKEKAVVDLSKCVENLEMTKSRLLETEQHLAEVKSQLTSAQRSNSLAETQLKCMTESYRSIEARAKEFETELNHLQMKTETLENELEDEKRAHEEALAKYKELEEQLQRNESSAADNDIKTKQERDLEAAAEKLAECQETIFLLGKQLKSMHPQTEPTGPPYSKAEGFAEREPNSPNFQDQAEMDSASSAFVQRLGGESPLHFSNSLYSPSDNESNFPAISSVQNPNHRPTKSTSSSASSTPTPEKHNRGFSRFFSSKGKNGH

SEQ ID NO: 6993 - protein, 1038 aa, Glycine max
MDRRWPWKKKSSEKSVIEKATTALDSSDASNNQDNKKKPNYVQISVESYSHLSGLEDQVKTYEEKVQTLEDEIKEMNEKLSAANSEINTKESMVKQHAKVAEEAVSGWEKAEAEALALKNHLESVTLLKLTAEDRATHLDGALKECMRQIRNLKEEHEQKIQEVALSKTKQLDKIKGELEAKIVNFEQELLRSAAENGALSRSLQECSNMLIKLSEEKAHAEAEIELLKGNIEACEKEINSLKYELHVVSKELEIRNEEKNMSMRSAEAANKQHMEGVKKIAKLEAECQRLRGLVRKKLPGPAALAQMKLEVESLGRDFGESRLRKSPVKPATPNLSPLPDFSLENVQKFQKDNEFLTERLLAMEEETKMLKEALAKRNSELQASRSMCAKTLSKLQSLEAQSQTSNQLKLSPKSIVQLTHESIYNQNASSAPSLVSMSEDGNDDAASCAESWSTAIVSGLSQFPREKCNEESNKSEVTNKLELMDDFLEVEKLARLNPLPNQVSSDPLMSAPDFQSDLSGLLLTELRSRILLVFESLAKDADIGKIVEDIKHVLEDSHDTTIHHSVDAHPSDATCDRKDNPEDAGLNLEKEVISSQQPKGYVQITSDLEAAISQIHDFVLFLGKEAMTFHDDVSSDGNEMRQKIEEFSITFNKVLCNNASLLQFVLDLSYVLDKASEFRFNVLGYRGTEAESSSPDCIDKIALPENKLVHDNSSGERYQNGCSHIINPCSNPEVPDDGNLVSGYKADAASQKLSIEEFEELKLEKEKVVIDLSNCTENLEMTKSQLLDTEQLLAEVKSQLASALKSKSLAETQLKCVAESYNSLETRAQVLETELNHLQIKIESLENELQDEKRAHEVAMARSKELEEQLQRIECSAADDDHKTSHERDLTAAAEKLAECQETILLLGKQLNSLRPQTEPNDSLYSKINPKDEGFTEDEHTTNQNFQELGQLEMDSSTSAFVQRLSSESPLHFSNSLFSPSDSESTIPARSPVQHSKSKPKHRPTKSASCSVSSATTPEKHARGFSRFFSPKGKSGH

SEQ ID NO: 6994 - protein, 1021 aa, Glycine max
MDRRWPWKKKSSEKSVIEKDNKKKPNYVQISVESYSHLSGLEDQVKTYEEKVQTLEDEIKEMNEKLSAANSEINTKESMVKQHAKVAEEAVSGWEKAEAEALALKNHLESVTLLKLTAEDRATHLDGALKECMRQIRNLKEEHEQKIQEVALSKTKQLDKIKGELEAKIVNFEQELLRSAAENGALSRSLQECSNMLIKLSEEKAHAEAEIELLKGNIEACEKEINSLKYELHVVSKELEIRNEEKNMSMRSAEAANKQHMEGVKKIAKLEAECQRLRGLVRKKLPGPAALAQMKLEVESLGRDFGESRLRKSPVKPATPNLSPLPDFSLENVQKFQKDNEFLTERLLAMEEETKMLKEALAKRNSELQASRSMCAKTLSKLQSLEAQSQTSNQLKLSPKSIVQLTHESIYNQNASSAPSLVSMSEDGNDDAASCAESWSTAIVSGLSQFPREKCNEESNKSEVTNKLELMDDFLEVEKLARLSNDSNVDATVSNTDFQSDLSGLLLTELRSRILLVFESLAKDADIGKIVEDIKHVLEDSHDTTIHHSVDAHPSDATCDRKDNPEDAGLNLEKEVISSQQPKGYVQITSDLEAAISQIHDFVLFLGKEAMTFHDDVSSDGNEMRQKIEEFSITFNKVLCNNASLLQFVLDLSYVLDKASEFRFNVLGYRGTEAESSSPDCIDKIALPENKLVHDNSSGERYQNGCSHIINPCSNPEVPDDGNLVSGYKADAASQKLSIEEFEELKLEKEKVVIDLSNCTENLEMTKSQLLDTEQLLAEVKSQLASALKSKSLAETQLKCVAESYNSLETRAQVLETELNHLQIKIESLENELQDEKRAHEVAMARSKELEEQLQRIECSAADDDHKTSHERDLTAAAEKLAECQETILLLGKQLNSLRPQTEPNDSLYSKINPKDEGFTEDEHTTNQNFQELGQLEMDSSTSAFVQRLSSESPLHFSNSLFSPSDSESTIPARSPVQHSKSKPKHRPTKSASCSVSSATTPEKHARGFSRFFSPKGKSGH

SEQ ID NO: 6995 - protein, 517 aa, Glycine max
MGGGGEEGNNLEFTPTWVVAVVCSVIVAASFAAERFLHYGGKFLKRKNQKPLYEALQKIKEELMLLGFISLLLTITQNGIIRICVPVGWTHHMLPCSLKDNGKEELTKTTSHFQTFFSFSDISGTARRLLAESESENEDHQPATGEKLGHCARKGKVPLLSVEALHHLHTFIFVLAVAHVTFCVLTVVFGGLKIREWKHWEDSIGNDNKNETQPVLEPTVTHVHQHAFIQNHFTGLGKDSAVLGWVKSFFKQFYGSVTKLDYVTLRLGFIMTHCKGNPKFNFHKYMIRALEDDFKKVVGISWYLWIFVVIFMLLNVHGWHAYFWISFIPLILLLAVGAKLEHVIIQLAHEVAEKHSAIEGELVVQPRDDHFWFNRPHIVLFLIHFILFQNAFEIAFFFWIWVIYGFDSCIMGRVRYIVPRLIIGIFIQLLCSYSTLPLYAIVTQMGTHFKKAVFDEQVQARLVGWAQKAKKKGQRGDNSHSGQGSSHVGAGIQLGSVFKRPSVPEDNVIVPRNDGPE

SEQ ID NO: 6996 - protein, 515 aa, Glycine max
MGGGGEEGNNLEFTPTWVVAVVCSVIVAASFAAERFLHYGGKFLKRKNQKPLYEALEKIKEELMLLGFISLLLTITQNGIIRICVPVGWTHHMLPCSLKDKEKEESTKTTSHFQTFFSFSDISGTARRLLAESESENEDHQPATGEKLCARKGKVPLLSVEALHHLHTFIFVLAVAHVTFCVLTVVFGGLKIREWKHWEDSIGNDNKNETQPVLEPTVTHVHQHAFIQNRFTGLGKDSAVLGWVKSFFKQFYGSVTKLDYVTLRLGFIMTHCKGNPKFNFHKYMIRTLEDDFKKVVGISWYLWIFVVIFMLLNVHGWHAYFWISFIPLILLLAVGTKLEHVIIQLAHEVAEKHSAIEGELVVQPRDDHFWFNRPHIVLFLIHFILFQNAFEIAFFFWIWVTYGFDSCIMGRVRYIVPRLIIGVFIQLLCSYSTLPLYAIVTQMGTHFKKAIFDEQVQARLVGWAQKAKKKGQRGDNSLSGQESSRAGAGIQLGSVFRRESASEDNVIVPRNDGSE

SEQ ID NO: 6997 - protein, 520 aa, Medicago truncatula
MGHGGGEAEEGRDLQFTPTWVVALVCTVIVAVSFAVERSLHYLGKVLKKKNQKPLFEALQKIKEELMILGFISLFLTVTQNGMIKICVPVEWTIHMLPCSINGDDEVKETKLPSKSHFQTFFSSKDVFGTAKRLLGDDHDHSSKDEEIGYCTAKGKVPLLSVEALHKLHIFIFVLAVVHVTSCVLTIVFGGLNIRRWKRWEDSIVADENNQSQTPERTDTVTHVHQHAFIKDHFTGFGKDSAIMGWLKSFFKQFYGSVTKLDYVTLRLGFIKTHCRGNPKFNFHKYMNRALEDDFKKVVGISWYLWIFVVIFLLLNVNGWHTYFWIAFIPVILLLAVGTKLEHVIIQLAHEVAEKHSAIQGELIVQPSDDHFWFHRPRIVLFLIHLILFQNSFEIAFFFWIWIQYGFNSCIMGQVKFIYPRLVMGVFIQVLCSYSTLPLYAIVTQMGTHFKRSIFDDQVQTRLIGWAQKAKKKGLRGDSNHSVQGSSHNGGSTNIQLGSMFRRGPAPENNAFVPKNDESV

SEQ ID NO: 6998 - protein, 506 aa, Glycine max
MSGGGEEGATLEFTPTWVVAAFCTVIVAISLAAERLLHYGGKFLKAKDQKPLYEALQKIKEELMLLGFISLLLTVTQNGITKICVRPSLTLHMLPCNLHDAPANHESHFQTFFPGTARRLLSGEHSTPESASKIGYCSRKHKVPLLSVEALHHLHIFIFVLAVVHVSFSVLTVVFGGARIRQWKHWEDSIAKQNYETDRVLKPKVTQVHQHDFIRGRFAGFGKDSAIVGWLLSFLKQFYGSVTKSDYVTLRHGFIMTHCRTNPKFNFHKYMIRALEDDFKQVVGISWYLWLFVVIFLLLNINGWHTYFWIAFIPVILLLAVGTKLEHIITQLAHEVAEKHAAIEGDLVVQPSDDHFWFHRPRVVLFLIHFILFQNAFEIAFFFWIWVTYGFDSCIMGQVRYIVPRLVIGVFIQVLCSYSTLPLYAIVTQMGTHYKRAIFNDHLQQNIVGWAQKAKKRKGLKADGNPGQGSSQESANTGIQLGSIFKKATAPGDSSSAPKADGISSV

SEQ ID NO: 6999 - protein, 517 aa, Medicago truncatula
MSGGGEGGEEENTLEFTPTWVVAGVCTVIVAISLAVERLLHYGGKFLKSKDQKSLYEALQKIKEELMLLGFISLLLTVSQNRLTKICVPPGVLRHMLPCSLEDKKESHSHSAFSFPGRIARRLLADRLLAESESAEEPLKTGFCGRKNKVPLLSVEALHHLHIFIFVLAVVHVTFSVLTVVFGGARIRQWKHWEDSIAKENYDTNKVLKPKLTHVQQHEFIKGRFSGFGKDSALIGWLQSFFKQFYGSVTKSDYVTLRLGFITTHCKTNPKFNFHKYMIRALEDDFKQVVGISWYLWLFVVIFLLLNINGWHTYFWIAFVPVILLLSVGTKLEHVITQLAHEVAEKHAAIEGDLVVQPSDNHFWFHRPHIVLFLIHFILFQNAFEIAFFFWIWVTYGFDSCIMGQVRYIVPRLVIGVFIQVLCSYSTLPLYAVVTQMGSHFKRAIFNDHVQVGIVGWAEKVKKKKALKADGQPSQGSSHIHEGSTGSSTGIQLGSVFQKRASAPEDTTSVTKPEGSN

SEQ ID NO: 7000 - protein, 480 aa, Glycine max
MEEEAPPVPPAPPIVAMLPSPGMGHLIPMIEFAKRAVRYHNLAVTFVIPTDGPPSKAQKAVFQALPDSISHTFLPPVNLSDFPPGTKIETLISHTVLLSLPSLRQAFHSLSSTYTLAAVVVDLFATDAFDVAAEFNASPYVFYPSTATVLSIALHLPTLDKQVQCEFRDLPEPVTIPGCIPLPVKDFLDPVLERTNEAYKWVLHHSKRYREAEGIIENSFAELEPGAWNELQREQPGRPPVYAVGPLVRMEPGPADSECLRWLDEQPRGSVLFVSFGSGGTLSSAQINELALGLENSQQRFLWVVKSPNDAIANATYFNAESHEDPLQFLPEGFVERTKGRGFLVKSWAPQPQVLAHQSTGGFLSHCGWNSILESVVNGVPLIAWPLFAEQRTNAFMLMHEVKVALRPKVAEDTGLVQSQEIASVVKCLMEGHEGKKLRYRIKDLKEAAAKALSPNGSSTDHISNLVLKWTNKTTISTSG

SEQ ID NO: 7001 - protein, 476 aa, Glycine max
MEVSKEEARVAPAPALVAMLPSPGMGHLIPMIEFAKRVVCYHNLAVSFVIPTDGPPSKAQKAVLEALPDSISHTFLPPVNLSDFPPDTKIETLISHTVLRSLPSLRQAFHSLSATNTLSAVVVDLFSTDAFDVAAEFNASPYVFYPSTATVLSLFFHLPTLDQQVQCEFRDLPEPVSIPGCIPLPGKDLLDPVQDRKNEAYKWILHHCKRYKEAEGIIGNSFEELEPGAWNELQKEEQGRPPVYAVGPLVRMEAGQADSECLRWLDEQPRGSVLFVSFGSGGTLSSAQINELALGLEKSEQRFLWVVKSPNEEIANATYFSAESQADPLQFLPEGFVERTKGRGFLVQSWAPQPQVLGHPSTGGFLTHCGWNSILESVVNGVPFIAWPLFAEQRTNAFMLTHDVKVALRPNVAESGLVERQEIASLVKCLMEGEQGKKLRYRIKDIKEAAAKALAQHGSSTTNISNLALKWTHKFN

SEQ ID NO: 7002 - protein, 479 aa, Clitoria ternatea
METPKELQPPPAMLAVVPTPGMGHLIPLIEFSKRLVRYHNLAVTFVIPTEIPPSKAQTTVLKALPDSISHIFLPPVTLSDLPPETKIETRISLTVLRSLPALRQAFRSLTAAHTVSAVVVDLFGTDVFDVAAEFNVPPYIYYPSTAMVLSLFLQLPKLDQEVHCEFHELPEPVKIPGCVPVNGSDLLDPVQDRKNDAYKWVLHHAKRYSEAEGIIENSFLELEPGAIKELQKEEPGKPPVYPVGPIVNMDCGGSGERGSECLRWLDEQPDGSVLFVSFGSGGTLSSGQINELAHGLEMSEQRFLWVVRSPHDKFANASYFSAENPSDSLGFLPKGFLERTKGRGLVVPSWAPQPQILAHGSTGGFLTHCGWNSTLESVVNGVPLVAWPLYAEQKMNAVMLTRDVKVALRPCVGENGLVERQEIASVVKCLMEGEEGKKLRYRIKDLKDAAAKAIAENGPSTHHISHLALKWTNKPTVSN

SEQ ID NO: 7003 - protein, 1118 aa, Glycine max
MASDSIQQSEAQVALILGPDSAHLESLISQLMSSSNDQRSQAESLFNLCKQARPEALLLGLAHLLHSSPNPETRTMSAILLRRHLTRHHDSFLWPLLSPPARSSLHSLLLSSLHNEPLKSITKKLCDTVSELAAATLPDDSAAWPDLLPLLFQWVTSPDPRLQEISLLIFAQLAHYIGQTLLPQISTLHSVFLRSLHSSTPADVRIAALAAAINFIQCLTNSSDRDRFQDLLPLMMQTLTEALNSGQEAVAQEALELLIELAGTEPRFLRRQIVDVVGSMLQVAEAETLEEGTRHLAIEFVVTLAEARERAPGMMRKFPQFVRKLFGVLMNLVLDIEDDPAWHGAVDEDEDAGETSNYGFGQECLDRLSISLGGNTIVPVASELLPTYLAAPEWEKHHAALIALAQIAEGCSKVMIKNLEQVLSMILNSFRDPHPRVRWAAINAIGQLSTDLGPDLQVKFHHLVLPALAGAMDDFQNPRVQAHAASAVLNFTENCTPDILTPYLDGIVSKLLVLLQNGKQMVQEGALTALASVADSSEVQFQKYYDAVMPYLKAILVNANDKSNRMLRAKAMECISLVGMAVGKEKFRDDAKQVMDVLMSLQQSQLDADDPTASYMLQAWARLCKCLGQDFLPYMGFVMPPLLQSAQLKPDVTITSADSDTEFDEDDDSIETITLGDKRIGIKTSVLEEKATACNMLCCYADELKEGFFPWIDQVAFTLVPLLKFYFHEEVRKAAVSAMPELLSSAKSAVVKGQSQGRDETYVKQLSDYIIPNLVEALHKEPEVEICASMLDALNECIQVSGSHLDEKQVRSIVDEIKQVLTASSSRKHERAERAKEEDFDAEERELLNEENEQEEELFDQVGDCLGTLIKTFRTSFLPFFDELSSYLTPLFGKDKTSEERRIAICIFDDVAEHGREAALKYYDSFLPFLLEACNDEYPDVRQAAVYGVGVCAEFGGSVFSPLVGEALSRLDAVIRHPNALHADNIMAYDNAVSALGKICQFHRDSINAAQVVPAWLSCLPIKGDLIEAKVVHDQLCSMVERSDRELIGPNNQYLSKIVAVFAEILCAGNDLATEQTVSRMINLLRQLQQTLPPSTLASTWSSLQPQQQLALQSILSS

SEQ ID NO: 7004 - protein, 1116 aa, Glycine max
MSINKQSEAQVALILGPDSAHLESLISQLMSSSNDQRSQAESLFNLCKQARPEALLLGLAHLLHSSPNPETRTMSAILLRRHLTRHHDSFLWPLLSPPARSSLHSLLLSSLHNEPLKSITKKLCDTVSELAAATLPDDSAAWPDLLPLLFQWVTSPDPRLQEISLLIFAQLAHYIGQTLLPQISTLHSVFLRSLHSSTPADVRIAALAAAINFIQCLTNSSDRDRFQDLLPLMMQTLTEALNSGQEAVAQEALELLIELAGTEPRFLRRQIVDVVGSMLQVAEAETLEEGTRHLAIEFVVTLAEARERAPGMMRKFPQFVRKLFGVLMNLVLDIEDDPAWHGAVDEDEDAGETSNYGFGQECLDRLSISLGGNTIVPVASELLPTYLAAPEWEKHHAALIALAQIAEGCSKVMIKNLEQVLSMILNSFRDPHPRVRWAAINAIGQLSTDLGPDLQVKFHHLVLPALAGAMDDFQNPRVQAHAASAVLNFTENCTPDILTPYLDGIVSKLLVLLQNGKQMVQEGALTALASVADSSEVQFQKYYDAVMPYLKAILVNANDKSNRMLRAKAMECISLVGMAVGKEKFRDDAKQVMDVLMSLQQSQLDADDPTASYMLQAWARLCKCLGQDFLPYMGFVMPPLLQSAQLKPDVTITSADSDTEFDEDDDSIETITLGDKRIGIKTSVLEEKATACNMLCCYADELKEGFFPWIDQVAFTLVPLLKFYFHEEVRKAAVSAMPELLSSAKSAVVKGQSQGRDETYVKQLSDYIIPNLVEALHKEPEVEICASMLDALNECIQVSGSHLDEKQVRSIVDEIKQVLTASSSRKHERAERAKEEDFDAEERELLNEENEQEEELFDQVGDCLGTLIKTFRTSFLPFFDELSSYLTPLFGKDKTSEERRIAICIFDDVAEHGREAALKYYDSFLPFLLEACNDEYPDVRQAAVYGVGVCAEFGGSVFSPLVGEALSRLDAVIRHPNALHADNIMAYDNAVSALGKICQFHRDSINAAQVVPAWLSCLPIKGDLIEAKVVHDQLCSMVERSDRELIGPNNQYLSKIVAVFAEILCAGNDLATEQTVSRMINLLRQLQQTLPPSTLASTWSSLQPQQQLALQSILSS

SEQ ID NO: 7005 - protein, 1114 aa, Glycine max
MASDPMQQVALILGPDSAQLESLISQLMSSSNHHRSQAESLFNLCKQARPEALLLGLAHLLHSSPNPESRTMSAILLRRHLTRHHDSFLWPLLSPPARSSLHSLLLSSLHNEPLKSITKKLCDTVSELAAATLPDDAAAWPDLLPLLFQWVTSPDPRLQEISLLIFAQLAHYIGQTLLPQISTLHSVFLRSLHSSTPSDVRIAALAAAINFIQCLTNSSDRDRFQDLLPLMMQTLTEALNSGQEAVAQEALELLIELAGTEPRFLRRQIADVVGSMLQVAEAEALEEGTRHLAIEFVVTLAEARERAPGMMRKLPQFVRKLFGVLMNLLLDIEDDPAWHGAEDEEEDAGETSNYGFGQECLDRLSISLGGNTIVPVASELLPTYLSAPEWEKHHAALIALAQIAEGCSKVMIKNLEQVLSMILNSFHDPHPRVQWAAINAIGQLSTDLGPDLQVKFHHLVLPALAGAMDDFQNPRVQAHAASAVLNFTENCTSDILTPYLDGIVSKLLVLLQNGKQMVQEGALTALASVADSSQEQFQKYYDAVMPYLKAILVNANDKSNRMLRAKAMECISLVGMAVGKEKFRDDAKQVMDVLMSLQQSQLDADDPTASYMLQAWARLCKCLGQDFLPYMGFVMPPLLQSAQLKPDVTITSADSDTEFDEEDDSIETITLGDKRIGIKTSVLEEKATACNMLCCYADELKEGFFPWIDQVAFTLVPLLKFYFHEEVRKAAVSAMPELLSSAKSAVEKGQSQGRDKTYVKQLSDYIIPNLVEALHKEPEVEICASMLDALNECIQVSESHLDEKQVRSIVDEIKQVLTASSSRKHERAERAKEEDFDAEERELLKEENEQEEELFDQVGDCLGTLIKTFRASFLPFFDDLSSYLTPMFGKDKTSEERRIAICIFDDVAEHGREAALKYYDSFLPFLLEACNDEYPDVRQAAVYGVGVCAEFGGSVFKPLVGEALSRLDAVIRHPNALHSDNIMAYDNAVSALGKICQFHRDSINAAQVVPAWLNCLPIKGDLIEAKVVHDQLCSMVERSDRELIGPNNQYLSKIVAVFAEILCAGNNLANEQTVSRMINLLRQLQQTLPPSTLASTWSSLQPQQQLALQSILSS

SEQ ID NO: 7006 - protein, 1118 aa, Medicago truncatula
MALNDQNQAQMALILGPDSTHFESLITNLMSTINDQRSQAENLFNLCKQTYPDSLILKLSHLLHTSSNPETRTMSTILLRRHLTRHHDDSFIYPHLSPSTQSTLRSLLLSSLHQEPIKSIVKKLCDTVSELASALLSDDLSSWPDLLPLLFQWVTSNDARLQEIALLVFAQLAHYIGETLLPQLSTLHSVFLRCLSAATSSSDVRIAALAASINFVQCLSNSSDRDRFQDLLPLMMQTLTEALNSGQEATAQEALELLIELAGTEPRFLRRQIVDIVGAMLQIAEAESLEEGTRHLAIEFVVTLAEARERAPGMMRKLPQFVKKLFGVLMNLLLDIEDDPAWHAAVSEDDDAGETSNYGFGQECLDRLSIALGGNTIVPVASELLPTYLAAPEWQKHHAALVALAQIAEGCSKVMTKNLEHVLSMVLNSFPDPNPRVRWAAINAIGQLSTDLGPDLQDKYHHLVLPALAGAMDDFQNPRVQAHAASAVLNFTENCTPDILVPYLDGIVSKLLVLLQSGKQMVQEGALTALASVADSSQEKFQKYYDAVIPYLKAILLNANDKSNRMLRAKAMECISLVGMAVGKEKFRDDAKQVMDVLMSLQQSQLDSDDPTASYMLQAWARLCKCLGQDFLPYMGFVMPPLLQSAQLKPDVSITSADSDAEFDEDDDSIETITLGDKRIGIKTSVLEEKATACNMLCCYADELKEGFFPWIDQVASTLVPLLKFYFHEEVRKAAASAMPELLSSAKWAIEKGQSQGRDATYLKQLSDYIIPNLVEALHKEPEVEICASMLGALNECIQVSGPHLDEKQVRSIVDEIKQVITASSSRKHERAERAKEEDFDAEERELLKEENELEEELFDQIGDCLGTLTKTFRASFLPFFEELSSYLIPMFGKDKTSEERRIAICIFDDIAEHCREAAHKYYGSFLPFLLEACNDECSDVRQAAVYGVGVCAEFGGSVFKPLVGEALSRLNAVITHPNAQHSDNVMAYDNAVSALGKICQFHRDSINAAQVVPAWLSCLPIKGDLIEAKVVHDLLCSMVERSDKELIGHNNQYLSKIVAIFAEILCAGTDLATEQTVSRMINLLRQLQQTLPPSTLASTWSSLHPQQQLALQSILSS

SEQ ID NO: 7007 - protein, 1116 aa, Vitis vinifera
MDPESTQLQQAQLAAILGPDPGPFETLISHLMSTSNDQRSHAELLFNLCKQSDPNSLSLKLAHLLQFSPHIEARAMAAILLRKQLTRDDSYLWPRLSASTQSSLKSILLGCIQREDAKSISKKLCDTVSELASSILPENGWPELLPFMFQCVTSDSAKLQEAAFLIFAQLAQYIGETLVPHIKHLHSVFLQSLTSSSSSDVKIAALSAAINFIQCLSSSADRDRFQDLLPAMMRTLTEALNCGQEATAQEALELLIELAGTEPRFLRRQLVDVVGSMLQIAEAESLEEGTRHLAVEFVITLAEARERAPGMMRKLPQFISRLFAILMKMLLDIEDDPAWHSADSEDEDAGESSNYSVGQECLDRLAISLGGNTIVPVASELLPAYLAAPEWQKHHAALIALAQIAEGCSKVMIKNLEQVVTMVLNTFQDPHPRVRWAAINAIGQLSTDLGPDLQVQYHQRVLPALAASMDDFQNPRVQAHAASAVLNFSENCTPDILTPYLDGIVGKLLVLLQNGKQMVQEGALTALASVADSSQEHFQKYYDAVMPYLKAILMNATDKSNRMLRAKAMECISLVGMAVGKDKFRDDAKQVMEVLMSLQGSQMETDDPTTSYMLQAWARLCKCLGQDFLPYMSVVMPPLLQSAQLKPDVTITSADSDNEIEESDDESMETITLGDKRIGIKTSVLEEKATACNMLCCYADELKEGFFPWIDQVAPTLVPLLKFYFHEEVRKAAVSAMPELLRSAKLAVEKGLAQGRNESYVKQLSDYIIPALVEALHKEPDTEICASMLDALNECLQISGRILDESQVRSIVDEIKQVITASSSRKRERAERTKAEDFDAEEGELLKEENEQEEEVFDQVGEILGTLIKTFKASFLPFFDELASYLTPMWGKDKTAEERRIAICIFDDVAEQCREAALKYYDTYLPFLLEACNDDNSDVRQAAVYGLGVCAEFGGAAFKPLVGEALSRLNVVIRHPNALQPDNVMAYDNAVSALGKICQFHRDSIDSAQVVPAWLSCLPIKGDLIEAKVVHDQLCSMVEMSDRELLGPNNQYLPQIVAVFAEVLCAGKDLATEQTISRMINLLRQLQQTLPPSTLASTWSSLQPQQQLALQSILSS

SEQ ID NO: 7008 - protein, 1116 aa, Vitis vinifera
MASDPTPLQLNQIAAILGPDPVHFEALISHLMATANDQRSQAEALFNLCKQTHPDSLVLKLAILLQSSPHPEARAMAAILLRKQLTRDDSYLWPNLSATTQANLKSILLDCVQRETAKTISKKLCDTVSELASGILPDGGWPELLPFMFQCVTSSNFKLQEAALLIFAQLSQYIGETLLPHLDTLHSVFLQSLASSMNSDVRIAALGAAINFIQCLSNAAERDKFQDLLPLMMQTLTEALNSSQEATAQEALELLIELAGTEPRFLRRQLVEVVGSMLQIAEAELLEEGTRHLAVEFVITLAEARERAPGMIRKLPQFIQRLFAILMKMLLDIEDDPVWHSAEEEHEDAGETSNYSVGQECLDRLSISLGGNTIVPVASELLPAYLAAPEWQKHHAALIALAQIAEGCSKVMIKNLEQIVSMVLNSFQDPHPRVRWAAINAIGQLSTDLGPELQVKYHQRLLPALAAAMDDFQNPRVQAHAASAVLNFSENCTPDILTPYLDGIVSKLLVLLQNGKQMVQEGALTALASVADSSQVHFQKYYDAVMPYLKAILVNANDKSNRMLRAKSMECISLVGMAVGKEKFRDDAKQVMDVLMSLQGSQMEADDPTTSYMLQAWARLCKCLGQDFLPYMNVVMPPLLQSAQLKPDVTITSADSDADIYDSDDDSIETITLGDKRIGIKTSVLEEKATACNMLCCYADELKEGFFPWIDQVAPTLVPLLKFYFHEEVRKAAVSAMPELLRSAKLAVEKGQSQGRNESYIKQLSDYIIPALVDALHKEPETEICASMLDSLNECIQISGPLLDEGQVRSIVDEIKQVITASSSRKRERAERAKAEDFDAEEGELLKEENEQEEELFDQIGDCLGTLIKTFKSSFLPFFDELSSYLMPMWGKDKTAEERRIAICIFDDVAEQCRESALKYYDTYLPFLLEACNDENPHVRQAAVYGIGVCAEFGGSAFKPLVGEALSRLDVVIRHSNARDSDNVMAYDNAVSALGKICQFHRDSIDAVQIVPAWLSCLPLKGDLIEAKVVHDQLCSMVERSDRELLGPNNQYLPKIVAVFAEVLCAGKDLATEETTSRMINLLRQLRQTLSPSALASTWSSLQPQQQLALQSILST

SEQ ID NO: 7009 - protein, 1114 aa, Glycine max
MDPEVQQSQVAAILGADPSPFQTLISHLMSSSNEQRSHAETLFNLCKQTDPDNLSLKLAHLLHSSPHQEARAMSAILLRKQLTRDDSYLWPRLSPQTQSSLKSLLLSSIQSENIKSISKKLCDTISELASGILPDNAWPELLPFMFQCVSSDSPKLQESAFLIFAQLSQYIGDSLTPHIKHLHDIFLQCLTNATVNPDVRIAALNAVINFIQCLSGSADRDRFQDLLPAMMRTLTEALNSGQEATAQEALELLIELAGTEPRFLRRQLVDVVGAMLQIAEAESLEEGTRHLAIEFVITLAEARERAPGMMRKLPQFISRLFTILMKMLLDIEDDPAWHSAETEDEDAGETSNYSVGQECLDRLSISLGGNTIVPVASEQLPAYLAAPEWQKRHAALIALAQIAEGCSKVMIKNLEQVVAMVLTSFPDQHPRVRWAAINAIGQLSTDLGPDLQVKYHQGVLPALAGAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRADAKQVMEVLMSLQVSQMETDDPTTSYMLQAWARLCKCLGQDFLPYMEFVMPPLLQSAALKPDVTITSADSDNDIEDSDDESMETITLGDKRIGIKTSVLEEKATACNMLCCYADELKEGFFPWIDQVAGTLVPLLKFYFHEEVRKAAVSAMPELLRSAKLAIEKGQSQGRDVTYLKFLTDSIIPALVEALHKEPDTEICASMLDSLNECLQISGMLLDESQVRSIVDEIKQVITASSSRKRERAERTQAEDFDAEEGDLIKEENEQEEEVFDQVGEILGTLIKTFKANFLPFFDELSSYLTPMWGRDKTPEERRIAICIFDDVAEQCREAAIKYYDTYLPFLLEACNDETPDVRQAAVYGLGVCAEFGGSVFKPLVGEALLRLNAVIQHPNALHSDNVMAYDNAVSALGKICQFHRDSIDSAQVVPAWLNCLPIKGDLIEAKVVHDQLCSMAERSDSELLGPNNQYLPKIVSVFAEVLCAGKDLATEQTAGRMVNLLRQLQQTLPPSTLASTWSSLQPQQQLALQSILSS

SEQ ID NO: 7010 - protein, 1114 aa, Populus trichocarpa
MDESTQLQQAQLAAVLGGDPSQFETLISSLMSSSNETRSQAELIFNLAKQHDPNSLCLKLAHLLQFSPHLDARAMSAVLLRKLLTRDDSYLWPRLSPQTQSSLKSILLACLQQESVKSNTKKLCDTVSELASGILPDNGWPELLPFMFQCVTSDSFKLQESAFLIFAQLSQYIGESLIPFIKELHGVFLQCLGSSTNFDVKIAALNAVINFIQCLDNSSDRDRFQDLLPSMIRTLTEALNNGNEATAQEALELLIELAGTEPRFLRRQLVDVVGSMLQIAEAESLEEGTRHLAIEFVITLAEARERAPGMMRKLPQFISRLFGILMRMLLDIEDDPAWHSAENEDEDAGETSNYSVGQECLDRLAISLGGNTIVPVASEQLPAYLAAPEWQKHHAALIALAQIAEGCSKVMLKNLEQVVTMVLNSFYDPHPRVRWAAINAIGQLSTDLGPDLQNQYHQRVLPALAAAMDDFQNPRVQAHAASAVLNFSENCTPEILTPYLDGVVSKLLVLLQNGKQMVQEGALTALASVADSSQEHFQKYYDAVMPYLKTILVNANDKANRMLRAKSMECISLVGMAVGKEKFRDDAKQVMDVLLSLQVSQMESDDPTTSYMLQAWARLCKCLGQDFLPYMSVVMPPLLQSAQLKPDVTITSADSDNDIDDSDDESMETITLGDKRIGIKTSVLEEKATACNMLCCYADELKEGFFPWIDQVAPTLVPLLKFYFHEEVRKAAVSAMPELLRSAKLAIEKGLAQGRNESYVKQLSDYIIPALVEALHKEPDTEICASMLDALNECLQISGVLVDEGQVRSVVDEIKLVITASSSRKRERAERAKAEDFDAEEGELIKEENEQEEEVFDQVGEILGTLIKTFKASFLPFFDELSSYLTPMWGKDKTAEERRIAICIFDDVAEQCREAALKYYDTYLPFLLEACNDDNPDVRQAAVYGLGVCAEVGGSVFKHLVGEALSRLNVVIRHPNAKQPDNVMAYDNAVSALGKICQFHRDSIDSAQVVPAWLNCLPITGDLIEAKAVHEQLCSMVERSDRELLGPNNQYLPKIVSVFAEVLCGKDLATEQTLSRMVNLLRQLQQTLPPATWASTLSVLHPQQQMALQSILSS

SEQ ID NO: 7011 - protein, 1114 aa, Populus trichocarpa
MDESTQFQQSQLAAILAGDPSQFEILISSLMSSSNETRSQAELLFNLAKQHDPNSLSLKLAQLLQFSPHLDARAMSAVLLRKLLTRDDSYLWPRLSLQTQSSLKSILLACLQQESVKSITKKLCDTVSELASGILPDNGWPELLPFMFQCVTSDSVKLQESAFLIFAQLSQYIGESLVPYIKELHGVFLQCLGSSTNFDVKIAALNAVTNFIQCLNNTSERDRFQDLLPSMIRTLTEALNNGNEATAQEALELLIELAGAEPRFLRRQLVDVVGSMLQIAEAEGLEEGTRHLAIEFVITLAEARERAPGMMRKLPQFISRLFAILMSMLLDIEDDPAWHSAENEDEDAGESSNYSMGQECLDRLAISLGGNTIVPVASEQLPAYLAAPEWQKHHAALIALAQIAEGCSKVMLKNLEQVVTMVLNSFYDPHPRVRWAAINAIGQLSTDLGPDLQNQYHQRVLPALAAAMDDFQNPRVQAHAASAVLNFSENCTPEILTPYLDGVVSKLLVLLQNGKQMVQEGALTALASVADSSQEHFQKYYDAVMPYLKTILVNANDKANCMLRAKSMECISLVGMAVGKDKFRDDAKQVMDVLMSLQGSQMESDDPTTSYMLQAWARLCKCLGQDFLPYMSVVMPPLLQSAQLKPDVTITSADSDNDIDDTDDESMETITLGDKRIGIKTSVLEEKATACNMLCCYADELKEGFFPWIDQVAPTLVPLLKFYFHEEVRKAAVSAMPELLRSAKLAVEKGLAQGRNESYIKQLSDYIIPALVEALHKEPDTEICANMLDALNECLQISGTFVDENQVRSIVDEIKLVITASSSRKRERADRAKAEDFDAEESELIKEENEQEEDVFDQVGEILGTLIKTFKASFLPLFEELSSYLTPMWGKDKTAEERRIAICIFDDVAEQCREAALKYYDTYLPFLLEACNDENPDVRQAAVYGLGVCAEFGGSVFKSLVGEALSRLNVVIRHPNAKQPDNVMAYDNAVSALGKICQFHRDSIDSAQVVPAWLNCLPITGDLIEAKVVHEQLCSMVERSDIELLGPNNQYLPKIVSVFAEVLCGKDLATEQTLSRMVNLLRHLQQTLPPATLASTLSLLHPQQQLALQSILST

SEQ ID NO: 7012 - protein, 1117 aa, Medicago truncatula
MDPESTQLQQSQLAAILGADPSPFETLISHLMSSTNEERSQAEALFNLCKQTDPDALVLKLGHLLHSSPHQEARAMSAILLRKQLTRDDSFLWPRLSSNTQASLKSLLLSSIQSENAKSISKKLCDTISELASSILPDNGWPELLPFMFQCVSSDSAKLQESAFLIFAQLSQYIGDSLTPHIKHLHDIFLQCLTSSAVNPDVRIAALNAVINFIQCLSGSADRDRFQDLLPAMMTTLTEALNSGQEATAQEALELLIELAGTEPRFLRRQIVDVVGAMLQIAEAESLEEGTRHLAIEFVITLAEARERAPGMMRKMPQFISRLFAILMKMLLDIEDDPAWHTADTEDEDAGESSNYSVGQECLDRLSISLGGNTIVPVASEQLPAYLAAPEWQKRHAALIALAQIAEGSSKVMIKTLEQVVAMVLNSFPDQHPRVRWAAINAIGQLSTDLGPDLQVQYHQGVMPALAAAMDDFQNPRVQAHAASAVLNFSENCTPEILTPYLDGIVSKLLVLLQNGKQMVQEGALTALASVADSSQEHFQKYYDAVIPYLKAILVNATDKSNRMLRAKSMECISLVGMAVGKEKFRADAKQVMEVLMSLQGSQMETDDPTTSYMLQAWARLCKCLGQDFLPYMEFVKPPLLQSASLKPDVTITFADSDNDIDDSDDESMETITLGDKRIGIKTSVLEEKATACNMLCCYADELKEGFFPWIDQVAGTLVPLLKFYFHEEVRKAAVSAMPELLRSAKLAIEKGQSQGRDVSYLKFLTDSIIPALVEALHKEPDTEICASMLDSVNECLQISGMLLDEKQVKSIVEEVKQVITASSSRKRERAERAQAEDFDAEEGELIKEENEQEEEVFDQVGEILGTLIKTFKASFLPFFEELSSYLTPMWGRDKTPEERRIAICIFDDVAEQCREGAIKYYDTYLPFLLEACNDETPDVRQAAVYGLGVCAEFGGSVFKPLVGEALSRLNAVIQHPNALHPDNVMAYDNAVSALGKICQFHQDSIDSAQVVPAWLNCLPIKGDLIEAKVVHDQLCSMAERSDSSLLGPNNQYLPKIVAVFAEVLCAGKDLATEQTAGRMVSLLRQLQQTLPPATLASTWSSLQPQQQLALQSILSS

SEQ ID NO: 7013 - protein, 1114 aa, Glycine max; identical to SEQ ID NO: 7005

SEQ ID NO: 7014 - protein, 1118 aa, Glycine max; identical to SEQ ID NO: 7003

SEQ ID NO: 7015 - protein, 480 aa, Glycine max; identical to SEQ ID NO: 7000

SEQ ID NO: 7016 - protein, 413 aa, Glycine max
MDLLKQELLKKRQSLAQDTGGKKFFKRSEIQQKEIQKLREQEKRELEAKSQKRLATSSDNAATAPSSSSTASASASSTIASSSAASLTNEQNIDNLVLPKPEVIRRLRFLKQPVTLFGEDDDARLDRLKYVLKAGVFEVDSDMTEGQTNDFLRDIAELRKRQKTGILGERKRQKADDGAAEDREGGAGDDDLSDCGGSDGADADKDLKRMKANFEELCDEDKILVFFKKLLNEWKQELREMPEAEKRTAKGKSMVATFKQCARYLNPLFKFCRKKVLPDDIRQALLLMVECCMRRDYLAAMDHYIKLAIGNAPWPIGVTMVGIHERSAREKIYTNSVAHIMNDETTRKYLQSVKRLMTFCQRRYPTLPSKAVEFNSLANGSDLHSLLAEERFSGGNQAASEERLRIMPAPRDS

SEQ ID NO: 7017 - protein, 411 aa, Glycine max
MDLLKQELLKKRQSLAQDTGGKKFFKRSEIQQKEIQKLRQQEKRELEAKSLKRLATSSDTAATAPSSSSTASSSASSTIASASASLTDEQNIDNLVLPKPEVIRRLRFLKQPVTLFGEDDDARLDRLKYVLKAGVFEVDSDMTEGQTNDFLRDIAELRKRQKTGILGERKRQKADDGAAQDREGGAGDDDLSDCGSSEGAEADKDLKRMKANFEELCDEDKILVFFKKLLNEWKQELREMPEAEKRTAKGKSMVATFKQCARYLNPLFKFCRKKVLPDDIRQALLLMVECCMKRDYLAAMDHYIKLAIGNAPWPIGVTMVGIHERSAREKIYTNSVAHIMNDETTRKYLQSVKRLMTFCQRRYPTLPSKAVEFNSLANGSDLHSLLAEERFSGGNQASEERLRIMPAPRDI

SEQ ID NO: 7018 - protein, 417 aa, Ricinus communis
MDLLKQELLKKRQSLAQDTGGKRVFKRSEIQQKEIQKLREQEKQELEAKAKRQSSSTETATTTTSTSSTANTPSTTTTTTTSAAATTSKSLTNEQNIDNLILPKQEVIRRLRFLKQPITLFGEDDDARLDRLKHVLKAGIFEVDSDMTEGQTNDFLRDIAELRKRQKSGIVSERKRKDREEGAGEDGEGGEGEREMSGDGDSSGGVDADKDLKRMKANFEELCDEDKILVFFKRLLIEWKQELDEMAEAEKRTAKGKSMVATFKQCARYLHPLFKFCRKKVLPDDIRQALLVVVECCMKRDYLAAMDHYIKLAIGNAPWPIGVTMVGIHERSAREKIYTNSVAHIMNDETTRKYLQSVKRLMTFCQRRYPTMPSKAVEFNSLANGSDLQSLLAEERVHSGNQPSEGRLQLMAGPEEN

SEQ ID NO: 7019 - protein, 412 aa, Vitis vinifera
MDLLKQELLKKRQSLAQEAGGKRFFKRSEIEQRNIQKLREQEKRELEAKALRHNNGTASSSTAAAASATSTPSSDAKPDLTSSSSKAITDEQKIDEMVLPKQEVIRRLRFLKQPITLFGEDDTARLDRLKYVLKAGIFEVDSDMTEGQTNDFLRDIAELRKRQKTGILSDRKRKSPEDGVEDGEGGGGDDDLSGDGGSSGVDADKDLKRMKANFEELCDEDKILVFFKRLLIEWNQELNEKQEGEKRTAKGKSMVATFKQCARYLNPLFKFCRKKVLQDDIRQALLVVVECCMKRDYLAAMDQYIKLAIGNAPWPIGVTMVGIHERSAREKIYTNSVAHIMNDETTRKYLQSIKRLMTFCQRRYPTMPSKAVEFNSLANGSDLQSLLAEERFSGGNQASEERLHLMAPPKES

SEQ ID NO: 7020 - protein, 420 aa, Populus trichocarpa
MDLLKQELLKKRQTLAQDTGGKKFFKRSEIQQKEIQKLREQEKRELEAKSKRQSSSSSITSSSTTTTPNSSVAASTATTTTTKNSSSTATTSKPLTVEQNIDNLVLPKQEVIRRFRFLKQPITLFGEDDDARLDRLKYVLKAGLFEVDSDMTEGQTNDFLRDIAELRKRQKSGIVSGRKRKDREDGGGEDGEGGEGDGELGGECGAGGGDNDLDSKRMKANFEELCEEDKILVFFKRLLNEWNQELDEMAEAEKRTAKGKSMVATFKQCARYLNPLFDFSRKKILPSDIRQGLLLMVECCMRRDYLAAMDHYIRLAIGNAPWPIGVTMVGIHERSAREKIYTNSVAHIMNDETTRKYLQSVKRLMTFCQRRYPTMPSKAVEFNSLANGSDLQSLLAEERVFDGNQPSEGRLRLMPAPDEN

SEQ ID NO: 7021 - protein, 417 aa, Arabidopsis lyrata subsp. lyrata
MDLLREEILKKRKSLAEESGGKKFFKRSEIEQKKIQKLREEERREHELKAQRRAASGGDGKLSGSAPGSSNASASASSKSSASDAAAIADSKSLTDENLILPRQEVIRRLRFLKQPMTLFGEDDQSRLDRLKYVLKEGLFEVDSDMTEGQTNDFLRDIAELKKRQKSGIMGDRKRKSRDERARDEGDRGETREDELSGGESSDVDADKDMKRLKANFEDLCDEDKILVFYKKLLIEWKQELDAMENTERRTAKGKQMVATFKQCARYLVPLFNLCRKKGLPADIRQALMVMVNYCIKRDYLAAMDHYIKLAIGNAPWPIGVTMVGIHERSAREKIYTNSVAHIMNDETTRKYLQSVKRLMTFCQRRYPTMPSKAVEFNSLANGSDLQSLLAEERFFGGDRERVSEERLRLMPSQSES

SEQ ID NO: 7022 - protein, 420 aa, Arabidopsis thaliana
MDLLREEILKKRKSLAEESGGKKFFKRSEIEQKKIQKLREEERREHELKAQRRAAAAASGGDGKSSGSAPGSSNAATSASSKSSASDAAAIADSKALTDENLILPRQEVIRRLRFLKQPMTLFGEDDQSRLDRLKYVLKEGLFEVDSDMTEGQTNDFLRDIAELKKRQKSGMMGDRKRKSRDERGRDEGDRGETREDELSGGESSDVDADKDMKRLKANFEDLCDEDKILVFYKKLLIEWKQELDAMENTERRTAKGKQMVATFKQCARYLVPLFNLCRKKGLPADIRQALMVMVNHCIKRDYLAAMDHYIKLAIGNAPWPIGVTMVGIHERSAREKIYTNSVAHIMNDETTRKYLQSVKRLMTFCQRRYPTMPSKAVEFNSLANGSDLQSLLAEERFFGGNREQVSEERLRLMPSQSES

SEQ ID NO: 7023 - protein, 436 aa, Glycine max
MASSLSTKPFSSTDALSAFASLNPDLRSFSPGYLRLSLHPRLPKRLHIPAAGSIYGNHFLVSTYGESHGGGVGCIIDGCPPHLPLSEADMQLDLDKRRPCQSLITTPRKETDTCKIFSGVSEGLTTATPIHVFVPNTDQRRHDYTEMAVAYRPSHADATYDMKYGVTSVQGGGRSSARETIGRVASGAVAKKILKDFSGTEILAYVSQVYNIVLPHDLIDHDTLTLDQIESNIVRCPDPEYAEKMISAIDAVRLIGDSAGGVVTCIVRNCPRGLGSPVFDKLEAELAKAAMSLPATKGFQFGSGFAGTFLTGSEHNDEFYIDEHGNTRTRTNRSGGIQGGISNGEIINMRIAFKPTSTIGKKHNTVTRDTKETEFIARGRHDPCVVPRAVPMVEAMVALVLVDQLMAQYAQCNLFPVNSDLQEPLVPILRPEEALL

SEQ ID NO: 7024 - protein, 435 aa, Glycine max
MASSLSTKPFSADALSAFASLNSDLGSLSPAYLRLSLRPRLPKRLHIQAAGSTYGNHFRVTTYGESHGGGVGCVIDGCPPRLPLSEADMQVDLDRRRPGQSRITTPRKETDTCKIFSGVSEGITTGTPIHVSVPNTDQRGHDYSEMAVAYRPSHADATYDMKYGVRSVQGGGRSSARETIGRVASGAVAKKILKEFSGTEILAYVSQVHKIVLPEDLIDHDTLTLDQIESNIVRCPDPEYAEKMISAIDAVRVRGDSVGGVVTCIVRNCPRGLGSPVFDKLEAELAKAAMSLPATKGFQFGSGFAGTFLTGSEHNDEFYIDEHGNTRTRTNRSGGIQGGISNGEIINMRIAFKPTSTIGKKQKTVTRDKKETEFIARGRHDPCVVPRAVPMVEAMVALVLVDQLMAQYAQCNLFPVNSDLQEPLVPILRPEEALL

SEQ ID NO: 7025 - protein, 435 aa, Ricinus communis
MASCSSSLVSKPFLGASRLNGSDNRKLSISTVRISFSPRAPKKLQIHAAGSTFGTHFRVTTFGESHGGGVGCTIDGCPPRVPLSEADMQVDLDRRRPGQSRITTPRKETDTCKIYSGVSEGMTTGTPIHVFVPNTDQRGHDYSEMSVAYRPSHADATYDMKYGVRSVQGGGRSSARETIGRVASGAIAKKILKQFSGTEVLAYVSQVHKVVLPEDMVDHETLTLDQIESNIVRCPDPEYAEKMIAAIDKIRVRGDSVGGVVTCIVRNVPRGLGSPVFDKLEAELAKAVMSLPATKGFEFGSGFAGTFLTGSEHNDEFYMEEHGKIRTRTNRSGGIQGGISNGETIYMRIAFKPTSTIGKKQHTVTRDKVETELIARGRHDPCVVPRAVPMVEAMVALVLVDQLMAQYAQCYMFPINPELQEPLKLPRAESVNMTI

SEQ ID NO: 7026 - protein, 437 aa, Populus trichocarpa
MASSTLTSKSFLGSSRIDGASISSDLRKLSISSVQISFRSRIPKKLQINAAGSTFGTNFRVTTFGESHGGGVGCIIDGCPPRIPLSEADMQFDLDRRRPGQSRITTPRKETDTCKISSGVSEGLTTGTPIHVFVPNTDQRGLDYSEMSVAYRPSHADATYDMKYGVRSVQGGGRSSARETIGRVAAGGVAKKILKLYAGTEILAYVSQVHKVVLPEGVVDHDSLTLDQMESNIVRCPDPEYAEKMIAAIDAVRVKGDSVGGVVTCIVRNAPRGLGSPVFDKLEAELAKAAMSLPATKGFEFGSGFAGTLLTGSEHNDEFYTDKHGRIRTRTNRSGGIQGGISNGEIINMRIAFKPTSTIGKKQHTVTRDKKETDLIARGRHDPCVVPRAVPMVEAMVALVLMDQLMAQYSQCYLLPINSELQEPLIMPRLEAANASV

SEQ ID NO: 7027 - protein, 436 aa, Vitis vinifera
MASSLSSKPFLTSPSTDGASGFGSLRKLSFPSVRYAIRPTHRRTLEIQAAGSTYGTYFRVTTYGESHGGGVGCIIDGCPPRLPLTEADMQIDLDRRRPGQSRITTPRKETDTCRIYSGVAEGMTTGSPIMVNVPNTDQRGNDYTEMSKAYRPSHADATYDFKYGVRSVQGGGRSSARETIGRVAAGAVAKKILKNFSGTEVLAYVSQVHKVVLPEDLVDHETLALDQIESNIVRCPDPEYAEKMIAAIDAVRVRGDSVGGVVTCIVRNIPRGLGSPVFDKLEAELAKAALSLPATKGFEFGSGFAGTFMTGSEHNDEFFTDAHGRIRTRTNRSGGIQGGISNGEIINIRIGFKPTSTIGKKQHTVTRDKQETELIARGRHDPCVVPRAVPMVEAAVALVLVDQLMAQYAQCELFPINPALQEPLEFRDPELAGTHI

SEQ ID NO: 7028 - protein, 438 aa, Populus trichocarpa
MASSTLTSKSFLDSSRIDTASLSSAHLRKLSFSSVQISSRSRLPKKLQINAAGSTFGNNFRVTTFGESHGGGVGCIIDGCPPRIPLSESDMQFDLDRRRPGQSRITTPRKETDTCKISSGVSEGQTTGTPIHVFVPNTDQRGFDYNEMSVAYRPSHADATYDMKYGVRSVQGGGRSSARETIGRVAAGAVAKKILKLYAGTEILAYVSQVHKVVLPEGVVNHDSLSLDQIESNIVRCPDPEYAEKMIAAIDAVRVKGDSVGGVVTCIVRNAPRGLGSPVFDKLEAELAKAAMSLPATKGFEFGSGFSGTFLSGSEHNDEFYTDEHGRIRTRTNRSGGIQGGISNGEIINLRIAFKPTSTIGRKQHTVTRDKKEIELIARGRHDPCVVPRAVPMVEAMVALVLMDQLMAQFSQSYLFPINPDLQEPLTMPRLEAANASV

SEQ ID NO: 7029 - protein, 436 aa, Vitis vinifera
MASSLSSKPFLTSPSTDGASGFGSLRKLSFPSVRYAIRPTHRRTLEIQAAGSTYGTYFRVTTYGESHGGGVGCIIDGCPPRLPLTEADMQIDLDRRRPGQSRITTPRKETDTCRIYSGVAEGMTTGSPIMVNVPNTDQRGNDYTEMSKAYRPSHADATYDFKYGVRSVQGGGRSSAGETIGRVAAGAVAKKILKNFSGTEVLAYVSQVHKVVLPEDLVDHETLALDQIESNIVRCPDPEYAEKMIAAIDAVRVRGDSVGGVVTCIVRNVPRGLGSPVFDKLEAELAKAALSLPATKGFEFGSGFAGTFMTGSEHNDEFFTDAHGRIRTRTNRSGGIQGGISNGEIINIRIGFKPTSTIGKKQHTVTRDKQETELIARGRHDPCVVPRAVPMVEAAVALVLVDQLMAQYAQCELFPINPALQEPLEFRDPELAGTHI

SEQ ID NO: 7030 - protein, 435 aa, Arabidopsis lyrata subsp. lyrata
MASSLTSKSILGSTKPGSSSLPSELRRLSSPAVQISIRTQTRKNLQIQATGSSYGTHFRVSTFGESHGGGVGCIIDGCPPRIPLTESDLQFDLDRRRPGQSRITTPRKETDTCRISSGVSEGMTTGTPIHVFVPNTDQRGLDYSEMSVAYRPSHADATYDMKYGVRSVQGGGRSSARETIGRVAPGALAKKILKQFAGTEILAYVSQVHHVVLPEDLVDHDNLTLEQIENNIVRCPNPEYAEKMIAAIDAVRTKGNSVGGVVTCIVRNAPRGLGTPVFDKLEAELAKACMSLPATKGFEFGSGFAGTFLTGLEHNDEFYTDENGRIRTRTNRSGGIQGGISNGEIINMRVAFKPTSTIGRKQNTVTRDKVETEMIARGRHDPCVVPRAVPMVEAMVALVLVDQLMAQYAQCHLFPINPELQEPLQIEQPQNATAL

SEQ ID NO: 7031 - protein, 434 aa, Fagus sylvatica
MASSSLSTKPFLGASRIHSFSRLPSDLRPSLHISFRTSTPKKLQIQAAGSTHGNYFRVTTFGESHGGGVGCIIDGCPPRLPLSEADMQVDLDRRRPGQSRITTPRKETDTCRILSGVSEGMTTGTPIAVLVPNTDQRGHDYSEMSIAYRPSHADATYDMKYGVRAVQGGGRSSARETIGRVAAGAVAKKILKSLAGTEIFAYVSQVHKVVLPEDLVDPYTLTLDQIESNIVRCPDPEYAEKMIAAIDAVRVRGDSIGGVVTCIVRRCPRGLGSPVFDKLEAELAKAAMSLPATKGFEFGSGFAGTTLCGSEHNDEFFTDENGRIRTRTNRSGGIQGGISNGEVINMRVAFKPTATISRKQQTVTREKKEIELIARGRHDPCVVPRAVPMVEAMVALVLADQLMSQYAQCNLFPINPDLQEPFSLPRFEPAHVPF

SEQ ID NO: 7032 - protein, 436 aa, Vitis vinifera
  misc_feature (26)..(26): Xaa can be any naturally occurring amino acid
MASSLSSKPFLTSPSTDGASGFGSLXKLSFPSVRYAIRPTHRRTLEIQAAGSTYGTYFRVTTYGESHGGGVGCIIDGCPPRLPLTEADMQIDLDRRRPGQSRITTPRKETDTCRIYSGVAEGMTTGSPIMVNVPNTDQRGNDYTEMSKAYRPSHADATYDFKYGVRSVQGGGRSSARETIGRVAAGAVAKKILKNFSATEVLAYVSQVHKVVLPEDLVDHETLALDQIESNIVRCPDPEYAEKMIAAIDAVRVRGDSVGGVVTCIVRNVPRGLGSPVFDKLEAELAKAALSLPATKGFEFGSGFAGTFMTGSEHNDEFFTDAHGRIRTRTNRSGGIQGGISNGEIINIRIGFKPTSTIGKKQHTVTRDKQETELIARGRHDPCVVPRAVPMVEAAVALVLVDQLMAQYAQCELFPINPALQEPLEFRDPELAGTHI

SEQ ID NO: 7033 - protein, 200 aa, Medicago truncatula
  misc_feature (1)..(1): Xaa can be any naturally occurring amino acid
XIPVNIRAAGSTYGNHFRVTTYGESHGGGVGCVIDGCPPRIPLSEADMQEDLDRRRPGQSRITTPRKETDTCKIFSGVSEGVTTGTPIHVFVPNTDQRGNDYSEMSLAYRPSHADATYDMKYGVRSVQGGGRSSARETIGRVASGAVAKKILKNFAGTEVCYLFHEFSHTNILAYVSQVHKIILPEDLIDHETLTLDQVQ

SEQ ID NO: 7034 - protein, 701 aa, Glycine max
MASLTPGILLKMLQAMNTNTRVTGDHRSPLLQVIGIVPALAGSDLWSNQGFYLNLSDSVNSTYVLLSHPDTDLILSNRLQLGQFVHVDRFHFDSPLPSVSNLRPLAGRHPFLGTPEPLIARISPSTRHFLIQPLSDSELDPLSLLSLNNNNKSPIPNPNPNPNHNHEEHKQHHKDSSKERISRDPLAPRDNNLPPQRFSSPATAKRSQSAGRNKIVSTTAERDPSPAGKGKRSASPVPSKCVVPSLVSAREENRKVSREPAIIVPSRYRQPSPTGRKQPSSSPRRTSLSPGRRLSGGLKVSPLVADSSVKKKMATIVAGISKVSDALVGSKSARKNWDEQLPATPVEAGGSKSKVDAQAILRTQAAMSRRLSDVSGQKPGSNDSSSNEKTKAVSPQSCVLEDKSNFAAMGITIHEKKWTDGSVPLDAVSGNLARLGKEAMQRKILASTAAAEALEEANATECIIRNLSMFSDLCSVCQARNPLPTIDRFFTIYDDVLKSTAMVESVASRHNSETPDEGIPTKHSKSLSFWVEAALATDLQIVSLLTGTTVDPPSTLQKSLSKRQSLGAAKNLKVRSSPQSSLSTGVWTGGSGMKETVELGANLLSEMQMWFLRFVEESLDAGFKVFGECTADGKKALPLDGGSIAVVLSHLKRVNAWLDRVVSKGDDSLTEKIEKLKRKIYGFVIQHVGTTFDSSASSASS

SEQ ID NO: 7035 - protein, 704 aa, Glycine max
MASLTPGILLKMLQAMNTNTRVTGDHRSPLLQVIGIVPALAGSDLWSNQGFYLNLSDSLNSTYVLLSHPDTDLILSNRLQLGQFVHVDRFHFDSPLPSVSNLRPLAGRHPFLGTPEPLITRISPSSRHFLIQPLSDSELDPLSHLSLNNNNNKSPIPNPNPNPNPEEPKQHHNHKDSTKERIISRDPLAPRDNNLPPQRFSSPATAKRSQSAGRNKSVITTAAERDPSPAGKGKRSASPVPSKCVVPSLVSAREENRKVSKEPAIIVPSRYRQPSPTGRKQPSPSPRRTSLSPGRRLSGGLKVSPLVVDSSGKKKMATIVAGISKVSDALVGSKSARKNWDEQPPATPVEAGGSKSKVDAQAILRTQAAMSRRLSDVSGKKPGSNDSSSNEKTKAGSPQSCVLEEKSNFAATGFTIHEKKWTDGSVPLDAVSGNLARLGKEAMQRKILASTAAAEALEEANATECIIRNLSMFSDLCSVCQARNPLPTIDRFFTIYDDVLKSTATVESVASRHNSETPDESIPTEHSKSLSLWVDAALATDLQIVSLLTGTTTDPPSTLQKSLSKRHSLGAAKNQKVPSSPQSSLSIGVWTRGSGMKETVELGANLLSEMQMWFLHFVEESLDAGFKVFGECTADGKKALPLDGGSIAVVLSHLKRVNAWLDRVVSKGDDSLTEKIEKLKRKIYGFVIQHVGTTFDSSVSSASS

SEQ ID NO: 7036 - protein, 476 aa, Glycine max; identical to SEQ ID NO: 7001

SEQ ID NO: 7037 - protein, 480 aa, Glycine max; identical to SEQ ID NO: 7000

SEQ ID NO: 7038 - protein, 483 aa, Medicago truncatula
MELSKQEPLSKPPPMVVMLPSPGMGHLIPMIEFAKRIIILNQNLQITFFIPTEGPPSKAQKTVLQSLPKFISHTFLPPVSFSDLPPNSGIETIISLTVLRSLPSLRQNFNTLSETHTITAVVVDLFGTDAFDVAREFNVPKYVFYPSTAMALSLFLYLPRLDEEVHCEFRELTEPVKIPGCIPIHGKYLLDPLQDRKNDAYQSVFRNAKRYREADGLIENSFLELEPGPIKELLKEEPGKPKFYPVGPLVKREVEVGQIGPNSESLKWLDNQPHGSVLFVSFGSGGTLSSKQIVELALGLEMSEQRFLWVVRSPNDKVANASYFSAETDSDPFDFLPNGFLERTKGRGLVVSSWAPQPQVLAHGSTGGFLTHCGWNSVLESVVNGVPLVVWPLYAEQKMNAVMLTEDVKVGLRPNVGENGLVERLEIASVVKCLMEGEEGKKLRYQMKDLKEAASKTLGENGTSTNHISNLALKWTNKSTVIN

SEQ ID NO: 7039 - protein, 483 aa, Medicago truncatula
MELSKQEPLSKPPPMVVMLPSPGMGHLIPMIEFAKRIIILNQNLQITFFIPTEGPPSKAQKTVLQSLPKFISHTFLPPVSFSDLPPNSGIETIISLTVLRSLPSLRQNFNTLSETHTITAVVVDLFGTDAFDVAREFNVPKYVFYPSTAMALSLFLYLPRLDEEVHCEFRELTEPVKIPGCIPIHGKYLLDPLQDRKNDAYQSVFRNAKRYREADGLIENSFLELEPGPIKELLKEEPGKPKFYPVGPLVKREVEVGQIGPNSESLKWLDNQPHGSVLFVSFGSGGTLSSKQIVELALGLEMSGQRFLWVVRSPNDKVANASYFSVETDSDPFDFLPNGFLERTKGRGLVVSSWAPQPQVLAHGSTGGFLTHCGWNSVLESVVNGVPLVVWPLYAEQKMNAVMLTEDVKVGLRPNVGENGLVERLEIASVVKCLMEGEEGKKLRYQMKDLKEAASKTLGENGTSTNHISNLALKWTNKSTVIN

SEQ ID NO: 7040 - protein, 228 aa, Glycine max
MTIGTLRRFFLPCFFPSKPQPTVPFSDHHHPPTKNRPSSPASSTSSSTAASAAPPRPSKSMVIGTIFGNRRGHVWFCIQHDRLSSKPSLLLELPLSTDHLVREMRNGIVRIALECSAAANACPLRSVPLWTAFCNGKKTGFAARRRAGDRVRNILRTMQCVSVGAGVIPSGFASSAAAASEELMYMRANFEHVVGNADSESFHLINPDECPGQELSVFLLRSRLGATR

SEQ ID NO: 7041 - protein, 231 aa, Glycine max
MTIDALRRFFLPCFFPSKPQSTIPFSDHHHHPPATKNNHPSSPASSTSSSTAASTAPPRPSKSMVIGTIFGNRRGHVWFCIQHDRLSSKPSLLLELPLSTDHLVREMRNGVVRIALECSAATNASPLRSVPLWTAFCNGKKTGFAARRRAGDRVRNILRTMQCVSVGAGVIPSGFASASAASSEELMYMRANFEHVVGNADSESFHLINPDECPGQELSLFLLRSRLGATR

SEQ ID NO: 7042 - protein, 435 aa, Ricinus communis; identical to SEQ ID NO: 7025

SEQ ID NO: 7043 - protein, 436 aa, Arabidopsis thaliana
MASSSLTSKSILGSTKLGSSSLPSELRRLSSPAVQISLRTQTRKNFQIQATGSSYGTHFRVSTFGESHGGGVGCIIDGCPPRIPLTESDLQFDLDRRRPGQSRITTPRKETDTCRISSGVSEGMTTGTPIHVFVPNTDQRGLDYSEMSVAYRPSHADATYDMKYGVRSVQGGGRSSARETIGRVAPGALAKKILKQFAGTEILAYVSQVHHVVLPEELVDHENLTLEQIENNIVRCPNPEYAEKMIAAIDAVRTKGNSVGGVVTCIVRNAPRGLGTPVFDKLEAELAKACMSLPATKGFEFGSGFAGTFLTGLEHNDEFYTDENGRIRTRTNRSGGIQGGISNGEIINMRVAFKPTSTIGRKQNTVTRDKVETEMIARGRHDPCVVPRAVPMVEAMVALVLVDQLMAQYAQCHLFPINPELQEPLQIEQPQNATAL

SEQ ID NO: 7044 - protein, 435 aa, Arabidopsis thaliana
MASSSLTSKSILGSTKLGSSSLPSELRRLSSPAVQISLRTQTRKNFQIQATGSSYGTHFRVSTFGESHGGGVGCIIDGCPPRIPLTESDLQFDLDRRPGQSRITTPRKETDTCRISSGVSEGMTTGTPIHVFVPNTDQRGLDYSEMSVAYRPSHADATYDMKYGVRSVQGGGRSSARETIGRVAPGALAKKILKQFAGTEILAYVSQVHHVVLPEELVDHENLTLEQIENNIVRCPNPEYAEKMIAAIDAVRTKGNSVGGVVTCIVRNAPRGLGTPVFDKLEAELAKACMSLPATKGFEFGSGFAGTFLTGLEHNDEFYTDENGRIRTRTNRSGGIQGGISNGEIINMRVAFKPTSTIGRKQNTVTRDKVETEMIARGRHDPCVVPRAVPMVEAMVALVLVDQLMAQYAQCHLFPINPELQEPLQIEQPQNATAL

SEQ ID NO: 7045 - protein, 231 aa, Glycine max; identical to SEQ ID NO: 7041

SEQ ID NO: 7046 - protein, 228 aa, Glycine max; identical to SEQ ID NO: 7040

SEQ ID NO: 7047 - protein, 452 aa, Glycine max
MARKPLLKQTLATLFLLFVLYAIFNAFFQPTDSSAFDAAATFSSASSVLLSGATTKSPAINVFLYDLPRRFTSDVIHHHALARGGASRVTPDDDAAAPKYPGHQHMAEWYLFADLSRAESERAGSGSPVVLVADPEEADLFFVPFFSSLSLIVNPVRPPGSNSGSEKPVYSDEENQEALVEWLEKQEYWKRNSGRDHVIVASDPNAMYRVIDRVRNAVLLVSDFGRLRPDQGSLVKDVVVPYSHRIRTYQGDAGVEDRNTLLFFMGNRYRKEGGKIRDILFKILENEKDVIIKHGAQSRESRRAASQGMHTSKFCLHPAGDTPSACRLFDAIVSLCIPVIVSDNIELPFEDTIDYRKLAVFIETSSAIKPGYLVSKLRALTPDRVLAYQKELKEVKRYFEYEEPDGTVNEIWRQVSKKLPLIKLMINREKRLFGKQVECSCVCTNQTAVRTL

SEQ ID NO: 7048 - protein, 459 aa, Glycine max
MARKPLLKQTLATLFLFFVLYAIFNAFFHPTDSSAFDAAATFSSASSVLLSAGTTKSLYVKVFLYDLPRRFTSGVIHHHTLARGSGGVGGSASRATPDDVADALKYPGHQHMAEWYLFADLSRAESERAGSGSPVVRVADPEEADLFFVPFFSSLSLIVNPVRPPGSNSGLEKPVYSDEENQEALVEWLEKQEYWKRNNGRDHVIVASDPNAMYRVIDRVRNAVLLVSDFGRLRPDQGSLVKDVVVPYSHRIRTYPGDVGVEDRKTLLFFMGNRYRKEGGKIRDLLFQILENEKDVIIKHGAQSRESRRAASHGMHTSKFCLHPAGDTPSACRLFDAIVSLCIPVIVSDNIELPFEDTIDYRKIAVFVETSSAIKPGHLLSKLRAVTPDRVLEYQKKLKEVKRYFEYEEPDGTINEIWRQVSKKLPLIKLMINREKRLFGKEVECSCVCTNQTAVIRTL

SEQ ID NO: 7049 - protein, 481 aa, Medicago truncatula
MPYTKNMDEEETTKNKGKKPKHTFQTLFSTMTRKPVFKQTLIIFFVLLLLYALFNTFFQPTDSSTFDSSTFSFNSATSSVLLSSAASKSPAVKVYLYDLPKRFTYGVIHHHSLARGSRANTDEKDVTSFKYPGHQHMAEWYLFSDLSRPDSERSGSPVVRVSDPEEADLFFVPFFSSLSLIVNPVRPAGSGSVPEKTAYSDEENQEALMEWLEMQEFWKRSKGRDHVIVASDPNAMYRVVDRVKNCVLLVSDFGRLRPDQGSLVKDVIVPYSHRIRTYDGGIGVDKRNTLLFFMGNRYRKEGGKIRDTLFQILEKEDDVIIKHGAQSRESRRAASQGMHTSKFCLHPAGDTPSACRLFDAIVSLCVPVIVSDSIELPFEDTIDYRKIAVFVETAAAIQPGYLVSILRGMAPDRIVEYQKELKEVKRYFKYDEPDGTVNEIWRQISKKLPLIKLMINREKRLFTKEPDCSCVCTNQTAIGTL

SEQ ID NO: 7050 - protein, 732 aa, Glycine max
MVASLHLHIRRIVFRNAHPRLHSTLTKPQLKALVLDHYSHGKFANLIQNVVASPPVLLTACQNLSPSFPPPDRFSIPATCLELLENRFDVASCCLPLTPSFVLPNLKLKVVIEAIRMVMEIVYDDRFVTFCYGGRVGMGRHTAIRYLKNSLENPTWWFTVRFKPHRFQHFHVEKLCSVIERKVNDSVFIDLIKRLFQCKALVIELGADWLGRGLPQECGLCSILINVYFDAFDKEIQEMRLRENRENRELDPKIIASGLYSDVFYKPVKVYAVRYLDEILLATSGSKMLALELRTGVVKTLELGLGLRVDKVNTAIHSAVSEKIEFLGMELQAVLPSILRPPMSEKAIRARKKYLRQKEVRALELRNARARNRRKLGLKIFSHVYKKIKQSDGFKFDFSIENQVREIFRSWADEVVQEFLGNIDECQEWHRSLSAGDFLQLRHIRNQLPPELVDAYDKFQEQVDQHLNPIKARKAIEEEERRVKEEEEQNYSKGTVEDLTKLCMKVEAPEILIRKAVKLVGFTNHMGRPRPIEFLVALEDADIIKWYAGIARRWLDYFCCCHNFKTVKTIVTYHLRFSCILTLAEKHESTKREVIKHFSKDLRVYDMNGNHEVHFPTEREVKMMGDRNLSDPKPVDGALSLAVVRLASDEPPCHCIAHFCDKTTTVFYRVHLLQNRLNVSPLDKEKWVQGMGVIHESLNRKCLPLCTDHVNDLYMGRITLQDIDCSYCVDVD

SEQ ID NO: 7051 - protein, 738 aa, Glycine max
MASYVSMVASLHLHIRRIVFGNAHPRLHSTLTKPQLKALVLDHYSHGKFSNLIQNIVASPPVLHTACQNLSPSFPPPDCFSIPATCRELLENRFDVASCCLTLTPSFVLPNLKLKVVIEAIRMVLEIVYDDRFVTFCYGGRVGMGRHTAIRYLKNSLENPTWWFTVRFKPHRFQHFHVEKLCSVIESKVKDSIFIDLIKRLFQCKALVIELGADWLGRGLPHECGLCSILINVYFDAFDKEIQEMRLRENRENRELDPKIIASGLYSDVFYKPVKVYAVRYLDEILLATSGSKMLALELRMGVVKTLELGLGLRVDKVNTAIHSAVSEKIEFLGMELQAVPPSILRPPMSEKAIRARKKYLRQKEVRALELRNARARNRRKLGLKIFSHVYKKIKQSDGFKFDFSIENQVREIFRSWADEVVQEFLGNIDECQEWHRSLSAGDFLQLRHIRNQLPPELVDAYDKFQEQVDKHLNPIEARKAIEEEERRVKEEEEQNYSKGTVEDLTKLCMKVEAPEILIRKAVKLVGFTNHMGRPRPIEFLVALEDADIIKWYAGIARRWLDYFCCCHNFKTVKTIVTYHLRFSCILTLAEKHESTKREVIKHFSKDLRVYDMNGNHEVYFPTEREVKMMGDRNLSDPKPVDGALSLAVVRLASDEPPCHCIAHFCDKTTTVFYRVHLLQNRLNVSPLDKEKWVQGMGVIHESLNRKCLPLCTDHVNDLYMGRITLQDIDCSYCVDVD

SEQ ID NO: 7052 - protein, 353 aa, Glycine max
MALSFRPLIHPRFTDRSLFQFLPPKPPPFPPPPPPSVLLPLTRRRGGFISSCLSDDAVSTRNFDRGFTVIAAMLRRIEPLDNSAISKGVSPAARDSMKQTISTMLGLLPSDHFAVTVTVSKHPLHRLLFSSIVTGYTLWNAEYRMSLARNLDMSGSRNEGSDCETCSEVLEVKDVAKTVGDEKIDVVNDLESCSSSGSLKEFGDLPSQALSYIQQLESELTSVMEELNAQKQEMMQLEYDKGKWNNLLEYLRSLDPDMVTELSRPSSLEVEDIIHQLVQNILRRFFVDDASSSFMEQSVEGNVDNRTDSDELSNTVATSRDYLAKLLFWCMLLGHHLRGLENRLHLSCVVGLL

SEQ ID NO: 7053 - protein, 354 aa, Glycine max
MALSFRPVIHPRVTDRSLFQFLPPKPPPLPTSPPPSVLLPLTRRRGGFLPSCLSDDAVSTRNFDRGFTVIAAMLRRIEPLDNSAISKGVSPAARDSMKQTISTMLGLLPSDHFAVTITVSKHPLHRLLFSSIVTGYTLWNAEYRMSLTRNLDISGSRDEGSDCETRSEVLEVKDGAKTVGDEKIEVVNDLESCSCSGNLKEFGDLPPQALSYIQQLQSELTSVTEELNAQKQEMMQLEYDKGKWNNLLEYLRSLDPNMVTELSRPSSLEVEDIIHQLVQNILRRFFVDDGSSSFMEQSVEGNVDNRAGSGDELSNTIATSRDYLAKLLFWCMLLGHHLRGLENRLHLSCVVGLL

SEQ ID NO: 7054 - protein, 704 aa, Glycine max; identical to SEQ ID NO: 7035

SEQ ID NO: 7055 - protein, 701 aa, Glycine max; identical to SEQ ID NO: 7034

SEQ ID NO: 7056 - protein, 470 aa, Glycine max
MEEESTSAESNPSSSDRIKLNVGGKLFETTFSTLRSGGPDSLLFALSNRRSADPSPVFIDRDPEIFSVLLSLLRTSHLPSAARRFSKHELADEALFYGIDSHLRAAAAPPPFSGIDAALSASLRPASEGLPSSFVASPSGGVWIAHGGQISCYDPILTHAATVRTHLDEIDSICRVWPEIAAVGSKSDTGLHFYNFSGSRHVGSVHWTDPLDPRIFKASVNAITSSSNSVFASFDCPHRENCIIEVDKEKLLIANQFARQSGNQAKNMVPRKLTWIPATGVLVGSAVTGGAFGYSGYVRLWDPRSGDVVWETNEPGGSGRSSRFGDSFADVEADVEGLLLFKLCSKSGDLAMADMRFLKDDPWVYMKEKNPSLVSCGEVRNSVVHCYRGQVFVAREGALEVWSRAEQKENSEGNAEGFFRRNFVDKREDSERGVIKKIEGGGDRLFVSREDVEGIEVWESSHSAGAISVL

SEQ ID NO: 7057 - protein, 478 aa, Medicago truncatula
MEEESTSQTTTDSNVTDRIKLNVGGKLFETTLSTIRSGGPDSLLFALSNRFSNDPNPVFIDRDPEIFSVFLSLLRTNHLPSTARRFSKQELADEALFYGIDSHLRNATSPPPFSGIDASIVASVRPASEGLSSTFTAAENGSVWIAHGGQLSSYDWNLIHSATVRTHLDEINSICRVWPEIAAVGTESDAGLHFYNFSGSRHVGSVHWSDPSDPRIFKARVNAITASDNSVFASFDCPHRENCILEVDKAKLQIVSQLGRQSGNQAKNMVPGKLTFVPTTGVLVGSAVTGGAFGYSGYIRVWDPRSGEVVWETNEPGAGRSSRFGDSFSAIDVDVEKLLLFKLCSKSGDLAMADMRRLGDDPWVYLKEKNPSLWTDGGDGSTSSVVNCYKGQVFVGRGGELEVWSRVKEVVECESERDRESDGEGVYRRNFVDKREDSEKGVIVKIEGGGDRLFISREDVEGIEVWESSHYAGAISVL

SEQ ID NO: 7058 - protein, 445 aa, Glycine max
  misc_feature (126)..(126): Xaa can be any naturally occurring amino acid
  misc_feature (143)..(143): Xaa can be any naturally occurring amino acid
  misc_feature (177)..(177): Xaa can be any naturally occurring amino acid
  misc_feature (284)..(284): Xaa can be any naturally occurring amino acid
  misc_feature (375)..(375): Xaa can be any naturally occurring amino acid
MEEEGTSTKSNPSLRERINLNVGGKLFETMLSMLHSNDPNSLLFSLSNRRLADPSPIFIDRDLEILSILLSLLRTSHLPSAVHHFSKHELGDEALFYGIDAHLCAAAATPPFSDIDVALFASLRPXSECLPSSFVVAPSSAVXIAHGGQISYCDPILTHATTTRTHLDKIDSIYKVXLEIAIVGSKSDVSLHFYNLSDNRHIGSVHWTDLLNPRIFKSSINAITSSTNYVFALFDCPYGENFIIEVDKEKLQTGKLMWILAIRVLVKSAVTGSVFGYFSYVRLXDPRFGEVVWEMNEPGGSGQSSRFGDSFVDVEGLLLFMLCSKSGDLAMADMRFLKDDPWVYLKEKNPSLVSYGEVRNIVVHCYRGQVFVAKXRALEVWSSVEQRENSGSGAEGFYRRDFMDKREDSERGVIKKIEGGGYRLFVSREDVEGIEVWERLANLVR

SEQ ID NO: 7059 - protein, 459 aa, Glycine max; identical to SEQ ID NO: 7048

SEQ ID NO: 7060 - protein, 452 aa, Glycine max; identical to SEQ ID NO: 7047

SEQ ID NO: 7061 - protein, 524 aa, Glycine max; identical to SEQ ID NO: 6326

SEQ ID NO: 7062 - protein, 492 aa, Glycine max; identical to SEQ ID NO: 6328

SEQ ID NO: 7063 - protein, 441 aa, Glycine max; identical to SEQ ID NO: 6380

SEQ ID NO: 7064 - protein, 443 aa, Glycine max; identical to SEQ ID NO: 6381

SEQ ID NO: 7065 - protein, 439 aa, Cucumis melo subsp. melo; identical to SEQ ID NO: 6382

SEQ ID NO: 7066 - protein, 432 aa, Ricinus communis; identical to SEQ ID NO: 6383

SEQ ID NO: 7067 - protein, 440 aa, Vitis vinifera; identical to SEQ ID NO: 6384

SEQ ID NO: 7068 - protein, 438 aa, Arabidopsis lyrata subsp. lyrata; identical to SEQ ID NO: 6385

SEQ ID NO: 7069 - protein, 439 aa, Arabidopsis thaliana; identical to SEQ ID NO: 6386

SEQ ID NO: 7070 - protein, 439 aa, Arabidopsis thaliana; identical to SEQ ID NO: 6387

SEQ ID NO: 7071 - protein, 436 aa, Populus trichocarpa; identical to SEQ ID NO: 6388

SEQ ID NO: 7072 - protein, 436 aa, Populus trichocarpa; identical to SEQ ID NO: 6389

SEQ ID NO: 7073 - protein, 524 aa, Glycine max; identical to SEQ ID NO: 6326

SEQ ID NO: 7074 - protein, 443 aa, Glycine max; identical to SEQ ID NO: 6381

SEQ ID NO: 7075 - protein, 441 aa, Glycine max; identical to SEQ ID NO: 6380

SEQ ID NO: 7076 - protein, 510 aa, Glycine max; identical to SEQ ID NO: 6339

SEQ ID NO: 7077 - protein, 510 aa, Glycine max; identical to SEQ ID NO: 6340

SEQ ID NO: 7078 - protein, 595 aa, Glycine max; identical to SEQ ID NO: 6331

SEQ ID NO: 7079 - protein, 553 aa, Glycine max; identical to SEQ ID NO: 6332

SEQ ID NO: 7080 - protein, 492 aa, Glycine max; identical to SEQ ID NO: 6328

SEQ ID NO: 7081 - protein, 117 aa, Glycine max
MELSMKVLVKVASLLFLLEFTATVVDARFDPSSFITQFLPNAEANNYYVKSTTKACCNSCPCTKSIPPQCRCSDIGETCHSACKTCICTRSIPPQCHCSDITNFCYEPCNSSETEAH

SEQ ID NO: 7082 - protein, 117 aa, Glycine max
MELSMKVLVKVASLLFLLGFTATVVDARFDPSSFITQFLPNAEANNYYVKSTTKACCNSCPCTKSIPPQCRCSDIGETCHSACKTCICTRSIPPQCHCSDITNFCYEPCNSSETEAH

SEQ ID NO: 7083 - protein, 118 aa, Glycine max
MELSMKVLVKVASLLFLLGFTATVVDARFDPSSFITQFLPNAEANNYYVKSTTNGCCDNCRCTISISPMCKCADIGETCHPSCKSCFCDIPTFPGLCQCIDVTNFCYELCNSSETKAH

SEQ ID NO: 7084 - protein, 116 aa, Apios americana
MEMKKKVVMKVALLLFFLGFTATVDARFDPSSFISQLLPNGDASYYVKTTTKACCDLCLCTKSIPPQCRCADIGETCHSACKACLCTRSFPPQCRCADGNDFCYEPCKSSFEGEAH

SEQ ID NO: 7085 - protein, 120 aa, Medicago truncatula
MDLMMNKKAMVMKLALLVFLLGFTSTVVDARFDGSSFITQLLSNGEATYEVKSTTTACCNSCPCTKSIPPQCHCADIGEKCHSACKRCLCTRSFPPQCRCTDTTDFCYEPCSYSSNGGSH

SEQ ID NO: 7086 - protein, 806 aa, Glycine max; identical to SEQ ID NO: 6336

SEQ ID NO: 7087 - protein, 825 aa, Medicago truncatula; identical to SEQ ID NO: 6337

SEQ ID NO: 7088 - protein, 847 aa, Medicago truncatula; identical to SEQ ID NO: 6338

SEQ ID NO: 7089 - protein, 553 aa, Glycine max; identical to SEQ ID NO: 6332

SEQ ID NO: 7090 - protein, 595 aa, Glycine max; identical to SEQ ID NO: 6331

SEQ ID NO: 7091 - protein, 510 aa, Glycine max; identical to SEQ ID NO: 6340

SEQ ID NO: 7092 - protein, 510 aa, Glycine max; identical to SEQ ID NO: 6339

SEQ ID NO: 7093 - protein, 365 aa, Glycine max; identical to SEQ ID NO: 6729

SEQ ID NO: 7094 - protein, 365 aa, Glycine max; identical to SEQ ID NO: 6728

SEQ ID NO: 7095 - protein, 342 aa, Glycine max; identical to SEQ ID NO: 6722

SEQ ID NO: 7096 - protein, 342 aa, Glycine max; identical to SEQ ID NO: 6723

SEQ ID NO: 7097 - protein, 553 aa, Glycine max; identical to SEQ ID NO: 6765

SEQ ID NO: 7098 - protein, 542 aa, Glycine max; identical to SEQ ID NO: 6766

SEQ ID NO: 7099 - protein, 567 aa, Glycine max; identical to SEQ ID NO: 6767

SEQ ID NO: 7100 - protein, 542 aa, Glycine max; identical to SEQ ID NO: 6766

SEQ ID NO: 7101 - protein, 553 aa, Glycine max; identical to SEQ ID NO: 6765

SEQ ID NO: 7102 - protein, 359 aa, Glycine max; identical to SEQ ID NO: 6724

SEQ ID NO: 7103 - protein, 359 aa, Glycine max; identical to SEQ ID NO: 6725

SEQ ID NO: 7104 - protein, 2490 aa, Glycine max
MAEPAAVPNLQPKVSHEAKLKELLHRITSLEIKLCSDGAKEFAKLLRSETGADLLREYVRGSPKCSELLEAWKLREGKQGMHYVFDLISAILSHREGKHNPSDIESVNITNDLDKFARLLISERLSDIHKEVNSKEWRRQKAALLLMASIARRGASLASEVAKSFDFKLAEFGRIASANRRRKPEARVGLLRKPFVGFAMSFLEVGKPWLLRWVLQQREMYSGVLRGLGSDDDETVVFVLTVLRDRVLVEESLVQPWLRSVLFGSATLEQLVEVCAREGGGDAAEVAFGVLFRVCTDPSNGLMPDSKMRLKGNTKRILDLMKKLRVTEVQYHKDLLLAIVEAKASFGLSYLKEFPYNIDNFKSSSWISAISVAAQLVSLVGNGISKESVNFRSNGPHLFDNMDLHSIVKCLFPRPFSRSLFNKGMPHIEPYVKHGTLRLLLELLKLLDSIFGGLNRNSNTNNPFMQHMMSIKDEIQNYVQAFIPDLQVLLNLLSSLDVNSEACNSSLKRNACHHEHNSSSRKKLKLDISESGDIDIVVAGISSTPDIDLTGNSGTVDGGPRADALDDEEDLMNSIGEIWGVDLRSMEINTFEDVESYLLSKLLDALRYYRRALPFSLDNSFETFKGLLKSPLELTSHLQVSVLSLLVEYIEWCPDDEIPIRTPPMLYKYLQPFIKLLMFSPYNETRELAYKLALAAMFSTGAFDGNLHEIEAWFLFLPGYHGKKPPVKISEVDVLQSLTLFVISFFCDAVSTLGNNLIKYWDILKSHAHCLEGGEDLSPQFSPFIICVLEKCLKVIRPKTGSCSLPKKSMVNAGLLSALVHADLTERLGGSYECDEVFPEWKPLKDLLDFVESILHQRNYCIFSKNEESVLPDSSLGSALGSVNRLLNCGSGHGIAETTIAFISSIILEGTNKILTNLPSHVVIPRDLVGVPFSLLLSVLFLDYSVLHHASKLWPVMFYAALDMAMSDLGIDGQNAAPVETSDLTLHPDSLTCSQLLDASEVDAVTFSIFLKQAPFHVIFPAMMCMNGPYISKLSKIQEFLLHKLSESNDSLLLTNLQLILFWTHRIQLCYEVNPIAEVEQLLNLCVILVGSLLAQLLVPESGSDWSINSAFYSLRHNIQEVIKTIFCHPCVLISLSFSLGSCQNLSNGNVENDINMLNVVSNEGFHNFGNPVLKILTMTLESMWSLSGAHLCVSTAEDVANNIVKAFKRLQQKLFLDVRNRFELYIRTEDVMPLLPTLYALHSLHRFLSPFQLLELVNWMFSRDEFDDLPIKKSSIFVGCSLAADAFSALSIYFQQSTENRAPYDLFWEMGEKNMKADIFEQIYLKVVDFSVCYEIDSADRCLLEAVNLLYKQKHLQQETFHPLLLVMWKIIMVTPLKVLSHCIYKTNAKKATFLHILSELSSLHSLIFGHLFLGTVNRSLHHGIGVMEHTFDPTLSEDQFLLLLPASLSYFSLISKRLREQSHRDFEHLPYFYSKILLKGFSQWKRFSSKDIFQEQYGEFFPSSAQELLCLTDLSLLGKSIHMLKYHFAHNGDMMKLKKRLNLFKSIFPKFDSHDDLMNCDCQVIDSYSLRQSLNIINCVVAKISLCKILLFHEAGGDFKDVAVKMQSKLGRCRIHFINILVDIWQFIVKKFSLASYQCRTAKGTNISLLYNHLEGFLLKSILELAGEMQNDLIQLQAISFLEQLIRSALLYRFGDFTTMKTVRVILSQLSEGRLSYDLYLQLLLAHSQFAPTLHSVRKQAGSLLKPVSSILKCLVIPSLDHCENDVKHRGLTTELSSGPLEIVKILWILLLVKARQIDSDNGNDIDVNLKELHALLRHSYGATVNWIDLEIYNLMQQIESMSGLLSQNAKLDSETIEEWYKSQHRDNFPIDPDICVSTVLYFPYDRTFSDELPSINKIEPDTPRKKVLYSHVEDKERYDPVFILRFSIHSLSKAYVAPVEFAGSGLLAIAFVSLSSPDQGIRRLAYGTLDKFKNAVEKCQKRKDVMGLRLLLNSVQNSIEEPWQRIPSVIALFAAEASCVLLDPAHDHYAAISTFFIHSSKLNMRVMFDNFFWSTSVNFKAERSWMLRLVYAGMNSDDDAAIYIRNSILEKLMSFYVSSLSDFESKNLIIEVINKSVKLHKITRHLVKHCSLFSWFSSLISVARQRLNGNENKLFLKHVLVALKVVNDVISSGGISKWLQNHGLEQLMELSSNLFNFLFQDATLTNETMYQAGSVCNQAIKSIKPELALEAILMNAPPVSIFMMNQERLQSFLIWATTTALQSESLQRLGSNESQFSRNNSREDFRENSVVSTFLRWLTASVINGKLHKKSYNWDSEFAETHNLESLHSLLVHVENTSGQRNDIDIGAEEVLASTIFHLQLRLGVNHEVLPSVVCALCLLMFGASKFAVSRTDLLKDYNTLISSYSSRVRCPPEANPTWRWSFYQPWKDDSLELTDSQKMEEYHACLTLLVIISNVLGAKKLESASLSPVDLERSGLFQWEISLLRN

SEQ ID NO: 7105 - protein, 2516 aa, Glycine max
MEEPAAVPNFQPKVSHEAKLKELLHRITSLEIKLCSDAAKEFAKLLKSETGADLLLEYVRGSPKCSELLEAWKLREGKQGMNYVFDLISAILSQSKGKYNPSDIESVNITKDLDKFARLLISERLSDIHKEVNSKEWRRQKAALLLMASIARRGASLASEVAKSFDFKLAEFGRIASEHRRRKPEARVGLLRKSFVGFAMSFLEVGKPWLLRWVLQQKQMYSGVLRGLGNDDDETVVFVLTVLRDRVLVEESLVQPWLRSVLFGSATLEQLAEVCGREGGGDAAEVAFGVLVRVCTDPSNGLMPDSRMGLTGNTKRVLDLMKKLRVTEVQYHKDLLLAIVEAKASFGLSYLKEFPYNIDNFKSSSWISALSVAAQLVSLVGNGISKESVNFQSNGPRLFDNMDLHSIVKCLFPRPFSRSLFNKGLPHIEPYVKHGTLRLLLELLKLLDSIFGGLYCNSNSNNPFMQHMMSIKVEIQNYVQAFLPDLQVLLNLLSSLDANSEARNSSLKRNACHHEHNSSSRKKLKLDTSESGDIDIVVAGISSTPDIDLTGNSETVDGGAREDALDDEEDLKNSIGEIWGVDLCSMEINTLEEMESYLLSKLLDALRYYRRALPYALDNSFETFKGLLKSPLELTSHLQVSVLSLLVEYIEWCPDDVIPIRTPPMLYKYLQPFIKLLMFSPYNETRDLAYKLALAAMFSTGAFDGNLHEIAAWFLFLPGYHGKKPPVKILEVDVLQSLTLFVISFLCDAVSTLGNNLIKYWDILKNHAHCLEGGEDLSPQFSPFIICVLEKCLKVIRPKSGFCSLPKKSMVNAELLSALVHADLTERLGGSYECDEVFPEWKPLEDLLDFVESILHQQNYCIFSKNEESVLPDSSLGSALGSVNRLLNSGSGHEIAETTIAFISSIILEGTNKILTNMPSHAVIPHDLVGVPFSLLLSVLFLDYSVLHHASKLWPAMFYAGLDMAMSDLGIDGRNAAPVGTSDLALHPDSLTCSQLLDASEVDAVTFSIFLKQVPFHVIFPAMMCMSGPYISKLSKIQEFLLHKLSESNDSSLLPNLRLILFWTHRIRSCYDVKPIAEIEQLLNLCVILVGSLLAQLLVPESGYDWSINSAFYSSRRNIQVIKTIFCHPCVLISLSFSLGSCQNLANGNVENDFNMLNVVSNEGFHNFGNPILKILTMTLEYMWSLFGAHLCASTAEDVANNFVKAFKGLQQKLFLDVRDRFELYICTKDVMPLLPTLYASHTLHRFLSPFQLLELVDWMFSRDKVDDLPIKKSSLFVGCSLAADAFSALSIYFQQSTENRAPYDLFWEMSQKNMKTDIFEQIYSKVVDFSVCFEIDSADRCLLEAVNLLYKQKIVQQETFHPLTSVMWKIIMVTPLKVLFHCIYKTNAKKAAFLHILTELSSLHSLIFGHLFLGTVNKSIHHDIGVMEHTFDPTFSEDQFLLLLPASLSYFSLISKRLREQSHKDFEHIPYFYSKILVKGFSQWKSFSSKDIFEEQYGEFFPSSAQELLRLIDLSLLGKSIHMLKYHFALNGAMKLKKRLNLFKSICPKFASHDDLMDCDCQVIDSYSLHQSLNIINRVVAKISLCKVLLFHEEAGGNFKDVAVKMKSKLGRSRIRFINILVDIWQFIVKKFSLASDQSRTPKGTNISLLYNHLEGFLLKNILELAGEMQNDLIQLQAISFLEQLIRSALLYRFGDFTTMKTLRVILSQLSKGRLSYDLYLQLLLAHSQFAPTLHSVCKQAGSFLKPVSSILKCLVIPSLDHCENDVKHRGLMTELSSGPLEIVKMLWILLRVKAHQIDLDNGNDINVNLKELHALLCHSYGATVNWIDLEIYNLMQHIESMSGLLSQNVKLDSETIEKWYRSQHSDSFPIDPDICVSTVLYFPYDRTIFDELPSVNKIEPDTVRKKVLHSQVEDKERYDPVFILRFSIHSLSKAYIEPVEFAGSGLLAIAFVSMSSPDQGIRRLAYGTLDKFKNALECQKKKDVLGLRLLLNSVQNSIEEPWQRIPSVIALFAAEASCVLLDPAHGHYAAISTFLTHSSKLNMRYLCQFQAERSWMLRLVYAGMNSDDDVALYIRNSILEKLMSFYVSPLSDFLSKNLIIEVIKKSVKLHKITRHLVKHCSLFSWFSSLISVARQRLNVDEHKLFLKHVLVALKVVNDVISSGSISKWLQNHGLEQLMELSSNLFNFLFHDATLANETVVLVNPFLQMIASVLKLSQKRKIYQPHFTLSIEGLYQMYQAGSACNQATKSIKPELALEAIIMSAPPASIFLMNQERLQSFLIWATTTALQSKSLQRLGSTESQILRNNLREDFQENSVVSTFLRWLIASVIIGKLHKKSYNWDSEYAETHNLESLHSLLVHVKNTSGQRNDIDIGAEEVLASTIFHLQLRLGVNHEVLPSVVCALCLLMFGASKFAVSRTDLLKDYNALIASHSSRVQCPPEANPTWRWSFYQPWKDDSLELTDSQKMEEYHACLTLLVIVSNVLGGKKLESASLSPVDLEKSGLFQWERSLLRN

SEQ ID NO: 7106 - protein, 482 aa, Glycine max; identical to SEQ ID NO: 6770

SEQ ID NO: 7107 - protein, 482 aa, Glycine max; identical to SEQ ID NO: 6771

SEQ ID NO: 7108 - protein, 567 aa, Glycine max; identical to SEQ ID NO: 6767

SEQ ID NO: 7109 - protein, 397 aa, Glycine max; identical to SEQ ID NO: 6772

SEQ ID NO: 7110 - protein, 358 aa, Glycine max; identical to SEQ ID NO: 6747

SEQ ID NO: 7111 - protein, 373 aa, Glycine max; identical to SEQ ID NO: 6748

SEQ ID NO: 7112 - protein, 365 aa, Glycine max; identical to SEQ ID NO: 6729

SEQ ID NO: 7113 - protein, 359 aa, Glycine max; identical to SEQ ID NO: 6724

SEQ ID NO: 7114 - protein, 365 aa, Glycine max; identical to SEQ ID NO: 6728

SEQ ID NO: 7115 - protein, 210 aa, Glycine max; identical to SEQ ID NO: 6746

SEQ ID NO: 7116 - protein, 553 aa, Glycine max; identical to SEQ ID NO: 6765

SEQ ID NO: 7117 - protein, 342 aa, Glycine max; identical to SEQ ID NO: 6722

SEQ ID NO: 7118 - protein, 482 aa, Glycine max; identical to SEQ ID NO: 6770

SEQ ID NO: 7119 - protein, 542 aa, Glycine max; identical to SEQ ID NO: 6766

SEQ ID NO: 7120 - protein, 397 aa, Glycine max; identical to SEQ ID NO: 6772

SEQ ID NO: 7121 - protein, 142 aa, Glycine max; identical to SEQ ID NO: 6777

SEQ ID NO: 7122 - protein, 146 aa, Glycine max; identical to SEQ ID NO: 6778

SEQ ID NO: 7123 - protein, 373 aa, Glycine max; identical to SEQ ID NO: 6748

SEQ ID NO: 7124 - protein, 358 aa, Glycine max; identical to SEQ ID NO: 6747

SEQ ID NO: 7125 - protein, 365 aa, Glycine max; identical to SEQ ID NO: 6729

SEQ ID NO: 7126 - protein, 365 aa, Glycine max; identical to SEQ ID NO: 6728

SEQ ID NO: 7127 - protein, 71 aa, Glycine max
MNHQQQSPAVTAYPAGAQSNLAAPPPPVGYPTKDDLPSQQNVPVKTTTRGDGFWKGCCAGLCCCCALDCCL

SEQ ID NO: 7128 - protein, 70 aa, Glycine max
MNHQQQSPVTAYPAVSQSNPAAPPPPVGYPTKDDVPSQQNVPIKTSTRGDGFWKGCCAGLCCCCALDCCL

SEQ ID NO: 7129 - protein, 553 aa, Glycine max; identical to SEQ ID NO: 6765

SEQ ID NO: 7130 - protein, 542 aa, Glycine max; identical to SEQ ID NO: 6766

SEQ ID NO: 7131 - protein, 567 aa, Glycine max; identical to SEQ ID NO: 6767

SEQ ID NO: 7132 - protein, 342 aa, Glycine max; identical to SEQ ID NO: 6722

SEQ ID NO: 7133 - protein, 342 aa, Glycine max; identical to SEQ ID NO: 6723

SEQ ID NO: 7134 - protein, 542 aa, Glycine max; identical to SEQ ID NO: 6766

SEQ ID NO: 7135 - protein, 553 aa, Glycine max; identical to SEQ ID NO: 6765

SEQ ID NO: 7136 - protein, 359 aa, Glycine max; identical to SEQ ID NO: 6724

SEQ ID NO: 7137 - protein, 359 aa, Glycine max; identical to SEQ ID NO: 6725

SEQ ID NO: 7138 - protein, 369 aa, Pisum sativum
MAAKKACETFSKSLIEEVHRWGCLKQTGVSLRYMMEFGSKPTDKNLLISAQFLHKELAIRIARRAIELENLPYGLSQKPAVLTVRDWYVDSFRDLRAFPNIKNVNDEQDFTEMIKAIKVRHNNVVPTMALGVQQLKKRMDPKIVYEDLVEIHQFLDRFYMSRIGIRMLIGQHVELHNPNPPPHVVGYIHTKMSPVEVARNASEDARAICCREYGSAPDVHIYGDPDFTFPYVPAHLHLMVFELVKNSLRAVQERFMDSDKVAPPIRIIVADGIEDVTIKVSDEGGGIAISGLPKIFTYLYSTARNPLDEHSDLGIGDNVTMAGYGYGLPISRLYARYFGGDLQIISMEGYGTDAYLHLSRLGDSQEPLP

SEQ ID NO: 7139 - protein, 369 aa, lipoamide
MAAKKACETFSKSLIEEVHRWGCLKQTGVSLRYMMEFGSKPTDKNLLISAQFLHKELAIRIARRAIELENLPYGLSQKPAVLKVRDWYVDSFRDLRAFPNIKNVNDEQDFTEMIKAIKVRHNNVVPTMALGVQQLKKRMDPKIVYEDLVEIHQFLDRFYMSRIGIRMLIGQHVELHNPNPPPHVVGYIHTKMSPVEVARNASEDARAICCREYGSAPDVHIYGDPDFTFPYVPAHLHLMVFELVKNSLRAVQERFMDSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 7140 - protein, 369 aa, Glycine max
MAAKKACETFSKSLIEEVHRWGCLKQTGVSLRYMMEFGSKPTDKNLLISAQFLHKELAIRIARRAIELENLPYGLSQKPAVLKVRDWYVDSFRDLRAFPNIKNVNDEQDFTEMIKAIKVRHNNVVPTMALGVQQLKKRMDPKIVYEDLVEIHQFLDRFCMSRIGIRMLIGQHVELHNPNPPPHVVGYIHTKMSPVEVARNASEDARAICCREYGSAPDVHIYGDPDFTFPYVPAHLHLMVFELVKNSLRAVQERFMDSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 7141 - protein, 369 aa, lipoamide
MAAKKACETFSKSLIEEVNRWGCLKQTGVSLRYMMEFGSKPTNKNLLISAQFLHKELAIRIARRAVELENLPYGLSQKPAVLKVRDWYVDSFRDVRAFPDIKNVNDEREFTEMIKAIKVRHNNVVPTMAMGVQQLKKGMDPKIVYEDLVEIHQFLDRFYMSRIGIRMLIGQHVELHNPNPPPHVVGYIHTKMSPVEVARNASEDARSICCREYGSAPDVHIYGDPNFTFPYVPAHLHLMVFELVKNSLRAVQERFMNSDKVAPPIRIIVADGIEDVTIKVSDEGGGIARSGLPKIFTYLYSTARNPLDEHSDLGIGDNVTMAGYGYGLPISRLYARYFGGDLQIISMEGYGTDAYLHLSRLGDSQEPLP

SEQ ID NO: 7142 - protein, 367 aa, Cicer arietinum
MAAIEAFSKSLIEEVHKWGCLKQTGVSLRYMMEFGSKPTDKNLLISAQFLQKELAIRIARRAIELETLPYGLSQKPAVLKVRDWYVDSFRDIRSFPEIKNINDEKEFTEVIKAIKVRHNNVVPTMALGVQQLKKGLKPNMVNEDFVEIHQFLDRFYLSRIGIRMLIGQHVELHNPNPPPYVVGYIHTKMSPVEVARNASEDARSICLREYGSAPDINIYGDPDFTFPYVPAHLHLMVFELVKNSLRAVQERYMDSDKVSPPIRIIVADGLEDVTIKISDEGGGIARSGLPKIFTYLYSTARNPLDEHEDLGVADSVTTMAGYGYGLPISRLYARYFGGDLQIISMEGYGTDAYLHLSRLGDSQEPLP

SEQ ID NO: 7143 - protein, 369 aa, Pisum sativum
MAAKKAIETFSKSLIEDVHKWGCFKQTGVSLRYMMEFGSKPSDKNLLISAQFLHKELAIRIARRAIELENLPCGLSHKPAILKVRDWYWDSFRDIRSFSEIKNMNDEKEFTEVIKAIKVRHNNVVPTMALGVQQLKKDLNPKIYKEDIVEIHQFLDRFYMSRIGIRMLIGQHVELHYPNPRPHVVGYIDTRMSPVEVARNASDDARAICCRQYGSAPDVHIYGDPDFTFPYVPAHLHLMVFELVKNSLRAVEERYMNSDKVSPPIRIIVADGLEDVTIKISDEGGGIPRSGLRKIFTYLYSTARNPLDEHTDLGVGDNVTMAGYGFGLPISRLYARYFGGDLQIISMEGYGTDAYLHLSRLGDSQEPLP

SEQ ID NO: 7144 - protein, 369 aa, Medicago truncatula
MAAKKAIETFSKSLIEEVHKWGCFKQTGVSLRYMMDFGSKPTSKNLLISAQFLHKELAIRIARRAVELERLPCDLSQKPAVLKVRDWYLDSFRDIRSFSEIKNMNDEKEFTEVIKAIKVRHNNVVPTMALGVQQLKKDVDPKIINQDFVEIHQFLDRFYMSRIGIRMLIGQHVELHSPNPPPHVVGYIHTRMSPVEVARNAVDDARSICSRQYGSAPDVHIYGDPDFTFPYVPAHLHLMVFELVKNSLRAVEERYMNSDKDPPPIRIIVADGLEDVTIKISDEGGGIPRSGLRKIFTYLYSTARNPLDEHADLGVGDNVTMAGYGYGLPISRLYARYFGGDLQIISMENYGTDAYLHLSRLGDSQEPLP

SEQ ID NO: 7145 - protein, 369 aa, Populus trichocarpa
MAAKKACEMLSKSMFEEVQRWGCMKQTGVSLRYMMEFGSVPTERNLLIAAQFLHKELPIRIARRAIELETLPYGLSEKPAVLKVRDWYLDSFRDMRSFPEIKGTNDEKEFTQMIKAIKVRHNNVVPMMALGVQQLKKELGPKIVHEDLDEIHQFLDRFYMSRIGIRMLIGQHVELHNPNPPPHCVGYIHTKMSPVEVAQNASDDARAICLREYGSAPVVNIYGDPNFTFPYVPTHLQLMVFELVKNSLRAVQERHMDSDRVSPPVRIIVADGIEDVTIKVSDEGGGIARSGLPKIFTYLYSTARNPLDEDSDLGTGEAVIMAGYGYGLPISRLYARYFGGDLQIISMEGYGTDAYLHLSRLGDSQEPLP

SEQ ID NO: 7146 - protein, 367 aa, Medicago truncatula
MAAIEAFSKSLLQEVHKWGCLKQTGVSLRYMMEFGSQPTDKNLLISAQFLQKELAIRIARRAIELESLPYGLSKKPAILKVRDWYVDSFRDIRSCPEVKDMKDEREFTDVIKAIKVRHNNVVPTMALGVQQLKKELKTKIDSEDLVEIHEFLDRFYLSRIGVRMLIGQHVELHNPNPPPHVVGYIHTKMSPVSVARNASEDARSICMREYGSAPEINIYGDPDFTFPYVPAHLHLMVFELVKNSLRAVQERYMDSDKVSPPIRIIVADGLEDVTIKISDEGGGIPRSGLPKIFTYLYSTARNPLDEHADLGVADSVTTMAGYGYGLPISRLYARYFGGDLQIISMEGYGTDAYLHLSRLGDSQEPLP

SEQ ID NO: 7147 - protein, 369 aa, Vitis vinifera
MAVKKLCESYSKSFRGEVQRWGCMKQTGVSLRYMMEFGSRPTEKNLLISAQFLHKELPIRIARRAIELESLPYGLSEKPAVLEVRDWYLDSYRDLRAFPEIKDKNDELEFTQMIKMIKVRHNNVVPTMALGVQQLKKGINVKIVYEDLDEIHQFLDRFYMSRIGIRMLIGQHVELHNPNPAPDCVGYIHTKMSPVEVARSASEDARSICLREYGSAPDISIYGDPNFTFPYVPTHLHLMVFELVKNSLRAVQEQFMDSDKVAPPVRIIVADGIEDVTIKVSDEGGGIPRSGLPKIFTYLYSTAKNPLDEQSDIGSSGGLTMAGYGYGLPISRLYARYFGGDLQIISMEGYGTDAYLHLSRLGDSQEPLP

SEQ ID NO: 7148 - protein, 871 aa, Ricinus communis
MAMEVTQVLLNAQSIDGNVRKHAEESLKQFQEQNLPSFLLSLSGELANDEKPVDSRKLAGLILKNALDAKEQHRKLELVQRWLSLDNNVKSQIKAFLLKTLSSPIADARSTASQVIAKVAGIELPQKQWPELIGSLLSNIHQLPAHVKQATLETLGYLCEEVSPDVVDQDQVNKILTAVVQGMNASEGNNDVRLAATRALYNALSFAQANFSNDMERDYIMRVVCEATLSPEVKIRQAAFECLVSISSTYYEKLAPYIQDIFSITAKSVREDEEPVALQAIEFWSSICDEEIDILEEYGGDFTGDSEIPCFYFIKQALPALVPMLLETLLKQEEDQDQDEGAWNIAMAGGTCLGLVARTVGDDIVPLVMPFIEENITKPDWRQREAATYAFGSILEGPSPDKLTPIVNVALNFMLSALTKDPNNHVKDTTAWTLGRIFEFLHGSTLDAPIITQANCQQIITVLLQSMKDAPNVAEKACGALYFLAQGYEEVGPSSPLTPYFQEIVQALLTVTHREDAGESRLRTAAYETLNEVVRCSTDETAPMVLQLVPVIMMELHKTLEGQKLSSDEREKQSELQGLLCGCLQVIIQKLGSSEPTKYVFMQYADQIMGLFLRVFACRSATVHEEAMLAIGALAYATGPDFAKYMPEFYKYLEMGLQNFEEYQVCAVTVGVVGDICRALEDKILPFCDGIMTQLLKDLSSNQLHRSVKPPIFSCFGDIALAIGENFEKYLMYAMPMLQSAAELSAHTAGADDEMIEYTNSLRNGILEAYSGILQGFKNSPKTQLLIPYAPHILQFLDSMYMEKDMDDVVMKTAIGVLGDLADTLGSNAGSLIQQSLSSKDFLNECLSSEDHMIKESAEWAKLAICRAISV

SEQ ID NO: 7149 - protein, 871 aa, Populus trichocarpa
MAMEVTQVLLNAQSIDGNVRKHAEESLKQFQEQNLPSFLLSLSGELANDEKPVDSRKLAGLILKNALDAKEQHRKLELVQRWLSLDNNAKGQIKACLLKTLASPVPDARSTASQVIAKIAGIELPQRQWPELIGSLLSNIHQLPAHVKQATLETLGYLCEEVSPDVVDQDHVNKILTAVVQGMNATEGNNDVRLAATRALYNALGFAQANFSNDMERDYIMRVVCEATLSPEMKIRQAAYECLVSISSTYYEKLAPYMQDIFNITAKAVREDEEPVALQAIEFWSSICDEEIDILEEYGGDFTGDSDVPCFYFIKQALPALVPMLLETLLKQEEDQDQDEGAWNIAMAGGTCLGLVARTVGDDIVQLVMQFIEDNITKPDWRHREAATYAFGSILEGPSPEKLTPLVNVALNFMLTALTKDPNNHVKDTTAWTLGRIFEFLHGSTVDTPIITQANCQQIVTVLLQSMKDVANVAEKACGALYFLAQGYEEVTPSSPLTPYFQEIVQTLLFVTHREDAGESRLRTAAYETLNEVVRCSTDETAPMVLQLVPVIMTELHNTLEGQKLSSDEREKQGELQGLLCGCLQVIIQKLGSSEPTKYVFMQYVDQIMGLFLRVFACRSATVHEEAMLAIGALAYATGPDFAKYMPEFYKYLEMGLQNFEEYQVCAVTVGVVGDICRALEDKILPYCDGIMTQLLKDLSSNQLHRSVKPPIFSSFGDIALAIGENFEKYLMYAMPMLQSAAELSAHTSVADDEMTEYTNSLRNGILEAYSGILQGFKNSPKTQLLIPYAPHILQFLDSMYMEKDMDDVVMKTAIGVLGDLADTLGSNAGSLIQQSLSSKDFLNECLSSDDHMIKESAEWAKLAISRAISV

SEQ ID NO: 7150 - protein, 871 aa, Vitis vinifera
MAMEVTQVLLNAQSVDGNIRKHAEESLKQFQDQNLPSFLLSLSGELANDEKPVDSRKLAGLILKNALDAKEQHRKFELVQRWLSLDAAVKTQIKTCLLQTLSSPVPDARSTASQVIAKIAGIELPQKQWPELIGSLLSNIHQLPAHVKQATLETLGYLCEEVSPDVVDQDQVNKILTAVVQGMNSSEGNNDVRLAATRALYNALGFAQANFTNDMERDYIMRVVCEATLSPEVKIRQAAFECLVSISSTYYEKLAPYIQDIFNITAKAVREDEEPVALQAIEFWSSICDEEIDILEEYGGDFSGDSDIPCFYFIKQALPALVPMLLETLLKQEEDQDQDEGAWNLAMAGGTCLGLVARTVGDDIVPLVMPFIEENITKPDWRQREAATYAFGSILEGPSPDKLAPIVNVALNFMLSALTKDPNNHVKDTTAWTLGRIFEFLHGSTMETPIITHANCQQIITVLLLSMKDVPNVAEKACGALYFLAQGYEDVGSASPLTPFFQEIVQSLLTVTHRKDAGESRLRTSAYETLNEVVRCSTDETAPMVLQLVPVIMMELHQTLEAQKLSSDEREKQNELQGLLCGCLQVIIQKLGSSEPTKYVFMQYADQIMGLFLRVFACRSATVHEEAMLAIGALAYATGPDFAKYMPEFYKYLEMGLQNFEEYQVCAVTVGVVGDICRALEDKILPYCDGIMTLLLKDLSSNQLHRSVKPPIFSCFGDIALAIGENFEKYLMYAMPMLQSAAELSSHTAGADDEMTEYTNLLRNGILEAYSGIFQGFKNSPKTQLLIPYAPHILQFLDSIYMEKDMDDVVMKTAIGVLGDLADTLGSNAGSLIQQSLSSKDFLNECLSSEDHLIKESAEWAKLAISRAISV

SEQ ID NO: 7151 - protein, 950 aa, Vitis vinifera
MRTHNFHTSHTLTQQTHNCSRPTVWRFLHRQPQLPESSSTFASSSLFLSLHFLSPRVSQRRFALFTIRDCSIAVVPRYNMAMEVTQVLLNAQSVDGNIRKHAEESLKQFQDQNLPSFLLSLSGELANDEKPVDSRKLAGLILKNALDAKEQHRKFELVQRWLSLDAAVKTQIKTCLLQTLSSPVPDARSTASQVIAKIAGIELPQKQWPELIGSLLSNIHQLPAHVKQATLETLGYLCEEVSPDVVDQDQVNKILTAVVQGMNSSEGNNDVRLAATRALYNALGFAQANFTNDMERDYIMRVVCEATLSPEVKIRQAAFECLVSISSTYYEKLAPYIQDIFNITAKAVREDEEPVALQAIEFWSSICDEEIDILEEYGGDFSGDSDIPCFYFIKQALPALVPMLLETLLKQEEDQDQDEGAWNLAMAGGTCLGLVARTVGDDIVPLVMPFIEENITKPDWRQREAATYAFGSILEGPSPDKLAPIVNVALNFMLSALTKDPNNHVKDTTAWTLGRIFEFLHGSTMETPIITHANCQQIITVLLLSMKDVPNVAEKACGALYFLAQGYEDVGSASPLTPFFQEIVQSLLTVTHRKDAGESRLRTSAYETLNEVVRCSTDETAPMVLQLVPVIMMELHQTLEAQKLSSDEREKQNELQGLLCGCLQVIIQKLGSSEPTKYVFMQYADQIMGLFLRVFACRSATVHEEAMLAIGALAYATGPDFAKYMPEFYKYLEMGLQNFEEYQVCAVTVGVVGDICRALEDKILPYCDGIMTLLLKDLSSNQLHRSVKPPIFSCFGDIALAIGENFEKYLMYAMPMLQSAAELSSHTAGADDEMTEYTNLLRNGILEAYSGIFQGFKNSPKTQLLIPYAPHILQFLDSIYMEKDMDDVVMKTAIGVLGDLADTLGSNAGSLIQQSLSSKDFLNECLSSEDHLIKESAEWAKLAISRAISV

SEQ ID NO: 7152 - protein, 897 aa, Ricinus communis
MAMEVTQALLNAQSVDGNVRKHAEESLKQFQEQNLPGFLLSLSGELANDDKPVDSRKLAGLILKNALDAKEQHRKYELVQRWLSLDAAAKSQIKTCLLKTLSSLVSDARSTASQVIAKIAGIELPQKQWPELIGSLLSNIHQLPAHVKQATLETLGYLCEEVSPDVVDQDQVNKILTAVVQGMNASEASIDVRLAATRALYNALGFAQANFSNDMERDYIMRVVCEATLSPEVKMRQAAFECLVSISSIYYEKLVPYMQDIFTITAKAVREDEEPVALQAIEFWSSICDEEIDILEEYRGDFTGDSDIPCFYFIKQALPALVPMLLETLLKQEEDQDQDEGAWNIAMAGGTCLGLVARTVGDDIVPLVMPFIEENITKPDWRQREAATYAFGSILEGPSPDKLTPLVNVALNFMLTALTNDPNNHVKDTTAWTLGRIFEFLHGSTMDTPIITQANCQQIITVLLQSMGDAPNVAEKACGALYFLAQGYEEAGPSSPLTPYFQEIVHALLTVTHREDAGESRLRTAAYETLNEVVRCSTDETAPMVLQLVPVIMTELHKTLEGLKLASDEREKQSELQGLLCGCLQVIIQKLGSSEPTKIVFMQYADQIMGLFLRVFACRNATVHEEAMLAIGALAYATGPDFVKYMSEFYKYLEMGLQNFEEYQVCAVTVGVVGDICRALEDKILPYCDGIMTQLLKDLSSNQLHRSVKPPIFSCFGDIALAIGENVEKYLMYAMPMLQSAAELSAHTAGADDEMIEYTNSLRNGILEAYSGILQGFKNSPKTQLLIPYAPHILQFLDSIYMEKDMDDLVMKTAIGVLGDLADTLGSNAGSLIQQSLSVKDFLNECLSSEDHMIKESAEWAKLAITEVIDLQVVTNSCISIMFLSEALGSDCVADMR

SEQ ID NO: 7153 - protein, 870 aa, Glycine max
MAMEVTQILLNAQAVDGTLRKQAEESLKQFQEQNLPSFLFSLAGELANDEKPAESRKLAGLILKNALDAKEQHRKIEFVQRWLSLDPTLKAQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKLAPYIQDIFNITAKAVREDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAGSASSPLTPFFQEIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASRSATAHEEAMLAIGALAYATGADFAKYMTEFYKYLEMGLQNFEDYQVCAITVGVVGDVCRALEEKILPYCDGIMTQLLKDLSSNQLHRSVKPPIFSCFGDIALAIGENFEKYLLYAMPMLQSAAELSAHTSGADDDMTEYTNSLRNGILEAYSGIFQGFKGSPKTQLLMPYAPHVLQFLDSLYNEKDMDDVVTKTAIGVLGDLADTLGSNAGPLIQQSVSSKDFLKECLSSDDHLIKESAEWAKLAISRAISF

SEQ ID NO: 7154 - protein, 870 aa, Glycine max
MAMEVTQILLNAQAVDGTLRKQAEESLKQFQEQNLPSFLFSLAGELANDDKPAESRKLAGLILKNALDAKEQHRKIEFVQRWLSLDPTLKSQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKLAPYIQDIFNITAKAVREDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAASASSPLTPFFQDIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASRSATAHEEAMLAIGALAYATGADFAKYMTEFYKYLEMGLQNFEDYQVCAITVGVVGDVCRALEEKVLPYCDGIMTQLLKDLSSNQLHRSVKPPIFSCFGDIALAIGENFEKYLLYAMPMLQSAAELSAHTSGADDDMTEYTNSLRNGILEAYSGIFQGFKGSPKTQLLMSYAPHVLQFLDSLYMEKDMDDVVTKTAIGVLGDLADTLGSSAGPLIQQSVSSKDFLKECLSSDDHLIKESAEWAKLAISRAISF

SEQ ID NO: 7155 - protein, 870 aa, Arabidopsis lyrata subsp. lyrata
MAMEVTQLLINAQSIDGTVRKHAEESLKQFQEQNLAGFLLSLAGELANDEKPVDSRKLAGLVLKNALDAKEQHRKYELVQRWLALDMSTKSQIRAFLLKTLSAPVPDVRSTASQVIAKVAGIELPQKQWPELIVSLLSNIHQLPAHVKQATLETLGYLCEEVSPDVVEQEHVNKILTAVVQGMNAAEGNNDVRLAATRALYMALGFAQANFNNDMERDYIMRVVCEATLSPEVKIRQAAFECLVSIASTYYEKLAHYMQDIFNITAKAVREDDESVALQAIEFWSSICDEEIDILEEYGGEFAGDSDVPCFYFTKQALPGLVPLLLETLLKQEEDQDLDEGAWNIAMAGGTCLGLVARAVGDDIVPHVMPFIEEKISKPDWREREAATYAFGSILEGPSADKLMAIVNAALTFMLNALTNDPSNHVKDTTAWTLGRIFEFLHGSTIETPIITQANCQQIITVLIQSMNDAPNVAEKACGALYFLAQGYEDIGPNSPLTPFFQEIIQSLLAVAHREDATESRLRTAAYEALNEVVRCSTDETSTMVLQLVPVIMLELHNTLEGEKLSLDEREKQNELQGLLCGCLQVIIQKLGSEPTKSAFMQYADQMMGLFLRVFGCRSATAHEEAMLAIGALAYAAGPNFAKYMPEFYKYLEMGLQNFEEYQVCAVTVGVVGDICRALEDKILPYCDGIMTQLLKDLSSNQLHRSVKPPIFSCFGDIALAIGEDFDKYWRYSMPMLQSAAELSAHSSGADDEMTEYTNSLRNGILEAYSGIFQGFKNSPKTQLLIPFAPHILQFLDSIYMEKDMDEVVMKTAIGVLGDLADTLGSHVGGLIQQSVSSKEFLNECLSSEDHTIKEAAEWAKHAITRAISV

SEQ ID NO: 7156 - protein, 870 aa, Arabidopsis thaliana
MAMEVTQLLINAQSIDGTVRKHAEESLKQFQEQNLAGFLLSLAGELANDEKPVDSRKLAGLVLKNALDAKEQHRKYELVQRWLALDMSTKSQIRAFLLKTLSAPVPDVRSTASQVIAKVAGIELPQKQWPELIVSLLSNIHQLPAHVKQATLETLGYLCEEVSPDVVEQEHVNKILTAVVQGMNAAEGNTDVRLAATRALYMALGFAQANFNNDMERDYIMRVVCEATLSPEVKIRQAAFECLVSIASTYYEKLAHYMQDIFNITAKAVREDDESVALQAIEFWSSICDEEIDILEEYGGEFAGDSDVPCFYFTKQALPGLVPLLLETLLKQEEDQDLDEGAWNIAMAGGTCLGLVARAVGDDIVPHVMPFIEEKISKPDWREREAATYAFGSILEGPSADKLMAIVNAALTFMLNALTNDPSNHVKDTTAWTLGRIFEFLHGSTIETPIINQANCQQIITVLIQSMNDAPNVAEKACGALYFLAQGYEDIGPSSPLTPFFQEIIKSLLAVAHREDATESRLRTAAYEALNEVVRCSTDETSTMVLQLVPVIMMELHNTLEGEKLSLDEREKQNELQGLLCGCLQVIIQKLGSEPTKSKFMEYADQMMGLFLRVFGCRSATAHEEAMLAIGALAYAAGPNFAKYMPEFYKYLEMGLQNFEEYQVCAVTVGVVGDVCRALEDKILPYCDGIMTQLLKDLSSNQLHRSVKPPIFSCFGDIALAIGEDFDKYWRYSMPMLQSAAELSAHSAGADDEMTEYTNSLRNGILEAYSGIFQGFKNSAKTQLLIPFAPHILQFLDSIYMEKDMDEVVMKTAIGVLGDLADTLGSHVGGLIQQSVSSKEFLNECLSSEDHTIKEAAEWAKHAITRAISV

SEQ ID NO: 7157 - protein, 872 aa, Hordeum vulgare subsp. vulgare
MSLDVTQILLSAQSADGSIRKHAEESLKQFQEQNLPGFLLSLSSELANNEKPEESRRLAGLILKNALDAKEQHRKNELFQRWLALDAGVKAQVKALLLQTLSSPVASARSTSSQVIAKIASIEIPQKQWPELIGSLLSNIHQVQPNVKQATLETLGYLCEEVSPEAVDQDQVNKILTAVVQGMNASEGNSEVRLAATRALYNALGFAQVNFSNDMERDYIMRVVCEATQSPDVKIRQAAFECLVAISSTYYDKLATYMQDIFNITAKAVRGDEESVALQAMEFWSSICDEEIDILDEYSSEFTADSDVPCYYFIKQALPALVPMLLETLLKQEDDQDLDEGAWNLAMAGGTCLGLVARTVGDDIVPLVMPFVEENITKPEWRHREAATYAFGSILEGPSADKLTPLVNVALNFMLSALVKDPNNHVKDTTAWTLGRIFEFLHGSALETAPVITAENCQQILTVLLQSMKDVPNVAEKACGALYFLAQGYVDAGSASPLSPFFQDIVQSLLVTSHREDAGESRLRTAAYETLNEVVRCSTEETAPIVMQLVPVIMMELHQTLEAGKLSTDEREKRSDLQGLLCGCLQVIIQKLGGMESTKFAFLQYSDQMMDLFLRVFACRNATVHEEAMLAIGALAYAAGSNFAKYMAQFYQYLEMGLQNFEEYQVCAITVGVVGDLCRALEDKILPYCDGIMTQLLKDLSSNQLHRSVKPPIFSCFGDIALAIGENFEKYLIYAMPMLQSAADLSAHTTATDDEMLDYTNQLRNGILEAYSGILQGFKSSPKTQLLMPYAPHILQFLDALHNGKDMDDSVMKTAIGVLGDLADTLGVNAGPLINQSTSSKQFLDECLSSDDPLVKESADWARIAISRAVSG

SEQ ID NO: 7158 - protein, 482 aa, Glycine max; identical to SEQ ID NO: 6770

SEQ ID NO: 7159 - protein, 482 aa, Glycine max; identical to SEQ ID NO: 6771

SEQ ID NO: 7160 - protein, 567 aa, Glycine max; identical to SEQ ID NO: 6767

SEQ ID NO: 7161 - protein, 397 aa, Glycine max; identical to SEQ ID NO: 6772

SEQ ID NO: 7162 - protein, 348 aa, Glycine max
MSCRKRQKTSPDKTSDDFFDSLPDDLVLSILCKLSSTATSPSDFISVLITCKRLNSLGLHSLVLSKASHKTFSVKAKNWCDSLHRFLKHCADAGNIEACYTLGMIRFYCLQNRGSGASLMAKAAMNSHAPALYSLAVIQFNGSGGTKNDKDLRAGVALCARAAFLGHIDALRELGHCLQDGYGVKLNVTEGRRFLVQANARELAAVLSAGNTKRPWLTWSHHPVTHPRLRSGCPLMSDYGCNVPAPDAHPASQFMSEWFDIRGGFPGPDMRLCSHSGCGRPETRRHEFRRCSVCGLVNYCSRACQALDWKFRHKAECATVERWLDDDGEGVAGENDGGGDDGVMMVNS

SEQ ID NO: 7163 - protein, 350 aa, Glycine max
MSCRKRQKTSPDKTSDCFDSLPDDLVLSILCKLSSTATSPSDFISVLITCKRLNSLGLHSLVLSKASHKTFSVKAKNWCDSLHRFLKHCADAGNIEACYTLGLIRFYCLQNRGSGAALMAKAAMNSHAPALYSLAVIQFNGSGGTKNDKDLRAGVALCARAAFLGHIDALRELGHCLQDGYGVKQNVTEGRRFLVQANVRELAAVLSAGNNKRPWLTWSHQPVPHPRLRSETGSGCPLLSDYGCNVPAPEVHPASQFMSEWFDIRGGFPSAGMRLCSQSGCGRPETRRHEFRRCSVCGVVNYCSRACQALDWKFRHKAECAPVERWLDDDDEDVAGENDGGDDGVMMVDS

SEQ ID NO: 7164 - protein, 381 aa, Medicago truncatula
MRTRTGLCYPQTLQLSNMFSDTNNNKRHKRMPQNTSDFFELLPDDIVLSILGKLSSTATSPSDFISVLITCKRLNGLSLNSVVLSKASNKTLSVKAKNWCDSAHRFLKRCVDAGNIEACYTLGMIRFYCLQNRGSGASLMAKAAMKSHAPSLYSLAVIQFNGSGGTKNDKDLRAGVALCARAAFLGHIDGLRELGHCLQDGYGVKQNVIEGRRFLVQANARELAAVLSNGNNNKQPLLTWSVNPGSSQPPQLRVLAGAGSVSGSGCPLLSDFGCNVPVQETHPANRFMTEWFDIRGGFPGPGMRLCSNSGCGRPETRKHEFRRCSVCGVVNYCSRACQALDWKFRHKAECAPVERWLEEEEHIAGEGDGGVNVDEVVVLDS

SEQ ID NO: 7165 - protein, 394 aa, Glycine max
MRTRRGACYSGVVSRMCSDARVSKKKNKDLHMHMHMHMHVPAGDSIIYSRKRQKKTPEKTAGADYEFFESLPDDLVISIFCKLSSTATKPSDFVNILITCKRLNRLALHSLVLSKASPKTFTIKARDWCDSAHKFLKHCADAGNVEACYTLGMIRFYCLQNRGSGASFMAKAAINSHARALYALAVIQFNGSGGTKSDKDLRAGVALCARAAFLGHVDAMRELGHCLQDGYGVRQNIAEGRRFLVQANARELAAVLSTGAAARTWLSWNLQPQQLRQGSGCPLLSDFGCNVPAPEVHPASLFMAEWFAARGGSPGPGLRLCSHAGCGRPETRKHEFRRCSVCGVVNYCSRACQALDWKFRHKAECSPVQRWLEEDGEDVGNDDGDGEVEVMVDS

SEQ ID NO: 7166 - protein, 391 aa, Glycine max
MRTRRGACYPGVVSRMCSNVRVTKKKSKDLHMHMHVPAGDSIIYSRKKQKKTPEKLAAGRYDFFESLPDDLVISIFCKLSSTATKPSDFVNVLITSKRLNRLALHSLVLSKASPRTFTIKAKYWCDSAHKFLKHCADAGNIEACYTLGMIRFYCLQNRGSGASLMAKAAINSHARALYALAVIQFNGSGGTKSDKDLRAGVALCARAAFLGHVDALRELGHCLQDGYGVRQNIAEGRRFLVQANARELAAVLSTGAAARTLLSWNLQPQQLRQGSGCPLLSDFGCNVPAPDVHPASLFMTEWFAAHGGSPGPGLRLCSNAGCGRPETRKHEFRRCSVCGEVNYCSRACQALDWKFRHKAECAPVERWLDEDGEDVGNDDGDGEVEVVMVDS

SEQ ID NO: 7167 - protein, 394 aa, Ricinus communis
MKTRRGLCYPRTDALDLDKRLVKRRKLGEIIAAATATGEQMVCRKRQRLSPEKIAGDKTDFFYALPDDLVTCILCKLSSSASCPSDFVNVLATCKRLNGLGLNSIVLSKASPKTFALKAKNWSDSAHRFLKLCADAGNVEACYTLGMIRFYCLQNRGSGASLMAKAAISSHAPALYSLAVIQFNGSGGSKNDKDLRAGVALCARAAFLGHIDALRELGHCLQDGYGVRQNIAEGRRFLVQANARELAAVLSNPNSDLNTRAWVNWNPHAHSNHRHASGPGCPLLSDFGCNVPAPEAHPASRFMADWFATRGGSPGQGLRLCSHVGCGRPETRKHEFRRCSVCGAVNYCSRACQALDWKLRHKEECAPVERWVVEDGEGGEAGVGDGNQNVVVDS

SEQ ID NO: 7168 - protein, 403 aa, Populus trichocarpa
MRTRRGISYPRRGVAVNACNTAAEKRTSSTTYNRGKPDFTAGEYMVCRKRNRLVSTGKKGETDLFESLPDDLVISILCKLSSSASCPSDFINVLITCRRLNGLGLHSLVLSKASPKSFAIKANNWSDSAHRFLKLCADAGNAEACYTLGMIRFYCLQNRGSGASLMAKAAISSHAPALYSLAVIQFNGSGGSKSDKDLRAGVALCARAAFLGHIDALRELGHCLQDGYGVRQNVTEGRRFLVQANARELAAVLSNPDSGLPTRAWLTWNPHAHPNHRHPSENGPSGCPLLSDFGCNVPAPEAHPASRFMTEWFAIRGGSAGSGLRLCSHTGCGRPETRKHEFRRCSVCGAVNYCSRACQALDWKLRHKEECAPVERWVDEDGEGGDDAGGVGGGDGDDVMVES

SEQ ID NO: 7169 - protein, 403 aa, Populus trichocarpa
MRTRRGLSYPRGAAVNACDTAAGKRTATTSYKRERPDFAAGDYLVCRKKNRLISTQKTGETDLFDSLPDDLVISILCKLSSSASCPSDFINVLLTCKRLNGLGLHSLVLSKASPKTFAVKAKNWSDSAHRFLKLFADAGNVEACYTLGMIRFYCLQNRGSGASLMAKAAISSYAPALYSLAVIQFNGSGGSKSDKDLRAGVALCARAAFLGHIDALRELGHCLQDGYGVRQNVTEGRRFLVQANARELAAVLSKHNSGFPTRTWFSWNPHAHPNHRHPTGNGPSGCPLLSDFGCNVPAPESHPASRFMTEWFAIRGGSSGSGLRLCSHTGCGRSETRKHEFRRCSVCGAVNYCSRACQALDWKLRHKEGCAPVERWVDEDGEGGADGDDGGVDGDDDDVMIES

SEQ ID NO: 7170 - protein, 385 aa, Vitis vinifera
MRTRRGVCYREVDMCTDNRVVKRRGDFSGDNVVCCRKRQRLAPESAGKSDFFEALPDDLVICILSKLSSSAGCPSDFINVLLTCKRFNGLGLHSLVLSRASSKSLAVRAKNWSESALRFLKLCADAGNVEACYTLGMIRFYCLQNRVSGASLMAKAAISSHAPALYSLAVIQFNGSVGSKNDKDLRAGVALCARAAFLGHIDALRELGHCLQDGYGVRQNVAEGRRFLVQANARELAAVLSSASSAVSSRSWLTWNPHQHHRHVTGSGCPLLSDFGCNVPAPEAHPASRFLAEWFAARGGVPGPGLRLCSHAGCGRPEMRRHEFRRCSVCGIVNYCSRACQALDWKLRHKAACAPVERWLVDDGDANGEGAVAGAAAEDDVIVAS

SEQ ID NO: 7171 - protein, 342 aa, Glycine max; identical to SEQ ID NO: 6722

SEQ ID NO: 7172 - protein, 359 aa, Glycine max; identical to SEQ ID NO: 6724

SEQ ID NO: 7173 - protein, 359 aa, Glycine max; identical to SEQ ID NO: 6725

SEQ ID NO: 7174 - protein, 359 aa, Glycine max; identical to SEQ ID NO: 6724

SEQ ID NO: 7175 - protein, 365 aa, Glycine max; identical to SEQ ID NO: 6728

SEQ ID NO: 7176 - protein, 221 aa, Helianthus annuus; identical to SEQ ID NO: 6734

SEQ ID NO: 7177 - protein, 260 aa, Vitis vinifera; identical to SEQ ID NO: 6735

SEQ ID NO: 7178 - protein, 221 aa, Vitis vinifera; identical to SEQ ID NO: 6736

SEQ ID NO: 7179 - protein, 254 aa, Vitis vinifera; identical to SEQ ID NO: 6737

SEQ ID NO: 7180 - protein, 267 aa, Vitis vinifera; identical to SEQ ID NO: 6738

SEQ ID NO: 7181 - protein, 221 aa, Arabidopsis thaliana; identical to SEQ ID NO: 6739

SEQ ID NO: 7182 - protein, 221 aa, Glycine max; identical to SEQ ID NO: 6740

SEQ ID NO: 7183 - protein, 221 aa, Dimocarpus longan; identical to SEQ ID NO: 6741

SEQ ID NO: 7184 - protein, 221 aa, Arabidopsis lyrata subsp. lyrata; identical to SEQ ID NO: 6742

SEQ ID NO: 7185 - protein, 221 aa, Vitis vinifera; identical to SEQ ID NO: 6743

SEQ ID NO: 7186 - protein, 396 aa, Glycine max; identical to SEQ ID NO: 6744

SEQ ID NO: 7187 - protein, 390 aa, Glycine max; identical to SEQ ID NO: 6745

SEQ ID NO: 7188 - protein, 210 aa, Glycine max; identical to SEQ ID NO: 6746

SEQ ID NO: 7189 - protein, 358 aa, Glycine max; identical to SEQ ID NO: 6747

SEQ ID NO: 7190 - protein, 373 aa, Glycine max; identical to SEQ ID NO: 6748

SEQ ID NO: 7191 - protein, 365 aa, Glycine max; identical to SEQ ID NO: 6729

SEQ ID NO: 7192 - protein, 390 aa, Glycine max; identical to SEQ ID NO: 6745

SEQ ID NO: 7193 - protein, 396 aa, Glycine max; identical to SEQ ID NO: 6744

SEQ ID NO: 7194 - protein, 553 aa, Glycine max; identical to SEQ ID NO: 6765

SEQ ID NO: 7195 - protein, 482 aa, Glycine max; identical to SEQ ID NO: 6770

SEQ ID NO: 7196 - protein, 542 aa, Glycine max; identical to SEQ ID NO: 6766

SEQ ID NO: 7197 - protein, 397 aa, Glycine max; identical to SEQ ID NO: 6772

SEQ ID NO: 7198 - protein, 731 aa, Medicago truncatula
MFDRSDYKSQYMDGQRESSFRWDFLDSKLSSSSDVRVTKSGFSIDKLNHGSHGSSTTSRSFKKGMRKGSEGLKLIGRSLGLGVSKAVFPEDLKVSEKKIFDPQDKFLLLWNKLFVISCIFSVFVDPLFFYLPVINDQLHCLGIDRKLAIIVTTLRTVIDAFYLLNMALQFRTAYIAPSSRVFGRGELVIDSAQIAKRYLRRYFIVDFLSVLPVPQIVVWRFLQRSKSSDVLATKQALLFIILLQYIPRFLRMVPLTSELKRTAGVFAETAWAGAVYYLLLYMLASHIVGAFWYLLAIERNDSCWQNACSDNGCNKNYLYCENQHTEGYSAWQNKSKAIFKSKCSVDDDPPPFDYGIFKQALSSGIISSKKFITKYLYCLWWGLQNLSTLGQGLQTSTYPGEVIFSIALAIAGLILFALLIGNMQTYLQSLTLRLEEMRVKRRDSEQWMHHRLLPKELRERVRRYDQYKWLATRGVDEDILVQSLPKDLRRDIKRHLCLALVRRVPLFESMDERLLDAICERLKPCLFTENTYIVREGDPVDEMLFIIRGRLESVTTDGGRSGFFNRTYLKEAEFCGEELLTWALDPRSGSNLPTSTRTVKALTEVETFALTADELKFVASQFRRLHSRQVQHTFRFYSQQWRTWAACFIQAAWRRYCKKKIMKLRMKEEEADESHGNASGSSSSLGAALLASKFAARTLRGVHRNRLAKTARELVKLQKPPEPDFTADDAD

SEQ ID NO: 7199 - protein, 728 aa, Glycine max
MFDCGPKSEYMGGQRENFLRLEALDSTLSSSSDAGVIKSGFSIDKLSHGHGNSTTSRSFKRGMRRGSEGLKSIGRSLGLGVSRAVFPEDLKVSEKKIFDPQDKFLLLWNKLFVISCILAVSIDPLFFYLPVINDSFHCLGIDRKLATIVTTLRTLVDAFYLLHMALQFRTAYIAPSSRVFGRGELVIDSAQIAKRYLQRYFIIDFLSVLPIPQIVVWRFLQRSKGSDVLATKQALLFIILLQYVPRFLRMVPLTSELKRTAGVFAETAWAGAAYYLLLYMLASHIVGAFWYLLAIERNDSCWQKACSDIRCNKNFLYCGNQHMEGYSAWNKTSEDIQSRCSADGDPAHFDYGIFGQVLSSGIISSKKFISKYCYCLWWGLQNLSTLGQGLQTSTYPGEVIFSIALAISGLILFALLIGNMQTYLQSLTIRLEEMRVKRRDSEQWMHHRLLPQDLRERVRRYDQYKWLATRGVDEENLVQSLPKDLRRDIKRHLCLALVRRVPLFESMDERLLDAICERLKPCLFTENTYIVREGDPVDEMLFIIRGRLESVTTDGGRSGFFNRGFLKEADFCGEELLTWALDPKSGSNLPSSTRTVKALMEVEAFALTADELKFVASQFRRLHSRQVQHTFRFYSQQWRTWAACFIQAAWRRYSKKKIMKLRQKEDESDGAHENVGGSSYSFGAALLASKFAAHTLRGVHRNRLAKTARELVKLQKPPEPDFSADDAN

SEQ ID NO: 7200 - protein, 728 aa, Glycine max
MFDCGPKSEYMGGQRENFLRLEALDSTLSSSSDAGVIKSGFNIDKLSHGHGSSTTSRSFKRGMRRGSEGLKSIGRSLGLGVSRAVFPEDLKVSEKKIFDPQDKFLLLWNKLFVISCILAVSIDPLFFYLPVINDSFHCLGIDRKLATIVTTLRTMVDVFYLIHMALQFRTAYIAPSSRVFGRGELVIDSAQIAKRYLQRYFIIDFLSVLPIPQIVVWRFLQRSKGSDVLATKQALLYIILLQYVPRFLRMVPLTSELKRTAGVFAETAWAGAAYYLLLYMLASHIVGAFWYLLAIERNDTCWQKACSDIGCKENFLYCGNRHMEGYSAWNKTSEDIQSRCSADGDPAHFDYGIFGQVLSSGIISSKKFISKYCYCLWWGLQNLSTLGQGLQTSTYPGEVIFSIALAISGLILFALLIGNMQTYLQSLTIRLEEMRVKRRDSEQWMHHRLLPQDLRERVRRYDQYKWLATRGVDEENLVQSLPKDLRRDIKRHLCLALVRRVPLFESMDERLLDAICERLKPCLFTENTYIVREGDPVDEMLFIIRGRLESVTTDGGRSGFFNRGFLKEADFCGEELLTWALDPKSGSNLPSSTRTVKALMEVEAFALTADELKFVASQFRRLHSRQVQHTFRFYSQQWRTWAACFIQAAWRRYSKKKIMKLRQKEDESDGTHENVGGSSYSFGAALLASKFAAHTLRGVHRNRLAKTARELVKLQKPPEPDFSADDAD

SEQ ID NO: 7201 - protein, 732 aa, Glycine max
MFDCGYKSQYVGGQCEKFVRLDDLDSRLSSSSEAAVKTCGFSIDKLSHGGHGSSTTSRSFKRRIRKGSEGLKSIGRSLGLGVSRAVFPEDLKVSEKKIFDPQDKFLLTWNKLFVISCILAVSVDPLFFYLPVINDSFHCLGIDRKLAITVTTLRTFIDAFYLVHMALQFRTAYIAPSSRVFGRGELVIDPAQIAKRYLRRYFIVDFLSVLPLPQIVVWRFLQRSKGSVVLATKRALLFIILHQYIPRFFRMVPLTSELKRTAGVFAETAWAGAAYYLLLFMLASHIVGSFWYLLAVERNDFCWQKACSGNGYNKNFLYCGNQYMEGYSAWQNRSKDILTSQCSVDNDNSPFDYGIFKQALSSRIVSSKKFFSKYCYCLWWGLQNLSTLGQGLETSTYTGEVVFSIALAIAGLILFALLIGNMQTYLQSLTIRLEEMRVKRRDSEQWMHHRLLPQELRERVRRYDQYKWLATRGVDEESLVQSLPKDLRRDIKRHLCLALVRRVPLFESMDERLLDAICERLKPCLFTESTYIVREGDPVDEMLFIIRGRLESVTTDGGRSGFFNRGFLKEADFCGEELLTWALDPKSGSNLPSSTRTVKALTEVEAFALTAEELKFVASQFRRLHSRQVQHTFRFYSQQWRTWAACFIQAAWRRYSKRKTMELSQKDEPEESEGTRGNASGSSYSLGATFLASRFAANALRGVHRNREAKSARELVKLQKPPEPDFTADDAD

SEQ ID NO: 7202 - protein, 743 aa, Vitis vinifera
MFDCGHKSQYMGVQREKFVRLDDLDSKLSISSDPGVNRCGFSIDGLSHVGLARSTSSRSLKKGMRKGSEGLKSIGRSLGFGVSRAVFPEDLKVSEKKIFDPQHKFLQLWNKLFVISCILAVSVDPLFFYLPVIDSSSKCLGIDRKLAITATTLRTIIDAFYLIHMALQFRTAYIAPSSRVFGRGELVIDPARIAKRYLRTYFIIDFLAVLPLPQIVVWRFLHSSDGSDVLSTKQALFFIVLLQYIPRLFRMLPLSSELKRTSGVFAETAWAGAAYYLLLYMLASHIVGAFWYLLAVERNDSCWQRACAHSGNCKTDFLYCSNRHTEGYDAWLIDSDNVLNSNCSVEGDNPPFNYGIYTNALSSGIVSSKKFLSKYCYCLWWGLQNLSTLGQGLQTSIYPGEVIFSIALAILGLILFALLIGNMQTYLQSLTIRLEEMRVKRRDSEQWMHHRLLPQELRERVRRYDQYKWLETRGVDEENLVQSLPKDLRRDIKRHLCLALVRRVPLFENMDERLLDAICERLKPSLFTENTFIVREGDPVDEMLFIIRGRLESVTTGGGRSGFFNRSLLKEGDFCGEELLTWALDPKSGSNLPSSTRTVKALTEVEAFALIAEELKFVASQFRRLHSRQVQHTFRFYSQQWRTWAACFIQAAWRRYSKRKILELRRKEEEEEEAAAAAAAEGLSGTNNNVRGGSYSLGATILASRFAANALRGVHRNRITKSARELVKLQKPPEPDFSADDAD

SEQ ID NO: 7203 - protein, 735 aa, Ricinus communis
MFDCNYKSQYLGGQREKFVRLDDLDSRLSSSSDTGGKKCGFGIEGFGRAGQGTNTTTTSRSFKKGIRKGSEGLKSIGRSLRFGVSRAVFPEDLKVSEKKIFDPQDKFLLLCNRLFVISCILGVSVDPLFFYLPVFNDPAHCLGIDRKLAIIATTLRTVIDAFYLIRMALQFRTAYIAPSSRVFGRGELVIDPAQIAKRYLRQYFIIDFLSVLPLPQIVVWRFLQRSNGSDVLATKQALLFIVLLQYIPRFLRIFPLFSEMKRTTGVFAETAWAGAACYLLMYMLASHIVGAFWYLLAVERQDTCWQKACHDTEKCNKNFLYCSNQHMSDYASWANISSNVLQSKCEAKDEDGPFDYGIYTNALSSGIASSMKFISKYCYCLWWGLQNLSTLGQGLQTSTYPGEVIFSISLAIFGLILFALLIGNMQTYLQSLTIRLEEMRVKRRDSEQWMHHRLLPQDLRERVRRYDQYKWLETRGVDEESLVQSLPKDLRRDIKRHLCLALVRRVPLFENMDERLLDAICERLKPCLFTERTYIVREGDPVDEMLFIIRGRLESVTTDGGRSGFFNRSLLKEGDFCGEELLTWALDPKSGVNLPSSTRTVKALTEVEAFALIAEELKFVASQFRRLHSRQVQHTFRFYSQQWRTWAACFIQAAWRRYSKRKNMELRRKEEEDEVDETRSNAGGGSYSIGATFLATRFAANALRGVHRNRNAKTARELVKLQKPPEPDFSAEDAD

SEQ ID NO: 7204 - protein, 733 aa, Populus trichocarpa
MFDCGSKSQYLGGGQRDKFVRLDDLDSRLSSPSSAGVRSCGFGIEGFRRTGQGADTPSRSFKRGIRKGSEGLKSIGRSLRFGVPRGVFPEDLKVSEKKIFDPQDKFLQFCNKLFLISCILAVSVDPLFFYLPVFSDSETCLGIDRKLATIATTLRTIVDAFYLIRMALQFRTAYIAPSSRVFGRGELVIDPTQIAKRYMQRYFIIDLLSVLPLPQIVVWRFLLRSKGSDVLATKQALLYIILLQYIPRFFRILPLTSELKRTAGVFAETAWAGAAYYLLLYMLASHIVGSFWYLLAVERNDACWQKNCTAAVKCKKDFLYCGNRGMEDYRAWDSSILNSNCSADDNNQFDYGIYSNALSSGIVSSKKFVSKYCFCLWWGLQNLSTLGQGLETSTYPGEVIFSIALAIFGLILFALLIGNMQTYLQSLTIRLEEMRVKRRDSEQWMHHRLLPQDLRERVRRYDQYKWLETRGVDEENLVQSLPKDLRRDIKRHLCLALVRRVPLFENMDERLLDAICERLKPCLFTESTYIVREGDPVDEMLFIIRGRLESVTTDGGRSGFFNRSLLREGDFCGEELLTWALDPKSGANLPSSTRTVKALREVEAFALIAEELKFVASQFRRLHSRQVQHTFRFYSQQWRTWAACFIQAAWRRYSKRKSLELRRKEEEDEAEADGNRSNMRGGGSYSIGATFLATRFAANALRGIHRNRNAKTARELVKLQKPPEPDFTADDAD

SEQ ID NO: 7205 - protein, 717 aa, Arabidopsis thaliana
MAGKRENFVRVDDLDSRLPSSSVAFQQNYASNFSGQLHPIHASNETSRSFKKGIQKGSKGLKSIGRSLGFGVYRAVFPEDLKVSEKKIFDPQDKFLLYCNKLFVASCILSVFVDPFFFYLPVINAESKCLGIDRKLAITASTLRTFIDVFYLAHMALQLRTAYIAPSSRVFGRGELVIDPAQIAKRYLQRWFIIDFLSVLPLPQIVVWRFLQSSNGSDVLATKQALLFIVLVQYIPRFLRVLPLTSELKRTAGVFAETAWAGAAYYLLLYMLASHIVGAFWYLLALERNDACWQEACIDAGNCSTDFLYCGNQNMDGYAVWNRAKESVLKSKCRADLDDNNPPFDFGIYTQALSSGIVSSQNFIVKYCYCLWWGLQNLSTLGQGLETSTYPMEIIFSISLAISGLILFALLIGNMQTYLQSLTIRLEEMRVKRRDSEQWMHHRMLPQDLRERVRRYDQYKWLETRGVDEEYLVQNLPKDLRRDIKRHLCLALVRRVPLFKSMDDKLLDAICMRLKPCLFTESTYLVREGDPVDEMLFIIRGRLESVTTDGGRSGFFNRSLLKEGEFCGEELLTWALDPKSGVNLPSSTRTVKALTEVEAFALTSEELKFVASQFRRLHSRQVQHTFRFYSHQWRTWAACFIQAAWRRYCKRKKMEEAEAEAAAVSSSTAGPSYSIGAAFLATKFAANALRTIHRNRNTKIRDLVKLQKPPEPDFTAD

SEQ ID NO: 7206 - protein, 717 aa, Arabidopsis lyrata subsp. lyrata
MAGKRDNFVRVDDLDSRLPSSSVAFQQNYASNFSGQLHPIHGANDTSRSFKKGIQKGSKGLKSIGRSLGFGVYRAVFPEDLKVSEKKIFDPQDKILLYCNKLFVASCILSVFVDPFFFYLPVINAESKCLGIDRKLAITASTLRTFIDVFYLAHMALQLRTAYIAPSSRVFGRGELVIDPAQIAKRYLQRWFIIDFLSILPAPQIVVWRFLQSSNGSDVLATKQALLFIVLVQYIPRFLRVLPLTSELKRTAGVFAETAWAGAAYYLLLYMLASHIVGAFWYLLALERNDACWQKACNDAGNCSTDFLYCGNQNMDGYAVWNRTKESVLQSKCRADLDDNNPPFDFGIYTQALSSGIVSSQNFIVKYCYCLWWGLQNLSTLGQGLETSTYPMEIIFSIALAISGLILFALLIGNMQTYLQSLTIRLEEMRVKRRDSEQWMHHRMLPQDLRERVRRYDQYKWLETRGVDEEYLVQNLPKDLRRDIKRHLCLALVRRVPLFESMDDKLLDAICMRLKPCLFTESTYLVREGDPVDEMLFIIRGRLESVTTDGGRSGFFNRSLLKEGEFCGEELLTWALDPKSGVNLPSSTRTVKALTEVEAFALTSEELKFVASQFRRLHSRQVQHTFRFYSHQWRSWAACFIQAAWRRYCKRKKMEEAEAEAAAVPSSTAGPSYSIGAAFLATKFAANALRTIHRNRNTKIRDLVKLQKPPEPDFTAD

SEQ ID NO: 7207 - protein, 710 aa, Arabidopsis thaliana
MAGKRENFVRLPSSSVAFQQNYASNFSGQLHPIHASNETSRSFKKGIQKGSKGLKSIGRSLGFGVYRAVFPEDLKVSEKKIFDPQDKFLLYCNKLFVASCILSVFVDPFFFYLPVINAESKCLGIDRKLAITASTLRTFIDVFYLAHMALQLRTAYIAPSSRVFGRGELVIDPAQIAKRYLQRWFIIDFLSVLPLPQIVVWRFLQSSNGSDVLATKQALLFIVLVQYIPRFLRVLPLTSELKRTAGVFAETAWAGAAYYLLLYMLASHIVGAFWYLLALERNDACWQEACIDAGNCSTDFLYCGNQNMDGYAVWNRAKESVLKSKCRADLDDNNPPFDFGIYTQALSSGIVSSQNFIVKYCYCLWWGLQNLSTLGQGLETSTYPMEIIFSISLAISGLILFALLIGNMQTYLQSLTIRLEEMRVKRRDSEQWMHHRMLPQDLRERVRRYDQYKWLETRGVDEEYLVQNLPKDLRRDIKRHLCLALVRRVPLFKSMDDKLLDAICMRLKPCLFTESTYLVREGDPVDEMLFIIRGRLESVTTDGGRSGFFNRSLLKEGEFCGEELLTWALDPKSGVNLPSSTRTVKALTEVEAFALTSEELKFVASQFRRLHSRQVQHTFRFYSHQWRTWAACFIQAAWRRYCKRKKMEEAEAEAAAVSSSTAGPSYSIGAAFLATKFAANALRTIHRNRNTKIRDLVKLQKPPEPDFTAD

SEQ ID NO: 7208 - protein, 373 aa, Glycine max; identical to SEQ ID NO: 6748

SEQ ID NO: 7209 - protein, 358 aa, Glycine max; identical to SEQ ID NO: 6747

SEQ ID NO: 7210 - protein, 951 aa, Glycine max
MGKKSSPAEGEEAVPEHLRCSRTDGRQWRCRRRVKENLKLCEIHYVQARRRQHKKTLKLKRKRQNDAVEVQIGAKRDRKSREALVNRRNQLELIRMVLQREVEKKKKKQSQLNLNLHLHFNHELKKELPNGVMAIASNMASSRYFRSKNAERGSVSKLQVVQCGQSIKKGRRKKCHWCQRSDSWSLVMCSSCQREFFCMECIKQRYFATQNEVKMACPVCRGTCTCKDCLSSQYEESESKEYLAGKNRVDRILHFHYLVCMLLPVLKQIKEDHHVGVEKTAKIKGGKRTSDIIIKPVDFVCNEKNYCNYCKTPILDLHRSCLSCSYSLCLSCSQALSQGSTSEEINSSISNLPDKINACIFSEGHLLDDKVISNGNLTDTSTLVEWTNCNGADIVSCPPTKLGDCGDSHLDLKYVFPLSWIKEMEVKAEEIVCSYDFPETLDRSSSCSLCVDKDHKTSRYKQLPEAAQREDSNDNFLFYPTILDISCNHFEHFRKHWGIGHPVVVRDVLQSMPNLSWDPLVMFCTYLERSMTRYENNKDLLEACLDWFEVEINVSQYFTGSLKCQPQKNNWHEMLKLKGWLSSQLFKEQFPAHFAEVIDSLPIQEYMNPWSGLLNLAANLPQGSTKHDIGPHVYISYGCADEEADSVTNLCYDSYDMVNIMAHTMDIPLSTDQLAKISKLLKKHKTLCQKVSSSKTTSEHSEDREQNEMHGMVREGTDFLRRVNRTASISTEAKPISNQKLDTNISDDEECGSDSETEKAQSSLPFQRRVLSTEMSPDHNPRNPFENSNSDKRKKFTENSGAHWDVFRRQDVPKLLEYLKRHSDEFSYNSECHEKMVHPILDQSFFLDNTHKMRLKEEFKIEPWTFEQHVGEAVIIPSGCPYQIRNPKCCVHVELEFVSPENVSECIQLIDEVRLLPEDHKAKGEKLEVKKMALYSMSTAIEEIRELTCKT

SEQ ID NO: 7211 - protein, 922 aa, Glycine max
MGKKSNPAEGEEAVPEHLRCSRTDGRQWRCRRRVKENLKLCEIHYVQARRRQHKKTLKLKRKRQNDAVEAQIGAKRDRKSREALVNRRNQLELIRMLKKELPNGVMAIASNVASSRYFRSKNADSGSVSKLQVVQCGRSMNKGRRKKCHWCQRSDSWSLVMCSSCQREFFCMECIKQRYFDTQNEVKMACPVCRGTCTCKDCLSSQYEDSESKEYLAGKNRVDGILHFHYLVCMLLPVLKQIKEDHHVDVEETAKTKGKRTSDILIKPVDFVCNEKNYCNYCKTPILDLHRSCLSCSYSLCLSCSQALSQGSTSEEINSSISNLPDKINACISSESHLLDDKVISNGNLTDTSTLLEWTNCNGAGIVSCPPTKLGDCGDNHLDLKYVFPLSWIKEMEVKAEEIVCSYDFPETSDKSSSCSLCVDKDHKTSRYKQLPEAAQREDSNDNYLFYPTILDISCNHFEHFRKHWGKGHPVVVRDVLQCTPNLSWDPVVMFCTYLERSMTRYENNKDLLEACLDWFEVEINVSQYFIGPLKCQPQKNTWHEMLKLKGWLSSQLFKEQFPAHFAEVIDALPIQEYMNPLSGLLNLAANLPQGSTKHDIGPYVYISYGCADEGDDFVTNLCYDSYDMVNIMAYSMDIPLSTDQLAKISKLLKKHKTLCQKVSSKTTSEHSEDREQNGMHSIVKEGTDFLRRVNRTSSISTEAKTISNQKLDTNISDDEECGSDSETEKAQSSLPSHRRVLSTERSPDHNPRNPFENSNSDKGKKFTENSAAHWDVFRRQDVPKLLEYLKRHSDEFSYTSECHEKMVHPILDQSFFLDNTHKMRLKEEFKIEPWTFEQHVGEAVIIPSGCPYQIRNPKCCVHVELEFVSPENVSECIQLIDEVRLLPEDHKAKVEKLEVKKMALYSMSTAIKEIRELTCKT

SEQ ID NO: 7212 - protein, 326 aa, Glycine max
MDPNPRTIRSLVSKLSSVSEAARIDALSQLRLMSKQSPETRPIIAQAGAIPYIAETLYSSSHPSQEDAATTLLNLSITLKEPLMSTRGVLDAIAHVISHHHTTSSPPAVQSAAATIHSLLSSVDSYRPVVGSKREIVYSLIDILRCHLSSPPRTIKDSLKALFAIALHPINRSTMINLGAVPALFSLVLKDGRVGIVEDATAVIAQVAGCEDAVDAFRKASGGVGVLADLLDLATAASMRTKENAVSALLNLVRCGGDKVAADVRDVVAFGALDGIADVRDGGSVKGKNKAAELMKVLLGQNNGDVVVFNSDTCSSFGSTRNHDSE

SEQ ID NO: 7213 - protein, 325 aa, Glycine max
METNPRTIRSLVSKLSSVSEAARVDALSQLRLMSKQSPETRPLIADAGAIPFVAETLYCSSHPPQENAAATLLNLSITQKEPLMSTRGVLDAIAHVISHHNTTSSPAAVQSAAATIHSLLSSVDSYRPVVGSKREIVYSLIDILRCHVSSPPRTIKDSLKALFAIALHPLNRSTMINLGAVPALFSLVAKDGRVGIVEDATAVIAQVAGCEDAAEAFFKASGVGVLADLLDLATAASMRTKENAVSALLNLVRCGGDKVAADVRDAVAFGALDGIADVRDGGSGKGKNKAAELLKVLLGENNGDVVALNSDTCSSFGSSRNHDSE

SEQ ID NO: 7214 - protein, 372 aa, Medicago truncatula
MDANRRVVRTLVSKLSSVSEKTRIESLIELRQLSKQDPSTRPIIAESGAIPYLAETLYSSLHPSQENATATLLNLSITEKEPIMSTRGVLDALAHVISHHSSTSAAAAVQSAAATIHSLLSSVDDYRTVVGSKREIVYALVDILRCHRSSPPRTVKDSLKALFAIALHPLNRATMVQFGVVPALFSLIVNDGRVGIVEDASAVIAQVITIFDSTHIYRNVYRKKKLNLIKCSFELSYILVAGCEESVEAFKKVSGVGVLADLLDLATGSSMRTRENAVSALLNLVRCGGDVVAGDVRDAVAFGAMDGIADVKDKGSVKGQSKAMELMRVMVGDVRSHGDVRSQGDVRNHGNVGLNSDSSFGSYMNEDSGTSF

SEQ ID NO: 7215 - protein, 321 aa, Glycine max
MESGLPLLNCLLQQTLRTICTSPNSSTPSKWVYAVFWRILPRNFPPPRWELGGTALDLSKGNKRNWILVWEDGFCDFNECEQRKSGSGYLNGRFGAELFFKMSHEVYNYGEGLVGKVAADNSHKWVYNESHNECESSYVASWNASVEPQPKAWEFQFNSGIQSIVIIAVREGVVQLGSFNKIAEDLNLVISIQRQFSYLQSIPGVFGIQRPYLRLQHPYIVKPSFIASNAMPLYDMGWNTPQNGAPGPSLCSGSPSLPLPTMPCNFGALLSKLPSGIPSHNSTQVPNAGTQSIIERVKIEDCEFHPTHDDDHKVKVGSLNK

SEQ ID NO: 7216 - protein, 323 aa, Glycine max
MESGLPLLNYLLQQTLRTICTSPNSSTPSKWVYAVFWRILPRNFPPPRWEFGGTALDLSKGNKRNWILVWEDGFCDFNECEQRKSGSGYLNGRFGADVFFKMSHEVYNYGEGLVGKVAADNSHKWVYNESHNECESSYIASWNASVEPQPKAWEFQFNSGIQSIVIIAVREGVVQLGSFNKISEDLNLVISIQRQFSYLQSIPGVFGIQRPYLPLQHPYIVKPSFIENNAMTLYDMGWNTNPQNGAPGPSLCSGSPSLPLPTMPCSFGALLSKLPSGIPPYNSTQVLDAGTQSTIERVKIEDCEFHPTLDDDHKGRKVGSLNK

SEQ ID NO: 7217 - protein, 202 aa, Glycine max
MKKLYRKGTVHPSPSPSPPTISDHLSFLPAAILTLTLSLSPKDQEVLAYLISCSSSSSSTTNFSGNHRRNPKVVVDGDHPPVFNCSCFRCYMSYWVRWNSSPNHQLIHEIIDTFEDSLAHTTKPSRKDKRNKRGSKTKPSELTRSEFPSSPPESVPESSSSSAGAGEVEAGQGGDGGGDEEKGSVRRFVSFIGERIWGAWAQ

SEQ ID NO: 7218 - protein, 195 aa, Glycine max
MKKLYRKGTVHPSPSPSPPTISDHLSFLPAAILTLTLSLSSEDREVLAYLISCSSNNNFSGNPRRKPKVVADGDHPPLFNCSCFRCYMSYWVRWNSSPNHQLIHEIIDAFEDSLTHTAKPSRKDKRNKRGSKPKPPEMTRSEFPSSPPESLPESSSSGAGAGEVEAGQGGDDEEKGSVRRFVSFIGERIWGAWGQ

SEQ ID NO: 7219 - protein, 323 aa, Glycine max; identical to SEQ ID NO: 7216

SEQ ID NO: 7220 - protein, 321 aa, Glycine max; identical to SEQ ID NO: 7215

SEQ ID NO: 7221 - protein, 524 aa, Glycine max; identical to SEQ ID NO: 6326

SEQ ID NO: 7222 - protein, 492 aa, Glycine max; identical to SEQ ID NO: 6328

SEQ ID NO: 7223 - protein, 228 aa, Populus trichocarpa
MASSTLSPATPSQLCSSKSGMFSPTHAVFVKPTRTNMVLKERGMRISCQATSVPADDRVPDMGKRELMNLLLLGALSLPTAGMLVPYTYFFVPTGLGGGGGGTVAKDALGNDIVAEQWLNTHGPGDRTLSQGLKGDPTYLVVEKDRVLATYGINAVCTHLGCVVPWNQAEKKFICPCHGSQYNDQGRVVRGPAPLSLALAHCDVDDGKVVFVPWVETDFRTGDAPWWS

SEQ ID NO: 7224 - protein, 228 aa, Populus trichocarpa
MASTTLSPATPSQLCSSKSGMFSPTHAAFVKPARTNMVTKEKGMRIACQATSIPADDGVPDMGKRELMNLLLLGALSLPTAGMLIPYTYFFVPSGLGGGGGGTVAKDALGNDIVVEQWLKTHGPGDRTLSQGLKGDPTYLVVEKDRTLATYGINAVCTHLGCVVPWNQAEKKFICPCHGSQYNDQGRVVRGPAPLSLALAHCDVDDGKVVFVPWVETDFRTGDDPWWT

SEQ ID NO: 7225 - protein, 227 aa, Glycine max
MASTTLSPTTPSQLCSGKSGIFSPSQALLVKPVKRQMMGKSKGMRIACQATSIPADRVPDMGKRQLMNLLLLGAISLPSAGMLIPYTYFFVPPGSGSSAGGTVAKDAVGNDVIAENWLKAHGPGDRTLAQGLKGDPTYLVVEKDRTLATYAINAVCTHLGCVVPWNQAENKFICPCHGSQYNDQGRVARGPAPLSLALAHCDIDDGKVVFVPWVETDFRTGDAPWWA

SEQ ID NO: 7226 - protein, 227 aa, Glycine max
MASTTLSPTTPSQLCSGKSGIFSSSQALLVKPVKRQMMGKSKGLRIACQATSISADRVPDMGKRQLMNLLLLGAISLPTAGMLIPYTYFFVPPGSGSSAGGTVAKDAVGNDVIAENWLKAHGPGDRTLTQGLKGDPTYLVVEKDRTLATFAINAVCTHLGCVVPWNQAENKFICPCHGSQYNDQGRVVRGPAPLSLALAHCDIDDGKVVFVPWVETDFRTGDAPWWA

SEQ ID NO: 7227 - protein, 227 aa, Glycine max
MASTTLSPTTPSQLCSGKSGIFSSSQALLVKPVKRQMMGKSKGLRIACQATSISADRVPDMGKRQLMNLLLLGAISLPTAGMLIPYTYFFVPPGSGSSAGGTVAKDAVGNDVIAENWLKAHGPGDRTLTQGLKGGPTYLAVEKDRTLATFAINAVCTHLGCVVPWNQAENKFICPCHGSRYNDQGRVVRGPAPLSLALAHCDIDDGKVVFVPWVETDFRTGDAPWWA

SEQ ID NO: 7228 - protein, 262 aa, Glycine max
MASTTLSPTTPSQLCSGKSGIFSSSQALLVKPVKRQMMGKSKGLRIACQATSISADRVPDMGKRQLMNLLLLGAISLPTAGMLIPYTYFFVPPGSGSSAGGTVAKDAVGNDVIAENWLKAHGPGDRTLTQGLKGDPTYLVVEKDRTLATFAINAVCTHLGCVVPWNQAENKFICPCHGSQYNDQGRVVRGPAPLSLALAHCDIDDGKVVFFPWVETDFRTVMLHGGLRLLKTSVVIYIFKHEINILFRIMHNIFCIKLIFCD

SEQ ID NO: 7229 - protein, 228 aa, Vitis vinifera
MAASTLSPATSSQLCSIRNGVLSPSHALLPKLTRTSPFVGKGKGLKIKCQATSIPADRVPDMGKRKLMNLLLLGAISLPSAGMLIPYATFFAPPGTGSAGGGIVAKDALGNDVIADEWLKTHGPGDRTLTQGLKGDPTYLVVENDKTLATYGINAVCTHLGCVVPWNAAENKFICPCHGSQYNNQGRVVRGPAPLSLALAHADIDDGKVLFVPWVETDFRTGEDPWWA

SEQ ID NO: 7230 - protein, 227 aa, Citrullus lanatus
MASSTLSSATPSQLCASRSALFCPSQALLRKPKNTQMGAKGKEVKISCQATSIPADRVPDMGKRKTMNLLLLGAIGLPTATMLYPYTYFFVPPGTGGAGGGIVAKDALGNDVLAEEWLKAHGPGDRTLTQGLRGDPTYLVVEKDKTLATYGINAVCTHLGCVVPWNAAENKFICPCHGSQYNDQGRVVRGPAPLSLALVHADVDDGKVVFVPWVETDFRTGENPWWA

SEQ ID NO: 7231 - protein, 228 aa, Vitis vinifera
MAASTLSSATPSQVSRGENGVLSPSHALLPKLTRMSPFVGKGKGLKIKCQATSIPANRVPDMGKRKLMNLLLLGVVSLPSAGMLIPYATFFAPPGTGSAGGGTVAKDALGNDVIADEWLKTHGPGDRTLTQGLKGDPTYLVVEDDKTLATYGINAVCTHLGCVVPWNTAENKFICPCHGSQYNNQGRVVRGPAPLSLALAHADIDDGKVVFIPWVETDFRTGEDPWWA

SEQ ID NO: 7232 - protein, 220 aa, Ricinus communis
  misc_feature (19)..(19): Xaa can be any naturally occurring amino acid
MASSTLSPPTTSQLCSGKXAVFLRPTRTHMVTKDRAMKLTCQATSIPADRVPDMGKRQLMNLLLLGAISLPTGFMLVPYASFFAPPGTGGAGGGTVAKDAVGNDVIAELWLKTHGPGDRTLTQGLKGDPTYLVVEKDRTLATYGINAVCTHLGCVVPWNAAENKFICPCHGSQYNDQGRVVRGPAPLSLALAHADIDDGKVVFVPWVETDFRTGDAPWWA

SEQ ID NO: 7233 - protein, 262 aa, Glycine max; identical to SEQ ID NO: 7228

SEQ ID NO: 7234 - protein, 230 aa, Pisum sativum
MSSTTLSPTTPSQLCSGKSGISCPSIALLVKPTRTQMTGRGNKGMKITCQATSIPADRVPDMSKRKTLNLLLLGALSLPTAGMLVPYGSFLVPPGSGSSTGGTVAKDAVGNDVVATEWLKTHAPGDRTLTQGLKGDPTYLVVEKDRTLATFAINAVCTHLGCVVPFNQAENKFICPCHGSQYNDQGRVVRGPAPLSLALAHCDVGVEDGKVVFVPWVETDFRTGDAPWWS

SEQ ID NO: 7235 - protein, 229 aa, Medicago truncatula
MSSTTLSPATPSQLCSGKSGISCPSIGLLVKPTRTQMIGKGKGMSITCQATGIPADRVPDMSKRETLNLLLLGALSLPTAGMLVPYGSFLVPPGSGSSTGGTVAKDAVGNDVVAAEWLKSHGPGDRTLTQGLKGDPTYLVVESDRTLATFAINAVCTHLGCVVPFNQAEKKFICPCHGSQYNDQGRVVRGPAPLSLALAHCDVGVDDGKVVFVPWVETDFRTGDAPWWS

SEQ ID NO: 7236 - protein, 415 aa, Glycine max; identical to SEQ ID NO: 6357

SEQ ID NO: 7237 - protein, 441 aa, Glycine max; identical to SEQ ID NO: 6380

SEQ ID NO: 7238 - protein, 443 aa, Glycine max; identical to SEQ ID NO: 6381

SEQ ID NO: 7239 - protein, 439 aa, Cucumis melo subsp. melo; identical to SEQ ID NO: 6382

SEQ ID NO: 7240 - protein, 432 aa, Ricinus communis; identical to SEQ ID NO: 6383

SEQ ID NO: 7241 - protein, 440 aa, Vitis vinifera; identical to SEQ ID NO: 6384

SEQ ID NO: 7242 - protein, 438 aa, Arabidopsis lyrata subsp. lyrata; identical to SEQ ID NO: 6385

SEQ ID NO: 7243 - protein, 439 aa, Arabidopsis thaliana; identical to SEQ ID NO: 6386

SEQ ID NO: 7244 - protein, 439 aa, Arabidopsis thaliana; identical to SEQ ID NO: 6387

SEQ ID NO: 7245 - protein, 436 aa, Populus trichocarpa; identical to SEQ ID NO: 6388

SEQ ID NO: 7246 - protein, 436 aa, Populus trichocarpa; identical to SEQ ID NO: 6389

SEQ ID NO: 7247 - protein, 524 aa, Glycine max; identical to SEQ ID NO: 6326

SEQ ID NO: 7248 - protein, 443 aa, Glycine max; identical to SEQ ID NO: 6381

SEQ ID NO: 7249 - protein, 441 aa, Glycine max; identical to SEQ ID NO: 6380

SEQ ID NO: 7250 - protein, 510 aa, Glycine max; identical to SEQ ID NO: 6339

SEQ ID NO: 7251 - protein, 510 aa, Glycine max; identical to SEQ ID NO: 6340

SEQ ID NO: 7252 - protein, 651 aa, Glycine max; identical to SEQ ID NO: 6789

SEQ ID NO: 7253 - protein, 652 aa, Glycine max; identical to SEQ ID NO: 6790

SEQ ID NO: 7254 - protein, 594 aa, Medicago truncatula; identical to SEQ ID NO: 6791

SEQ ID NO: 7255 - protein, 685 aa, Ricinus communis; identical to SEQ ID NO: 6792

SEQ ID NO: 7256 - protein, 647 aa, Vitis vinifera; identical to SEQ ID NO: 6793

SEQ ID NO: 7257 - protein, 674 aa, Vitis vinifera; identical to SEQ ID NO: 6794

SEQ ID NO: 7258 - protein, 662 aa, Vitis vinifera; identical to SEQ ID NO: 6795

SEQ ID NO: 7259 - protein, 673 aa, Vitis vinifera; identical to SEQ ID NO: 6796

SEQ ID NO: 7260 - protein, 674 aa, Vitis vinifera; identical to SEQ ID NO: 6797

SEQ ID NO: 7261 - protein, 673 aa, Vitis vinifera; identical to SEQ ID NO: 6798
  misc_feature (51)..(52): Xaa can be any naturally occurring amino acid
  misc_feature (79)..(79): Xaa can be any naturally occurring amino acid
  misc_feature (397)..(397): X can be Leucine or Isoleucine

SEQ ID NO: 7262 - protein, 253 aa, Medicago truncatula
MSILPKLRCVTIDVTGTLMAYKGELGDYYCMAAKASGRPCPDYKRMHEGFKYAYKDMAKKYPCFGFAAKMPNIVWWKTCVRDSFVRAGYEYDEETFEKIFRRIYSSFGSSAPYTVFPDSKPFLRWLRGKGLKVGIVSNAEYRYRDVILPALGLNQGSEWDFGVFSGLEGVEKPDPKIYEIALERAGNIAPEEALHIGDSMRKDYEPAKSIGMHALLLDRFKTPEAVEWRKSGAVVLPDLTTTQEWLSSEKSTS

SEQ ID NO: 7263 - protein, 253 aa, Glycine max
MSLLAKLRCVTIDVTGTLMAYKGELGDYYCMAAKAAGKPCPDYKRMHEGFKLAYKEMAKNYPCFGHAAKMPNIVWWKTCVRDSFVRAGYEYDEETFEKIFRRIYASFGSSAPYTVFPDSQPFLRWLRGEGLKVGIVSNAEYRYQDVILPALGLNEGSEWDFGVFSGLEGVEKPNPKIYEIALERAGNIAPEEALHIGDSMRKDYEPAKSIGMHALLLDRFKTPDAVEWRKSGAVVLPDLLAAKEWLSSDKSNC

SEQ ID NO: 7264 - protein, 253 aa, Glycine max
MSLLAKLRCVTIDVTGTLMAYKGELGDYYCMAAKAAGKPCPDYQRMHEGFKLAYKEMAKNYPCFGHAAKMPNIVWWKTCVRDSFVRAGYEYDEETFEKIFRRIYASFGSSAPYTVFPDSQPFLRWLRGEGLKVGIVSNAEYRYQDVILPALGLNEGSEWDFGVFSGLEGVEKPNPKIYEIALERAGNIAPEEALHIGDSMRKDYEPAKSIGMHALLLDRFKTPDAVEWRKSGAVVLPDLLAAKEWLSSDKSNC

SEQ ID NO: 7265 - protein, 253 aa, Glycine max
MSLLAKLRCVTIDVTGTLMAYKGELGDYYCMAAKAAGKPCPDYKRMHEGFKLAYKEMAKNYPCFGHAAKMPNIVWWKTCVRDSFVRAGYEYDEETFEKIFRRIYASFGSSAPYTVFPDSQPFLRWLRGEGLKVGIVSNAEYRYQDVILPALGLNEGSERDFGVFSGLEGVEKPNLKIYEIALERAGNIAPEEALHIGDSMRKDYEPAKSIGMHALLLDRFKTPDAVEWRKSGAVVLPDLLAAKEWLSSDKSNC

SEQ ID NO: 7266 - protein, 250 aa, Vitis vinifera
MSMLSKLRCITFDVTGTLIAYKGELGDYYCMAAKSIGLPCPDYKRVHEGFKLAYTEMAKKYPCFGYAAKMPNIVWWKTCVRDSFVRAGYDYDEETFEKVFRRIYSTFGSSAPYTIFPDSQPFLRWVHEKGLKVGIISNAEYRYKDVILPALGLNQGTEWDFGVFSGLEGVEKPNPRIYEIALERAGNIAPEEVLHIGDSMRKDYLPAKGVGMHALLLDRFKTPDAIEWSKSGATVLPDLVSVQEWLTSQN

SEQ ID NO: 7267 - protein, 261 aa, Oryza sativa Japonica Group
MSLISKLRLITVDVTGTLLAYKGQLGDYYCMAAKAAGKPCPDYQRMHEGFKLAYTEMARQYPCFGFAAKMPNIDWWRMCVKDSFVKAGYEYDEETFEKIFKRIYSSFGSSAPYSVFPDAQPFMRWLRGKGLTVGIVSNAEYRYKDVILPALGLNQGSEWDFGVFSGIVGVEKPDPSIYRIALEMAGKVAPEEALHIGDSMRKDYTPARSIGMHALLLDRFKTADAESWRKSGATVLPDLVAAQEWLSKNLKDEPVAAEQNV

SEQ ID NO: 7268 - protein, 279 aa, Ricinus communis
MLASGEIEVSLLFTIWSSCETAAIAVMSLLSKLRCITVDVTGTLIAYKGELGDYYCMAAKSVGLPCPDYKRVHEGFKLAYTEMAKKYPCFGHAAKMPNIVWWKIVVRNSFMKAGYDYDEETFEKIFRRVYASFGSSAPYSIFPDSQPFLRWAREKGLLVGIVSNAEYRYHDVILPALGLNQGSEWDFGVFSGLDGVEKPDPRMYKIALEKAGNVAPEEALHIGDSMRKDYLPAKSVGMHALLLDRFKTPDAEEWRKSGATVLPDLVSVQELLSLGTLTC

SEQ ID NO: 7269 - protein, 253 aa, Silene latifolia
MAMSLLPKLRCITVDVTGTLLAYKGELGDYYCMAAKAAGLPCPDYKRVHEGFKLAYTDMAKKYPCFGHAAKMPNIVWWKTCVTDSFKKAGYEYDEETFEKIFRRIYSSFGSSAPYVLFPDSIPFLRWLRVNGIPVGLVSNAEYRYRDVILPALGLHQGSEWDFGVFSGLEGVEKPDPRIYEIALERAGNVAPEETLHIGDSFRKDYLPAKSLGMHAILLDRFKIPDAENWRKDGIPVYPDLASVQEFLDSDNL

SEQ ID NO: 7270 - protein, 253 aa, Silene latifolia
MAMSLLPKLRCITVDVTGTLLAYKGELGDYYCMAAKAAGLPCPDYKHVHEGFKLAYTDMAKKYPCFGHAAKMPNIVWWKTCVTDSFKKAGYEYDEETFEKIFRRIYSSFGSSAPYVLFPDSIPFLRWLRVNGIPVGLVSNAEYRYRDVILPALGLHQGSEWDFGVFSGLEGVEKPDPRIYEIALERAGNVAPEETLHIGDSFRKDYLPAKSLGMHAILLDRFKNPDAENWRKDGIPVYPDLASVQEFLDSDNL

SEQ ID NO: 7271 - protein, 274 aa, Sorghum bicolor
MSLLSKLRLITVDVTGTLIAYKGHLGDYYCMAAKSAGMPCPDYNRMHEGFKLAYTEMARQYPCFGFAAKMPNIEWWRTCVKNSFVKAGYDYDEETFEKIFRRIYSAFGSSAPYSAFPDAQPFMRWAREKGLIVGVVSNAEYRYKDVILPALGLNQGSEWDFGVFSGMVGVEKPDPRIYKIALEMAGNVAPEEALHIGDSMRKDYTPARSIGMHALLLDRFKTADAESWRQSGATVLPDLVATQEWLTKNQNEEQEKTVASRVLNRMSEKLKMGA

SEQ ID NO: 7272 - protein, 595 aa, Glycine max; identical to SEQ ID NO: 6331

SEQ ID NO: 7273 - protein, 553 aa, Glycine max; identical to SEQ ID NO: 6332

SEQ ID NO: 7274 - protein, 492 aa, Glycine max; identical to SEQ ID NO: 6328

SEQ ID NO: 7275 - protein, 806 aa, Glycine max; identical to SEQ ID NO: 6336

SEQ ID NO: 7276 - protein, 825 aa, Medicago truncatula; identical to SEQ ID NO: 6337

SEQ ID NO: 7277 - protein, 847 aa, Medicago truncatula; identical to SEQ ID NO: 6338

SEQ ID NO: 7278 - protein, 510 aa, Glycine max; identical to SEQ ID NO: 6340

SEQ ID NO: 7279 - protein, 510 aa, Glycine max; identical to SEQ ID NO: 6339

SEQ ID NO: 7280 - protein, 553 aa, Glycine max; identical to SEQ ID NO: 6332

SEQ ID NO: 7281 - protein, 595 aa, Glycine max; identical to SEQ ID NO: 6331

SEQ ID NO: 7282 - protein, 988 aa, Glycine max
MGLSLKMQNHHPVALRLHDQMGSKRKYTFIQAHRAWLPKFLLLWILLMALISWCIYSKMDDDTKVRRKEVLGSLCDQRARMLQDQFSVSVNHVHALAILVSTFHYYSYPSAIDQETFAEYTARTAFERPLLSGVAYAQRVVNSERERFEKEHGWVIKTMERKSSLVRDEYAPVIFAQQTVSYLESIDMMSGEEDRENILRARATGKAVLTSPFRLLGSHHLGVVLTFPVYKSKLPQKPTVEERIEATAGYVGGSFDVESLVKNLLGQLDGNQAILVNVYDVTNYTNPLIMYGNQYQEGDMSLAHESKLDFGDPYRKHQMICRYHQKAPTNWIALTTAFLFFVILFLVGYILYSAGNHIVKVEDDFHEMQELKVRAEAADVAKSQFLATVSHEIRTPMNGILGMLALLLDTELSSTQRDYAQTAQACGKALITLINEVLDRAKIEAGKLELEAVPFDLRSIIDDVLSLFSEKSRHKGLELAVFVSDKVPDIVMGDPGRFRQIITNLVGNSVKFTEQGHIFVKVHLADNRKSMMNGKHETFLNGESDEVFYISGDYHFKTLSGCEAADERNSWDNFKHLIADKEYGLDSSRETMAACESSEQVTLRVCVEDTGIGIPFSAQDRIFMPFVQADSSTSRNYGGTGIGLSISKCLVELMGGQINFISRPQVGSTFSFTAVCGAFKKSSVTDKKENLEDLPSNFRGMKVIVVDGKPVRASVTRYHLKRLGILVKVANSISKAVALCGKTGSLTSGMFQPDIIMVEKDTWISGEDGIFNIWKQNGRMFKMPKMILLATNIISAEFDKAKATGFTDTVIMKPLRASMVAACLQQVLGMGKRRQLGKDMPNGFLHSLLYGKKILVVDDNGVNRRVAAGALKKFGADVKCAESGKAALEMLQLPHNFDACFMDIQMPEMDGFEATSRIRMMESKANEEMNNGNEWHVPILAMTADVIHATYDKCMKCGMDGYVSKPFEEENLYQEVAKFFKSKTMSDS

SEQ ID NO: 7283 - protein, 987 aa, Glycine max
MGLSLKMQSHHPVALRLHDQMGSKRKYTFIQAHRAWLPKFLLLWILLMALISWCIYSKMDDDTKVRRKEVLGSLCDQRARMLQDQFSVSVNHVHALAILVSTFHYYRYPSAIDQETFAEYTARTAFERPLLSGVAYAQRVVNSERERFEKEHGWVIKTMERKSSLVRDEYAPVIFAQETVSYLESLDMMSGEEDRENILRARATGKAVLTSPFSLLGSHHLGVVLTFPVYKSKLPQKPTVEERIEATAGYVGGSFDVESLVKNLLGQLDGNQAILVNVYDITNYTNPLVMYGNLYEEGDMSLVHESKLDFGDPYRKHQMICRYHQKAPTNWIALTTAFLFFVILFLVGYILYGAGNHIVKVEDDFHAMEELKVRAEAADIAKSQFLATVSHEIRTPMNGILGMLALLLDTELSSTQRDYAQTAQACGKALITLINEVLDRAKIEAGKLELEAVPFDLRSIIDDVLSLFSEKSRHKGLELAVFVSDKVPDIVMGDPGRFRQIITNLVGNSVKFTEQGHIFVKVHLADNRKSIMNGKHDTFLNGESDEVFHISGDYHFKTLSGCEAADERNSWDNFKHLIADEEYGLDSSRETMAACESSEQVTLRVCVEDTGIGIPFSAQDGIFMPFVQADSSTSRNYGGTGIGLSISKCLVELMGGQINFISRPQVGSTFSFTAVCEAFKKSSVTNKKKNLEDLPSSFRGMKVIVVDGKPVRAAVTRYHLKRLGILVKVANRISKAVALCGKSGSLKSGMFQPDIIMVEKDTWITGEDGIFNTWKHNGRTIKMPKMILLATNISNAEFDKAKFTGFTDTVIMKPLRASMVAACLQQVLGMGKKRQLGKDMPNGFLHSLLYGKKILVVDDNGVNRRVAAGALKKFGADVKCAESGKVALEMLQLPHNFDACFMDIQMPEMDGFEATSRIRMMESKANEEMNGSEWHVPILAMTADVILATYDKCVKCGMDGYVSKPFEEENLYQEVAKFFKSKTISDS

SEQ ID NO: 7284 - protein, 996 aa, Lotus japonicus
MGLSLKMQSHHDQMGSKRKYTFIQDHRAWLPWFLFMWVLLMAFISWNIYSKMDDDTKVRRKEVLGSLCDQRARMLQDQFSVSVNHVHALAILVSTFHYYRNPSAIDEETFAEYTARTAFERPLLSGVAYAQRVINSERERFEKQHGWVIKTMERESSQVRDEYAPVIFAQETVSYLESLDMMSGEEDQENILRARATGKAVLTSPFRLLGSHHLGVVLTFPVYKSKLPPKPTLEERIEATAGYVGGSFDVESLVENLLGQLAGNQAILVNVYDITNCSNPLTMYGNHSEEADMSLSYESKLDFGDPYRIHQMICRYHQKEPTNWVALTTAVLFFVILILVGYILYEAGNHIVKVEDDFHEMQDLKVRAEAADVAKSQFLATVSHEIRTPMNGILGMMALLLDTELSSTQRDYAQTAQACGKALITLINEVLDRAKIEAGKLELEAVPFDLRSILDDVLSLFSEKSRHKSLELAVFVSDKVPDILMGDPGRFRQIITNLVGNSVKFTEQGHIFVKVHLEDNINPVMNGKHETILNGESDEVFHLSGDCHFKTLSGCEAVDEQNSWENFKHLIANEERYFDCSSKMAATSESSEQVKLRVCVEDTGTGIPFSAQDTIFMPFVQADSSTSRNYGGTGIGLSISKCLVELMGGQINFTSRPQVGSTFSFTAAFGMFKKNSVSDMKKLNLEDLPSSFRGLKVIVVDGKPVRAAVTRYLLKRLGILVKVANSISQAVALCGKNGSLTSGMFQPDIIMVEKDTWISGEHGGFNIWKLDFKQNGHVFKMPKMILLATNIKNTEFDQAKATGFTDTVIMKPLRSSMVAACLQQVLGIGKKRQLGQDMLNGSSFLQSLLYGKKILVVDDNVVNRRVAAGALKKFGADVKCVESGKAALEMLQLPHCFDACFMDIQMPEMDGFEATSKIRMMERKANEQVNGELGEGNTRKSEWHVPILAMTADVIHATYDKCLKCGMDGYVSKPFEEQKLYQEVAKFFKSKTISDS

SEQ ID NO: 7285 - protein, 1011 aa, Glycine max
MGLGLKMKSLRHHPMALKLHEQAGSIRKYTFIQAHRAWLPKFLMLWILLMALIGCFIYSKMDADTKVRRKEVLGSLCDQRARMLQDQFSVSVNHVHALAILVSTFHYYRTPSAIDQETFAEYTARTAFERPLLSGVAYAQRVVNSERGTFEKQHGWVIKTMEREPSLVRDEYAPVIFAQETLSYLESLDMMSGEEDRENILRARATGKAVLTSPFNLLGSHHLGVVLTFPVYKSKLPPKPTMEERIKATAGYVGGSFDVESLVENLLGQLAGHQAILVNVYDITNSTNPLIMYGNQNEEGDMSLVHESKLDFGDPYRNHTMICRYHQKAPTNWIALTTAFLFFVILLLVGYILYGAGNHIVKVEDDFHQMEELKVRAEAADVAKSQFLATVSHEIRTPMNGILGMLGLLLKTELSSTQRDYAQTAQACGKALIALINEVLDRAKIEAGKLELEAVPFDIRSILDDVLSLFSEKSRNKGLELAVFVSDKVPDIVMGDPGRFRQIVTNLVGNSVKFTERGHIFVKVHLSENSMSTMNGKTEKFINRGSGEPVHMSGAYNSKTLSGYEAADERNSWDNFKHLIADEEFFFDASVKKAASESYEQVTLMVSVEDTGIGIPFSAQDRIFMPFVQADSSTSRHYGGTGIGLSISKCLVELMGGEISFISQLQVGSTFSFTAGFGTIEKNAITDMKKHNLEDLPSNFRGLKAIVVDGKPVRAAVTRYHLKRLGIQAKVANSINKAVSLCGKNGSLTSVLFQPDIIFVEKDSWVCGEDEIFNVWQLDWKQNGHMFKIPQMILLATNIGNAEFDKAKAAGFSDTVIMKPLRASMVAACLQQVLGTGKKRQHGKDMKPNGSTLVRSLLCGKKILVVDDNVVNRRVAAGALKNFGADVTCAESGKTALEMLQLPHNFDACFMDIQMPEMDGFQATQRIRMMETKANEQQMNGEGNGWKDKYHIPILAMTADVIHATYDECVKYGMDGYVSKPFEEENLYQAVAKFFNPKPTTDNSLIENGRT

SEQ ID NO: 7286 - protein, 1016 aa, Glycine max
MGLGLKMKSLRHHPMALKIHEQAGSKRKYTFIQAHRAWLPKFLMLWILLMALIGCFIFSKMDADTKVRRKEVLGSLCDQRARMLQDQFSVSVNHVHALAILVSTFHYYRTPSAIDQETFAEYTARTAFERPLLSGVAYAQRVVNSERETFEKQHGWVIKTMEREPSLVRDEYAPVIFVQETLSYLESIDMMSGEEDRENILRARATGKAVLTSPFRLLGSHHLGVVLTFPVYKSKLPPKPTMEERIKATAGYVGGSFDVESLVENLLGQLAGHQAILVNVYDITNSTDHLIMYGNQNEEGDMSLVHESKLDFGDSYRKHTMICRYHQKAPTNWIALTTAFLFFVILLLVGYILYGAGNHIVKVEDDFHQMEELKVRAEAAHVAKSQFLATVSHEIRTPMNGILGMLGLLLKTELSSTQRDYAQTAQACGKALIALINEVLDRAKIEAGKLELEAVPFDIRSILDDVLSLFSEKSRNKGLELAVFVSDKVPDIVMGDPGRFRQIVTNLVGNSVKFTERGHVFVKVHLSENRMSTMNGKIEKFLNGGLDEPVHMSGGYNSKTLSGYEAADERNSWDNFKHLIADEEFFYDASVKRVASESYEQVTLMVSVEDTGIGIPFSAQDRIFMPFVQADSSTSRHYGGTGIGLSISKCLVELMGGEISFISQPQVGSTFSFTADFGTIKKNAITDMKKHNLEDLPSNFRGLKAIVVDGKPVRAAVTRYHLKRLGIQAKVANSFNKAVSLCGKNGCLTSGLFQPDIIFVEKDSWVCVEDGIFNVWQLDWKQNRHIFKIPQMILLATNIGNDEFDKAKAAGFSDTVIMKPLRASMVAACLQQVLGTGKKRQHGKDMNPNGSTFVRSLLCGKKILVVDDNVVNRRVAAGALKNFGADVTCAESGKTALEMLQLPHNFDACFMDIQMPEMDGFEATRQIRMMETKANEQQMNGECGEGNGWKDKKYHIPILAMTADVIHATYDECVKCGMDGYVSKPFEEENLYQAVAKFFNPKPTSIQQNARTGKAT

SEQ ID NO: 7287 - protein, 1029 aa, Medicago truncatula
MGLLLKMKMQNQHHPLASKLQEQTGNKRYTFIQAHRAWLLKLMFLWILLMALISRIIYSKMDVGTKVRRKEVLGSLCDQRARMLQDQFSVSVNHVHALAILVSTFHYYRNPSAIDQETFAEYTARTAFERPLLSGVAYAQRVVNSEREQFEKQHGVVIKTMEREASPVRDEYAPVIFAQETVSYLESIDMMSGEEDRENIMRARATGKAVLTSPFRLLGSHHLGVVLTFPVYKSKLPPNPTTEELIKATAGVIDTTSIIELKKTVSVTRLVFGYILLYVGGSFDVESLVENLLGQLAGHQAILVNVYDVTNSSDPLIMYGNQYEEGDVSLVHESKLDFGDPYRKHQMICRYHQKAPPNWTALSTAILFFVILLLIGYILYGAGNHIVKVEDDFHEMQELKVRAEAADVAKSQFLATVSHEIRTPMNGILGMLGLLLRTELNSTQRDYAQTAQACGKALIALINEVLDRAKIEAGKLELEAVPFDLRSILDDVLSLFSEKSRHKGLELAVFVSDKVPDIVMGDPGRFRQIVTNLVGNSVKFTERGHIFVKVHLSENRKPVTNGKHETYRNGGSEEVVHASGGYNLKTLSGYEAADERNNWDNFNHLIADEEFFCDASTKKVASNEFYEQVTLMVCVEDTGIGIPFSAQDRIFMPFVQADSSTSRNYGGTGIGLSISKCLVELMGGQINFISRPQVGSTFSFTADFGIFKKNPITEVKKVNYEDLPSSFRGLKAVVVDGKPVRAAVTRYHLKRLGIQVKVANAINKAVSLCGKNGASSTGLFQPDIIFVEKDSWVCGEDGIFSVRQLDWKQNGHIFKMPQMILLATNISNDEFDKAKSAGFSDTVIMKPLRASMVGACLQQVLGTGKKRQLGKEMPNGSTSVRSLLFGKKILVVDDNVVNRRVAAGALKNFGADVKCADSGKAALEMLQFPHKFDACFMDIQMPEMDGFEATRRIREMERTANEETNSECGERKSEFHLPILAMTADVIHATYEECLKCGMDGYVSKPFEEENLYQAVAKFFQTKPTSVDS

SEQ ID NO: 7288 - protein, 1002 aa, Vitis vinifera
MGLKMQSHHSVAVRLNEQMGTKRGYTFIQANRAWLPKFLVFWIMLMAVFSNFVYNKMDAANKERREEVLVSMCDQRARMLQDQFSVSVNHVHALAILVSTFHYYKNPSAIDQETFAEYTARTAFERPLLSGVAYAQRVAYSERERFEKQHGWTIKTMKREASPIRDEYAPVIFSQETVSYIESLDMMSGEEDRENILRARATGKAVLTSPFRLLGSHHLGVVLTFPVYKSKLPPNPTVEQRIEATAGYLGGAFDVESLVENLLGQLAGNQAILVNVYDVTNSSDPLVMYGRQYQDVDMSLLHESKLDFGDPFRKHQMICRYHQKEPTSWTSLTTAFLFFVIGLLVGYILYGAAIHIVKVEDDFHEMQELKVRAEAADVAKSQFLATVSHEIRTPMNGILGMLALLLDTDLSSTQRDYAQTAQACGKALITLINEVLDRAKIEAGKLELEAVPFNLRSILDDVLSLFSEKSRHKGLELAVFVSDKVPEMVIGDPGRFRQIITNLVGNSVKFTERGHIFVQVHLAEHTKALMDAKAETCLNGGSDEGLVSNGGSQFRTLSGCEAADDQNSWDRFKHLIFDEDLRSDASNIMTVTSEASEKVTLMVSVEDTGIGIPLRAQGRVFTPFMQADSSTSRNYGGTGIGLSISKCLVELMGGQIKFISRPQIGSTFSFTADFGRCKKNALSDLKKSNSDDLPIGFRGLKAIVVDGRPVRAIVTKYHLKRLGILVEVANSIKKAVAITGKNGSLTSGGNQPDMILVEKDSWISEEDADLNLRLLDWKQNRHTLKLPKMILLATNISSAEFDKAKAAGFADTVIMKPLRASMVAACLQQVLGLGKKRQQGKDMLNGSAFLQSLLCGKKILVVDDNKVNRRVAAGALKKFGADVECAESGKAALQLLQLPHNFDACFMDIQMPEMDGFEATRRIRLIESKANEQMNGGCTPEGAATKGEWHVPILAMTADVIHATYDKCLKCGMDGYVSKPFEEENLYQAVAKFFKSKPISES

SEQ ID NO: 7289 - protein, 1004 aa, Betula pendula
MGLKMQQSHHHSVAVRLNEQMGTKRGCTFIQANRDWLPKFLLLWILVMAFLSTMIYNSMDDDNKVRRKEILGSMCDQRARMLQDQFSVSVNHVHALAILVSTFHYYKNPSAIDQETFAEYTARTAFERPLLSGVAYAQRVVNSERESFERQHGWIIKTMEREPSPVRDVYAPVIFTQESVSYIESLDMMSGEEDRENILRATATGKAVLTSPFRLLGSHHLGVVLTFPVYKSKLSSSPAMQELIEATAGYVGGAFDVESLVENLLGQLAGNQAILVNVYDVTNSSDPLIMYGHQYQDSDLSLFHESKLDFGDPFRRHQMICRYHQKAPMSWTALTTAFLFFVIGLLVGYILYGAGIHIVKVEDDFHEMEELKVRAEAADVAKSQFLATVSHEIRTPMNGILGMLALLLDTELSSTQRDYAQTAQICGKALIALINEVLDRAKIDAGKLELEAVPFVLRSILDDVLSLFSEKSRHKGIELAVFVSDKVPEIVMGDPGRFRQIVTNLVGNSVKFTERGHIFVKVHLAEHTMAMVNAKAETCLNGGSDRSLFLSGGREFKTLSGCEVADERNSWDIFKHLVADEELRSEASRNMMNTNEASEHVTLMVCVEDTGIGIPLCAQDRVFMPFMQADSSTSRHYGGTGIGLSISKCLVELMGGQINFISRPQVGSTFSFTAVFGRCKKNAFSDVKKPISEDLPSGFRGLKALVVDEKPVRAAVTRYHLKRLGILVEVASSFKIAVAMTGKKGSLTLRKFQPDLVLVEKDSWMSAEEGGLNGWLLDWKQNGHIFQLPKMILLATNIDKAEFDKAKAAGFADTVIMKPLRASMVAACLQQVLGIGKKRQQEKDMLNGSSFLQSLLCGKKILVVDDNRVNRRVAEGALKKFGADVECAESGKAALALLQLPHNFDACFMDIQMPEMDGFEATRQIRVMESKENEQINGGATDEGAIRKREWHVPILAMTADVIHATYDECLKCGMDGYVSKPFEEENLYQAVAKFFKSNPISES

SEQ ID NO: 7290 - protein, 993 aa, Lotus japonicus
MGLGFKMQQSHHPVALKLHEQAGSQRKFTFIQNFRNWFLPLLFVWFIVMAAFGACIYHKMDAETKVRRKEVLGSLCDQRARMLQDQFSVSVNHVHALAILVSTFHYYRNTSAIDQETFAEYTARTAFERPLMSGVAYAQRVVHSERERFEKQHGWVIKTMERVPSGVRDEYAAVIFAQETVSYLESIDMMSGEEDRENILRARATGKAVLTSPFRLLDSHHLGVVLTFPVYKSKLPPEPTTEEVIKAIAGYIGGSFDVESLVENLLGQLAGNQAILVKVYDITNSSDPLIMYGSQYEEGDMSLVHESKLDFGDPYRKHHMICRYHQQAPTNWIAYTTAFLFFVILCLVGYILYAAGTHIVKVEDDYNAMQDLKVKAEAADIAKSQFLATVSHEIRTPMNGILGMLGLLLRTELSSTQRDYAQTAQACGKALIALINEVLDRAKIEAGKLELEAVPFDLRSILDDVLSLFSEKSRHKGLELAVFVSDKVPDIVMGDPGRFRQIVTNLVGNSVKFTERGHIFVKVHLAEKRQCTMNGKCETFLNGGCDDVLHVSGSYNLKTLSGYEAADERNSWDNFKHHIADEEFFFDASVKKLASSESYEQVTLMVSVEDTGIGISFSAQDSIFMPFVQADSSTSRNYGGTGIGLSISKCLVELMGGQINFISRPQVGSTFSFTADFGTFKKNSTTDMKKLNFEDLPSSFRGLKAIVVDGKPVRAAVTRYHLKRLGIQAKVAISINKAVSLCGKNGSLTSALFQPDIIFVEKDSWVSGEDGGIFNAFKMPQMILLATNICNAEFDKAKAAGFSDTVIMKPLRASMLAACLQQVFGTGKTRQFGKDMSNGSSVRSLLCGKKILVVDDNLVNRRVAAGALKNFGADVKCAASGKAALEMLQYPHDFDACFMDIQMPEMDGFEATRRIRMMEREASEQLKSESGEENGKKSEFHMPILAMTADVIHATYDKCLNCGMDGYVSKPFEEENLYQAVAKFFKSKPASDS

SEQ ID NO: 7291 - protein, 1006 aa, Populus trichocarpa
MALNIQQSYHHSVAVKMNGQQMGTKRGYTFIQANRTWLPKILLLWVMAMALFSLTIYNGMDADNRVRRKEVLSSMCDQRARMLQDQFNVSVNHVHALAILVSTFHYYKNPSAIDQETFAEYTARTAFERPLLSGVAYAQRVVNSERLEFERQHGWTIKTMEREPSPIRDEYAPVIFSQETVSYIESLDMMSGEEDRENILRARASGKAVLTGPFRLLGSHHLGVVLTFPVYKSKLPPSPTVAQRIEATAGYLGGAFDVESLVENLLGQLAGNQAILVNVYDITNSSDLLIMYGHQNQDGDMSLLHESKLDFGDPFRRHLMTCRYHEKAPTSWTALTTTFLFFVIGLLVGYILYEAAIHIVKVEDDFHEMQDLKVQAEAADVAKSQFLATVSHEIRTPMNGILGMLALLLDTDLSSTQRDYAQTAQVCGKALIALINEVLDRAKIEAGKLELEAVPFHIRSIVDDVLSLFSEKSRNKGIELAVFVSDKVPEIVVGDPGRFRQIITNLVGNSVKFTERGHTFVKVHLYEHAKATTDTKADTCLIGGSNESVLISGSQKFKTLSGCEAADDQNSWDVFKHLSDEDFRFDASINVMTSNEASENITLMVCVEDTGIGIPLKAQSRVFMPFVQADSSTSRHYGGTGIGLSISKCLVELMGGQISFISRPEVGSTFSFTAVFSTCKKNAFTKMEKRNAEDLPSGFRGLKALVVDGKPVRAAVTRYHLKRLGILAEVVSNLKVAAGSCGKNGSLTSGSKIQPDMILVEKDTWISGEDGVSNVWKLDWKQNGHAFKFPKMILLATNITNSEFDKAKAAGFADTVIMKPLRASMVAACLLQVLGMGKKRSQGKCMPNGSSFLQSLLCGKKILVVDDNRVNRRVAAGALKKFGADVECADSGKEALKLLQLPHTFDACFMDIQMPEMDGFEATRRIRQMESQANEQMNGESMVEGGTARKGQWHIPILAMTADVIHATHDECLKCGMDGYVSKPFEEENLYQAVARFFDSKSTLKS

SEQ ID NO: 7292 - protein, 751 aa, Glycine max
MVELEISRRESLQTKEKVNMLSSRIGKPLSKFNGFPKDMIEKDRINNADLSLTKTIRIPKKEKIPPYTSWVYVVRNERMAKDQTVLGKYQMYYDKNRGEMMICSDSEEEMVNPKDVKHDFTEAEDQILWTTLAEYGSTEEIFSIVKEIVKTTDSQIQERYEILNKKNMRSPSQNFEDCHCRGCQNHLGICLEENLNVILEPFDNFFCRRCLIFDCSVHGIYQPLIYHSEKQSIWSELEGDKKPCSKQCYIMLKDVNILSKNTSQRYFRDKIITPMEEDPTLPHDEPQDSSKRLRTPNDIITEIDLRYMELNLDANDEENHTTYGASLKSLNEHSSGKSTVFYNYSHDEQGKGVMDGEKDLTNEIEFNQLSISREVQAYEMTNESNWRPLERDLYLKGVEMFGKNSCLIAFNLLHGLKTCIEVTKYMSACDETITHGSIPSSTVDKKEKINAEFTDQEMASRSRSQRKKGKPRKFNYSRKSAGLPPRWRKIAYGQNQYNKQYTPCGCQGMCGKECPCLLHGTCCEKYCGCSKLCNNRFRGCRCAKSQCRSRQCPCFAANRECDPDVCRNCWVSCGDGSLGEPPRCGDGKCGNMNLLLGLKERILLAKSDVIGWGTFAKNPINKNVCLGEYTGELITPKEAEKRGKLYDRINTSFLFNLNDRWVIDSCRLGDKLKFANHSSKPNCYAKVMLVGGEHRVGIFSKENIEAGEEIFYDYWYDLDCAPQWALPPDEVSKKDESIVSQGRAKKNQSHC

SEQ ID NO: 7293 - protein, 1781 aa, Glycine max
MADRASATTRLHISAAPPFPISKDFHGPDNPIPLSPQWLLPKPGESKPAIGTVVCNDYGNRSETVKTSGDGEDANDGHKRKDVFRPSMLDSESGRRDRWRDEERDTKSSIHKDRWRNGDKNLSDTQRMDRWTENVSMRHFGEARRATSDRWNGSSNRDTNFEQRRESKWNTRWGPDDKAPEGLCEKWNDPGKDSDLHVDKGLSNISNLVKDEKEGDHYRPWRPNSSQSRGRVEPTHHQNVMPNKQVSALSYRRGRGEDTTPGIAFGRARLSSGGSSINSTYMHSQYPGTLLDKVESEQGEAHPFRYSRANLLDVYRVADMHTSRKLVEFVQVPSVTQDEPLEPLALGAPNSEELSVLKDIDKGEIISSSAPQVPKDGLNSTEFTHSRQMKLVKASFQDRVEDNDSYRMADEVPSNRESTFEESHSVHHGATWLGTPLGEHAGTLMHDSRDVSSDIKSRNSDMSWSHQPKDTHAQWERNLDYLSETRDVAKWHDGGDPIKRQLSGTLDSEFESRKVQQICPEELSLLYKDPQGRIQGPFKGIDIISWFEAGYFGIDLPVRLENAAFDSPWLQLGDAMPHLRAKARPPPGFSAAKLDSTETPGRQYSSTFGNMHSGLSEIEMMRNDSMHRSSSTEAENRFLESLMSGTKSSSPLDSLTLSEGLQGFLGNNYGNLGPSGVDSGNNLHLLAKRMALERQRSLPNAYPYWPGRDAGSLPPKSDIFPDASPHSNILSSLSDNSRQLQSQNSELMSIIQGLSDRSSTGLNSGIAGWLNFPLQGGLDPLQNKTDLHHDQNYVQMPFGIQQQRFQTPNQLPLNNLIAQTSDIPSSILTAEKLLSSGLSQDPQMLNMLQQQHLLQLHSQAAAAPSQPMPLIDKLLLLKQQQQQEEQQLLLRQQQQQEEQQLLLRQQQQLLSQVLQEHQSHQRFGNLSHQQLQGGGIPLGNLHVNLSQIQQPKEIFPMSSQTPIPTVQGELTTNSLDLPLQVSQDTSYNISSESSAQMSDQLFENISHQKSWSATLPEQINDNYQKEALPVSASVEGSLLLEQNRAKEEPAIAQKLLPFSNYTAKTLEQMPDNTCRDDDTLVSATSESGENSQPIQCVAPVVAMSSAGSCGTELPLVSQLSEDLEINSDSLEEQQGGRPSVVDVRSVEVHEPKKTTEKKSKKQKSSKSQSSDKVKGLLKNVILQQSKKSESWESNYSEANKGEPAHETCLQQTMDKGKQSATATAETDDHQEGSGLPTNIQGSNTETVIENELKAVSSVATQNTELPSVRAWKPAPGFKAKSLLEIQLEEQKKVQTEKLVSEVATPVNSMSSTPWVGVVANPDSMKVSSDSNREAENTEYLAKAEKSQNSKSKKSPLHDLLAEDLVPKSSERDDKVPDSMLPPQNIAVHSEPVDDGDFIEAKDTKRSRKKSAKLKSSGAKVSMPVASNEVPISSSHIEKVKSSRSVQQEKELLPSVPSGPSLGDFVLWKGETTSPSPPPAWTTDSARIPKPTSLRDILKEQEKKSYAVLPNQLPTPQKSQPAQAARNSGSSRPISASSPSKTAPSSQINSQASLSKYRGDDDLFWGPVEQSKQENKQSGFPQLASLGSWGSKSVPMNGNSPGSLSQQKSGSGKPTEQSLSSSPASSQKLLKLKKNAMTKNSEAMDFRVWCENECVRLVGTKDTSFLEFCLKQTRSEAEMFLTENLGSYDPDREFIDKFLNYMDLLPSDVLEIAFQTGNDQKAAGGMISANTDVQELGYTDGSFSKVGKKKGGKKGKKVSSSVLGFNVVSNRIMMGEIQTVED

SEQ ID NO: 7294 - protein, 1783 aa, Glycine max
MADRASASTRLHISAAPPFPISKDFHGPDNPIPLSPQWLLPKPGESKPAIGTENHVISTPPNGNRSETVKTSGNGEDVNDDHKRKDVFRPSMLDSKSGCRERWRDEERDTKSSIHKNRWRNGDKNLSDTQRMDQRTENPSTRHFGEARRGTSDRWNDSGNRDTNFEQRHESKWNTRWGPDDKAPEGLREKRSSPGKDSDRHVDKGLPNISNLVKDEKEGDHYRPWRRNSSQSRGRVEPTHHQNGMPNKQVSALPYGWGHGEDTPPVIAFGRARLGSGGSSINSTYMHSQYPGTLLDKVESEQGEARPFRYSRTNLLDVYRVADMHTSRKLVEFVQVPSVTQDEPLEPLALCSPNSEELSVLKDIDKGEIISSSAPQLPKDGRNSTEFTHSRRMKPVNAPFQDRVEDNDSYRMADEVPSNKESTFEESHSAHHGATWRGTPLGEHAGTLMHDGRDVSSDIKSRNSDMSWSHQPKNTHAQWEHNLDYLSETRDVTKWQSSGDPIKRQLSGILDSEFESRRIQQICPEELSLFYKDPQGRIQGPFKGIDIISWFEAGYFGIDLPVRLENAASDSPWLQLGDAMPHLRAKARPPPGFSAAKLDSSEASGRPYSSTFGNMHSGLSEVEMLRNDSMHRSSTTEAENRFLESLMSGSKSSSPLSSLTLSEGLQGFLGNDSGNLGPSGVDSGINLYLLAKRMALERQRSLPNAYPYWPGRDAAPLPPKSDIFPDASPHSNMLSSLSDNSRLLQSQSSELMSIIQGLSDRSSTCLNSGIAGWPNFLLQGGLDPPIQNKIDLQGGLDPPIHDQNYVQMPFGIQQQRLQTLNQLPLNNLIAQNSDIPSSILTAEKLLSSGLSQDPEMLNMLQQQHLLQLHSQAAAAAPSQTMPLLDKLLLLKQQQQQEEQQLLLRQQQQLLSQVLQEHQSHQRFGNLSYQQFQGGGIPLGNLHVNLSQIQPPKEIFPMSSQTPIPSVQGELTTNSLDLPLQVSQDTSYNISSESSAQLSDQLFENIGDQKSWSATLPEQINDNYQKETLPVSASVEGSLLLEQSRAKEEPGNAQKLLPFSDYTAKTLEQMPDNTCRNDDTLVSATSESDENSQPIQCVTPAVDMSSAASCGTELPLVSQLSEDVEIKSDSLEEHHGGRESSKIDPSVVDVRSIEVREPKKTAEKKSKKQKSSKSQSSGQAKGLLKNVPLQQSKKSEPEKPNYSEANKGEPAHETFMQQTKGKDKQSATATAETDDNQEVSGLPTNIPGSNTKTVIENELKAVSSVATQNTELPSARAWKPAPGFKAKSLLEIQLEEQKKSLTEKLVSEVATPVNSMSSTTPWVGVVANPDSMKVSNDGHREAENTEYLAKAEKSQNSKSKKSPLHDLLAEDLVPKSSERDGKVPDSMLPSQNIAVHSKLVDDGDFIEAKDTKRSRKKSAKLKSSGAKVSMPVASSEVPISPIHIEKVKSSRSVQQEKEQLPSIPSGPSLGDFVLWKGEPTSPSPPPAWTTDSARIPKPTSLRDILKEQEKKSSAVLPNQLPTPQKSQTAQAARSSGSSRPISASSPSKTAPSSQINSQASLSKYRGDDDMFWGPVEQSKQENKQSNFPQLARQGSWGSKSVPMKGNSPGSLSRQKSGSGKPTEQSLSSSPASSQSLLKLKKDAMTKNSEAMDFRVWCENECARLIGTKDTSFLEFCLKQTRSEAEIFLTENLGLYDHDHEFIDKFLNYMDLLPSDVLEIAFQTVNDRKVDANTDVLELGYTDGSFSKVGKKKGGNKGKKVSSSVLGFNVVSNRIMMGEIQTVED

SEQ ID NO: 7295 - protein, 1783 aa, Glycine max; identical to SEQ ID NO: 7294

SEQ ID NO: 7296 - protein, 1781 aa, Glycine max; identical to SEQ ID NO: 7293

SEQ ID NO: 7297 - protein, 671 aa, Glycine max
MSIIFERGSLETEKNVNMLSSRIHNPLCKLSGFPKGIVEKNQINNVDLSPTKSIRIPHTDKLPQYTSWVYVARNERMVDDQSVIGKYQMYHDKNKGEMVICSDNEEEIVDPEDVKHEFTEVEDKFLRMTLEEYGCTEEVLNVVKKFVKTTNSEIQERYEKLKEKNMEILDQHCEDCHCRGCENHLGLCLEKSLSVTLETFNNLLCRQCLIFDCPMHGINKPLVYHSENQPVWLEPEGDKKPCSDQCYLMLKDARILSKNSTQWSFQDKVITTMEEDSILPRDDEENHTVEVQANGMSSDSYWRPLEMDLYLKGVKMFGKNSCLIAITLLPGLKTCLEVARYMFGGGELMTNGFIPSSIMEKNEKINAGCTDQEMSSRSRPQRKKGKPKKFNYSRKSAGLPPRWRKIAYGQNLCNKQYTPCGCHGICGKECSCLVNGTCCEKYCGCSKHCSNRFRGCRCTKSQCKSRSCPCFAANRECDPDVCQNCWVSCGDDSLGRLPRHEDAKCGNMNLLLGQKERILLAKSDVIGWGAFAKNPISKNVCLGEYTGELIPPKEAEKRGKLYDRINTSFLFNLNDQWVIDAFRMGDKLKFANHSSKPNCYAKVMLVGGDHRVGIFARENIKAGDEIFYDYGYDLDSAPLWALPPNEAAKKDKLVVSLSRTKKKEKKSVSFQ

SEQ ID NO: 7298 - protein, 751 aa, Glycine max; identical to SEQ ID NO: 7292

SEQ ID NO: 7299 - protein, 365 aa, Glycine max; identical to SEQ ID NO: 6729

SEQ ID NO: 7300 - protein, 365 aa, Glycine max; identical to SEQ ID NO: 6728

SEQ ID NO: 7301 - protein, 721 aa, Vigna radiata
MGKGEFHGGVLMLLFFWVCGVTASVTYDHKAIVIDGKRRILISGSIHYPRSTPQMWPDLIQKAKDGGLDVIQTYVFWNGHEPSPGKYYFEDRYDLVRFVKLAQQAGLYVHLRIGPYICAEWNFGGFPVWLKYVPGIAFRTDNEPFKAAMQKFTAKIVSLMKEERLFQSQGGPIILSQIENEYGPVEWEIGAPGKSYTKWAAQMAVGLDTGVPWVMCKQEDAPDPVIDTCNGFYCENFKPNKNTKPKMWTENWTGWYTDFGGASPIRPAEDLAFSVARFIQNGGSFVNYYMYHGGTNFGRTSGGLFIATSYDYDAPLDEYGLQNEPKWGHLRALHKAIKQSEPALVSTDPKVTSLGYNLEAHVFSTPGACAAFIANYDTKSSAKATFGSGQYDLPPWSISILPDCKTVVYNTARVGNGWVKKMTPVNSGFAWQSYNEEPASSSQDDSIAAEALWEQVNVTRDSSDYLWYMTDVYINGNEGFLKNGRSPVLTVMSAGHLLHVFINGQLSGTVYGGLGNPKLTFSDNVNLRVGNNKLSLLSVAVGLPNVGVHFETWNAGVLGPVTLKGLNEGTRDLSRQKWSYKVGLKGEALNLHTESGSSSVEWIQGSLVAKKQPLTWYKATFSAPAGNDPLALDLGSMGKGEVWVNGRSIGRHWPGYIAHGSCNACNYAGYYTDQKCRTNCGKPSQRWYHVPRSWLNSGGNSLVVFEEWGGDPNGIALVKRT

SEQ ID NO: 7302 - protein, 721 aa, Glycine max
MGKREFNGVVLMMLCLWVCGVTASVTYDHKAIVVDGKRRILISGSIHYPRSTPQMWPDLIQKAKDGGLDVIQTYVFWNGHEPSPGQYYFEDRFDLVKFVKLAQQAGLYVHLRIGPYICAEWNLGGFPVWLKYVPGIAFRTDNEPFKAAMQKFTAKIVSLMKENRLFQSQGGPIILSQIENEYGPVEWEIGAPGKAYTKWAAQMAVGLDTGVPWVMCKQEDAPDPVIDTCNGFYCENFKPNKNTKPKMWTENWTGWYTDFGGAVPRRPAEDLAFSVARFIQNGGSFVNYYMYHGGTNFGRTSGGLFIATSYDYDAPLDEYGLENEPKYEHLRALHKAIKQSEPALVATDPKVQSLGYNLEAHVFSAPGACAAFIANYDTKSYAKAKFGNGQYDLPPWSISILPDCKTVVYNTAKVGYGWLKKMTPVNSAFAWQSYNEEPASSSQADSIAAYALWEQVNVTRDSSDYLWYMTDVNVNANEGFLKNGQSPLLTVMSAGHVLHVFINGQLAGTVWGGLGNPKLTFSDNVKLRAGNNKLSLLSVAVGLPNVGVHFETWNAGVLGPVTLKGLNEGTRDLSRQKWSYKVGLKGESLSLHTESGSSSVEWIQGSLVAKKQPLTWYKTTFSAPAGNDPLALDLGSMGKGEVWVNGRSIGRHWPGYIAHGSCNACNYAGYYTDTKCRTNCGQPSQRWYHVPRSWLSSGGNSLVVFEEWGGDPNGIALVKRT

SEQ ID NO: 7303 - protein, 721 aa, Glycine max
MGKREFHGVVLMSLCLWVCGVTASVTYDHKAIVVDGKRRILISGSIHYPRSTPQMWPDLIQKAKDGGLDVIQTYVFWNGHEPSPGQYYFEDRFDLVKFVKLVQQAGLYVHLRIGPYICAEWNFGGFPVWLKYVPGIAFRTDNEPFKAAMQKFTAKIVSLMKENRLFQSQGGPIIMSQIENEYGPVEWEIGAPGKAYTKWAAQMAVGLDTGVPWVMCKQEDAPDPVIDTCNGYYCENFKPNKNTKPKMWTENWTGWYTDFGGAVPRRPAEDLAFSVARFIQNGGSFVNYYMYHGGTNFGRTSGGLFIATSYDYDAPLDEYGLQNEPKYEHLRNLHKAIKQCEPALVATDPKVQSLGYNLEAHVFSTPGACAAFIANYDTKSYAKATFGNGQYDLPPWSISILPDCKTVVYNTAKVGNSWLKKMTPVNSAFAWQSYNEEPASSSQADSIAAYALWEQVNVTRDSSDYLWYMTDVYINANEGFLKNGQSPVLTAMSAGHVLHVFINDQLAGTVWGGLANPKLTFSDNVKLRVGNNKLSLLSVAVGLPNVGVHFETWNAGVLGPVTLKGLNEGTRDLSSQKWSYKVGLKGESLSLHTESGSSSVEWIRGSLVAKKQPLTWYKTTFSAPAGNDPLALDLGSMGKGEVWVNGRSIGRHWPGYIAHGSCNACNYAGFYTDTKCRTNCGQPSQRWYHVPRSWLSSGGNSLVVFEEWGGDPNGIALVKRT

SEQ ID NO: 7304 - protein, 839 aa, Glycine max
MGSRVLIENLPRGNFCTLLLVLWVCAVTASVTYDHKAIVVNGQRRILISGSIHYPRSTPEMWPDLIQKAKDGGLDVIQTYVFWNGHEPSPGKYYFEDRYDLVKFIKLVQQAGLYVHLRIGPYICAEWNFGGFPVWLKYVPGIAFRTDNEPFKAAMQKFTEKIVSIMKEEKLFQTQGGPIIMSQIENEYGPVEWEIGAPGKAYTKWFSQMAVGLDTGVPWIMCKQQDTPDPLIDTCNGYYCENFTPNKKYKPKMWTENWTGWYTEFGGAVPRRPAEDMAFSVARFVQNGGSFVNYYMYHGGTNFDRTSSGLFIATSYDYDGPIDEYGLLNEPKWGHLRDLHKAIKLCEPALVSVDPTVTWPGNNLEVHVFKTSGACAAFLANYDTKSSASVKFGNGQYDLPPWSISILPDCKTAVFNTARLGAQSSLMKMTAVNSAFDWQSYNEEPASSNEDDSLTAYALWEQINVTRDSTDYLWYMTDVNIDANEGFIKNGQSPVLTVMSAGHVLHVLINDQLSGTVYGGLDSHKLTFSDSVKLRVGNNKISLLSIAVGLPNVGPHFETWNAGVLGPVTLKGLNEGTRDLSKQKWSYKIGLKGEALNLNTVSGSSSVEWVQGSLLAKQQPLAWYKTTFSTPAGNDPLALDMISMGKGQAWINGRSIGRHWPGYIARGNCGDCYYAGTYTDKKCRTNCGEPSQRWYHIPRSWLNPSGNYLVVFEEWGGDPTGITLVKRTTASVCADIYQGQPTLKNRQMLDSGKVVRPKAHLWCPPGKNISQIKFASYGLPQGTCGNFREGSCHAHKSYDAPQKNCIGKQSCLVTVAPEVFGGDPCPGIAKKLSLEALCG

SEQ ID NO: 7305 - protein, 723 aa, Cicer arietinum
MRKEFNLLGLMLLLCFWVCAVTASVTYDHKTIVIDGQRRILISGSIHYPRSTPEMWPALFQKAKEGGLDVIQTYVFWNGHEPSPGKYYFEDRFDLVKFIKLAQQAGLYVHLRIGPYVCAEWNFGGFPVWLKYVPGISFRTDNEPFKAAMQKFTTKIVSMMKAENLFQNQGGPIIMSQIENEYGPVEWNIGAPGKAYTNWAAQMAVGLDTGVPWDMCKQEDAPDPVIDTCNGYYCENFTPNKNYKPKMWTENWSGWYTDFGNAICYRPVEDLAYSVARFIQNRGSFVNYYMYHGGTNFGRTSSGLFIATSYDYDAPIDEYGLTNEPKWSHLRDLHKAIKQCEPALVSVDPTITSLGNKLEAHVYSTGTSVCAAFLANYDTKSAATVTFGNGKYDLPPWSVSILPDCKTDVFNTAKVGAQSSQKTMISTNSTFDWQSYIEEPAFSSEDDSITAEALWEQINVTRDSSDYLWYLTDVNISPNEDFIKNGQYPILNVMSAGHVLHVFVNGQLSGTVYGVLDNPKLTFSNSVNLTVGNNKISLLSVAVGLPNVGLHFETWNVGVLGPVTLKGLNEGTRDLSWQKWSYKVGLKGESLSLHTITGGSSVDWTQGSLLAKKQPLTWYKATFNAPAGNDPLGLDMSSMGKGEIWVNDQSIGRHWPGYIAHGSCGDCDYAGTFTNTKCRTNCGNPTQTWYHIPRSWLNPTGNVLVVLEEWGGDPSGISLLKRI

SEQ ID NO: 7306 - protein, 730 aa, Cicer arietinum
MESLTRWRKFYMVIGLVLFLCLFVFSVTASVTYDHKAIVINGQRRILISGSIHYPRSTPQMWPDLIQKAKDGGVDVIQTYVFWNGHEPSPGNYYFEDRFDLVKFVKVVQQAGLYVNLRIGPYVCAEWNFGGFPVWLKYVPGVAFRTDNEPFKAAMQKFTAKIVSMMKAENLFESQGGPIIMSQIENEYGPVEWEIGAPGKAYTKWFSQMAIGLDTGVPWIMCKQEDAPDPIIDTCNGYYCENFTPNKNYKPKMWTENWSGWYTDFGSAVPYRPAQDVAFSVARFIQNRGSYVNYYMYHGGTNFGRTSAGLFIATSYDYDAPIDEYGLLSEPKWGHLRNLHKAIKQCEPILVSVDPTVSWPGKNLEVHVYKTSTGACAAFLANYDTTSPAKVTFGNGQYDLPPWSISILPDCKTAVFNTAKVGTVPSFHRKMTPVSSAFDWQSYNEAPASSGIDDSTTANALLEQIKVTRDSSDYLWYMTDVNISPNEGFIKNGQYPVLTAMSAGHVLHVFVNGQFSGTAYGGLENPKLTFSNSVKLRVGNNKISLLSVAVGLSNVGLHYETWNVGVLGPVTLKGLNEGTRDLSGQKWSYKIGLKGETLNLHTLIGSSSVQWTKGSSLVKKQPLTWYKATFDAPAGNDPLALDMSSMGKGEIWVNGESIGRHWPAYIARGSCGGCNYAGTFTDKKCRTSCGQPTQKWYHIPRSWVNPRGNFLVVLEEWGGDPSGISLVKRT

SEQ ID NO: 7307 - protein, 730 aa, Lupinus angustifolius
MFGSRIVMESLMSRRNFHMVLLLLFFWVCYVTASVTYDHKAIMINGQRRILISGSIHYPRSTPQMWPDLIQKAKDGGLDVIETYVFWNGHEPSPGKYYFEDRFDLVGFIKLVQQAGLFVHLRIGPFICAEWNFGGFPVWLKYVPGIAFRTDNEPFKEAMQKFTEKIVNIMKAEKLFQSQGGPIILSQIENEYGPVEWEIGAPGKAYTKWAAQMAVGLDTGVPWVMCKQEDAPDPIIDTCNGFYCENFTPNKNYKPKLWTENWTGWYTAFGGATPYRPAEDIAFSVARFIQNRGSLFNYYMYHGGTNFGRTSNGLFVATSYDYDAPIDEYGLLNEPKWGHLRELHRAIKQCESALVSVDPTVSWPGKNLEVHLYKTESACAAFLANYNTDYSTQVKFGNGQYDLPPWSISILPDCKTEVFNTAKVNSPRLHRKMTPVNSAFAWQSYNEEPASSSENDPVTGYALWEQVGVTRDSSDYLWYLTDVNIGPNDIKDGKWPVLTAMSAGHVLNVFINGQYAGTAYGSLDDPRLTFSQSVNLRVGNNKISLLSVSVGLANVGTHFETWNTGVLGPVTLTGLSSGTWDLSKQKWSYKIGLKGESLSLHTEAGSNSVEWVQGSLVAKKQPLAWYKTTFSAPAGNDPLALDLGSMGKGEVWVNGQSIGRHWPGNKARGNCGNCNYAGTYTDTKCLANCGQPSQRWYHVPRSWLRSGGNYLVVLEEWGGDPNGIALVERT

SEQ ID NO: 7308 - protein, 840 aa, Ricinus communis
MLKGSNTVFLFLFLLFLLSSSWVCSILATVSYDHRAITINGQRRILISGSIHYPRSTPEMWPDLIQKAKDGGLDVIQTYVFWNGHEPSPGNYYFEDRYDLVKFIKVVQAAGLYVHLRIGPYICAEWNFGGFPVWLKYVPGIEFRTDNGPFKAAMQKFTEKIVSMMKSEKLFESQGGPIILSQIENEFGPVEWEIGAPGKAYTKWAADMAVKLGTGVPWVMCKQDDAPDPVINTCNGFYCENFKPNKDYKPKLWTENWTGWYTEFGGAVPYRPAEDLAFSVARFIQNGGSFMNYYMYHGGTNFGRTSAGLFIATSYDYDAPLDEYGLTRDPKWGHLRDLHKAIKLCEPALVSVDPTVKSLGSNQEAHVFQSKSSCAAFLANYDTKYSVKVTFGNGQYDLPPWSISILPDCKTAVFNTARLGAQSSQMKMTPVGGALSWQSYIEEAATGYTDDTTTLEGLWEQINVTRDASDYLWYMTNVNIDSDEGFLKNGDSPVLTIFSAGHSLHVFINGQLAGTVYGSLENPKLTFSQNVKLTAGINKISLLSVAVGLPNVGVHFEKWNAGILGPVTLKGLNEGTRDLSGWKWSYKIGLKGEALSLHTVTGSSSVEWVEGSLSAKKQPLTWYKATFDAPEGNDPVALDMSSMGKGQIWVNGQSIGRHWPAYTARGSCSACNYAGTYDDKKCRSNCGEPSQRWYHVPRSWLNPSGNLLVVFEEWGGEPSGISLVKRTTGSVCADIFEGQPALKNWQMIALGRLDHLQPKAHLWCPHGQKISKIKFASYGSPQGTCGSFKAGSCHAHKSYDAFEKKCIGKQSCSVTVAAEVFGGDPCPDSSKKLSVEAVCT

SEQ ID NO: 7309 - protein, 726 aa, Medicago truncatula
MLMESFTRRRNCYILFLCFFVCYVTASVTYDHKAIVINGKRRILISGSIHYPRSTPQMWPDLIQKAKDGGVDVIETYVFWNGHEPSQGKYYFEDRFDLVKFIKVVQQAGLYVHLRIGPYVCAEWNFGGFPVWLKYVPGVAFRTDNEPFKAAMQKFTTKIVSIMKSENLFQSQGGPIILSQIENEYGPVEWEIGAPGKSYTKWFSQMAVGLNTGVPWVMCKQEDAPDPIIDTCNGYYCENFSPNKNYKPKMWTENWTGWYTDFGTAVPYRPAEDLAFSVARFVQNRGSYVNYYMYHGGTNFGRTSSGLFIATSYDYDAPIDEYGLISEPKWGHLRDLHKAIKQCESALVSVDPTVSWPGKNLEVHLYKTSFGACAAFLANYDTGSWAKVAFGNGHYDLPPWSISILPDCKTEVFNTAKVRAPRVHRSMTPANSAFNWQSYNEQPAFSGESGSWTANGLLEQLSQTWDKSDYLWYMTDVNISPNEGFIKNGQNPVLTAMSAGHVLHVFINGQFWGTAYGSLDNPKLTFSNSVKLRVGNNKISLLSVAVGLSNVGVHYEKWNVGVLGPVTLKGLNEGTRDLSKQKWSYKIGLKGESLNLHTTSGSSSVKWTQGSFLSKKQPLTWYKTTFNAPAGNDPLALDMSSMGKGEIWVNGQSIGRHWPAYIARGNCGSCNYAGTFTDKKCRTNCGQPTQKWYHIPRSWLNPSGNVLVVLEEWGGDPTGISLVKRT

SEQ ID NO: 7310 - protein, 838 aa, Populus trichocarpa
MWNVFLLLLLLQLLFFFSSRISTVTASVSYDHKAVIINGQRRILISGSIHYPRSTPEMWPDLIQKAKDGGVDVIQTYVFWNGHEPSPGNYYFEDRYDLVKFIKLVQQAGLYLHLRIGPYICAEWNFGGFPVWLKYVPGIEFRTDNGPFKAAMQKFTEKIVGMMKSEKLFENQGGPIILSQIENEYGPVEWEIGAPGKAYTKWAADMAVKLGTGVPWIMCKQEDAPDPMIDTCNGFYCENFKPNKDYKPKIWTEAWTGWYTEFGGAVPHRPAEDMAFSVARFIQNGGSYINYYMYHGGTNFGRTAGGPFIATSYDYDAPLDEFGLPREPKWGHLRDLHKAIKLCEPALVSVDPTVTSLGSNQEAHVFKSKSVCAAFLANYDTKYSVKVTFGNGQYELPPWSVSILPDCKTAVYNTARLGSQSSQMKMVPASSSFSWQSYNEETASADDDDTTTMNGLWEQINVTRDATDYLWYLTDVKIDADEGFLKSGQNPLLTIFSAGHALHVFINGQLAGTAYGGLSNPKLTFSQNIKLTEGINKISLLSVAVGLPNVGLHFETWNAGVLGPITLKGLNEGTRDLSGQKWSYKIGLKGESLSLHTASGSESVEWVEGSLLAQKQALTWYKTAFDAPQGNDPLALDMSSMGKGQMWINGQNIGRHWPGYIAHGSCGDCNYAGTFDDKKCRTNCGEPSQRWYHVPRSWLKPSGNLLAVFEEWGGDPTGISFVKRTTASVCADIFEGQPALKNWQAIASGKVISPQPKAHLWCPTGQKISQIKFASFGMPQGTCGSFREGSCHAHKSYDAFERNCVGKQSCSVTVAPEVFGGDPCPDSAKKLSVEAVCS

SEQ ID NO: 7311 - protein, 321 aa, Vicia faba
MDDTVLDDIIRKLVSAKNGRTTKQVHLTEADIRQLCTTAKEIFLSQPNLLELEAPIKICGDVHGQFSDLLRLFEYGGYPPEANYLFLGDYVDRGKQSIETICLLLAYKIKYKENFFLLRGNHECASINRIYGFYDECKRRFNVRLWKTFTDCFNCLPVAALVDEKILCMHGGLSPELKNLDQIRNIARPIDVPDHGLLCDLLWADPDKDLEGWGENDRGVSFTFGADKVAEFLEHHDLDLICRAHQVVEDGYEFFAKRKLVTIFSAPNYCGEFDNAGAMMSVDDTLTCSFQILKSSDKKGKGGFGNNSSRPGTPPHKGGKT

SEQ ID NO: 7312 - protein, 321 aa, Medicago sativa subsp. x varia
MDDTVLDDIIKKLVSAKNGRTTKQVHLTEADIRQLCTSAKEIFLSQPNLLELEAPIKICGDVHGQFSDLLRLFEYGGYPPEANYLFLGDYVDRGKQSIETICLLLAYKIKYKENFFLLRGNHECASINRIYGFYDECKRRYNVRLWKTFTDCFNCLPVAALVDEKILCMHGGLSPELKNLDQIRNIARPIDVPDHGLLCDLLWADPDKDLEGWGENDRGVSFTFGADKVVEFLEHHDLDLICRAHQVVEDGYEFFAKRKLVTVFSAPNYCGEFDNAGAMMSVDDSLTCSFQILKSSDKKGKVGFGNNSSRPGTPPHKGGKN

SEQ ID NO: 7313 - protein, 321 aa, Medicago truncatula
MDGTVLDDIIKKLVSAKNGRTTKQVHLTEADIRQLCTSAKEIFLSQPNLLELEAPIKICGDVHGQFSDLLRLFEYGGYPPEANYLFLGDYVDRGKQSIETICLLLAYKIKYKENFFLLRGNHECASINRIYGFYDECKRRYNVRLWKTFTDCFNCLPVAALVDEKILCMHGGLSPELKNLDQIRNIARPIDVPDHGLLCDLLWADPDKDLEGWGENDRGVSFTFGADKVVEFLEHHDLDLICRAHQVVEDGYEFFAKRKLVTVFSAPNYCGEFDNAGAMMSVDDSLTCSFQILKSSDKKGKVGFGNNSSRPGTPPHKGGKN

SEQ ID NO: 7314 - protein, 321 aa, Glycine max
MDENVLDDIIRRLLAAKNGRTTKQVLLTEAEIRQLCVSSKEIFLSQPNLLELEAPIKICGDVHGQYSDLLRLFEYGGYPPEANYLFLGDYVDRGKQSIETICLLLAYKIKYKENFFLLRGNHECASINRIYGFYDECKRRFNIRLWKTFTDCFNCLPVAALVDEKILCMHGGLSPDLKHLDQIRSIARPIDVPDHGLLCDLLWADPDKDLDGWGENDRGVSFTFGADKVAEFLEHHDLDLICRAHQVVEDGYEFFAKRQLVTIFSAPNYCGEFDNAGAMMSVDDTLTCSFQILKSSEKKGKCGFGNNTSRPGTPPHKGGKN

SEQ ID NO: 7315 - protein, 321 aa, Glycine max
MDENLLDDIIRRLVAAKNGRTTKQVQLTEAEIRQLCVSSKEIFLSQPNLLELEAPIKICGDVHGQYSDLLRLFEYGGYPPEANYLFLGDYVDRGKQSIETICLLLAYKIKYKENFFLLRGNHECASINRIYGFYDECKRRFNVRLWKTFTDCFNCLPVAALIDEKILCMHGGLSPDLKHLDQIRSIARPIDVPDHGLLCDLLWADPDKDLDGWGENDRGVSFTFGADTVVEFLEHHDLDLICRAHQVVEDGYEFFAKRQLVTIFSAPNYCGEFDNAGAMMSVDDTLTCSFQILKSSEKKGKGGFGINTSRPGTPPHKGGKN

SEQ ID NO: 7316 - protein, 321 aa, Glycine max
MDENLLDDIIRRLVAAKNGRTTKQVQLTEAEIRQLCVSSKEIFLSQPNLLELEAPIKICGDVHGQYSDLLRLFEYGGYPPEANYLFLGDYVDRGKQSIETICLLLAYKIKYKENFFLLRGNHECASINRIYGFYDECKRRFNVRLWKTFTDCFNCLPVAALIDEKILCMHGGLSPDLKHLDQIRSIARPIDVPDHGLLCDLLWADPDKDLDGWGENDRGVSFTFGADTVVEFLEHHDLDLICRAHQVVEDGYEFFAKRQLVTIFSAPNYCGEFDNAGAMMSVDDALTCSFQILKSSEKKGKGGFGINTSRPGTPPHKGGKN

SEQ ID NO: 7317 - protein, 320 aa, Ricinus communis
MDETLLDDIIRRLVEAKNGRTTKQVQLTEAEIRHLCLASKEIFLSQPNLLELEAPIKICGDVHGQFSDLLRLFEYGGYPPAANYLFLGDYVDRGKQSIETICLLLAYKVKYKENFFLLRGNHECASINRIYGFYDECKRRFNVRIWKTFTDCFNCLPVAALIDEKILCMHGGLSPDLKNLDQIRNIARPVDVPDQGLLCDLLWADPDKDIQGWGENDRGVSYTFGADKVAEFLQKHDLDLVCRAHQVVEDGYEFFAKRQLVTIFSAPNYCGEFDNAGAMMSVDDTLTCSFQILKSSEKKGKMGFGNNALRPGTPPHKGKG

SEQ ID NO: 7318 - protein, 320 aa, Populus trichocarpa
MDESLLDDIIRRLVEAKNGRTTKQVHLTEAEIKQLCLASRGVFLSQPNLLELEAPIKICGDVHGQFSDLLRLFEYGGYPPEANYLFLGDYVDRGKQSIETICLLLAYKIKYKENFFLLRGNHECASINRIYGFYDECKRRFNVRVWKTFTDCFNCLPVAALIDEKILCMHGGLSPELKSLDQIRNLARPIDVPDHGLLCDLLWADPDKDMEGWGENDRGVSYTFGADKVVEFLRKQDLDLVCRAHQVVEDGYEFFAKRQLVTIFSAPNYCGEFDNAGAMMSVDDTLTCSFQILRASEKKGKGGFGNNILRPGTPPHKGKS

SEQ ID NO: 7319 - protein, 319 aa, Vitis vinifera
MDGELLDDIIRRLVDAKNGRTPRQVQLTEAEIRMLCVTSKEIFLSQPNLLELEAPIKICGDVHGQFSDLLRLFEYGGYPPEANYLFLGDYVDRGKQSIETICLLLAYKIKYKENFFLLRGNHECASINRIYGFYDECKRRFNVRLWKTFTDCFNCLPVAALIDEKIICMHGGLSPELKNLDQIRNIARPVDVPDQGLLCDLLWADPDKDIEGWGENDRGVSYTFGADKVTEFLQKHDLDLICRAHQVVEDGYEFFAKRQLVTIFSAPNYCGEFDNAGAMMIVDDTLTCSFQILKSTDKKGKLGFGNMLRPGTPPHKGKG

SEQ ID NO: 7320 - protein, 322 aa, Arabidopsis thaliana
MEDSVVDDVIKRLLGAKNGKTTKQVQLTEAEIKHLCSTAKQIFLTQPNLLELEAPIKICGDTHGQFSDLLRLFEYGGYPPAANYLFLGDYVDRGKQSVETICLLLAYKIKYKENFFLLRGNHECASINRIYGFYDECKKRYSVRVWKIFTDCFNCLPVAALIDEKILCMHGGLSPELKHLDEIRNIPRPADIPDHGLLCDLLWSDPDKDIEGWGENDRGVSYTFGADKVEEFLQTHDLDLICRAHQVVEDGYEFFANRQLVTIFSAPNYCGEFDNAGAMMSVDDSLTCSFQILKASEKKGNFGFGKNAGRRGTPPRKGGGKG

SEQ ID NO: 7321 - protein, 436 aa, Glycine max; identical to SEQ ID NO: 6730

SEQ ID NO: 7322 - protein, 443 aa, Glycine max; identical to SEQ ID NO: 6731

SEQ ID NO: 7323 - protein, 443 aa, Glycine max; identical to SEQ ID NO: 6732

SEQ ID NO: 7324 - protein, 460 aa, Medicago truncatula; identical to SEQ ID NO: 6733

SEQ ID NO: 7325 - protein, 359 aa, Glycine max; identical to SEQ ID NO: 6724

SEQ ID NO: 7326 - protein, 359 aa, Glycine max; identical to SEQ ID NO: 6725

SEQ ID NO: 7327 - protein, 1328 aa, Glycine max
MDSRLEGKFPSKAAFCITQLSMKCLASEPKHRPSMKDVLENLERIQAANEKPVEPKFRSTHAANRQDLYGAKHSEEYCAMYDICGQSSDGKALNCPYGSPSVKPDDLLSAKIQSLCPTITGNVCCTADQFDTLRVQVQQAVPILVGCPACLRNFLNLFCELSCSPNQSLFINVTSISEVNGNMTVDGIDYYITETFGEGLYESCKDVKFGTMNTRAIDFVGAGASNFKEWFAFLGQKVPPGFPGSPYSILFKTTILDSSPMKLMNASVYSCNDTSLGCSCGDCPSSPVCSGSEPSPPRKDPCSIRIGSLKVRCVDFSMAILYIVLVFVLFGWALLQRTRGRRRLGSGVEPLLDDMVDEGSSFANLQKDGTHPAEVQQIDPQGQNVVQFSFVQGCLSSFYRTYGRWATRKPTIVLCSSLTIVVLLCLGLLRFEVETRPEKLWVGPGSKAAEEKEFFDSHLAPFYRIEQLIIATIPESKHGKPPSIITEENIELLFEIQEKVDGIRANYSGLLVSLSDICLKPLGDDCASQSILQYFQMDPDNYDNYGGVEHAEYCFQHYTSTETCFSAFKAPLEPTTALGGFSGNNYSEASAFVITYPVNNAITKVGDENGKAIAWEKAFIQLAKEELLPMVQSSNLTLSFSTESSIEEELKRESTADVITILVSYIVMFAYISVTLGDRPPHPSSLFLSSKVLLGLLGVLLVMLSVLGSVGFFSAIGVKSTLIIMEVIPFLVLAVGVDNMCIIVDAVKRQPSGLPVEEQISNAMGEVGPSITLASLSEILAFAVGSFVSMPACRVFSMIAALAVLLDFLLQITAFVALVTLDFMRAKDNRIDCFPCMKLNPPSAERNEGVRRERDGLLTRYMKEVHAPFLGLCGVKILVIAVFAAFTLASIALCTRIEPGLEQQIALPRDSYLQGYFSNISEYLRVGPPLYFVVKDYNYSLESKHTNQLCSISHCDSNSLLNEISRASLVPTSSYIAKPAASWLDDFLVWISPEAFSCCRKFTNDSYCPPDDQPPCCLPDEGPCGLGGVCKDCTTCFRHSDLVNDRPSTAQFREKLPWFLDALPSADCAKGGHGAYTNSVDLNGYEGGVIQASEFRTYHTPVNRQGDYVNAIRAARDFSARISSSLKMDIFPYSVFYIFFEQYLDIWKLALINISIALGAIFVVCLIITSSVWSSVIILLVLIMIILDLMGVMAILGIQLNAVSVVNLIMSIGIAVEFCVHIVHAFTVSLGDRSQRAKTALCTMGASVFSGITLTKLVGVLVLCFSTSQIFVVYYFQMYLALVLIGFLHGLVFLPVVLSLFGPPLRYTVIKEQLEDMPSASSEQPLIR

SEQ ID NO: 7328 - protein, 1268 aa, Glycine max
MDIIFSVTFLLQVFLLSSSPAASQRETYRAKHSEEYCAMYDICGQRSDGKALNCPYGSPSVKPDDLLSAKIQSLCPTITGNVCCTADQFDTLRVQVQQAIPILVGCPACLRNFLNLFCELSCSPNQSLFINVTSISEVDGNTTVDGIDYHLTETFGQGLYESCKDVKFGTMNTRAIDFVGAGASNFKEWAEFLGQKVPPGFPGSPYSILFKTAILDSSPMKLMNASVYSCNDTSLGCSCGDCPSSPVCSGSEPSPPRKDPCSIGIGSLKVRCVDFSIAILYIVLVFVLFGWALLQRTRGRRRLGSSAEPLLDDMVGEGSSFANLPKDGTHPAEVQWIDPQGQNVVQFSFVQGCLSSFYRTYGRWAARKPTIVLCSSLAIVVLLCLGLLRFEVETRPEKLWVGPGSKAAEEKEFFDSHLAPFYRIEQLIIATIPESKHGKPPSIITEENIELLFEIQEKVDGIRANYSGFLVSLSDICLKPLGDDCATQSILQYFQMDPDNYDNYGGVEHAEYCFQHYTSTETCFSAFKAPLEPTTALGGFSGNNYSEASAFVITYPVNNAITKVGGENGKAIAWEKAFIQLAKDELLPMVQSSNLTLSFSTESSIEEELKRESTADVITILVSYIVMFAYISVTLGDTPPHPSFFFLSSKVLLGLLGVLLVMLSVLGSVGFFSAIGVKSTLIIMEVIPFLVLAVGVDNMCIIVDAVKRQPSGLPVEEQISNAMGEVGPSITLASLSEILAFAVGSFVSMPACRVFSMIAALAVLLDFLLQITAFVALVTLDFMRAKDNRIDCFPCVKLNPPSAEQNEGIRLERDGLLTRYMKEVHAPFLGLWGVKILVIAVFAAFTLASIALCTRIEAGLEQQIALPRDSYLQGYFSNISEYLRVGPPLYFVVKDYNYSLESKHTNQLCSISHCDSNSLLNEISRASLVPTSSYIAKPAASWLDDFLVWISPEAFSCCRKFTNDSYCPPDDQPPCCLPDEGPCGLGGVCKDCTTCFRHSDLVNDRPSTAQFREKLPWFLDALPSADCAKGGHGAYTNSVDLNGYEGGVIQASEFRTYHTPLNRQGDYVNAIRAARDFSAIISSSLKMDIFPYSVFYIFFEQYLDIWKLALINITVALGAIFVVCLIITSSVWSSAILLLVLIMIILDLMGVMAILGIQLNAVSVVNLIMSIGIAVEFCVHIVHAFMVSLGDRSQRAKTALCTMGASVFSGITLTKLVGVLVLCFSTSEIFVVYYFQMYLALVIIGFLHGLVFLPVVLSLFGPPLRYSH

SEQ ID NO: 7329 - protein, 1223 aa, Populus trichocarpa
MYDICGARSDGKVLNCPFPTSSVKPDDYFSAKIQSLCPAISGNVCCTETQFDTLRAQVQQAIPLLVGCPACLRNFLNLFCELSCSPNQSLFINVTSISEVNGNLTVDGIAYYVTDDFGERLYDSCKDVKFGTMNTRAIDFVGGGANNFKEWFAFIGQKAPPGFPGSPYEIDFKSTIPDSSKMVPMNVSAYSCGDTSLGCSCGDCPLAPACSSSEPPSPPKKESCLIRIGPLKVKCLDFSVAILYIILVFAFLGWASLNRTRERRAAASKEPLLSSMDEVEADSTEIQKDGKVPRLINRFQLDGVQGHMSSFYRNYGKWVARNPTLVLCSSVAVVLVLCIGLICFKVETRPEKLWVGPGSKAAEEKHFFDSHLAPFYRIEQLILATLPDSKNDKRNSIVTDENIQLLFEIQKKVDGIRANYSGSVVSLTDICLKPLGDDCATQSLLQYFKMDPENYDDYGGVEHAEYCFQHYTTADTCMSAFKAPLDPSTALGGFSGNNYSEASAFVVTYPVNNAIDEAGNGKAVAWEKAFIRLVKEELLPMVQSSNLTLSYSSESSIEEELKRESTADIITIAVSYVVMFAYVSVTLGDASRLSTFFLSSKVLLGLSGVVLVMLSVLGSVGFFSAVGVKSTLIIMEVIPFLVLAVGVDNMCILVHAVKRQSIELAIEERISNALHEVGPSITLASLSEILAFAVGSFIPMPACRVFSMFAALAVLLDFLLQVTAFVALIAFDCRRAEDNRIDCFPCIKVPSSPGGSNEGINQRRPGLLARYMKEVHAPILGLWAVKIVVIAIFVAFALASVALCPRIESGLEQQVVLPRDSYLQGYFNNISEYLRIGPPLYFVVKDYNYSLESRHTNQLCSISQCDSNSLLNEVSRASLVPESSYIAKPAASWLDDFLVWLSPEAFGCCRKFMNGTYCPPDDQPPCCSPDEFSCGFGGVCKDCTTCFRHSDLVNDRPSTVQFREKLPWFLDALPSSDCAKGGHGAYTSSVDLNGYENGVIRASEFRTYHTPVNKQGDYVNALRAAREFSSRISDSLKIEIFPYSVFYIFFEQYLDIWRIALINIAIALGAIFIVCLVITSSFWCSAIILLVLVMIVVDLMGVMAILDIQLNAVSVVNLIMSIGIAVEFCVHIAHAFLVSHGDRGQRAKEALSTMGASVFSGITLTKLVGVIVLFFARSEVFVVYYFQMYLALVIIGFLHGLVFLPVVLSVFGPPPRHVIMETR

SEQ ID NO: 7330 - protein, 1345 aa, Vitis vinifera
MANCTSITRKPFITSFLAFLRENTEEDDDFLGEKHGVLVSSSRRPFAVTGKNSFLFLAILFSGIVGRVIICGIEFVLIFASLLGAEKTDSQFLLFPNATSGERHSPEYCAMYDICGERSDGKVLNCPYGTPAVKPDEFLSAKIQSLCPMISGNVCCTEAQFDTLRAQVQQAIPFLVGCPACLRNFLNLFCELSCSPNQSLFINVTSIAKVRHTDSTVDGIDFYVSDAFGEGLYNSCKDVKFGTMNTRAIQFIGAGARNFKEWFAFIGQQADLGMPGSPYAINFKSRPESSGMELMNVSIYSCGDTSLGCSCGDCPSSPVCSDYEPPSPQQKDACSISLGSVKVKCIEFSLAILYIVLVSAFFGWGLFHRTRERRRIPASNMKPLLNFEDEKLTTLKVHEMVPQETNVQLSAVQGYMSSFYRQYGTWVAKNPSLVLCMSLAVVLILCLGLIRFKVETRPEKLWVGPGSRAAEEKNFFDSHLAPFYRIEQLILATMPDIKSGKSSSIVSDDNIQLLFEIQKKVDGLRANYSGSVVSLTDICLKPMGQDCATQSVLQYFKMDPENYYGYGGVQHVEYCFQHYTTADTCMSAFKAPLDPSTALGGFSGNNYTEASAFIVTYPVNNAIGGAGNENGKAVAWEKAFVQLVKDELLSMVQSRNLTLSFSSESSIEEELKRESTADVITISISYLVMFAYISITLGDVSRLSSFYVSSKVLLGLSGVIVVMLSVLGSVGFFSAIGVKSTLIIMEVIPFLVLAVGVDNMCILVHAVKRQSLDLPLEGRISNALVEVGPSITLASLSEVLAFAVGSFIPMPACRVFSMFAALAVLLDFLLQVTAFVALIVFDFMRAEDNRIDCFPCIKIPSSSVESDEGINQRKPGGLLAWYMQEVHAPILGIWGVKIFVIAAFFAFTLASIALCTRIEPGLEQQIVLPRDSYLQGYFNNVSEYLRIGPPLYFVVKDYNYSSDSRHTNQLCSINQCDSNSLLNEISRASLVPESSYIAKPAASWLDDFLVWMSPEAFGCCRKFVNGSYCPPDDQPPCCSPDEGYCDLGGVCKDCTTCFRHSDLNSGRPSTEQFREKLPWFLNALPSADCAKGGHGAYTSSVDLNGYESSVIQASEFRTYHTPLNKQVDYVNSMRAAREFSSRVSDALKIQIFPYSVFYMFFEQYLDIWRTALINIAIALGAVFIVCLVITSSVWSSAIILLVLAMIIVDLMGVMACLDIQLNAVSVVNLIMSIGIAVEFCVHISHAFSVSQGDRNQRAKLALGTMGASVFSGITLTKLVGVIVLCFSKSEIFVVYYFQMYLALVLIGFLHGLVFLPVILSMIGPPSMHVPIKQQEDEPSSSALLG

SEQ ID NO: 7331 - protein, 443 aa, Glycine max; identical to SEQ ID NO: 6731

SEQ ID NO: 7332 - protein, 436 aa, Glycine max; identical to SEQ ID NO: 6730

SEQ ID NO: 7333 - protein, 567 aa, Glycine max; identical to SEQ ID NO: 6767

SEQ ID NO: 7334 - protein, 553 aa, Glycine max; identical to SEQ ID NO: 6765

SEQ ID NO: 7335 - protein, 542 aa, Glycine max; identical to SEQ ID NO: 6766

SEQ ID NO: 7336 - protein, 482 aa, Glycine max; identical to SEQ ID NO: 6770

SEQ ID NO: 7337 - protein, 482 aa, Glycine max; identical to SEQ ID NO: 6771

SEQ ID NO: 7338 - protein, 531 aa, Medicago truncatula
MDSKSLCFITHQDIFNVVRSGDLEGLKEVLKYVNKGESSNGPSPISEFLSMQNDAGETLLYIAAENGVKDLFSFLLRLCDLEILKIRSKSDMNAFHVAAKRGHLEIVREILSTWPEACKLCDSSNTSPLYLAAVQDHLDVVNAILDVDVSSMMIVRKNGKTALHNAARYGILRIVKALIARDSAIVCIKDKKGQTALHMAVKGQCTSVVEEILQADPMVLNEKDKKGNTALHMATRKARSQIVSFLLSYASMNVNAINNQQETALDLADKLPYGDSSLEIKEALSDCGAKNARNIGKVNEAMELKRVVSDIKHEVQSQLVQNEKTRKRVSGIAKELRKIHREAIQNTINSVTVVAVLFASIAFMALFSLPGQYRKQQPEAGKANIAHEVAFSVFCLLNATSLFISLAVVVVQITLVAWDTRAQRQIVSVINKLMWTACACTCGAFLAIAFVVVGKERWMAITVTVLGTPILVGTLAYLCYFVFRRHFGFQSESQRVLSKRPSGSKSLSWSYSAHISDEEEYNSDVEKIYAL

SEQ ID NO: 7339 - protein, 525 aa, Glycine max
MDSNSKAVCFITHQAIFNAVRCGDLEGLKEQLKNKGEEGVSEVMSMQNDAGETMFYIAAEIGLREVFSFLFGLCDMEVLKIRAKSDLNPFHVAAKGGHLDIVREILSTWPEVCTLCDSSNTSPLYFAAIGDHLDVVNAILDVDVSSMMIVRKNGKTALHNAARYGILRIVKALIARDPGIVCIKDRKGQTALHMAVKGQSTSVVDEILQADLTILNERDKKGNTALHMATRKCRPQVVSILLTYTALNVNAINNQKETALDLADKLRYGDSALEIKEALAECGAKHARHIGKVNEAMELKRAVSDIKHEVQSQLIQNEKTRKRVSGIAKELKKIHREAVQNTINSVTVVAVLFGSIAFMALFSLPGQYRKKQPEAGKANIADDAAFSAFCLLNATALFLSLAVVVAQITLVAWDTRSQRQVVSVINKLMWAACACTCGAFLAISFVVVGDETWLAISVTVLGAPILLGTLAYLCYFVFRRRFGLRSDSQGLVKRPSGSKSFSWSYSVNISDVDDYDSDHVKIYAL

SEQ ID NO: 7340 - protein, 525 aa, Glycine max
MDSNSKAMCFVTHQAIFNAVRCGDLEGLKQQLKNKGAEGVSEVMSMQNDAGETILYIAAEIGLREVFSFLLGLCDMEVLKIRAKSDLNPLHVAAKGGHFDIVREILSTWPEVCKLCNSSNTSPLYFAAVQDHLDVVNAILDVDVSSMMIVRKNGKTALHNAARYGILRIVKALIARDPGIVCIKDRKGQTALHMAVKGQSTSVVEEILQADLTILNERDKKGNTALHMATRKCRPQIVSLLLTYTALNVNAINNQKETALDLADKLRYGDSALEIKEALTECGAKHARHIGKVDETMELKRAVSDIRHEVQSQLIQNEKTRKRVSGIAKELKKIHREAVQNTINSVTVVAVLFGSIAFMALFSLPGQYRKKQPDAGEANIANDAAFSAFCLLNATALFLSLAVVVAQITLVAWDTRSQRQVVSVINKLMWAACACTCGTFLAISFVVVGDETWLAISVTLLGAPILLGTLAYLCYFVFRRRFGHCSDSQRLVKRPSGSKSFSWSYSVNISDVDDYDSDPMKIYAL

SEQ ID NO: 7341 - protein, 530 aa, Glycine max
MMEAKGVRFLAYQSIFSSVGSGDFDGVKKLVEKVKNEEWSSLSDVMSLQNDAGETALYIAAENNLQEIFSFLLSMCDFEVVKIRSKKADMNAFHVAAKRGNLDIVRELLNTWPEVCKLCDSSNTSPLYSAAVQDHLDVVDAILDVDVSCMFIVRKNGKTSLHNAARYGVLRIVKTLIARDPGIVCIKDKKGQTALHMAVKGQCTSVVEEILLADPSILNERDKKGNTALHMATRKCRSQIVSLLLSYSAMDVNAINKQQETAMDLADKLPYGDSALEIKEALAEYGAKHARYVGKEDEAMELKRTVSDIKHEVQSQLIQNETTRRRVSGIAKELKKLHREAVQNTINSVTVVAVLFASIAFLAIFNLPGQYITEEGQEIGKANIADHVSFQVFCLLNSTSLFISLAVVVVQITLVAWDTRAQKQIVSVVNKLMWAACACTCGAFLAIAFEVVGKKTWMAITITLLGVPILVGTLASMCYFVFRQHFGIFRSDSQRRIKRTSGSKSFSWSYSANISDLDEYNSDIEKIYAL

SEQ ID NO: 7342 - protein, 538 aa, Medicago truncatula
MESKGLRFMTHQSIFTTVGSGDLDGLKKLLEKLNKEEDGDISNGSSSSSMSVSDVMSLQNDHGETPLYIAAHNNLKEVFTFLIKLCDFEVLKIRSKSDMNAFHVAAKRGHLDIVREILSAWPAVCKLCDSTNTSPLYAAAVQDHLDVVNAILDVDVSSMFIVRKNGKTALHNAVRYGVDRIVKALIVRDPGIVCIKDKKGQTALHMAVKGQSTSVVEEILQADPTILNERDKKGNTALHMATRKGRSQIVSYLLSYAAVDVNAINKQQETALDLADKLPYGSSALEIQEALSEYGAKYARHVGKVDEAMELKRTVSDIKHEVQSQLIQNEKTRRRVSGIAKELKKLHREAVQNTINSVTVVAVLFASIAFLAIFNLPGQYIMKGSHIGESNIADHVGFQIFCLLNSTSLFISLAVVVVQITLVAWDTRAQKQIVSVVNKLMWAACACTCGAFLAIAFEVVGKKKWMAITITGLGIPILVGTLASMCYFVFRQHFGIFQSDSQRRIKRASGSKSFSWSYSANISDIDEYTSDIEKIYAL

SEQ ID NO: 7343 - protein, 528 aa, Glycine max
MEAKGVRFLAYQSIFSSVGSGDFDGVKKLVEEVKKEEGSSLSDVMSLQNDAGETALYIAAENNLQEMFSFLLSICHFEVVKIRSKADMNAFHVAAKRGNLDIVRELLNIWPEVCKLCDSSNTSPLYSAAVQDHLDVVDAILDVDVSSMFIVRKNGKTSLHNAARYGVHRIVKTLIARDPGIVCIKDKKGQTALHMAVKGQCTSVVEEILLADPSILNERDKKGNTALHMATRKCRSQIVGLLLSYSAVDVNAINKQQETALDLADKLPYGDSALEIKEALAEYGAKHARYVGKEDDAMELKRTVSDIKHEVQSQLIQNETTRRRVSGIAKELKKLHREAVQNTINSVTLVAVLFASIAFLAIFNLPGQYITDEGKEIGKAKIADHVSFQVFCLLNSTSLFISLAVVVVQITLVAWDTRAQKQIVSVVNKLMWAACACTCGAFLAIAFEVVGKKTWMAITITLLGVPVLVGTLASMCYFVFRQHFGIFRSDSQRRIKRASGSKSFSWSYSANISDLDEYNSDIEKIYAL

SEQ ID NO: 7344 - protein, 531 aa, Ricinus communis
MDANPLCFLTRQSFFSAVRSADLNSVKEIVKKITKDEPCDGSSPVSDLMTVQTDAGETALYIAAENKFEDVFSYLVKFSDIEAVKIRSKSDMNAFHVAAKKGHLGIVKELLSIWPELCKLCDSSNTSPLYSAAVQDHLDVVNAILDADVSSLRIVRKNGKTALHTAARYGLVEMVKALIDRDPEIVRVKDKKGQTALHMAVKGQSTAVVEEILSADCSILNERDKKGNTAVHIATRKSRPVIVSLLLTYRSIDVNVINNQRETAMDLADKLQYGESSMEIKEALTDAGAKHARYVGTVDEAMELKRTVSDIKHEVHSQLIQNEKTNRRVSGIAKELRKLHREAVQNTTNSVTVVAVLFSSIAFLAIFNLPGQYLMDGGEVGKANIADNVGFRVFCLLNATSLFISLAVVVVQITLVAWDTRAQKQVVSVVNKLMWAACACTCGSFLSIAFVVVGKGSSWMAITITLMGAPLLVGTLASMCYFVFRQHFGGFRDSERRIKRGSGSKSFSWSYSANISDVDEYNSDMEKIYAL

SEQ ID NO: 7345 - protein, 526 aa, Populus trichocarpa
MEPSKSSLRFIAHQAFFSAVRSGDLDSLRQIVGDQPSDVSDLMSLQTDAGETALYIAADNNLEEIFSYLIKRCDLETVKIRSKSDLDAFHLAAKKGHLGIVKELLAMWPELCKLCDSSNTSPLYSAAVKNHLDVVNAILDADVSSMRIVRKNGKTALHTAARYGLLDIVKVLIARDSGIVCIKDKKGQTALHMAVKGQSTSVVEEILVADHSILNERDKKGNTAVHIATRKSRPQIIFLLLSYTSINVNIINNERETAMDLADKLQYGESALEIKEALIEAGAKHARHVGQMDEAMELKRTVSDIKHEVHSQLIQNEKTNRRVSGIAKELRKLHREAVQNTTNSVTVVAVLFASIAFLAIFNLPGQYIQDGAETGKANIAGSVGFQVFCLLNATSLFISLAVVVVQITLVAWDTQAQKQVVSVVNKLMWAACACTCGAFLSIAFVVVGKKSSWMAITITLTGAPILVGTLASMCYFVFRQHFGFFRDSQRRIKRASGSKSFSWSVHSTNISDPDEYNSDLEKIYAL

SEQ ID NO: 7346 - protein, 529 aa, Populus trichocarpa
MMMMEPSKSSLRFIAHQAFFSAVRSGDLDSLRQIVGDQPSDVSDLMSLQTDAGETALYIAADNNLEEIFSYLIKRCDLETVKIRSKSDLDAFHLAAKKGHLGIVKELLAMWPELCKLCDSSNTSPLYSAAVKNHLDVVNAILDADVSSMRIVRKNGKTALHTAARYGLLDIVKVLIARDSGIVCIKDKKGQTALHMAVKGQSTSVVEEILLADHSILNERDKKGNTAVHIATRKSRPQIIFLLLSYTSINVNIINNERETAMDLADKLQYGESALEIKEALIEAGAKHARHVGQMDEAMELKRTVSDIKHEVHSQLIQNEKTNRRVSGIAKELRKLHREAVQNTTNSVTVVAVLFASIAFLAIFNLPGQYIQDGAETGKANIADSVGFQVFCLLNATSLFISLAVVVVQITLVAWDTQAQKQVVSVVNKLMWAACACTCGAFLSIAFVVVGKKSSWMAITITLTGAPILVGTLASMCYFVFRQHFGFFRDSQRRIKRASGSKSFSWSVHSTNISDPDEYNSDLEKIYAL

SEQ ID NO: 7347 - protein, 529 aa, Populus trichocarpa
MTMMEPSKSSLRFIAYQRFFTAVRSGDLDSLKQIVGEQPSDVSDLMSLQTNAGETALYIAADNNLEEVFSYLVKLCDFETVKIRSKSDLNAFHLAAKKGHLGIVKDLLVMWPELCKLCDSSNTSPLYSAAVKDHLDVVNAILDVDVSSMRIVRKNEKTALHTAARYGLLDMVKVLIHRDPGIVCIKDKKGQTALHMAVKGQSTSVVEEIFLADRSILNERDKKGNTAVHVATRKSRPQIISLLLNYISIDVNIINNQHETAMDLADKLPYGESALEIKEALTEAGAKHARHVGQMDEAMELKRTVSDIKHEVHSQLIQNEKTNRRVSGIAKELRKIHREAVQNTTNSVTVVAVLFASIAFLAIFNLPGQYIQDGAETRKAYIADNVGFQVFCLLNATSLFISLAVVVVQITLVAWDTQAQKQLVSIVNKLMWAACACTCGAFLSIAFVVVGKKSSWMAITITLTGAPILVGTLASMCYFVFRQHFGAFRDSQRRIKRASGSKSFSWSVYSANISDPDEYNSDLEKIYAL

SEQ ID NO: 7348 - protein, 472 aa, Medicago truncatula
MHIEAPENYGPEDKNFDDDGRAKRTGTWLTASAHIITAVIGSGVLSLAWAIAQMGWVAGPAVLFAFSFITYFTSTLLADCYRSPDPVHGKRNYTYTEVVRANLGGRKFQLCGLAQYINLVGVTIGYTITASISMVAVQRSNCFHKHGHQDKCYVSNNPFMIIFACIQIVLCQIPNFHELSWLSIVAAVMSFAYSSIGLGLSVAKVAGGGNHVTTSLTGVQIGVDVTATEKVWRMFQAIGDIAFAYAFSNVLIEIQDTLKSSPPENRVMKRASLIGILTTTLFYVLCGTLGYAAFGNDAPGNFLTGFGFYEPFWLIDFANVCIAVHLIGAYQVFVQPIFGFVEGQSKQKWPDSKFVNGEHAMNIPLYGSYNVNYFRVIWRSCYVIITAIIAMLFPFFNDFLGLIGSLSFYPLTVYFPIEMYIKKTNMPKYSFTWTWLKILSWLCLVISIISAAGSIQGLATSLKTYKPFRGEQ

SEQ ID NO: 7349 - protein, 479 aa, Glycine max
MNPDQFQKNSMFVETPEDGGKNFDDDGRVKRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHDKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSHFVNGEHALKFPLFGTFPVNFFRVVWRTTYVIITALIAMMFPFFNDFLGLIGSLSFWPLTVYFPIEMYIKQSKMQKFSFTWTWLKILSWACLIVSIISAAGSIQGLAQDLKKYQPFKAQQ

SEQ ID NO: 7350 - protein, 479 aa, Glycine max
MNSDQFQKNSMFVETPEDGGKNFDDDGRVRRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHVKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSQFVNGEHALNFPLCGTFPVNFFRVVWRTTYVIITALIAMMFPFFNDFLGLIGSLSFWPLTVYFPIEMYIKQSKMQRFSFTWTWLKILSWACLIVSIISAAGSIQGLAQDLKKYQPFKAQQ

SEQ ID NO: 7351 - protein, 482 aa, Medicago truncatula
MSRDQFQKNSMYIETPEAFTDGSKNFDDDGRAKRTGTWVTASAHIITAVIGSGVLSLAWAIAQMGWIAGPAVLLAFSFITYFTSTLLADSYRSPDPVHGKRNYTYSEVVRSVLGGRKFQLCGLAQYINLIGVTIGYTITASISMVAVKRSNCYHKQGHDAKCYISNNPFMIIFACIQIVLSQIPNFHKLSWLSIVAAVMSFAYSSIGLGLSIAKVAGRGPAVRTSLTGVQVGVDVTGTEKVWRMFQAIGDIAFAYAYSNVLIEIQDTLKSSPPENQVMKRASLIGILTTTMFYMLCGCLGYAAFGNDAPGNFLTGFGFYEPFWLIDLANIFIAVHLIGAYQVFCQPIFGFVESKSKEKWSNSQFVNGEHAVNIPLCGTLHVNFFRVVWRTAYVVITALIAMIFPFFNDFLGLIGSLSFWPLTVYFPIEMYIKQSKMQRFSFTWTWMKILSWACLIVSIISAAGSIQGLAHDLKKYQPFKAQQ

SEQ ID NO: 7352 - protein, 479 aa, Glycine max
MNSDQFQKNSMFVETPEDGGKNFDDDGRVRRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHVKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGRERWPNSQFVNGEHALNFPLCGTFPVNFFRVVWRTTYVIITALIAMMFPFFNDFLGLIGSLSFWPLTVYFPIEMYIKQSKMQRFSFTWTWLKILSWACLIVSIISAAGSIQGLAQDLKKYQPFKAQQ

SEQ ID NO: 7353 - protein, 470 aa, Glycine max
MGSMHIETPETFADGSKNFDDDGRAKRTGTWITASAHIITAVIGSGVLSLAWAIAQMGWVAGPAVLFVFSLITYFTSTLLADCYRSPDPVHGKRNYTYSEVVKANLGGRKFQLCGLAQYINLVGVTIGYTITASLSMGAVKKSNCLHKHGHQDECKVKDNAFMIAFACIQILLSQIPNFHKLSWLSIVAAVMSFAYSSIGLGLSIAKIIGGGHVRTTLTGVEVSGTEKVWKMFQAIGDIAFAYAFSNVLIEIQDTLKSSPPENKVMKRASLIGIMTTTLFYVLCGCLGYAAFGNDAPSNFLTGFGFYEPFWLIDFANVCIAVHLVGAYQVFVQPIFGFVEKWSKENWTESQFINGEHTLNIPLCGSYNVNFFRVVWRTAYVIITAVVAMLLPFFNDFLALIGALSFWPLTVYFPIEMYIKKSNMQRFSFTWTWLKILSWVCLIISIISLVGSIQGLSVSIKKYKPFQAEQ

SEQ ID NO: 7354 - protein, 481 aa, Brassica napus
MEKKSMFIEQSFTDHKSGDMNKNFDDDGRQKRTGTWMTGSAHIITAVIGSGVLSLAWAIAQLGWVAGPAVLMAFSFITYFTSTMLADCYRSPDPVTGKRNYTYMEVVRSYLGGRKVMLCGLAQYGNLIGITIGYTITASISMVAVKRSNCFHKNGHNVKCSTSNTPFMIIFACIQIVLSQIPNFHNLSWLSILAAVMSFSYASIGIGLSIAKVAGGGVHARTALTGVTVGVDVTGSEKVWRTFQAVGDIAFAYAYSTVLIEIQDTLKASPPSENKAMKRASLVGVSTTTFFYMLCGCVGYAAFGNNAPGNFLTGFGFYEPFWLIDFANVCIAVHLVGAYQVFCQPIFQFVESQSAKRWPDNKFITGEYKMNVPCGGDFGISLFRLVWRTSYVVVTAVVAMIFPFFNDFLGLIGAASFWPLTVYFPIEMHIAQKNMKKFSFTWTWLKILSWACFLVSLVAAAGSVQGLIQSLKDFKPFQAPE

SEQ ID NO: 7355 - protein, 483 aa, Populus tremula x Populus alba
MDREMQNSSLHIARGPEGSESGGMSKNLDDDGRPKRTGTWITASAHIITAVIGSGVLSLAWAIAQLGWVVGPLVLMVFSFITFFTSTLLADSYRSPDPITGNRNYTYMDAVRAHLGGRKVQLCGLAQYVNLIGITVGYTITASISMVAVRRSNCFHKHGHAVKCQTSNNPYMIIFACIQIMLSQIPNFHKLSWLSILAAVMSFAYSSIGLGLSLAKVIGGAHARTSLTGVTVGVDVSAEQKVWRTFQALGDIAFAYAYSTVLIEIQDTLKSSPPENKAMKRASFVGILTTTTFYILCGCLGYAAFGNDAPGNFLTGFGFYEPFWLIDLANACIAIHLIGAYQVFCQPIFSFVESRCHRRWPDSKFMTREHAINIPFYGVYYLNLFRLVWRTLYVIVTAVLAMILPFFNDFLALLGAISFWPLTVYFPIEMYMARSKMPKFSFRWTSLKMLSWACLAVSLVSAAGSVEGLIQALKTYKPFKAQQ

SEQ ID NO: 7356 - protein, 484 aa, Ricinus communis
MAKEMQPSSMYLEQVDVEGYENGGVRKNVDDDGRPKRTGTWLTASAHIITAVIGSGVLSLAWAIAQLGWVAGPVILMAFSFITFFTSTLLADSYRSPDPVTGKRNYTYMDAVRANLGGWKVTFCGISQYANLVGITVGYTITASISMVAVKRSNCFHRHGHAAKCHTSNNPYMIIFACIQIILSQIPNFHKLSWLSVLAAVMSFAYSSIGLGLSIAKVAGGEHVRTSITGTTVGVDVTAAQKIWRAFQSIGDIAFAYAYSTVLIEIQDTIKSGPPENKAMKKASFVGIVTTTMFYILCGCIGYAAFGNDAPGNFLTGFGFYEPFWLIDIANVCIAIHLIGAYQVFCQPIFSFMEKNSRQRWPENKFITTEYAINIPFLGVYYLSTFRLVWRTLYVIVTAIVAMILPFFNDFLGLIGAAAFWPLTVYFPIEMYITRTRIPKFSSTWIWLKILTLACLVVSLLAAAGSVEGLINSLKTYKPFQSEQ

SEQ ID NO: 7357 - protein, 488 aa, Populus trichocarpa
MDREMQNSSLYISRGRPEGSESGGIISKNLDDDGRPKRTGTWITASAHIITAVIGSGVLSLAWAIAQLGWVVGPLVLVVFSFITFFTSTLLADSYRSPDPITGNRNYTYMDAVRANLGGRKVQLCGLAQYVNLIGITVGYTITASISMVAVRRSNCFHKHGHAVKCQTSNNPYMIIFACIQIMLSQIPNFHKLSWLSILAAVMSFAYASIGLGLSLAKVIGGAHARTSLTGVTVGVDVSAQQKVWRTFQALGDIAFAYAYSTLNLTVELRDDTLKSSPPENKAMKRASFVGILTTTTFYILCGCLGYAAFGNDAPGNFLTGFGFYEPFVLIDIANVCIAIHLIGAYQVFCQPIFSFVESRCHRRWPDSKFITSEHAINIPFYGVYYLNLFRLVWRTLYVIVTAVLAMILPFFNDFLALLGAISFWPLTVYFPVEMYMARTKMPKFSFRWTSLKMLSWACLAVSLVSAAGSVEGLIQALKTYKPFKAQQ

SEQ ID NO: 7358 - protein, 359 aa, Glycine max; identical to SEQ ID NO: 6724

SEQ ID NO: 7359 - protein, 359 aa, Glycine max; identical to SEQ ID NO: 6725

SEQ ID NO: 7360 - protein, 359 aa, Glycine max; identical to SEQ ID NO: 6724

SEQ ID NO: 7361 - protein, 436 aa, Glycine max; identical to SEQ ID NO: 6730

SEQ ID NO: 7362 - protein, 221 aa, Helianthus annuus; identical to SEQ ID NO: 6734

SEQ ID NO: 7363 - protein, 260 aa, Vitis vinifera; identical to SEQ ID NO: 6735

SEQ ID NO: 7364 - protein, 221 aa, Vitis vinifera; identical to SEQ ID NO: 6736

SEQ ID NO: 7365 - protein, 254 aa, Vitis vinifera; identical to SEQ ID NO: 6737

SEQ ID NO: 7366 - protein, 267 aa, Vitis vinifera; identical to SEQ ID NO: 6738

SEQ ID NO: 7367 - protein, 221 aa, Arabidopsis thaliana; identical to SEQ ID NO: 6739

SEQ ID NO: 7368 - protein, 221 aa, Glycine max; identical to SEQ ID NO: 6740

SEQ ID NO: 7369 - protein, 221 aa, Dimocarpus longan; identical to SEQ ID NO: 6741

SEQ ID NO: 7370 - protein, 221 aa, Arabidopsis lyrata subsp. lyrata; identical to SEQ ID NO: 6742

SEQ ID NO: 7371 - protein, 221 aa, Vitis vinifera; identical to SEQ ID NO: 6743

SEQ ID NO: 7372 - protein, 358 aa, Glycine max; identical to SEQ ID NO: 6747

SEQ ID NO: 7373 - protein, 373 aa, Glycine max; identical to SEQ ID NO: 6748

SEQ ID NO: 7374 - protein, 895 aa, Glycine max
MAGADKELEEQLLEAGNKLVDPPSSVEELLALLEQVESCLSRVEQSPTDSMQNALSPSLKALIAEKLLRHSDDDVKIAVASCISEITRITAPEAPYDDDQMKEVFQLIVSSFENLHDKLSQTYPKRISILETVAKVRSCVVMLDLECDVLILEMFQHFLKAIREHHPENVFSSMETIMTLVLEESEDISLDLLSPLLASIKKDNKEVFPIAQKLGERVLESCATKLKPYLVQSVKSLGISVDDYSAVLASICQDTSDDLEKNDTCVTSEHVVKKDSREVTSSQQENPDDVNKSPKSVMSNGVACVGEDNALADSESIKKKEDADCSNHSDGLNTFGHGVHNDLDIEKVDNSKQKTEKATKKQRKKSSSSTKSAKPSKGQVATNEKETEKMLDCESNCKIVHSSPHEDHSVEAAGPSENDKEIDANIMSPKACNDDSEIVASPPSESLCDENHSKKLGQSKKKDDPVKEGTAEDVSKVSASDSEAKPTRRSVKKALGQKSDVKKTSVVDSVKKGSGAANDADAKKHSAKKSDENKKGSGGSSSRQMEYKKKGGRGKANSEADVAKSSDVDKEMVSSPTSGTKSTKDGKSEETPKTNVKRKRTPGKENDSDVKEYGENLVGLRVKVWWPKDHEFYIGVIDSFDSAKKKHKVLYDDGDEETLNLVKEKWKVIEADSDADEEERSDRADLDVSTDMSLKKKGKASAGESTKQGKMDASSKSGGAAASNGSKGASTKSSQKAKDGNKSKGSKANSKSEDKVSRKSKDGTPKSGSSKSIVAAKKMSNKLKNTDTSKTSESKDDDSSKPKPSAKSKHETLKSGKSKQETPKAAISKGKPVKSGGKTDVNGTGKVKSGLLKRKHFENENSDVSAGEIEDSKGKTASSSKAQGSELKSRKRRKT

SEQ ID NO: 7375 - protein, 894 aa, Glycine max
MAGADKELEEQLLEAGNKLVDPPSSVEDLLALLEQVESCLSRVEQSPTDSMQNALSPSLKALIADKLLRHSDDDVKIAVASCISEITRITAPEAPYDDDQMKEVFQLIVSSFENLHDKLSRSYSKMISILDTVAKVRSCVVMLDLECDALILEMFQHFLKAIREHHPENVFSSMETIMTLVLEESEDISLDLLSPLLGSIKKDNEEVFPIAQKLGERVLESCATKLKPYLVQAVKSLGISVDDYSAVLASICQDVSDDLEKNDTCVTSEHVDSREVTSSQQENPDDVNKSPKSVMSNVVACVEDNALAHSESIKKQEDADCSNHSEGLNTSGNEVNNDLDIEKVDNSKQKTEKATKKPRKKSSSSIKLTKPSKGQVAANEKETEKMLDCESNSKIVHSSPPEDHSVEAAGPSENDKGIDAKISSPMACNDDSEVVASPPSESLCDENHSKKLGRTKKKDGPVKEGTAEDVSKVTASDSEAKPARRSVKKALGQKADVKKTSVVVSVKKGSWAANDADAKKHSAKKFDENKKGSGGSSSRQMEDKKKGGRGKANSEADVAKSSAIDVDKEMVSSPTSGTKSTKDGKSEETPKTNLKRERTPGKENESGVKEYGENLVGLRVKVWWPKDREFYIGVIDSFDSARKKHKVLYDDGDEETLNLVKEKWKVIEADSDADEEERSDCADLDVSTDMPLKKKGKTSAGESTKQGKMDVSSKSSGAAASNRSKGASTKSSQKSKDGNKSKDSKANSKSEDGVNRKSKDSTPKNGSSKSIVAAKKMSNKSKNTDTSKTSESKDDGSIKQKPSAKFKHETPKSGKSKQETPKAAISKGKPVKSGGKTDVNGTSKARSGLLKRKDSENENSDVSAGEREDAKGKSANSSKAKGSELKSGKKRRKT

SEQ ID NO: 7376 - protein, 919 aa, Glycine max
MAGADKELEEQLLEAGNKLVDPPSSVEDLLALLEQVESCLSRVEQSPTDSMQNALSPSLKALIADKLLRHSDDDVKIAVASCISEITRITAPEAPYDDDQMKEVFQLIVSSFENLHDKLSRSYSKMISILDTVAKVRSCVVMLDLECDALILEMFQHFLKAIREHHPENVFSSMETIMTLVLEESEDISLDLLSPLLGSIKKDNEVVEVFPIAQKLGERVLESCATKLKPYLVQAVKSLGISVDDYSAVLASICQDVSDDLEKNDTCVTSEHVEDKSESAKQSLEESTHFDQVVKKDSREVTSSQQENPDDVNKSPKSVMSNVVACVEDNALAHSESIKKQEDADCSNHSEGLNTSGNEVNNDLDIEKVDNSKQKTEKATKKPRKKSSSSIKLTKPSKGQVAANEKETEKMLDCESNSKIVHSSPPEDHSVEAAGPSENDKGIDAKISSPMACNDDSEVVASPPSESLCDENHSKKLGRTKKKDGPVKEGTAEDVSKVTASDSEAKPARRSVKKALGQKADVKKTSVVVSVKKGSWAANDADAKKHSAKKFDENKKGSGGSSSRQMEDKKKGGRGKANSEADVAKSSAIDVDKEMVSSPTSGTKSTKDGKSEETPKTNLKRERTPGKENESGVKEYGENLVGLRVKVWWPKDREFYIGVIDSFDSARKKHKVLYDDGDEETLNLVKEKWKVIEADSDADEEERSDCADLDVSTDMPLKKKGKTSAGESTKQGKMDVSSKSSGAAASNRSKGASTKSSQKSKDGNKSKDSKANSKSEDGVNRKSKDSTPKNGSSKSIVAAKKMSNKSKNTDTSKTSESKDDGSIKQKPSAKFKHETPKSGKSKQETPKAAISKGKPVKSGGKTDVNGTSKARSGLLKRKDSENENSDVSAGEREDAKGKSANSSKAKGSELKSGKKRRKT

SEQ ID NO: 7377 - protein, 898 aa, Glycine max
MTMGSTDKELEEQLLDAGNKLLLDPPSSAEELLPLLDQVECCLSRVEQSPIDSMQNALSPSLKALIADKLLSHSDDDVKVAVASCISEITRITAPEAPYDDAQMKDVFQLIVSSFENLHDKLSQSYAKRTSILETVAKVRSCVVMLDLECDTLILEMFQHFFKNIREHHPENVFSSMETIMTLVLEESEDISLDLLSPLLTSIKKDNKEVFPIAQKLGERVIESCATKLKPYLVQAVKSLGISVDDYSSVLASICQDTSDDLEKNDTCVTSEHVEDKSDSAKQSLEESTHVVNKDSSEVTPSQPENTDVKISPKLVMSNGVVEDNVLADSKSIKKQEDADCSSHSEGLNLSGHEVHNDLDTEKVDTSKQKPEQATKRQRKKSSSSTKSAKPSKGQVAANEKETEKMLDFESNSKKVPSSSHEDHSAEAAGPPENDNGIDAKISSPKACNDESEVVASPPSESFSDENHSKKIGRTKKKDGDAEGVSKVSEGASDSEAKPVRRSVKRALGQKSDAKKTNVVDSVKKGSGTANDADAKKHPAKKLDENKKDRDGSSSRQMEDKKKGRWGKANSEANVVKSSAMDVDKEMVSSLRSGTKSTKNENSEETPKTNVKRKRSSGKENESNAKEYGQNLVGLRVKVWWPDDREFYRGVVDSFDSAKKKHKVLYDDGDEETLNLVKEKWKVIGADDSDADEEERSDRASLDASTDMPPKKKGKTSAVESTKQGKMDASSRSGGASASNRSKGASTKSGLKSKDGNKSKDSKTISKPEDAVSRKSKASIPKSGSSKSIVTAKKIGNKSKNTDNSIESKDDDTSTPKPSAKSKQETPKSGKSKQETPKSGKFKQETPKSGKSKQETLKTALSKVKPLKSGGKTDVNGKNKVKSGSSKRKYSENEYSDV

SEQ ID NO: 7378 - protein, 443 aa, Glycine max; identical to SEQ ID NO: 6731

SEQ ID NO: 7379 - protein, 482 aa, Glycine max; identical to SEQ ID NO: 6770

SEQ ID NO: 7380 - protein, 597 aa, Glycine max
MTLTNMAHNNINSTTMDGVPHRVNSPRYTGSMTRRAHSFKRNNNSNNEIELQINSPRSPLVSAEGSVLKRNQHHHKEKKNKFGHWVFLLFCGVCLFLGLLKICASAWWFGSKVHSTHESIIQELSDSITSRNLMDQSSHGYAYREGANEVERTLKMVTTGVIDSQAGMAEESGVWSRPNYDNFTQCIDLPRNHKKLDEKTNGYILVNANGGLNQMRFGICDMVAVAKIMKATLVLPSLDHTSYWGDASGFKDLFDWKHFIETLKDDIHVVETLPPAYAEIEPFSKTPISWSKASYYKNEVLPLLKQHKVIYFTHTNSRLANNGIPSSIQKLRCRVNYRALKYSAPIEEFGSKLISRMRQNENPYLALHLRYEKDMLAFTGCSHNLTAEEDEELRQMRYEVGHWKEKEINGTERRLTGGCPLTPRETSLLLRALGFPSQTRIYLVAGEAYGRGSMKYLEDAFPNIFSHSSLSSEEELNPFKNHQNMLAGIDYIVALQSDVFLYTYDGNMAKAVQGHRHFENFKKTINPDKVNFVKLVDKLDEGKISWKKFSSKVKRLHEDRIGAPYPRERGEFPKLEESFYANPLPGCICERKLDTSQ

SEQ ID NO: 7381 - protein, 628 aa, Glycine max
MAIFSESNHHHNTSDGVSQRVNSPRFSGPMTRRAHSFKRNNSSNNSNNTATTTSHGGGGGSGGVEIELQINSPRSEEASEGVPVGKHSHHHVTQRVHVRGLLKKPLASIVEDLGLRERKKIGHWMFLVFCGVCLFMGVLKICATGWLGSAIEITQSNKELSDSIPSLTLMDKSSLGYAYRGGASDVERTLKTVATGVDGSHTAMTEDSGIWSKPNSDNFTKCIDLPSNHKKLDAKTNGYIFVNANGGLNQMRFGICDMVAVAKIVKATLVLPSLDHTSYWADDSGFKDLFDWKHFINMLKDDVHIVEKLPPAYAGIEPFPKTPISWSKVHYYKTEVLPLLKQHKVMYFTHTDSRLDNNDIPRSIQKLRCRVNYRALKYSAPIEELGNTLVSRMQQNGNPYLALHLRYEKDMLAFTGCSHNLTAEEDEEMRQMRYEVSHWKEKEINGTERRLLGGCPLTPRETSLLLRALGFPSHTRIFLVAGEAYGRGSMKYLEDDFPNIFSHSSLSSEEELNPFKNHQNMLAGLDYVVALKSDVFLYTYDGNMAKAVQGHRRFEDFKKTINPDKMNFVKLVDQLDEGKISWKKFSSKVKKLHTDRIGAPYPREPGEFPKLEESFYANPLPGCICETR

SEQ ID NO: 7382 - protein, 626 aa, Glycine max
MAIFSESNHHHNTSDGVSQRVNSPRFSGPMTRRAHSFKRNNNNIAANTAATTSHGGAGGSGAGEVELQINSPRSEEASEGVPVGKHSHHHVTQRVHVRGLLKKPLASIVEDLGLRERKKIGHWMFLVFCGVCLFMGVLKICATGWLGSAIERTQSNKELSDSIASLNLMDKSSLGYAYRGGASDVERTLKTVATGDGSHTAMTEDSGIWSKPNSDNFTKCIDLPSNHKKLDAKTNGYILVNANGGLNQMRFGICDMVAVAKIMKATLVLPSLDHTSYWADDSGFKDLFDWKHFINMLKNDVHIVEKLPPAYAGIEPFPKTPISWSKVPYYKTEVLPLLKQHKVMYFTHTDSRLDNNDIPRSIQKLRCRANYRALKYSAPVEELGNTLVSRMQQNGNPYLALHLRYEKDMLAFTGCSHNLTAEEDEELRQMRYEVGHWKEKEINGTERRLLGGCPLTPRETSLLLRALDFPSHTRIYLVAGEAYGRGSMKYLEDDFPNIFSHSSLSSEEELNSFKNHQNMLAGIDYVVALKSDVFLYTYDGNMAKAVQGHRRFENFMKTINPDKMNFVKLVDQLDEGKISWKKFSSKVKKLHTDRIGAPYPRETGEFPKLEESFYANPLPGCICETR

SEQ ID NO: 7383 - protein, 634 aa, Vitis vinifera
MGFHHNASDGVSQRVNSPRFSGPMTRRAHSFKRGNSSGNAHNNGSSKGGGGFDPHYEIDVHLNSPRSEICGSPVSGDGFDVVLERKQTHHVNQRVHGGVLKNQPKKHVGSAVLDLGLRERKKLGHWMFFVFCGVCLFLGVLKICATGWFGSAIDRIGSHQDFSDPLNTHLNEMDKSSHDYVYREGGSDVERTLMMVASGVVNRQKSMAENSDIWSKPNSENFTQCVNQPRIHKKLDAKTNGYIIINANGGLNQMRFGICDMVAIAKVMKATLVLPSLDHTSYWADDSDFKDLFDWQHFIKALKDDVHIVETLPPDYAGIEPFTKTPISWSKVSYYKTEILPLLKQYKVIYFTHTDSRLANNGIPSSIQKLRCRVNYKALKYSSLIEELGNTLVSRMREGGNPYIALHLRYEKDMLSFTGCSHNLTAAEDEELRTMRYEVSHWKEKEINGTERRLLGGCPLTPRETSLLLKGLGFPSSTRIYLVAGEAYGKGSMQYLMNDFPNIFSHSTLSTEEELSPFKDHQNRLAGLDYVVALQSDVFVYTYDGNMAKAVQGHRRFENFKKTISPEKMNFVKLVDDLDEGKITWKKFSSKVKKLHKDRAGAPYLREPGEFPKLEESFYANPLPGCICETTPQK

SEQ ID NO: 7384 - protein, 653 aa, Arabidopsis lyrata subsp. lyrata
MGHHHDGGDGVPQHHVNSPRFSGPMTRRAQSFKRGGSGGSSSNTHVGDGNNTSTLRVHHEIDLPLNSPRSEIVSGSSGSDPSGGFDSALNRKHQTYGQLRERVVKGLLRKPMGSVVSDFSLRERKKLGHWMFFAFCGVCLFLGVFKICATGWLGSAIDGAASHQDLSNSIPRVNLLDHSSHDYIYKDGGNDVDPTLVMVASDVVGDQNSVVEYSGVWAKPESGNFSQCIDSPRSRKKLGVNTNGYLLINANGGLNQMRFGICDMVAVAKIMKATLVLPSLDHSSYWADDSGFKDLFDWQHFIEELKDDIHIVEMLPSELAGIEPFVKTPISWSKVGYYKREVLPLLKQHIVMYLTHTDSRLANNDLPDSVQKLRCRVNYRALKYSAPIEELGNVLVSRMRQNRGPYLALHLRQMQDQFELVWYEKDMLAFTGCSHSLTAEEDEELRQMRYEVSHWKEKEINGTERRLQGGCPLTPRETSLLLRALEFPSSSRIYLVAGEAYGNGSMDPLNTDFPNIFSHSILATKEELSPFNNHQNMLAGLDYIVALQSEVFLYTYDGNMAKAVQGHRRFEDFKKTINPDKMNFVKLVDALDEGRISWKKFSSKVKKLHKDRNGAPYNREPGEFPKLEESFYSNPLPGCICENTEEEGVMRRT

SEQ ID NO: 7385 - protein, 684 aa, Ricinus communis
MGHHHNTSSSDGVSQRVNSPRFSGPMTRRAPSFKRHTTTTTATSTTNGSNTHINISNNQSDNNSHEIDLQQLNSPRSESIEVFERQQNYSQYVTQRVHGGVVKNFLNKKGVGGGIGSVVVELGFRDRKNLGQLMFFLFCGLCLFLGVFKICANGWFGSALEKAAANSNQDLPDFTTQVHDKYQNSQDSDTYGHGMEVTYEEQDITTVLSGVVGDFSGIWSRPNSENFTQCIDQSRSRKKLDAKTNGYILINANGGLNQMRFGICDMVAVAKIMKATLVLPSLDHTSYWADESGFKDLFNWQYFIDTLKNDIHIVETLPPEYAGIEPLTKTPISWSKVSYYKTEVLPLLKQHKVIYFTHTDSRLANNGLPDSIQRLRCRVNYRALKYSEPIEELGNILISRMRQNGSPYLALHLRYEKDMLAFTGCSHNLTAEEDEELRKMRYEVSHWKEKEINGTERRLLGGCPLTPRETSLLLKGMGFPLDTRIYLVAGEAYGNGSMQYLLDEFPYIFSHSSLSTEQELNPFKKHQNMLAGLDYVIALQSDVFVFTYDGNMAKAVQGHRRFEDFKKTINPDKMNFVKLVDELDEGKISWESFSSKVKELHKDRVGAPYLREPGEFPKLEESFYANPLPGCICETTEEKCKLDAYIKQHAAFLPGLLSQKGANSIIQSQVAIGLLVEGASACIR

SEQ ID NO: 7386 - protein, 652 aa, Arabidopsis thaliana
MGHHHDGGDGVPQHHVNSPRFSGPMTRRAQSFKRGGSAGSSSNNNNTHVGVSGGDGNNNNNTSSTLRVHHEIDLPLNSPRSEIVSGSSGSDPSGGFDSALNRKHQTYGQLRERVVKGLLRKPMGSVVSDFSLRERKKLGHWMFFAFCGVCLFLGVFKICATGWLGSAIDGAASDQDLSIPRVNLLDHSSHDYIYKDGGNDVDPTLVMVASDVVGDQNSVVEFSGVWAKPESGNFSRCIDSSRSRKKLGANTNGYLLINANGGLNQMRFGICDMVAVAKIMKATLVLPSLDHSSYWADDSGFKDLFDWQHFIEELKDDIHIVEMLPSELAGIEPFVKTPISWSKVGYYKKEVLPLLKQHIVMYLTHTDSRLANNDLPDSVQKLRCRVNYRALKYSAPIEELGNVLVSRMRQDRGPYLALHLRYEKDMLAFTGCSHSLTAEEDEELRQMRYEVSHWKEKEINGTERRLQGGCPLTPRETSLLLRALEFPSSSRIYLVAGEAYGNGSMDPLNTDFPNIFSHSILATKEELSPFNNHQNMLAGLDYIVALQSEVFLYTYDGNMAKAVQGHRRFEDFKKTINPDKMNFVKLVDALDEGRISWKKFSSKVKKLHKDRNGAPYNRESGEFPKLEESFYANPLPGCICENTEEEGLMRRT

SEQ ID NO: 7387 - protein, 648 aa, Populus trichocarpa
MAHHSHHHNHNSASDGVSQRVNSPRFSGPMTRRAHSFKRNNTSSNNNSNAGNANSSNNGSNNVSNGNSNNSILSPHLEIDLPLNSPRSETVDGFERESHSRQNLSQRVHGGVVRILTNKKGSIGSVILDFGFKERKKLGHWMFFFFCGLCLFLGVFKICLYGWFGSTLERAASNQVLHLIDVFGSITRQEQDSYRYMGSENDQKRMIIEVGSDVVDRLNKKAEFSGIWSKPNSENFTQCIDQPGNHKKLGARTNGYILINANGGLNQMRFGICDMVAVAKIMKATLVLPSLDHTSYWADDSGFKDLFNWQHFIDTLKDDVHIVEKLPPAYDGIEPFNKTLISWSKVHYYKTEVLPLLKQHKVIYFTHTDSRLANNGLSDSIQKLRCRANYRALKYSKPIEELGNTLVSRMRENGSRYLALHLRYEKDMLAFTGCSHNLTAAEDEELLRMRYEVSHWKEKEINGTERRLLGNCPLTPRETSLLLKGLGFPSSSRIYLVAGEAYGTGSMQYLLDDFPNIFSHSTLSTEEELNPFKDHQNMLAGLDYLVALQSDVFVYTYDGNMAKAVQGHRRFEEFKKTINPDKMNFVKLVDELDEGKISWKKFSSKVQKLHKDRIGVPYAREPGEFPKLEESFFANPLPGCICETAQEK

SEQ ID NO: 7388 - protein, 603 aa, Glycine max
MGTSPSREGLEVTDSDSDYEHEEEETEHYEHAKTHSTELDDLDAKLKALKLKYQTPSSSSSKSLPQNAVKLYLHIGATTPNAKWILSDKRTSYAFLKDSDDENDAVWFLTVGSKVRARVSSEMQLKMFGDQRRVDFVADGVWALKFPSDDTYRRFVTEFQNCVFENVYGIECTEENKVKIFGKEFIGWVKPEAADDSVWEDAFAADPSPSRRRDDLMEEFEEAANGGVQTLTLGALDNSFMVNDAGVHVYRNFNRGIHGKGVAVKFAGGDATPNKALLMRAETNMMLMSPLKDGKPHASKLHQLDIETGKIVTEWKFGKDGVDLTMRDITNDTKGSQLDPSESTFLGLDDNRLCQWDMRDRKGIVQNIATASSSPVLHWSQGHQFSAGSNFQSFATTGDGSIVVGSLDGKIRLYSKTSMRMAKTAFPGLCSPITSVDVTYDGKWVLGTTDTYLVLICTLFTDKDGMTKTGFSGRMGNRIPAPRLLKLTPLDSHLAGANNKFHSGHFSWVTENGKQERHLVATVGKFSVIWDFQRVKNSAHECYRNQEGLKSCYCYKIVLKDESIVESRFMHDKFAVSDSPEAPLVVATPMKVSSISLSGKRHG

SEQ ID NO: 7389 - protein, 607 aa, Glycine max
MGTSQSREGLEVTDSDSDYENEEETEHYEDAKTTHSTELDDVDAKLKALKLKYQTPSSSAKPLPQNAVKLYLHIGGNTPNAKWILSDKHTSYAFHKDTDENENDDVWLLTVGSKVRARVSSEMQLKMFGDQRRVDFVADGVWALKFPSDDTYRRFVTEFQSCMFENVYGIECTEENKVKIYGKEFIGWVKPEAADDSVWEDAVSGEPSPSPSPSRRRNDLMEEFEEAANGGVQTLTLGALDNSFMVNDTGVHVYRNFDRGIHGKGVAVKFAGDGSTPNKALLMRAETNMMLMSPLNDGKPHASKLHQLDIETGKIVTEWKFGKDGADLTMRDITNDTKGSQLDPSESTFLGLDDNRLCQWDMRDRKGIVQNIATASSSPVLHWSQGHQFSRGTNFQCFATTGDGSIVVGSLDGKIRLYSKTSMRMAKTAFPGLGSPITSVDVTYDGKWVLGTTDTYLVLICTLFTDKDGRTKTGFSGRMGNRIPAPRLLKLTPLDSHLAGANNKFHGGHFSWVTENGKQERHLVATVGKFSVIWDFQQVKNSAHECYRNQEGLKSCYCYKIILKDESIVESRFMHDKFAVSDSPEAPLVVATPMKVSSISMSGKRHG

SEQ ID NO: 7390 - protein, 627 aa, Medicago truncatula
MGTSQSREGREFSDSDSDYDEQEPEQEEDQDQYQDAQSSSQSHSTNLDDVDAKLSALKLKYSSPSKSQSETKTPLPKNAVKLYLHIGGNTPNAKWILSDKRTSYAFVKNYEDEEEDEQNDVAQGQWILKVGSKIRARVSTELQLKMFGDQRRVDFVSNGVWALKFPTDESYRKFVTEFQNCTFENVYGLSPTEENKVKVYGKEFIGWVKPEAADDSVWEDAVSDDGSGKSPEPYRSRGDLMEEFEEAANGGIQTLTLGALDNSFLLNDAGFQVYRNFDRGIRKGVAVKYGGNLQQETPNKALLMRAETNMMLMSPMNSGMPHASKLNQLDIETGKIVTEWKFEKDGADITMRDITNDTKGSQLDPSESTFLGLDDNRLCQWDMRDRKGIVQNIATANSPVLHWNQGHQFSRGTNFQCFATTGDGSIVVGSLDGKIRLYSNKSMRMAKTAFPGLGSPITSVDVTFDGKWVLGTTDTYLVLICTLFTDKDGKTKTGFGGRMGNRIGAPRLLKLTPLDSHLAGTTNKFHGGHFSWVTENGKQERHLVATVGKFSVIWDFQQVKNSAHECYRNQQGLKSCYCYKIVLKDESIIESRFMHDNYAVSDSPEAPLVVATPMKVSSISMSGKRTR

SEQ ID NO: 7391 - protein, 639 aa, Ricinus communis
MGTAQSREGQDLTDSESEYQSEEEEEEGQYDDAVDRQETPQSTTSTPSSRKALEEIDTKLKSLKLKYPSSANSNSKNPLPNNPVKLYLHIGGNTPNAKWVLSDKLTSYNFIKSCNADGPDSDDDDDDQDNDSFWVLKVASKVRAKVSTEIQLKMFGDQKRVDFVNKGVWALKFFTDEEYRKFITQFQDCIFENVYGLEATEENKIKIYGKDFIGWVKPEIADDTMWEDAMDDHESAKTTPLRVNQDLMEEFEEAANGGVQSLTLGALDNSFLVNDLGVQVFRNYHKGIHGKGICVNFDKTSGGSLMQSTPKKAMLMRAETNMMLMSPLKEGKPHSSGIKQLDIETGKIVAQWKFGKDGTEITMKDITNDTKGSQLDPSESTFLGLDDNRLCQWDMRDKRGVVQSIGDDSPVLNWSQGHQFSRGTNFQCFASTGDGSIVVGSLDGKIRLYSRTSMRQAKTAFPGLGSPITHVDVTYDGKWILGTTDTYLILICTLFTDKDGKTKTGFSGRMGNKIPAPRLLKLIPLDSHLAGVNNKFHGGHFSWVTENGKQERHLVATVGKFSVIWDFQQVKNSAHECYRNQQGLKSCYCYKIVLKDESIVESRFMHDNYAVSGSPEAPLVVATPMKVSSISLSGKRSHA

SEQ ID NO: 7392 - protein, 635 aa, Populus trichocarpa
MGTSQSREGQEFSDTESEYQSEEEEVEEEEEEFHYDAVERQETPQATSSSKKTLDEIDSKLKSLKLKYPSNSQTTLNTVKLYLHIGGDSPNAKWILSDKLTSYKFIKTNGPDDSDSDHDDKEGDGNSFWVLKVGSKVKARISTEMQLKMFGDQRRVDFVNNGVWALRFFSDEEYRKFLSLFQDCLFENVHGLNATEENKLKIYSKEFIGWLKPEIADDSMWEDAVEEKEEEPVRVNQDLLEEFEEAANGGVQSLSLGALDNSFLVNDLGVQVLRNYNKGIYGKGICVKFDSNRSEGSSLEQSTPKKAMLMRAETNMMLMSPLKEGKPHSTGIKHLDIETGKIVTEWKFEKDGTEITMRDITNDTKGSQLDPSESTFLGLDDNRLCQWDMRDRRGIVQDIVKGGDSPVLNWSQGHQFSRGTNFQCFASTGDGSIVVGSRDGKIRLYSKTSMRQAKTAFPGLGSPITHVDVTYDGKWVLGTTDTYLILICTLFTDKDGKTKTGFGGRMGNKIPAPRLLKLTPLDSHLAGANNKFHGGHFSWVTENGKQERHLVVTVGKFSVIWDFQRVKNSGHDCYRNQHGLKSCYCYKIVLKDESIVESRFMHENYAVSDSPEAPLVVATPMKVSSISLSGKRSRG

SEQ ID NO: 7393 - protein, 639 aa, Solanum lycopersicum
MGASHSREGLELSDESDYEDEEGSSRTESEEQYEDAADDHASMRTPQVSNRNLDELDSKLKALKLKYGSPVTPTNLRNAVKLYLHVGGNTPKAKWIISQKLTNYEFVKTLKIGGDDEDDYGSSSGGDEGFWVLKVGKKIKVRVSTDMQLKMFGDQRRIDFVDNGVWALKFFVDDEYRNFITKFQDCLFENVYGMEATEANKVKIYGKEFIGWLKPEESDDAMWEDADSGVWKGSGKSPMTPARDRQDLLEEFEEAATGGGIQSLALGALDNSFLVNDSGVQVVKNFSHGIHGKGVYVKFDEKDKWSGGSTPKKALLMRGETNMMLMSPFKEGKPRSTGLHQLDIETGKVVTEWKFEKDGTDITMKDITNDTKGSQLDPSESTLLGLDDNRLCQWDMRDKKGIVQTLANTSSPVLNWTQGHQFSRGTNFQCFATTGDGSIVVGSLDGKIRLYSKTSMRQAKTAFPGLGSPITHVDVTYDGKWILGTTDTYLILICTLFTDKAGKTKTGFTGRMGNKIPAPRLLKLTPVDAHIAGANNEFHGGHFSWVTESGKQERHLVAAVGKFSVIWNFQQVKDSAHRCYQNQQGLKSCYCYKIVPKDESIIESRFMHDKYAVSDSPEAPLVVATPMKVTSISMSGKRR

SEQ ID NO: 7394 - protein, 639 aa, Solanum lycopersicum
MGASHSREGLELSDESDYEDEEGSSRTESEEQYEDAADDHASMRTPQVSNRNLDELDSKLKALKLKYGSPVTPTNLRNAVKLYLHVGGNTPKAKWIISQKLTNYEFVKTLKIGGDDEDDYGSSSGGDEGFWVLKVGKKIKVRVSTDMQLKMFGDQRRVDFVDNGVWALKFFVDDEYRNFITKFQDCLFENVYGMEATEANKVKIYGKEFIGWLKPEESDDAMWEDADSGVWKGSGKSPMTPARDRQDLLEEFEEAATGGGIQSLALGALDNSFLVNDSGVQVVKNFSHGIHGKGVYVKFDEKDKWSGGSTPKKALLMRGETNMMLMSPFKEGKPRSTGLHQLDIETGKVVTEWKFEKNGTDITMKDITNDTKGSQLDPSESTLLGLDDNRLCQWDMRDKKGIVQTLANTSSPVLNWTQGHQFSRGTNFQCFATTGDGSIVVGSLDGKIRLYSKTSMRQAKTAFPGLGSPITHVDVTYDGKWILGTTDTYLILICTLFTDKAGKTKTGFTGRMGNKIPAPRLLKLTPVDAHIAGANNEFHGGHFSWVTESGKQERHLVAAVGKFSVIWNFQQVKDSAHRCYQNQQGLKSCYCYKIVPKDESIIESRFMHDKYAVSDSPEAPLVVATPMKVTSISMSGKRR

SEQ ID NO: 7395 - protein, 648 aa, Arabidopsis thaliana
MGTSQSREDRISESDTESDSDYYEEEDEDQYDDAKKQGSSSVSGTRPSDSSSSSGPTDSSSLDIEQKLKALKLKYPSSSSVTPKMKNAVKLYRHIGGNTPKAKWIVSDKMTSYKFVKTSSVDGEDIDDYDDCEESGEGGESFWFLGVGTKVKARVSTDMQLKMFGDQRRVDFVSNGVWALKFLTDEDYRKFVTRFQDYLFENVYKIRASEENRVKVYGKDFIGWANPEAADDSMWEDAEAPPEEEETQGKRNTDLTEEFEEVANGGVQSLTLGALDNSFLVNDYGVQVYRNMERGIHGKGVCVRFDSGNSKFGSGSSQTTPNKALLMRAETNMMLMSPAKQGKPNSTGVKQLDIESGKIVTEWKFEKDGTEITMRDITNDTKGSQLDPSESTFLGLDDNRLCQWDMRDRRGIVQNIDSPILEWTQGHQFSRGTNFQCFATTGDGSIVVGSLDGKIRLYSKTSMRMAKTAFPGLGSPITHVDVSYDGKWILGTTDTYLVLICTLFTDKNGLTKTGFSGRMGNKIPAPRLLKLTPLDSHLAGKDNKFHGGHFSWVTESGKQERHIVATVGKFSVIWDLERVKNSAHECYRNQQGLKSCYCYKILLKDESIVESRFMHDNFSFSGNKSPEAPLVVATPLKVSSISLSGKRL

SEQ ID NO: 7396 - protein, 647 aa, Arabidopsis lyrata subsp. lyrata
MGTSQSREDRITESDTDSDSDYYDEEDEDQYDDAKKQGSSSVSGSGPSDSSSSGPSDSSSLDIEEKLKALKLKYPSSSSVTLKMKNAVKLYRHIGGNTPKAKWIITDKMTSYKFVKTSTADGEDIGDYDDCEESGEGGESFWFLGVGTKVKARVSTDMQLKMFGDQRRVDFVSNGVWALKFLTDEDYRKFVTRFQDYLFENVYKIRASEENRIKVYGKDFIGWANPEAADDSMWEDAEAPPEEEETQAKRNTDLTEEFEEVANGGVQSLTLGALDNSFLVNDYGVQVYRNMERGIHGKGVCVRFDSGTSKFGSGSSQTTPNKALLMRAETNMMLISPAKQGKPNSTGVKQLDIESGKIVTEWKFEKDGTEITMRDITNDTKGSQLDPSESTFLGLDDNRLCQWDMRDRRGIVQNIESPILEWTQGHQFSRGTNFQCFATTGDGSIVVGSLDGKIRLYSKTSMRMAKTAFPGLGSPITHLDVSYDGKWILGTTDTYLVLICTLFTDKDGRTKTGFSGRMGNKIPAPRLLKLTPLDSHLAGKDNKFHGGHFSWVSESGKQERHIVATVGKFSVIWDLERVKNSAHDCYRNQQGLKSCYCYKILLKDESIVESRFMHDNFSFSGNKSPEAPLVVATPLKVSSISLSGKRL

SEQ ID NO: 7397 - protein, 572 aa, Vitis vinifera
MGGSHSREGLDLSDSSDDEVEEEEEEQYDDLKDLKLKYPSQSPDLPNAVKLYLHIGGNAPKAKWIVSEKIAFYSLVGSKIRARVSTEMQIKMFGEQRRVDFVCKGVWAMKFFRDGDYRSFVTRFQDCLFENVYGVKATEENKVKVYGKDFIGWLKPEVADDSMWEDAEEGPWKSPQARSTNDLMEEFEEAATNGGIQSLALGALDNSFLVGDSGVQVVKNFSHGIHGKGVHVKFDNGGYKGGATPKKGLLMKAETNMLLMSPLKDGKPHATGLHQLDIETGKIVTEWKFEKDGTDITMRDVTNDAKGSQLDPSQSTFLGLDDNRLCQWDMREKRGMVQNITTASSPVLHWTQGHQFSRGTNFQCFATTGDGSIVVGSLDGKIRLYSRTSMRQAKTAFPGLGSPITHVDVTYDGKWILGTADTFLILICTSFTDKDGKTKTGFSGRMGNKIPAPRLLKLTPVDSHMAGVDNKFHGGQFSWVTENGKQERHLVATVGKFSVIWNFQQVKNSSHECYQNQQGLKSCYCYKIVLKDESIVESRFMHDKFAVSDSPEAPLVVATPLKVSSFSISNKR

SEQ ID NO: 7398 - protein, 397 aa, Glycine max
MEEPVKEQPLSAGNSARPKLQRYALRSSSKSKENKQDTAPDLSISSESKRGLSTPHVSRSVGGLDFSGNKDKSTSAKPPRRLSNPVKAASPTPNPKLVGNITPISESRTMRSGKGQVSQSRSQTPASDISRTSSRMKFNLLSSSSYWLNQIKLSESADKHTVSLGFFKLASEARCEPFQKMKDELKSYVQRHQLAELGEVKELLQTYDIAENIEQPQVSESISQVPEEGTRSSDDEEVHCSSASTMETVKLKPEPLDTESTEPAPVIIESTKKETSQKKNPLDTESTQPTPVKIESIKKESSQKNNPGSRLRENLKKNSANSRPASDNGSSRLFKKPEKPTKQLTNKGKSEVKKEGKKSDVIKAPISPTHAENNNAQGNKENMDVQTTDEMSLTEIA

SEQ ID NO: 7399 - protein, 371 aa, Glycine max
MEEPVKEQQPLSAGNSARPKLQRYALRSSSKSKENKPDAPDRSISSESKRGRGLSTPRLSRSVCGLDFSGNKDKSTSAKPPRRLSNPVKASPTPNLKLVGNITPISESRTMRSGNVQGSQSRSQTPASEISRTSSRMKFNLLSSSSYWLNQIKLSESADKHSVSLGFFKLASEARCEPFQKMKDELKSYVQRHQLAELGEVKELLQSYDIAENIEQPQVSESITQVPEEGTGSSDDEEVHCSSSSTMDTAKLKPEPLDTESTEPAPVKIESTKKETSQKNNHPGSRLRENLKNSANSRPASDSGSSRLVKKSEKPTTQQTNKEKSEVKKQGKKSDVIKAPISPTHAEDNAQGNKENMDVQTPDEMILTEVA

SEQ ID NO: 7400 - protein, 397 aa, Glycine max; identical to SEQ ID NO: 7398

SEQ ID NO: 7401 - protein, 660 aa, Glycine max
MVTENCLYQLGLNCSLLEEVDLTDCFGIDDIALRYLSRCSELVRLKLGLCTNISDIGLAHIAYNCPKMTELDLYRCVRIGDDGLAALTSGCKGLTNLNLSYCNRITYRGLKYICHLGELSDLELCGLSNITSVEEKRVCLDMEGDEHMNEVPSENSNLGSDSLEKENILEDEKEDLQDGLKLKVVTEEVSGGLLAENGCISLEDGSLKRSLETVGTSVSGAKRARITVDEYQPSVHFTYNSLTRASRQKLQELLQKWSAWHAKHVSSSSDASEVLESGEETFFPALHVGLEKTSAVSFWMENQTRNDKNKDFIPLADNTVPLYDRGYALGLTSADGSSNVDGGLEIIDAAARCFNCGSYNHSLRECPRPRDNIAVNNARDKLKSRRNQNSSSRHPTRYYQNSPAGKYDGLRPGSLDDATRKLLGLRELDPPPWLNRMRELGYPPGYLDVDNEDQPSGITIFTDSEIADQEDGEIMEANASKPKRKKTVKFPGINAPIPEKADERLWGTRAGPSSSDISRNLSLPQHRSNYSTDYGSRGYHREHRLGDLRDEGPPGDPGHSSFMFSFHPRFGGHDSALRSPSMARSQSDRSRSPMHDEESSMPFSFHSLHYSSSERHFSPLDRDSGRLGSWTSESMYYDRDRVFSSRFMDRFDDRHYRSWR

SEQ ID NO: 7402 - protein, 267 aa, Medicago truncatula
MNRNHDPNPFEEEEVNPFSNGTGSKSRVPSVASEPLGFGQRHDATVDIPLETSNGDSKKKSQELAVWEADLKRREKDIKRREDSVAKAGVPVDDKNWPPFFPIIHHDIANEIPVHAQRLQYSAFASWLGIVLCLVFNVVAVIVCWIRGGGVKIFFLAVIYALLGIPLSYVLWYRPLYRAMRTDSALKFSWFFMFYLLHIAFCIFAAIAPPVVFHGKSLTGILAAIDVFSDHVLVGIFYLIGFGLFCLEALLSLWVIQRIYMFFRGHK

SEQ ID NO: 7403 - protein, 269 aa, Glycine max
MNRHHDPNPFEEEEVNPFSNGTTAPASKSRIPPLASESLGFGQRHDATVDIPLDTTNDSKKKGQELAAWEADLKRREKEIKRREEAVSRAGVPVDDKNWPPFFPIIHHDIANEIPVHAQRLQYLAFASWLGIVLCLGFNVVAVTVCWIRGGGVKIFFLAVIYALLGVPLSYVLWYRPLYRAMRTDSALKFGWFFMLYLLHIGFCIFAAIAPPIVFHGKSLTGILAAIDVFSDHVLVGIFYLIGFGMFCLEALLSFWVLQKIYMYFRGHK

SEQ ID NO: 7404 - protein, 269 aa, Glycine max
MNRHNDPNPFEEEEVNPFSNGGAAPASKSRIPPLASQPLGFGQRHDATVDIPLDTTNDSKKRGQELAAWEADLKRKEKEIKRREEAVSRAGVPVDDKNWPPIFPIIHHDIANEIPVHAQRLQYLAFASWLGIVLCLVFNVVAVTVCWIRGGGVKIFFLAVIYGLLGVPLSYVLWYRPLYRAMRTDSALKFGWFFMFYLLHIGFCIFAAIAPPIVFHGKSLTGILAAIDVFSDHVLVGIFYLIGFGMFCLEALLSLWVLQKIYMYFRGHK

SEQ ID NO: 7405 - protein, 271 aa, Nicotiana tabacum
MSRGNDPNPFDEEEPEVNPFSNGGSAPASKSRFPQMIASSLGFGQKHDATIDIPLDSTNGSNKKQKELANWEADLQRRERDIKRREDAVAGAGVPTDDRNWPPFFPIIHHDIANEIPAHSRKLQYLAFASWLGIVFCLAFNVLAVTICWIRGGGVKIFFLAIIYALMGCPLSYVLWYRPLYNAMRTDSALKFGWFFMFYLIHIGFCILAAIAPPIVFHGKSLTGILAAIDVFSDHVLVGIFYLIGFAFFCLEALLSLWVLQKVYMFFRGHK

SEQ ID NO: 7406 - protein, 272 aa, Ricinus communis
MSRFHNDPNPFDEEEVNPFSNGSTAPASKTRIPPLGPEPAGFGHNDATVDIPLDTMNDPKKKEKELASWEADLKRREKEIKRREDAVAKAGVPVDDKNWPPFFPIIHHDIANEIPIHAQRLQYLAFASWLGIVLCLVFNVIAVLVNWIRGGGVKIFLLASIYALSGIPMSYVLWYRPLYRAMRTDSALKFSWFFLFYLLHIGFCIFAAIAPPIVFHGKSLTGILPAVDVISHHLLVGIFYLVGFGLFCLESLLSLWVLQKVYMYFRGHKGDH

SEQ ID NO: 7407 - protein, 270 aa, Populus trichocarpa
MSRYNSDPNPFDEEEEVNPFSKGAVAPASKARIPPLGHEAMGFGHNDATVDIPLDTMNDSKKKGKDLASWEADLKRREKEIKRREDAVAKTGITPNDKNWPPFFPIIHHDIANEIPIHAQRIQYLAFASWLGIVLCLVFNVIAVTVCWIRGGGVKIFFLAIIYALMGCPLSYVLWYRPLYRAMRTDSALKFSWFFVFYLIHIGFCIFAAIAPPIVFHGKSLTGILPAVDVFSDHVLVGIFYLVGFGLFCLESLLSLWVLQKIYMYFRGNK

SEQ ID NO: 7408 - protein, 270 aa, Populus trichocarpa
MSRFNSDPNPFDEEEEVNPFSKGSSVPAVKARIPPLGHEPMGFGHNDATVDIPLDTMNDSKKKEKDLASWEADLKRREKEIKRREDAVAKTGITPDDKNWPPFFPIIHHDIANEIPIHAQRLQYLAFASWLGIVLCLVFNLIAVTVCWIRGGGVKIFFLAVIYVLMGCPLSYILWYRPLYRAMRTDSALKFGWFFLFYLIHIGFCIFAAIAPPIVFHGKSLTGILPAVDVISDHLLVGIFYLVGFGLFCLESLLSLWVLQKIYMYFRGHK

SEQ ID NO: 7409 - protein, 269 aa, Populus trichocarpa
MSRFNSDPNPFDEEEEVNPFSGSSVPAVKARIPPLGHEPMGFGHNDATVDIPLDTMNDSKKKEKDLASWEADLKRREKEIKRREDAVAKTGITPDDKNWPPFFPIIHHDIANEIPIHAQRLQYLAFASWLGIVLCLVFNLIAVTVCWIRGGGVKIFFLAVIYVLMGCPLSYILWYRPLYRAMRTDSALKFGWFFLFYLIHIGFCIFAAIAPPIVFHGKSLTGILPAVDVISDHLLVGIFYLVGFGLFCLESLLSLWVLQKIYMYFRGHK

SEQ ID NO: 7410 - protein, 269 aa, Vitis vinifera
MIRQNDPNPFDEEEVNPFSKVATAPGSRSRVPPAASANLGFNDKYDATVDIPLDTLNDSNKKEKELAAWEADLKRKEKDIKRREDAVSKKGIPTEDKNWPSFFPIIHNDIANEIPVDAQRLQYLAFASWLGIVLCLVFNIIAVTVCWIKGGGAKIFLLAIIYALVGCPLSYVLWYRPLYRAMRTNSALNFGWFFLVYAIHICFCIVAAIAPPIVFEGKSLTGILSAIDLFSDHVLVGIFYLIGFALFCLEMLLSLWVIQKVYLRFRGRK

SEQ ID NO: 7411 - protein, 264 aa, Arabidopsis lyrata subsp. lyrata
MNRHHDPNPFDEEEEIVNPFSKGGGRVPAASRPVEFGQSLDATVDIPLDNMNDSSQKQRKLADWEAELRKKEMDIKRREDAIAKSGVQIDDKNWPPFFPIIHHDIAKEIPVHAQKLQYLAFASWLGIVLCLVFNVIATMVCWIKGGGVKIFFLATIYALIGCPLSYVLWYRPLYRAMRTDSALKFGWFFFTYLIHIGFCIVAAIAPPIFFHGKSLTGVLAAIDVISDSLLAGIFYFIGFGLFCLESLLSLWVLQKIYLYFRGNK

SEQ ID NO: 7412 - protein, 365 aa, Glycine max; identical to SEQ ID NO: 6729

SEQ ID NO: 7413 - protein, 365 aa, Glycine max; identical to SEQ ID NO: 6728

SEQ ID NO: 7414 - protein, 436 aa, Glycine max; identical to SEQ ID NO: 6730

SEQ ID NO: 7415 - protein, 443 aa, Glycine max; identical to SEQ ID NO: 6731

SEQ ID NO: 7416 - protein, 443 aa, Glycine max; identical to SEQ ID NO: 6732

SEQ ID NO: 7417 - protein, 460 aa, Medicago truncatula; identical to SEQ ID NO: 6733

SEQ ID NO: 7418 - protein, 390 aa, Glycine max; identical to SEQ ID NO: 6745

SEQ ID NO: 7419 - protein, 396 aa, Glycine max; identical to SEQ ID NO: 6744

SEQ ID NO: 7420 - protein, 187 aa, Glycine max; identical to SEQ ID NO: 6818

SEQ ID NO: 7421 - protein, 187 aa, Glycine max; identical to SEQ ID NO: 6819

SEQ ID NO: 7422 - protein, 187 aa, Glycine max; identical to SEQ ID NO: 6820

SEQ ID NO: 7423 - protein, 553 aa, Glycine max; identical to SEQ ID NO: 6765

SEQ ID NO: 7424 - protein, 542 aa, Glycine max; identical to SEQ ID NO: 6766

SEQ ID NO: 7425 - protein, 567 aa, Glycine max; identical to SEQ ID NO: 6767

SEQ ID NO: 7426 - protein, 342 aa, Glycine max; identical to SEQ ID NO: 6722

SEQ ID NO: 7427 - protein, 342 aa, Glycine max; identical to SEQ ID NO: 6723

SEQ ID NO: 7428 - protein, 359 aa, Glycine max; identical to SEQ ID NO: 6724

SEQ ID NO: 7429 - protein, 359 aa, Glycine max; identical to SEQ ID NO: 6725

SEQ ID NO: 7430 - protein, 542 aa, Glycine max; identical to SEQ ID NO: 6766

SEQ ID NO: 7431 - protein, 553 aa, Glycine max; identical to SEQ ID NO: 6765

SEQ ID NO: 7432 - protein, 202 aa, Glycine max
MGGAMKAAQNALRKLRRPHAGCANDCSTTITSLVEKGQWFDVVNADRIKSINDFANFFAYKLIPEYNIRVQVYDGTGNACFKLPYKDVKILLKISCKDIVLHIEGPYAQELPALLYDLNGLDLLFLVDTRIEGSATSSSNVSDHDGYSVSEICHEKEILRMLQRGEHYFQFDEGQAKRALCLSVKENKLKVTKQHHAPGCID

SEQ ID NO: 7433 - protein, 443 aa, Glycine max; identical to SEQ ID NO: 6731

SEQ ID NO: 7434 - protein, 436 aa, Glycine max; identical to SEQ ID NO: 6730

SEQ ID NO: 7435 - protein, 142 aa, Glycine max; identical to SEQ ID NO: 6777

SEQ ID NO: 7436 - protein, 146 aa, Glycine max; identical to SEQ ID NO: 6778

SEQ ID NO: 7437 - protein, 169 aa, Vitis vinifera; identical to SEQ ID NO: 6834

SEQ ID NO: 7438 - protein, 175 aa, Betula platyphylla; identical to SEQ ID NO: 6835

SEQ ID NO: 7439 - protein, 567 aa, Glycine max; identical to SEQ ID NO: 6767

SEQ ID NO: 7440 - protein, 482 aa, Glycine max; identical to SEQ ID NO: 6770

SEQ ID NO: 7441 - protein, 482 aa, Glycine max; identical to SEQ ID NO: 6771

SEQ ID NO: 7442 - protein, 397 aa, Glycine max; identical to SEQ ID NO: 6772

SEQ ID NO: 7443 - protein, 142 aa, Glycine max; identical to SEQ ID NO: 6777

SEQ ID NO: 7444 - protein, 210 aa, Glycine max; identical to SEQ ID NO: 6746

SEQ ID NO: 7445 - protein, 358 aa, Glycine max; identical to SEQ ID NO: 6747

SEQ ID NO: 7446 - protein, 373 aa, Glycine max; identical to SEQ ID NO: 6748

SEQ ID NO: 7447 - protein, 365 aa, Glycine max; identical to SEQ ID NO: 6729

SEQ ID NO: 7448 - protein, 390 aa, Glycine max; identical to SEQ ID NO: 6745

SEQ ID NO: 7449 - protein, 359 aa, Glycine max; identical to SEQ ID NO: 6724

SEQ ID NO: 7450 - protein, 443 aa, Glycine max; identical to SEQ ID NO: 6731

SEQ ID NO: 7451 - protein, 365 aa, Glycine max; identical to SEQ ID NO: 6728

SEQ ID NO: 7452 - protein, 436 aa, Glycine max; identical to SEQ ID NO: 6730

SEQ ID NO: 7453 - protein, 553 aa, Glycine max; identical to SEQ ID NO: 6765

SEQ ID NO: 7454 - protein, 342 aa, Glycine max; identical to SEQ ID NO: 6722

SEQ ID NO: 7455 - protein, 185 aa, Glycine max; identical to SEQ ID NO: 6860

SEQ ID NO: 7456 - protein, 190 aa, Glycine max; identical to SEQ ID NO: 6861

SEQ ID NO: 7457 - protein, 397 aa, Glycine max; identical to SEQ ID NO: 6772

SEQ ID NO: 7458 - protein, 373 aa, Glycine max; identical to SEQ ID NO: 6748

SEQ ID NO: 7459 - protein, 358 aa, Glycine max; identical to SEQ ID NO: 6747

SEQ ID NO: 7460 - protein, 415 aa, Glycine max; identical to SEQ ID NO: 6357

SEQ ID NO: 7461 - protein, 415 aa, Glycine max; identical to SEQ ID NO: 6357

SEQ ID NO: 7462 - protein, 441 aa, Glycine max; identical to SEQ ID NO: 6380

SEQ ID NO: 7463 - protein, 443 aa, Glycine max; identical to SEQ ID NO: 6381

SEQ ID NO: 7464 - protein, 439 aa, Cucumis melo subsp. melo; identical to SEQ ID NO: 6382

SEQ ID NO: 7465 - protein, 432 aa, Ricinus communis; identical to SEQ ID NO: 6383

SEQ ID NO: 7466 - protein, 440 aa, Vitis vinifera; identical to SEQ ID NO: 6384

SEQ ID NO: 7467 - protein, 438 aa, Arabidopsis lyrata subsp. lyrata; identical to SEQ ID NO: 6385

SEQ ID NO: 7468 - protein, 439 aa, Arabidopsis thaliana; identical to SEQ ID NO: 6386

SEQ ID NO: 7469 - protein, 439 aa, Arabidopsis thaliana; identical to SEQ ID NO: 6387

SEQ ID NO: 7470 - protein, 436 aa, Populus trichocarpa; identical to SEQ ID NO: 6388

SEQ ID NO: 7471 - protein, 436 aa, Populus trichocarpa; identical to SEQ ID NO: 6389

SEQ ID NO: 7472 - protein, 524 aa, Glycine max; identical to SEQ ID NO: 6326

SEQ ID NO: 7473 - protein, 492 aa, Glycine max; identical to SEQ ID NO: 6328

SEQ ID NO: 7474 - protein, 443 aa, Glycine max; identical to SEQ ID NO: 6381

SEQ ID NO: 7475 - protein, 441 aa, Glycine max; identical to SEQ ID NO: 6380

SEQ ID NO: 7476 - protein, 510 aa, Glycine max; identical to SEQ ID NO: 6339

SEQ ID NO: 7477 - protein, 510 aa, Glycine max; identical to SEQ ID NO: 6340

SEQ ID NO: 7478 - protein, 651 aa, Glycine max; identical to SEQ ID NO: 6789

SEQ ID NO: 7479 - protein, 652 aa, Glycine max; identical to SEQ ID NO: 6790

SEQ ID NO: 7480 - protein, 594 aa, Medicago truncatula; identical to SEQ ID NO: 6791

SEQ ID NO: 7481 - protein, 685 aa, Ricinus communis; identical to SEQ ID NO: 6792

SEQ ID NO: 7482 - protein, 647 aa, Vitis vinifera; identical to SEQ ID NO: 6793

SEQ ID NO: 7483 - protein, 674 aa, Vitis vinifera; identical to SEQ ID NO: 6794

SEQ ID NO: 7484 - protein, 662 aa, Vitis vinifera; identical to SEQ ID NO: 6795

SEQ ID NO: 7485 - protein, 673 aa, Vitis vinifera; identical to SEQ ID NO: 6796

SEQ ID NO: 7486 - protein, 674 aa, Vitis vinifera; identical to SEQ ID NO: 6797

SEQ ID NO: 7487 - protein, 673 aa, Vitis vinifera; identical to SEQ ID NO: 6798
  misc_feature (51)..(52): Xaa can be any naturally occurring amino acid
  misc_feature (79)..(79): Xaa can be any naturally occurring amino acid
  misc_feature (397)..(397): X can be Leucine or Isoleucine

SEQ ID NO: 7488 - protein, 595 aa, Glycine max; identical to SEQ ID NO: 6331

SEQ ID NO: 7489 - protein, 553 aa, Glycine max; identical to SEQ ID NO: 6332

SEQ ID NO: 7490 - protein, 492 aa, Glycine max; identical to SEQ ID NO: 6328

SEQ ID NO: 7491 - protein, 524 aa, Glycine max; identical to SEQ ID NO: 6326

SEQ ID NO: 7492 - protein, 365 aa, Glycine max; identical to SEQ ID NO: 6729

SEQ ID NO: 7493 - protein, 365 aa, Glycine max; identical to SEQ ID NO: 6728

SEQ ID NO: 7494 - protein, 436 aa, Glycine max; identical to SEQ ID NO: 6730

SEQ ID NO: 7495 - protein, 443 aa, Glycine max; identical to SEQ ID NO: 6731

SEQ ID NO: 7496 - protein, 443 aa, Glycine max; identical to SEQ ID NO: 6732

SEQ ID NO: 7497 - protein, 460 aa, Medicago truncatula; identical to SEQ ID NO: 6733

SEQ ID NO: 7498 - protein, 390 aa, Glycine max; identical to SEQ ID NO: 6745

SEQ ID NO: 7499 - protein, 396 aa, Glycine max; identical to SEQ ID NO: 6744

SEQ ID NO: 7500 - protein, 553 aa, Glycine max; identical to SEQ ID NO: 6765

SEQ ID NO: 7501 - protein, 542 aa, Glycine max; identical to SEQ ID NO: 6766

SEQ ID NO: 7502 - protein, 567 aa, Glycine max; identical to SEQ ID NO: 6767

SEQ ID NO: 7503 - protein, 342 aa, Glycine max; identical to SEQ ID NO: 6722

SEQ ID NO: 7504 - protein, 342 aa, Glycine max; identical to SEQ ID NO: 6723

SEQ ID NO: 7505 - protein, 542 aa, Glycine max; identical to SEQ ID NO: 6766

SEQ ID NO: 7506 - protein, 553 aa, Glycine max; identical to SEQ ID NO: 6765

SEQ ID NO: 7507 - protein, 359 aa, Glycine max; identical to SEQ ID NO: 6724

SEQ ID NO: 7508 - protein, 359 aa, Glycine max; identical to SEQ ID NO: 6725

SEQ ID NO: 7509 - protein, 443 aa, Glycine max; identical to SEQ ID NO: 6731

SEQ ID NO: 7510 - protein, 436 aa, Glycine max; identical to SEQ ID NO: 6730

SEQ ID NO: 7511 - protein, 142 aa, Glycine max; identical to SEQ ID NO: 6777

SEQ ID NO: 7512 - protein, 146 aa, Glycine max; identical to SEQ ID NO: 6778

SEQ ID NO: 7513 - protein, 222 aa, Glycine max
MAHDTSSDSENEIIGARAKLFGHEKPIHEVLGGGKVADMLLWRDRYVSGALLGGMTVIWFLFEIVEYNFVALLCHISITTMLVLFIWSTVADIFKWKGPQIPNIVLQESFFHDLASILHKRFNQLLPMLLHISCGIDLPIFLLNIVSLYILSVIGSYFSFVNLLYIGFLCMQTLPIVYERYEEEINNWVSDIIIVIRKNYRRFNKNYLNKIPRGPVKAKKTQ

SEQ ID NO: 7514 - protein, 222 aa, Glycine max
MMNDTSSDSENEIIGSRAKLFGHEEPIHEVLGGGKVADVLLWKDRYVSDALLGGMTVIWFLFEIVEYNFVALLCHISITTMLVLFIWSTVADIFKWKGPQIPDIVLKESFFHDLASILHKRFNQLLPMLLRISCGIDLPIFLPNIVSLYILSVIGSYFSFVNLLYIGFLCMQTLPIVYERYEEEINNWVGDVIIVLKKNYRRFNKNYLNKIPRGPGKAKKTQ

SEQ ID NO: 7515 - protein, 169 aa, Vitis vinifera; identical to SEQ ID NO: 6834

SEQ ID NO: 7516 - protein, 175 aa, Betula platyphylla; identical to SEQ ID NO: 6835

SEQ ID NO: 7517 - protein, 567 aa, Glycine max; identical to SEQ ID NO: 6767

SEQ ID NO: 7518 - protein, 482 aa, Glycine max; identical to SEQ ID NO: 6770

SEQ ID NO: 7519 - protein, 482 aa, Glycine max; identical to SEQ ID NO: 6771

SEQ ID NO: 7520 - protein, 190 aa, Glycine max; identical to SEQ ID NO: 6861

SEQ ID NO: 7521 - protein, 185 aa, Glycine max; identical to SEQ ID NO: 6860

SEQ ID NO: 7522 - protein, 397 aa, Glycine max; identical to SEQ ID NO: 6772

SEQ ID NO: 7523 - protein, 342 aa, Glycine max; identical to SEQ ID NO: 6722

SEQ ID NO: 7524 - protein, 359 aa, Glycine max; identical to SEQ ID NO: 6724

SEQ ID NO: 7525 - protein, 359 aa, Glycine max; identical to SEQ ID NO: 6725

SEQ ID NO: 7526 - protein, 359 aa, Glycine max; identical to SEQ ID NO: 6724

SEQ ID NO: 7527 - protein, 365 aa, Glycine max; identical to SEQ ID NO: 6728

SEQ ID NO: 7528 - protein, 436 aa, Glycine max; identical to SEQ ID NO: 6730

SEQ ID NO: 7529 - protein, 396 aa, Glycine max; identical to SEQ ID NO: 6744

SEQ ID NO: 7530 - protein, 390 aa, Glycine max; identical to SEQ ID NO: 6745

SEQ ID NO: 7531 - protein, 142 aa, Glycine max; identical to SEQ ID NO: 6777

SEQ ID NO: 7532 - protein, 210 aa, Glycine max; identical to SEQ ID NO: 6746

SEQ ID NO: 7533 - protein, 358 aa, Glycine max; identical to SEQ ID NO: 6747

SEQ ID NO: 7534 - protein, 373 aa, Glycine max; identical to SEQ ID NO: 6748

SEQ ID NO: 7535 - protein, 390 aa, Glycine max; identical to SEQ ID NO: 6745

SEQ ID NO: 7536 - protein, 365 aa, Glycine max; identical to SEQ ID NO: 6729

SEQ ID NO: 7537 - protein, 553 aa, Glycine max; identical to SEQ ID NO: 6765

SEQ ID NO: 7538 - protein, 185 aa, Glycine max; identical to SEQ ID NO: 6860

SEQ ID NO: 7539 - protein, 190 aa, Glycine max; identical to SEQ ID NO: 6861

SEQ ID NO: 7540 - protein, 443 aa, Glycine max; identical to SEQ ID NO: 6731

SEQ ID NO: 7541 - protein, 373 aa, Glycine max; identical to SEQ ID NO: 6748

SEQ ID NO: 7542 - protein, 358 aa, Glycine max; identical to SEQ ID NO: 6747

SEQ ID NO: 7543 - protein, 140 aa, Arabidopsis thaliana
MVATFATPSTVIGLGGSSITTKPFSSSFLKPTLSAKNPLRLAGASGGRVTCFERNWLRRDLNVVGFGLIGWLAPSSIPAINGKSLTGLFFDSIGTELAHFPTPPALTSQFWLWLVTWHLGLFLCLTFGQIGFKGRTEDYF

SEQ ID NO: 7544 - protein, 140 aa, Arabidopsis thaliana
MAATFATPSTVIGLGGSSITTKPFSSSFLKPTLSAKNPLRLAGASGGRVTCFERNWLRRDLNVVGFGLIGWLAPSSIPAINGKSLTGLFFDSIGTELAHFPTPPALTSQFWLWLVTWHLGLFLCLTFGQIGFKGRTEDYF

SEQ ID NO: 7545 - protein, 140 aa, Arabidopsis lyrata subsp. lyrata
MAATFATPSTVIGLGGSSITTKPFSSPFLKPTLSAKNPLRLAGASGGRVTCFERNWLRRDLNVVGFGLIGWLAPSSIPAINGKSLTGLFFDSIGTELAHFPTPPAVTSQFWLWLVTWHLGLFLCLTFGQIGFKGRTEDYF

SEQ ID NO: 7546 - protein, 142 aa, Thellungiella halophila
MAATFTTPSTVIGLGGSSVSPRPFSSSFLKPTLRAKNPLRLAGASGGRFTCFERNWLRRDLNVVGFGLIGWLAPSSIPAINGKSLTGLFFDSIGTELAHFPTPPALTSQFWLWLVTWHLGLFLCLTFGQIGFKGRTEDYFQK

SEQ ID NO: 7547 - protein, 143 aa, Ricinus communis
MAATFATSSTVIGLCSSSLSSPKKICLGSGFVKSPVPARNPLRQTGANGGKFVCFERNWLRKDLNVIGFGLIGWLAPSTIPAIDGKSLTGLFFESIGSELAHFPSPPALTSQFWLWLITWHLGLFLCLTFGQIGFKGRTEDYF

SEQ ID NO: 7548 - protein, 146 aa, Silene latifolia
ASSFAASSTVVGLGTSTLSRSYAKSTTLSSGFLKSKVAAVNPLRQACGTSGGRFTCSFQRDWLRRDLNVIGFGLIGWLAPSSIPAIDGNSLSGLFFSSIGEELAHFPTPPAVTSQFWLWLVLWHLGLFLCLTFGQIGFKGRTEEYF

SEQ ID NO: 7549 - protein, 149 aa, Populus trichocarpa
MAATFASSSAVTGLGSSSLSSPSRASSPKKICLSSGFVKSPVAARSPLRLAGTHGGKFMCFERDWLRKDLNVIGFGLIGWLAPSSIPAIGGKSLSGLFFESIGTELAHFPTPPPLTSQFWLWLVTWHLGLFICLTLGQIGFKGRTDEYF

SEQ ID NO: 7550 - protein, 138 aa, Medicago truncatula
MAATTFPTVLGMAGASRLTSGFVKPQVIARNPLKQAMALGNGGRVTCFQRDWLRRDFNVIGFGLIGWLAPSSIPAIDGKSLTGLFFDSIGTELAHFPTPPALTSPFWLWLICWHLGLFISLTFGQIGFKGRTEDYFQK

SEQ ID NO: 7551 - protein, 143 aa, Silene vulgaris
ASSFAASATVVGLGTSTISRSYAKSTPLSSGFLKSKVAAVNPLRQAWGTSGGRFTCSFQRDWLRRDLNVIGFGLIGWLAPSSIPAIDGNSLSGLFFSSIGEELAHFPTPPAVTSQFWLWLVLWHLGLFLCLTFGQIGFKGRTE

SEQ ID NO: 7552 - protein, 151 aa, Populus trichocarpa
MAATFASPSAVVGLGSGSLSSPSRISSPKKICLSSGFVKSPVTARNPLGLAGTGGGKFMCFQGDWLRKDLNVIGFGLIGWLAPSSVPAIGGKSLTGLFFESIGTELAHFPTPPPLTSQFWLWLVTWHLGLFICLTFGQIGFKGRTEDYFQK

SEQ ID NO: 7553 - protein, 194 aa, Glycine max
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAMDLSSASDELSQIIELPSLESTDDGSVVLEKEFVFVDSLDAWMYQPPFGFDTEQDTGFEGLMWNY

SEQ ID NO: 7554 - protein, 194 aa, Glycine max
MRVSTEKLETEPESKKIKRIRGGGGGDSSNKHPLYRGVRMRNWGKWVSEIREPRKKSRIWLGTFPTPEMAARAHDVAALSIKGSAAILNFPHFANSLPRPASLAPRDVQAAAAKAAHMDPSSLSSLVSAKDLSSASDELSQIIELPSLESTDDGSVVLEKEFVFVDSLDAWMYQPPFGFDTEQDTGFEGLMWNY

SEQ ID NO: 7555 - protein, 188 aa, Glycine max
MRVSTETEPETKKIKRIRGGGDSSKHPLYRGVRMRNWGKWVSEIREPRKKSRIWLGTFPTPEMAARAHDVAALSIKGPAAILNFPHLANSLPRPASLAPRDVQAAAAKAAHMDPSSLSSLVSAMDLSSASDELSQIIELPSLESTDDGSVDLKKEFVFVDSLDAWMYQPPFGFDTEQDTGFEGLMWNY

SEQ ID NO: 7556 - protein, 167 aa, Glycine max
MAAMNSSVLACSYAISGAACSELNGKVTSVAYVACSGYKLPLIKAEARVPKAKESEGGRRGALVLLAATLFTSAASNSSANAGIIEDYLERSKANKELNDKKRLATTGANFARAYTVEFGSCKFPENFTGCQDLAKQKKVPFLSDDLELECEGKDKYKCGSNVFWKW

SEQ ID NO: 7557 - protein, 166 aa, Glycine max
MAGMNSSVLACSYAISGAACSELNGKVTSVASVASSGYKLPLIKCEARVPKAKESEGRRGALVLLAATLFISAASNSSANAGIIDDYLERSKANKELNDKKRLATTGANFARAYTVEFGSCKFPENFTGCQDLAKQKKVPFLSDDLELECEGKDKYKCGSNVFWKW

SEQ ID NO: 7558 - protein, 171 aa, Arabidopsis lyrata subsp. lyrata
MAAMNSSVLTCSYAIAGSGSVELNQKVGLVNSSVGFGQKKQMIMPVIKAQRVVGDDVDGSNGRRSAMVFLAATLFSTAAVSASANAGVIDEYLERSKANKELNDKKRLATSGANFARAFTVQFGSCKFPENFTGCQDLAKQKKVPFISEDLALECEGKDKYQCGSNVFWKW

SEQ ID NO: 7559 - protein, 172 aa, Populus trichocarpa
MAAMNSSVLACNYAISGTGSSELNAKIVSMPAVASLVVSGPKLPVIRAQQTRADSREMKASEGRRAAMVYLAATLFTSAAAASSANAGVIEEYLEKSKANKELNDKKRLATSGANFARAFTVQFGTCKFPENFTGCQDLAKQKKVPFISDDLALECEGKDKYKCGSNVFWKW

SEQ ID NO: 7560 - protein, 171 aa, Arabidopsis thaliana
MAAMNSSVLTCSYAIAGSGSVELNQKVGLVNSSVGFGQKKQMIMPVIKAQRVVGDDVDGSNGRRSAMVFLAATLFSTAAVSASANAGVIDEYLERSKTNKELNDKKRLATSGANFARAFTVQFGSCKFPENFTGCQDLAKQKKVPFISEDIALECEGKDKYKCGSNVFWKW

SEQ ID NO: 7561 - protein, 172 aa, Populus trichocarpa x Populus deltoides
MAAMNSSVLACNYAISGTGSSELNAKIVSMPAVASLVVCGPKLPVIRAQQTRADSREMKASEGRRAAMVYLAATLFTSAAAASSANAGVIEEYLEKSKANKELNDKKRLATSGANFARAFTVQFGTCKFPENFTGCQDLAKQKKVPFISDDLALECEGKDKYKCGSNVFWKW

SEQ ID NO: 7562 - protein, 169 aa, Ricinus communis
MAAMNSSVLACNYAISGTASSELSKLASVPSAVFPTVSGPKLPVIRAQRAKPASDSKADGRRAAMLCLAATLFTTAAAVSSANAGVIEEYLEKSKANKELNDKKRLATSGANFARAYTVQFGTCKFPENFTGCQDLAKQKKVPFISDDLALECEGKDKYKCGSNVFWKW

SEQ ID NO: 7563 - protein, 172 aa, Populus trichocarpa
MAAMNSSVLACNYAISGTGSSELNAKIVSMPAVASPVVSGPKLPIIRAQQARADSKEMKASEGRRAALVYLAATLFTSAAAAASANAGVIEDYLEKSKANKELNDKKRLATSGANFARAYTVQFGTCKFPENFTGCQDLAKQKKVPFISEDLALECEGKDKYKCGSNVFWKW

SEQ ID NO: 7564 - protein, 170 aa, Phaseolus vulgaris
MSAMNSTVLACNYARSGCSDLNAKLTSMPSVASPQLSALKLPLIKAHQAKVTESKSDQGRRSALVYLAATLFTAAAAASNSSANAGVIEEYLEKSKTNKELNDKKRLATTGANFARAYTVEFGSCKFPENFTGCQDLAKQKKVPFLSDDLDLECEGKDKYKCGSNVFWKW

SEQ ID NO: 7565 - protein, 170 aa, Thellungiella halophila
MATMNSSVLTCSYAISGASSAELNQKVGLVNSSVGFGQKKQTMSVIKAQRVGGDDVDGSNGRRSAMVFLAATLFSSAAVSASANAGVIDEYLEKSKANKELNDKKRLATSGANFARAFTVQFGSCKFPDNFTGCQDLAKQKKVPYISEDLALECEGKDKYKCGSNVFWKW

SEQ ID NO: 7566 - protein, 241 aa, Vitis vinifera
MAEPLNSETESSSNSGSSSSSSPSSPGSTQSRPNSSKPEPESKKMKRIRDSSKHPVYRGVRMRNWGKWVSEIREPRKKSRIWLGTFPTPEMAARAHDVAALSIKGNSAILNFPQLAASLPRPVSLAPRDVQAAAAKAAAMDKFDSPSSSSSSSSLSSLVSSIDLSTASDELSEIVELPNLDPSFDSPESKTDFVFDDSADGWLYPPPWLQSVEDCGYFSEQLLVPESLIPGSFEAFLWDNN

SEQ ID NO: 7567 - protein, 371 aa, Glycine max
MEITNVSEYEAIAKQKLPKMVFDYYASGAEDQWTLQENRNAFSRILFRPRILIDVSKIDITTTVLGFKISMPIMLAPTAMQKMAHPEGEYATARAASAAGTIMTLSSWATSSVEEVASTGPGIRFFQLYVYKDRNVVAQLVRRAERAGFKAIALTVDTPRLGRREADIKNRFTLPPFLTLKNFEGLDLGKMDKADDSGLASYVAGQIDRTLSWKDVKWLQTITKLPILVKGVLTAEDTRIAVQSGAAGIIVSNHGARQLDYVPATISALEEVVKAAEGRVPVFLDGGVRRGTDVFKALALGASGIFIGRPVVFSLAAEGEAGVRNVLRMLREEFELTMALSGCTSLKDITRDHIVTDWDQPRTIPRALPRL

SEQ ID NO: 7568 - protein, 371 aa, Glycine max
MEITNVSEYEAIAKQKLPKMVFDYYASGAEDQWTLQENRNAFSRILFRPRILIDVSKIDITTTVLGFKISMPIMLAPTAMQKMAHPEGEYATARAASAAGTIMTLSSWATSSVEEVASTGPGIRFFQLYVYKDRNVVAQLVRRAERAGFKAIALTVDTPILGRREADIKNRFTLPPFLTLKNFEGLDLGKMDKADDSGLASYVSGQIDRTLSWKDVKWLQTITKLPILVKGVLTAEDTRIAIQSGAAGIIVSNHGARQLDYVPATISALEEVVKAAEGRLPVFLDGGVRRGTDVFKALALGASGIFIGRPVVFSLAAEGEAGVRNVLRMLREEFELTMALSGCTSLKDITRDHIVTDWDQPRILPRALPRL

SEQ ID NO: 7569 - protein, 371 aa, Glycine max
MEITNVSEYEAIAKQKLPKMAFDYYASGAEDQWTLQENRNAFSRILFRPRILIDVSKIDLTTTVLGFKISMPIMIAPTAFQKMAHPEGEYATARAASAAGTIMTLSSWATSSVEEVASTGPGIRFFQLYVYKDRNVVAQLVRRAERAGFKAIALTVDTPILGRREADIKNRFTLPPFLTLKNFEGLDLGKMDKADDSGLASYVSGQIDRTLSWKDVKWLQTITKLPILVKGVLTAEDTRIAIQSGAAGIIVSNHGARQLDYVPATISALEEVVKAAEGRLPVFLDGGVRRGTDVFKALALDASGIFIGRPVVFSLAAEGEAGVRNVLRMLREEFELTMALSGCTSLKDITRDHIVTDWDQPRILPRALPRL

SEQ ID NO: 7570 - protein, 371 aa, Vitis vinifera
MEITNVTEYEAIAKQKLPKMVFDYYASGAEDQWTLYQNRHAFSQILFRPRILIDVSKIDMTTTVLGFKISMPIMIAPTAMQKMAHPEGEYATARAASATGTIMTLSSWATSSVEEVASTGPGIRFFQLYVYKDRHVVAQLVRRAERAGFKAIALTVDTPRLGRREADIKNRFTLPPFLTLKNFEGLDLGKMDKADDSGLASYVAGQIDRTLSWKDVKWLQTITNLPILVKGVLTAEDTRLAIQAGAAGIIVSNHGARQLDYVPATIMALEEVVKAAQGRVPVFLDGGVRRGTDVFKALALGASGIFIGRPVVFSLAAEGEAGVRKVLQMLREEFELTMALSGCRSLKEITRDHIVTEWEVPHPGSRPLPRL

SEQ ID NO: 7571 - protein, 369 aa, Mikania micrantha
MGVTNVTEYEAIAKEKLPKMVYDYYASGAEDQWTLEESRNAFSRILFRPRILIDVSKIVMTTTILGFKISMPIMVAPTAMQKMAHPEGEYATARAASSAGTIMTLSSWATSSVEEAASTGPGIRFFQLYVYKDRNVVAQLVRRAERAGFKAIALTVDTPRLGRREADIKNRFTLPPFLTLKNFEGLDLGKMDEANDSGLASYVAGQIDRTLSWKDVQWLQTITKMPILVKGVITAEDTRLAIQAGAAGIIVSNHGARQLDYVPATISALEEVVKAAQGRVPVFLDGGVRRGTDVFKALALGAAGIFIGRPVVLSLAAEGEAGVRKVLQMLRDEFELTMALSGCTSLKEITRDHIVTEWDAPKARPAPRL

SEQ ID NO: 7572 - protein, 369 aa, Arabidopsis lyrata subsp. lyrata
MEITNVNEYEAIAKEKLPKMVFDYYASGAEDQWTLQENRNAFSRILFRPRILIDVSKIDMTTTVLGFKISMPIMVAPTAMQKMAHPEGEYATARAASAAGTIMTLSSWATSSVEEVASTGPGIRFFQLYVYKDRNVVAQLVRRAERAGFKAIALTVDTPRLGRRESDIKNRFTLPPYLTLKNFEGLDLGKMDEANDSGLASYVAGQIDRTLSWKDVQWLQTITKLPILVKGVLTAEDARMAVQAGAAGIIVSNHGARQLDYVPATIIALEEVVKAAQGKIPVFLDGGVRRGTDVFKALALGASGIFIGRPVVFSLAAEGEAGVRKVLQMMREEFELTMALSGCTSLKEITRNHIITDWDAPQARLVPKL

SEQ ID NO: 7573 - protein, 371 aa, Vitis vinifera
MEITNVTEYEAIAKQKLPKMVFDYYASGAEDQWTLYQNRHAFSQILFRPRILIDVSKIDMTTTVLGFKISMPIMIAPTAMQKMAHPEGEYATARAASAAGTIMTLSSWATSSVEEVASTGPGIRFFQLYVYKDRHVVAQLVRRAERAGFKAIALTVDTPRLGRREADIKNRFTLPPFLTLKNFEGLDLGKMDKADDSGLASYVAGQIDRTLSWKDVKWLQTITNLPILVKGVLTAEDTRLAIQAGAAGIIVSNHGARQLDYVPATIMALEEVVKAAQGRVPVFLDGGVRRGTDVFKALALGASGIFIGRPVVFSLAAEGEAGVRKVLQMLREEFELTMALSGCRSLKEITRDHIVTEWEVPPPGSRPLPRL

SEQ ID NO: 7574 - protein, 369 aa, Populus trichocarpa
MEITNVMEYEAIAKQKLPKMVFDYYASGAEDQWTLAENRNAFSRILFRPRILIDVSKIDMATTVLGFKISMPIMIAPTAMQKMAHPEGEYATARAASAAGTIMTLSSWATSSVEEVASTGPGIRFFQLYVYKDRNVVAQLVRRAERAGFKAIALTVDTPRLGRRESDIKNRFSLPPFLTLKNFEGLDLGKMDKADDSGLASYVAGQIDRTLSWKDVEWLQTITRLPILVKGVLTAEDARLSVQAGAAGIIVSNHGARQLDYVPSTIMALEEVVKAAQGRVPVFLDGGVRRGTDVFKALALGASGIFIGRPVVFSLASEGEAGVRKVLQMLREEFELTMALSGCRSLKEITRDHIVADWDHPRARLAPKL

SEQ ID NO: 7575 - protein, 371 aa, Lens culinaris
MEITNVSEYENVAKQKLPKMVFDYYASGAEDQWTLQENRNAFSRILFRPRILIDVSKIDMTTTVLGFKISMPIMIAPTAMQKMAHPEGEYATARAASAAGTIMTLSSWATSSVEEVASTGPGIRFFQLYVYKDRNVVAQLVRRAERAGFKAIALTVDTPRLGRREADIKNRFVLPPFLSLKNFEGLDLGKMDQANDSGLASYVAGQIDRSLSWKDVKWLQTITSLPILVKGVLTAEDARIAVQSGAAGIIVSNHGARQLDYVLATISALEEVVKAAQGRVPVFLDGGVRRGTDVFKALALGARGVFIGRPVVFSLAAEGEVGVKKVLQMLRDEFEMTMTLSGCRSLKEITREMIVADWDTPRIQPRALPRL

SEQ ID NO: 7576 - protein, 369 aa, Ricinus communis
MEITNVMEYEEIARQKLPKMVYDYYASGAEDQWTLKENRNAFSRILFRPRILIDVSKIDMTTSVLGFKISMPIMIAPTAMQKMAHPEGEYATARAASAAGTIMTLSSWATSSVEEVASTGPGIRFFQLYVYRDRNVVAQLVRRAERAGFKAIALTVDTPRLGRREADIKNRFTLPPFLTLKNFEGLDLGKMDKSDDSGLSSYVAGQIDRTLSWKDIKWLQTITSLPILVKGVLTAEDTRLAIQNGAAGIIVSNHGARQLDYVPATIMALEEVVKAAQGRVPVFLDGGVRRGTDVFKALALGASGIFIGRPVVFSLAAEGEAGIRKVLQMLRDEFELTMALSGCRSLREITRDHIVTDWDLPRPVASARL

SEQ ID NO: 7577 - protein, 256 aa, Glycine max
MVLYVSNVRGGKAEKTNWVMHQYHLGTEEDEKDGEYIISKVFYQQQQVKLGDKNDQDVPEASEITGPHPGLSVGEEGTIEKVDPVTPKLVTPEPPCNGRWCADLDLGQETHNVPQPPRMDCLDEIQADCQVLANESSMVETQHNEGMDDKENNAEDGQKWWDSESQNLLDSQQLVEALSLCDDLLQSQSPSRDGKHEDHKNQPGLSVYAQLGPEHLKKDIEECQNLALNPANIENDTPSEFQLSQLVFLCSQQLLK

SEQ ID NO: 7578 - protein, 548 aa, Glycine max
MAFKLKSLPLLCSLHSPSRQNPNSTLSNHHFSRRFFAPSIPPTLCLSGAASASTFHRHRFFVTARSQDEDQITEALEQEEEKDNEEISRQGEKKELAKQGIWDQIKEIVMFTGPATGLWICGPLMSLIDTAVIGQRSSIELAALGPATVVCDYMCYVFMFLSIATSNMVATALAKQDKEEVQHHISVLLFVGLSCGIAMLLFTRLFGAAIITAFTGPKNVHVVPAASNYVKIRGLASPALLVGWVAQSASLGMKDSLGPLKALAAATVINVAGCVLLCTYLGYGIVGAAWATMVSQVVASYMMIQNLNMKGYNALAFSIPSGKELLTIFGLAAPVFITLMSKVAFYALLIYFATSMGTHTMAAHQVMVQTYLMCTVWGEPLSQTSQSFMPELIYGVNRSLSKARMLLRSLVIIGAILGLLLGIIGTSVPWLFPNIFTPDRMVIQEMHKVLIPYFIALAVTPPTVSLEGTLLAGRDLKFISLSMSGCFCVGSLVLWALSSRYGLLGCWFSLALFQWARFSMALQRLLSPKGILYSEDTEQYKLLKLRTA

SEQ ID NO: 7579 - protein, 552 aa, Ricinus communis
MLIKTLNHHSFSSLISLQNPNFKKHNHCLITFNKPPPLHLPSLHLSALKYQRNGLISNCISSSKDVVYDSDNNQGIESGNDGNIVQFQEQEVEIERDGLENQSIWKQMKEIVMFTGPATGLWLCGPLMSLIDTAVIGQGSSIELAALGPGTVVCDYMSYVFMFLSVATSNLVATSLARRNKNEVQHQISILLFVGLACGVFMFLFTRFFGSWALTAFTGPKHVHIVPAANTYVQIRGLAWPAVIVGWVAQSASLGMKDSWGPLKALAVSSIVNGVGDVVLCSFMGYGIAGAAWATMVSQVIAAYMMIEALNKKGYNAFAVTIPTLDELLSIVGIAAPVFITMMSKVAFYSLLIYFATSMGTHSVAAHQVMIQTYSMCTVWGEPLSQTAQSFMPELLYGANRSLAKARTLLKSLVIIGATLGLVLGTIGTSVPWLFPNLFTPDQNIIQEMHKVLLPYIMALAVTPSTHSLEGTLMAGRDLKFLSLSMTGCFAFGGLVLMLICSRGYGLAGCWYALVGFQWSRFFLALQRLLSPDGVLYSEDLSRYKIEKLKAT

SEQ ID NO: 7580 - protein, 223 aa, Glycine max
MAVVAVSHSSAPPTFNLNKSPKFPPSPISATFPIPNSATSTSRIFCRATNSRTDPVKNKNNKKKKRKKTSDESLPQMNPNDDFQVLNDFPLQNGPDTSDAPIHYPSMPLPEPPAGFVLDDNGNVLHASPNRLITVVDPTNNLPLECVIGRVFKSSERDECMLLCPVDTPVQILKSTKADGWSAISDEEVESILPAAAYALAKIHMHLVYSGYCYTARGGFCYT

SEQ ID NO: 7581 - protein, 480 aa, Glycine max
MDSKSFKFYALSGSIARRVFFRALLLSSAVSLVALIRFLPTVDLGSLTPKTYFDCVDDDSDSLSENATLTAGSYLLQSRILNTFWGSFDSMNCKNDTSLASTVITILTGKRLLNFGARSLCVGEGSNVIVSSMQRLGFSSVVGLHKHPFLSLHKKKTVCHFEYDDSTFDFVFSKDVVDQVSVPAALLVLEVERILKPGGIGALLVGSSSSSSVPSLLRSSNLVHVGYVNELNLVVFKKRSENASTSSPFYNHVLPEDCASVEFTKPLVKLMEPLVVERVGHDVKYEKKNVSYLPKFVDVSNKKRLVYIDIGVRELVNANVNVTNWFPPSYPIDQKAFSVYFVHYNASVLSYVKLPRVTFVYHPGLAGKIAHKNGVDGEMEPFFGEEEFDFLVWFKETVQHADFVVLKMHAGEVEMKFLADIFESGAICSVDELFLSCSESGDGKRETMSSREHCMDTYKGLRSNGVYVHQWWDAKLHQGA

SEQ ID NO: 7582 - protein, 443 aa, Glycine max
MMPPKPSPPPAPPAYAGQPPPPPPPFISSSGGSGSNNSGGEFLPPPSPGISLGFSKSTFTYEELARATDGFSDANLLGQGGFGYVHRGILPNGKEVAVKQLKAGSGQGEREFQAEVEIISRVHHKHLVSLVGYCITGSQRLLVYEFVPNNTLEFHLHGKGRPTMDWPTRLRIALGSAKGLAYLHEDCHPKIIHRDIKSANILLDFKFEAKVADFGLAKFSSDVNTHVSTRVMGTFGYLAPEYASSGKLTDKSDVFSYGIMLLELITGRRPVDKNQTYMEDSLVDWARPLLTRALEEDDFDSIIDPRLQNDYDPHEMARMVASAAACIRHSAKRRPRMSQVVRALEGDVSLADLNEGIRPGHSTMYSSHESSDYDTAQYKEDMKKFRKMALGTQEYGASSEYSAATSEYGLNPSGSSSEAQSRQTTREMEMRKMKNNQGFSGSS

SEQ ID NO: 7583 - protein, 563 aa, Vitis vinifera
MSSPSPGQSPGPTSPPSTNTTSPPPPSTNTTAPPPATPAAPPPSSPSPPPPTAPTGSPPTAPAGSPPPPPDSPGSPPPSGQTGSPPPPSRASPPPPPSSPSSNKSPPPPPSDSKSPPPPPSSPSSNTVSTGLVVGIAIGGVVILVVLSLLFICCKKKKRRDHRQDYYVPPPPGFSKSTFTYEELVMATDGFSNANLLGQGGFGYVHRGVLPNGKEVAVKQLKAGSGQGEREFQAEVEIISRVHHKHLVTLAGYCITGSHRLLVYEFVPNNTLEFHLHGKGRPTMDWSTRLKIALGSAKGLAYLHEDCHPKIIHRDIKAANILLDFKFEAKVADFGLAKFSSDANTHVSTRVMGTFGYLAPEYAASGKLSDKSDVFSFGVMLLELLTGRRPVDANQTFMEDSLVDWARPLLTRALEDGNFDTLVDPRLQKDYNHHEMARMVACAAACVRHSARRRPRMSQIVRALEGDASLSDLNEGMRPGQSSIYSSHGSSDYDTNQYNEDMIKFRKMALASRDYGSSEYSGPTSEYGLYPSGSSSEGQRTTREMEMGKMKKDSRGYSGGSEK

SEQ ID NO: 7584 - protein, 202 aa, Glycine max
MERFVRLLTVVLAMAMVLAAPAHAQISTPCSTSMINGFFNPCMNFLTNSSGNGNGTSPTAECCNSIKSLTSGGMDCLCLIMTGNVPFRIPINRTLAISLPRTCNLPRLPLQCKSSPLPAPGPAAFGPSLSPSAPSLSPEASSVLPSPSLAPLSDITPPLLTPSSATTGSGRSDLTPSSAMPSYRFLPSVVLIALGFAVLKHY

SEQ ID NO: 7585 - protein, 397 aa, Glycine max
MQPQRLRQHAMLQPSLYHHPALLTPPQIEPILSGNLPPGFDSSSCRSVYVGNIHPQVTDSLLQELFSTAGALEGCKLIRKEKSSYGFVDYFDRSSAAFAIVTLNGRNIFGQPIKVNWAYASSQREDTSGHFNIFVGDLSPEVTDATLYACFSVYPSCSDARVMWDQKTGRSRGFGFVSFRNQQDAQSAINDLTGKWLGSRQIRCNWATKGASASDEKQSSDSKIVVELINGSSEEGQETTNDDTPEKNPQYTTVYVGNLAPEVTSVDLHQHFHSLNAGIIEDVRVQRDKGFGFVRYSTHAEAALAIQMGNARILFGKPIKCSWGSKPTPLGTASTPLLPPSANVPGFSLAGLAAYERQMALSKMGGAHTLMHQQGQHALKHVDMGMGATGTGSDASS

SEQ ID NO: 7586 - protein, 426 aa, Vitis vinifera
MQQQRLKQQQQALIQQSLLQQQSLYHHPGLLAPPQIEPILSGNLPPGFDSSTCRSVYVGNIHPQVTEPLLQEVFSSTGPLEGCKLIRKEKSSYGFVDYFDRRSAALSIVTLNGRHLFGQPIKVNWAYASSQREDTSGHYNIFVGDLSPEVTDATLFACFSVYPSCSSGIRDARVMWDQKTGRSRGFGFVSFRNQQEAQSAINDLNGRWLGSRQIRCNWATKGAGGNEDKPNSDAKSVVELTNGTSEDGKDKSNDEAPENNLQYTTVYVGNLAPEVTSVDLHRHFHALGAGAIEDVRVQRDKGFGFVRYSTHAEAALAIQMGNARILCGKPIKCSWGSKPTPAGTSSTPLPPPAAPHMPGISAADFAAYERQMALSKMGGAQGLMHPQAQHALKQTAMGMGAGGSSQAIYDGGFQNAATTQQLMYYQ

SEQ ID NO: 7587 - protein, 429 aa, Vitis vinifera
MQQQRLKQQQQALIQQSLLQQQSLYHHPGLLAPPQIEPILSGNLPPGFDSSTCRSVYVGNIHPQVTEPLLQEVFSSTGPLEGCKLIRKEKSSYGFVDYFDRRSAALSIVTLNGRHLFGQPIKVNWAYASSQREDTSGHYNIFVGDLSPEVTDATLFACFSVYPSCSDARVMWDQKTGRSRGFGFVSFRNQQEAQSAINDLNGRWLGSRQIRCNWATKGAGGNEDKPNSDAKSVVELTNGTSGEVIYGIQNGKDKSNDEAPENNLQYTTVYVGNLAPEVTSVDLHRHFHALGAGAIEDVRVQRDKGFGFVRYSTHAEAALAIQMGNARILCGKPIKCSWGSKPTPAGTSSTPLPPPAAPHMPGISAADFAAYERQMALSKMGGAQGLMHPQAQHALKQTAMGMGAGGSSQAIYDGGFQNAATTQQLMYYQ

SEQ ID NO: 7588 - protein, 406 aa, Nicotiana plumbaginifolia
MMQQQRLKQQQQQALMQQSLYHPGLLAPPQIEPILSGNLPPGFDSSTCRSVYVGNIHPQVTEPLLQEVFASTGPLEGCKLIRKDKSSYGFVDYFDRRSAALAIVTLNGRHLFGQPIKVNWAYASAQREDTSNHYNIFVGDLSPEVTDATLFACFSVYTSCSDARVMWDQKTGRSRGFGFVSFRNQQEAQSAINDLNGKWLGSRQIRCNWAAKGAGAVGEQNSDAKSVVELTSGTSDDGQEKVVNEDAPENNPQYTTVYVGNLAPEVTSVDLHRHFHALGAGVIEDVRIQRDKGFGFVRYSSHAEAARAIQLGNARLLFGKPVKCSWGSKPTPPGSSSNPLPPPAIGQIPGLSAMDLAAYQRQLALAKMAGAQAFMQPQGQRIGAPGQGIYDGGYGGIASTQPPMYF

SEQ ID NO: 7589 - protein, 426 aa, Populus trichocarpa
MQQQRLKQQQQALMQQALLQQQSLLQQQSLYHPGLLAPQIEPIPSGNLPPGFDPSTCRSVYVGNIHTQVTEPLLQEVFASTGPVEGCKLIRKEKSSYGFIHYFDRRAAALAILSLNGRHLFGQPIKVNWAYASGQREDTSGHFNIFVGDLSPEVTDATLYACFSVYPSCSDARVMWDQKTGRSRGFGFVSFRNQQDAQSAINDLTGKWLGSRQIRCNWAAKGASSNDDKQSSDSKSVVELTNGTSEDCKEATNNEAPENNPQYTTVYVGNLAPEVAQPDLHRHFHALGAGVIEEVRVQRDKGFGFVRFSTHAEAALAIQMGNTQSLFGKQMKCSWGSKPTPPGTSSNPLPPPAAAPLPGLTATDILAYERQLAISKMGGIHALMHPQGQHPLKQATMGMGAAGASQAIYDGGFQNVAAAQQLMYYQ

SEQ ID NO: 7590 - protein, 422 aa, Ricinus communis
MQHQRLKQQQQALMQQALLQQQSLYHPGLLAPPQIEPIPSGNLPPGFDPSTCRSVYVGNIHTQVTEPLLQEVFASTGPVESCKLIRKEKSSYGFIHYFDRRSAALAILSLNGRHLFGQPIKVNWAYASGQREDTSGHYNIFVGDLSPEVTDATLFACFSVYHSCSDARVMWDQKTGRSRGFGFVSFRNQQDAQSAINDLTGKWLGSRQIRCNWATKGATSNDDKQSSDAKSVVELTNGSSEEGKETANNDAPENNPQYTTVYVGNLAPEVTQLDLHRHFHSLGAGVIEEVRVQRDKGFGFVRFSTHAEAALAIQMGNTQSILYGKQIKCSWGSKPTPPGTSSNPLPPPAAAPLPGLSATDLLTYERQLAMGKMGGVHALMHPQGQHPLKQAAMGMGAAGASQAIYDGGFQNVAAAQQLMYYQ

SEQ ID NO: 7591 - protein, 358 aa, Ricinus communis
MMQHHRLKQQAMMPYPHPALVAAPQIEPILSGNLPPGFDSTTCRSVYVGNIHPQVTEPLLQEVFSNTGLIEGCKLIRKEKSSYGFVDYFDRRSAALSIVTLNGRHLFGQPIKVNWAYASSQREDTSGHFNIFVGDLSPEVTDATLYASFALFPSCSDARVMWDQKTGRSRGFGFVSFRNQQDAQNAINELNGKWIGSRQIRCNWAAKGTTSNDDKQSSDAKSVVELTNGTSEDSQEKNDDAPENNPQYTTVYVGNLAPEVTSVDLHRHFYGLGAGTIEDVRVQRDKGFGFVRYSTHAEAALAIQMGNARILYGKPVKCSWGSKPTPPGTSSTPLPPPAAVRMPGFQLLSLQPMNGRWL

SEQ ID NO: 7592 - protein, 420 aa, Vitis vinifera
MQHQRLKQQQQALMQQALLQQQSLYHPGLLAPPQIEPIPSGNLPPGFDSSTCRSVYVGNIHTQVSEPLLQEVFASTGPVEGCKLVRKEKSSYGFIHYFDRRSAALAILSLNGRHLFGQPIKVNWAYASGQREDTSGHFNIFVGDLSPEVTDATLFACFSVFPSCSDARVMWDQKTGRSRGFGFVSFRNQQDAQSAINDITGKWLGSRQIRCNWATKGAGSNDDKQSSDAKSVVELTNGSSEDGKETATNEAPDNNPQYTTVYVGNLAPEVTQLDLHRHFHTFGAGVIEEVRVQRDKGFGFVRYNTHAEAALAIQMGNTQSILCGKPIKCSWGSKPTPPGTSSNPLPPPAAAPLPGLSATDLLAYERQLAMSKMGHALMHPQGQHPLKQAAMGMGAAGASQAIYDGGFQNVAAAQQLMYYQ

SEQ ID NO: 7593 - protein, 407 aa, Vitis vinifera
MQQALLQQQSLYHPGLLAPPQIEPIPSGNLPPGFDSSTCRSVYVGNIHTQVSEPLLQEVFASTGPVEGCKLVRKEKSSYGFIHYFDRRSAALAILSLNGRHLFGQPIKVNWAYASGQREDTSGHFNIFVGDLSPEVTDATLFACFSVFPSCSDARVMWDQKTGRSRGFGFVSFRNQQDAQSAINDITGKWLGSRQIRCNWATKGAGSNDDKQSSDAKSVVELTNGSSEDGKETATNEAPDNNPQYTTVYVGNLAPEVTQLDLHRHFHTFGAGVIEEVRVQRDKGFGFVRYNTHAEAALAIQMGNTQSILCGKPIKCSWGSKPTPPGTSSNPLPPPAAAPLPGLSATDLLAYERQLAMSKMGHALMHPQGQHPLKQAAMGMGAAGASQAIYDGGFQNVAAAQQLMYYQ

SEQ ID NO: 7594 - protein, 420 aa, Vitis vinifera
MQHQRLKQQQQALMQQALLQQQSLYHPGLLAPPQIEPIPSGNLPPGFDSSTCRSVYVGNIHTQVSEPLLQEVFASTGPVEGCKLVRKEKSSYGFIHYFDRRSAALAILSLNGRHLFGQPIKVNWAYASGQREDTSGHFNIFVGDLSPEVTDATLFACFSVFPSCSDARVMWDQKTGRSRGFGFVSFRNQQVAQSAINDITGKWLGSRQIRCNWATKGAGSNDDKQSSDAKSVVELTNGSSEDGKETATNEAPDNNPQYTTVYVGNLAPEVTQLDLHRHFHTFGAGVIEEVRVQRDKGFGFVRYNTHAEAALAIQMGNTQSILCGKPIKCSWGSKPTPPGTSSNPLPPPAAAPLPGLSATDLLAYERQLAMSKMGHALMHPQGQHPLKQAAMGMGAAGASQAIYDGGFQNVAAAQQLMYYQ

SEQ ID NO: 7595 - protein, 519 aa, Medicago sativa
MDSLLKYPIMENFKEEPFLMAIMFILPLILLLGLVSRILKRPRYPPGPKGLPVIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDHAIRTVSDNIGNPVNIGELVFNLTKNIIYRAAFGSSSREGQDEFIGILQEFSKLFGAFNISDFVPCFGAIDPQGLNARLVKARKDLDSFIDKIIDEHVQKKKSVVDEETDMVDELLAFYSEEAKLNNESDDLHNSIKLTKDNIKAIIMDVMFGGTETVASAIEWAMAELMKSPEDLKKVQQELAEVVGLSRQVEEPDFEKLTYLKCALKETLRLHPPIPLLLHETAEEATVNGYFIPKQARVMINAWAIGRDANCWEEPESFKPSRFLKPGVPDFKGSNFEFIPFGSGRRSCPGMQLGLYALDLAVAHLLHCFTWELPDGMKPSEMDMSDVFGLTAPRASRLIAIPTKRVLCPLD

SEQ ID NO: 7596 - protein, 519 aa, Medicago sativa
MDSLLKFPIMVNLKEEPFLMAIMVIVPLTLLLGLMSRILKRPRYPPGPKGLPIIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDYAVRTVSDNIGNPVNIGELVFNLTKNIIYRAAFGSSSREGQDEFIGILQEFSKLFGAFNISDFVPCFGAIDPQGLNARLVKARKDLDSFIDKIIDEHVEKKKSVVDEETDMVDELLAFYSEEAKLNNESDDLHNSIKLTKDNIKAIIMDVMFGGTETVASAIEWVMAELMKSPEDLKKVQQELAEVVGLSRQVEEPDFEKLTYLKCALKETLRLHPPIPLLLHETAEEATVNGYFIPKQARVMINAWAIGRDANCWDEPESFKPSRFLKPGVPDFKGSNFEFIPFGSGRRSCPGMQLGLYALDLAVAHLLHCFTWELPDGMKPSEMDMSDVFGLTAPRASRLIAIPTKRVLCPLD

SEQ ID NO: 7597 - protein, 519 aa, Medicago truncatula
MDSLLKSPIMENLKEEPFLMAIMFIVPLILLLGLVSRILERPRYPPGPIGLPTIGNMLMMDQLTHRGLANLAKKYGGIFHLRMGFLHMVAISDADAARQVLQVQDNIFSNRPTTVAIKYLTYDRADMAFAHYGPFWRQMRKLCVMKLFSRKHAESWQSVRDEVDYAVRTVSDNIGNPVNIGELVFNLTKNIIYRAAFGSSSREGQDEFIGILQEFSKLFGAFNISDFVPCFGAIDPQGLNARLVKARKELDSFIDKIIDEHVQKKKSVVDEETDMVDELLAFYSEEAKLNNESDDLNNSIKLTKDNIKAIIMDVMFGGTETVASAIEWAMAELMKSPEDLKKVQQELAEVVGLSRQVEESDFEKLTYPKCALKETLRLHPPIPLLLHETAEEATVNGYFIPKQARVMINAWAIGRDANCWEEPQSFKPSRFLKPGVPDFKGSNFEFIPFGSGRRSCPGMQLGLYALDLAVAHLLHCFTWELPDGMKPSEMDMSDVFGLTAPRASRLVAIPTKRVLCPLD

SEQ ID NO: 7598 - protein, 515 aa, Glycine max
MANLDLDPFQTSILILVPIALLVALLSRTRRRAPYPPGPKGLPIIGNMLMMEQLTHRGLANLAKHYGGIFHLRMGFLHMVAISDPVAARQVLQVQDNIFSNRPATIAISYLTYDRADMAFAHYGPFWRQMRKLCVMKLFSRKRAESWQSVRDEVDAAVRAVASSVGKPVNIGELVFNLTKNIIYRAAFGSSSQEGQDEFIKILQEFSKLFGAFNIADFIPYLGCVDPQGLNSRLARARGALDSFIDKIIDEHVHKMKNDKSSEIVDGETDMVDELLAFYSEEAKLNNESDDLQNSIRLTKDNIKAIIMDVMFGGTETVASAIEWAMAELMRSPEDQKRVQQELADVVGLDRRAEESDFEKLTYLKCALKETLRLHPPIPLLLHETAEDATVGGYFVPRKARVMINAWAIGRDKNSWEEPETFKPARFLKPGVPDFKGSNFEFIPFGSGRRSCPGMVLGLYALELAVAHLLHCFTWELPDGMKPSEMDMGDVFGLTAPRSTRLIAVPTKRVVCPLF

SEQ ID NO: 7599 - protein, 442 aa, Medicago truncatula
  misc_feature (430)..(430): Xaa can be any naturally occurring amino acid
MDSLLKSPIMENLKEEPFLMAIMFIVPLILLLGLVSRILKRPRYPPGPIGLPIIGNMLMMDQLTHRGLANLAKKYGGIFHLRMGFLHMVAISDADAARQVLQVQDNIFSNRPATVAIKYLTYDRADMAFAHYGPFWRQMRKLCVMKLFSRKHAESWQSVRDEVDYAVRTVSDNIGNPVNIGELVFNLTKNIIYRAAFGSSSREGQDEFIGILQEFSKLFGAFNISDFVPCFGAIDPQGLNARLVKARKELDSFIDKIIDEHVQKKKSVVDEETDMVDELLAFYSEEAKLNNESDDLNNSIKLTKDNIKAIIMDVMFGGTETVASAIEWAMAELMKSPEDLKKVQQELAEVVGLSRQVEESDFEKLTYLKCALKETLRLHPPIPLLLHETAEEATVNGYFIPKQARVMINAWAIGRDANCWEEPQSFKPSXVFETRCARFQRK

SEQ ID NO: 7600 - protein, 520 aa, Glycine max
MDWQSMMGNLDPFQRTILILVPLTLLLLLLLSRTRPRPPYPPGPKGFPIIGNMFMMDQLTHRGLANLAKHYGGIFHLRMGFLHMVAISDPDAARQVLQVQDNIFSNRPATIAISYLTYDRADMAFAHYGPFWRQMRKLCVMKLFSRKRAESWQSVRDEVDAAVRAVASSVGKPVNIGELVFNLTKNIIYRAAFGSSSQEGQDEFIKILQEFSKLFGAFNIADFIPYLGCVDPQGLNSRLARARGALDSFIDKIIDEHVHKMKNDKSSEIVDGETDMVDELLAFYSEEAKLNNESDDLQNSIRLTKDNIKAIIMDVMFGGTETVASAIEWAMAELMRSPEDQKRVQQELADVVGLDRRAEESDFEKLTYLKCALKETLRLHPPIPLLLHETAEDATVGGYFVPRKARVMINAWAIGRDKNSWEEPETFKPARFLKPGVPDFKGSNFEFIPFGSGRRSCPGMVLGLYALELAVAHLLHCFTWELPDGMKPSEMDMGDVFGLTAPRSTRLIAVPTKRVVCPLF

SEQ ID NO: 7601 - protein, 511 aa, Leucaena leucocephala
MDSLLLHLQPLAMALLFAIPLLLLLGLLSRFRKRPPYPPGPKGLPIIGNMAMMDQLTHRGLAKLANLYGGILHLRMGFLHMVAISDADSARQVLQVHDNIFSNRPATIAISYLTYVRADMAFAHYGPFWRQMRKICVMKLFSRKRAESWQSVQDEVETVVRTVGANTGKEVNIGELVFSLTKNITYRAAFGSSSREGQDEFIGILQEFSKLFGAFNIADFIPSLSWVDPQGLNARLAKARGSLDSFIDKIIDEHMQNKKKEDEEGDMVDELLAFYSEDHSKVSESDDLHNSIKLTKDNIKAIIMDVMFGGTETVASAIEWAMAELMRSPEDLKRVQRELAEVVGLDRRVQESDMEKLTYLKCALKETLRLHPPIPLLLHETAEDAVVSGYFVPKKSRVMINAWAIGRDRNAWEDPDSFKPARFLGEGVPDFKGSNFEFIPFGSGRRSCPGMQLGLYALEMAVAHLLHCFSWELPDGMKPSEMDMSDVFGLTAPRASRLVAVSRKRLVCPLF

SEQ ID NO: 7602 - protein, 514 aa, Camptotheca acuminata
MEMDALRQVLHPMPTALFFIAPLFFLFILSRLRRKLPYPPGPNGLPLVGNMMMMDQLTHRGLAKLAKQYGGIFHLRMGFLHMVAVSSPEIARQVLQVQDNIFSNRPATIAISYLTYDRADMAFAHYGPFWRQMRKLCVMKLFSRKRAESWESVRDEVDSMVRVVVSHTGKSVNIGELVFSLTRDIIYRAAFGSSSHEGQDEFIKILQEFSKLFGAFNIADFIPGLGWVDPQGLNARLVQARASLDGFIDSIIDDHIEKHRRRNVVDSDGDMVDDLLAFYSDEAKVTESDDLQNAIRLTRDNIKAIIMDVMFGGTETVASAIEWAMAELMKSPEDLKRVQQELAEVVGLDRRLEESDFDKLTYLKCALKETLRLHPPIPLLLHETAEDTEVAGYYIPARSRVMINAWAIGRDKNSWDEPETFKPSRFLKEGVPDFKGSNFEFIPFGSGRRSCPGMQLGLYALEMAVAHLLHCFTWTLPDGMKPSELDTDDVFGLTAPRATLFVAVPSPRLLCPLY

SEQ ID NO: 7603 - protein, 513 aa, Populus trichocarpa
MDSLLQSLQTLPMSFFLIIISSIFFLGLISRLRRRSPYPPGPKGFPLIGSMHLMDQLTHRGLAKLAKQYGGLFHMRMGYLHMVAVSSPEVARQVLQVQDNIFSNRPANIAISYLTYDRADMAFAHYGPFWRQMRKLCVMKLFSRKRAESWESVRDEVDSMVKTVESNIGKPVNVGELIFTLTMNITYRAAFGAKNEGQDEFIKILQEFSKLFGAFNISDFIPWLGWIDPQGLTARLVKARKALDKFIDHIIDDHIQKRKQNNYSEEAETDMVDDMLTFYSEETKVNESDDLQNAIKLTRDNIKAIIMDVMFGGTETVASAIEWAMAELLKSPEDIKRVQQELADVVGLERRVEESDFDKLTFFKCTLKETLRLHPPIPLLLHETSEDAEVAGYYVPKKTRVMINAYAIGRDKNSWEDPDSFKPSRFLEPGVPDFKGNHFEFIPFGSGRRSCPGMQLGLYALDLAVAHLLHCFTWELPDGMKPSELDMTDMFGLTAPRATRLVAVPRKRVVCPL

SEQ ID NO: 7604 - protein, 501 aa, Populus trichocarpa
MSFFLIIISSIFFLGLISRLRRRSPYPPGPKGFPLIGSMHLMDQLTHRGLAKLAKQYGGLFHMRMGYLHMVAVSSPEVARQVLQVQDNIFSNRPANIAISYLTYDRADMAFAHYGPFWRQMRKLCVMKLFSRKRAESWESVRDEVDSMVKTVESNIGKPVNVGELIFTLTMNITYRAAFGAKNEGQDEFIKILQEFSKLFGAFNISDFIPWLGWIDPQGLTARLVKARKALDKFIDHIIDDHIQKRKQNNYSEEAETDMVDDMLTFYSEETKVNESDDLQNAIKLTRDNIKAIIMDVMFGGTETVASAIEWAMAELLKSPEDIKRVQQELADVVGLERRVEESDFDKLTFFKCTLKETLRLHPPIPLLLHETSEDAEVAGYYVPKKTRVMINAYAIGRDKNSWEDPDSFKPSRFLEPGVPDFKGNHFEFIPFGSGRRSCPGMQLGLYALDLAVAHLLHCFTWELPDGMKPSELDMTDMFGLTAPRATRLVAVPRKRVVCPL

SEQ ID NO: 7605 - protein, 510 aa, Glycine max
MDGRASSSVGGEASPAPAPVPITNANAPPPFLSKTYEMVEDPSTDSIVSWSPTNNSFVVWNPPEFARDLLPKHFKHNNFSSFVRQLNTYGFRKVDPDRWEFANEGFLRGQKHLLKTITRRKPAHGHNQQAQQAHGQSSSVGACVEVGKFGLEEEVEILKRDKNVLMQELVRLRQQQQATDNQLQSMVQRLQGMEQRQQQMMSFLAKAVQSPGFLAQFVQQQNESSRRITEANKKRRLKQEGIGEMEHTAASDGQIVKYQPLINEAAKAMLRQMMKLDTSRLESFSNNADNYLIGDHSSSSGATDRGNSLSRTSGVTLQVVPLTTIQSSHIPSATGIGDDPSTGKSEILSTPQVVACDEVTKAQYSNVNVSVGESNAPAIPATQTDEIMRDLSTIPDIVAGNILDIPQENYMAPETGGEGYMDPTSFGVNVSLPIDFDSISPEADIDDLLNNPHFWDDILRTPVSEEIDTNDAEVFKENEVQPMENGLDESQNMDQLTEQMGLLSSDAKRI

SEQ ID NO: 7606 - protein, 587 aa, Lotus japonicus
TVSISLISNSCSPGRPTRPNRLESLQSAFDYAVQSEGYGSHYQGVYPVKCNQDRFVVEDIVRFGSSFRFGLESGSKPELLMAMSCLCKGNAEALLICNGFKDAEYISLALAARKLALNSVIVLEQEEEVDLIIDLSNKMHIRPVIGMRAKLRTKHSGHFGGTSGERGKFGLTTAQILRVVKKLEHAGMLDCLQLLHFHIGSQIPSTALLADGVGEAAQIYCELVRLGAQMRVIDIGGGLGIDYDGTKSSDSDISVGYGLQEYATAVVRAVQGVCDRRSIKHPVICSESGRAIVSHHSVLVFEAVGASSYGAPPAFSSLALQYLVEGLSEEARADYCNLSDAAIRGEHETCLLYTEEMKRRCVEEFKQGLLGMEELAGVEGLCDLVRKTVGEADPVRRYHVNLSIFTSIPDVWSIDQVFPIIPIHRLDEKPTVKGILSDLTCDSDGKIDKFINGESSLAMHELEGGRKYYLRMFLGGAYEEALGGYHNLFGGPSVVRVLQSEGPHSFAVTRAMPGPSNGDVLRVMQHQPELMFETLKHRAEESVHDDELTAAALATALARSFHNMPYLVTAADHAGEDEHDQWSYCIA

SEQ ID NO: 7607 - protein, 630 aa, Vitis vinifera
HQEIDLMKIVKKVSDPKSAGGLGLQLPLIVRLPDVLQNRLESLQSAFDFAIQSQGYESHYQGVFPVKCNQDRFIVEDVVKFGSAFRFGLEAGSKPELLLAMSCLCKGNPEALLVCNGFKDADYIALALVARKLALNTVIVLEQEEELDLVINLSQKLSVRPVIGVRAKLRTKHAGHFGSTSGEKGKFGLTTTQILRVVRKLEQAGMLDSLQLLHFHIGSQIPSTDLLADGVSEAAQIYCELVRLGAHMRVIDIGGGLGIDYDGSKSSESDISVGYGLEEYAMAVVRAVQHVCDRKSVKHPVICSESGRALVSHHSILIFEAVSASVHDSPATSLSLQRFVEGLSEEARVDYQNLAAAAVSGEYETCLRFADQLKQRCVDQFKEGSLGIEQLADVDGLCDLVSKEVGATDPVRTYHVNLSVFTCIPDFWGIGQLFPIVPIHRLDQRPGARGILSDLTCDSDGKIDKFIGGESSLPLHELEGSDVVFGGSGKYYLGMFLGGAYEEALGGLHNLFGGPSVVRVLQSDGPHSFAVTRAMPGPSCGDVLRVMQHEPELMFETLKHRAEECGHEDGMTNGSLASGLALSFHKMPYLVAGSSCCMTNSGYYYGNEDNYSRVADSAAGDDDHWSYCFA

SEQ ID NO: 7608 - protein, 717 aa, Cucumis sativus
MPALAYCVDAAVAPPPGYVFAGDSSLPSSVLFSGGPPETTIFSSPDSPPTSENMSWSPPLSSSLYKIDGWGAPYFSVNGSGNMAVRPYGTATLPHQKIDLLKIVKKASDPICSGGLGLQLPLIVRFPDVLKNRLESLQSAFDYAIQSQGYGSHYQGVYPVKCNQDRFVVEDIVKFGSSFRFGLEAGSKPELLLAMSCLCKGNSDAFLVCNGFKDAEYISLALIARKLALNTVIVIEQEEEIDLVIDLSKRLFVRPVVGMRAKLRTKHSGHFGSTSGEKGKFGLTTTQILRVVRKLEQADMLDCLQLLHFHIGSQIPSTALLADGVGEAAQIYCELVRLGANMRVIDIGGGLGIDYDGSKSSDSELSVAYGLEEYAAAVVDAVRCVCDCRSVKHPIICSESGRAIVSRHSVLIFEAVSASSYEVPSMSSLELQYLVDGLTDEARVDYQNLSAAAYMGEYKTCLVYADQLKQRCVEKFKDGCLGMEQLAAVDGLCALVAKAVGELDSVRTYHVNLSIFTSIPDFWGIDQLFPIVPIHRLDQRPTVRGVLSDLTCDSDGKIDKFIGGESSLPLHELEGNGSLSGGGGGRYYLGMFLGGAYEEALGGVHNLFGGPSVIRVMQSDGPHSFAVTRTVPGPSCGDVLRVMQHEPELMFETLKHRAEEFGQEDDDGGEGIANSLAMSFRNMPYLASASSCCSETDYNGAVDSGAGDAEQWTYCYA

SEQ ID NO: 7609 - protein, 729 aa, Trifolium pratense
MPALACFVDAAAAVLPPPSGYALAGDSTLPPPLTFTTATTDGVDDDSDSASNWSPSLSSKLFKIDGWGFPYFGVNNAGDIAVRPHGAATMSHQEIDLLKVVKKASDPKCCGGLGLQLPLVVRFPDVLKNRLESIQGAFDGAIQLQGYESHYQGVYPVKCNQDRFVVEDIVEFGSGFRFGLEAGSKPELLLAMSCLCKGNREAFLICNGFKDSEYISLALVARKLALNTVIVLEQEEELDMVVEISNKLCIRPVIGVRAKLRTKHSGHFGSTSGDKGKFGLTTIQILRVVKKLEQLDMLDCLQLLHFHIGSQIPTTELLADGVGEAAQIYCELLRLGAQMRVLDIGGGLGIDYDGSKSGDSDISVAYGIEEYAAAVVHAVKYVCDRRNVNHPVICSESGRAIVSHHSVLIFEAIGASSNKAPSLSSIGLQYLGEGLSEEALADYQNISAATLRGEHEACLLYTDQFKKRCVEQFKQGTLGIEQLAAVDGLCDLITETIGAKDLVKKYHMNLSVFTSIPDFWSIDQLFPIVPIHRLDEKPTARGILSDLTCDSDGKIDKFIGGESSLPLHELEGHGGGYYLGMFLGGAYEEALGGLHNLFGGPSVVRVLQSDGPHGFAVTRAVSGPSCADVLRVMQHEPQLMFETLKHRALEFCEQHDDDSVVNAAGLANSLARSFDNMPYLVSSTTCCLNALTNNDGFYYCSGDDFSAADSASVVTSVAGEDEHWNYCCA

SEQ ID NO: 7610 - protein, 720 aa, Vitis vinifera
MPALACCVDAAVAPPGYAFAGDSSLPAPVPFAGDPLATNDAAALPTGEHSHWSPSLSADLYRIDGWGAPYFSVNTSGNISVRPYGKNTLPHQEIDLMKIVKKVSDPKSAGGLGLQLPLIVRLPDVLQNRLESLQSAFDFAIQSQGYESHYQGVFPVKCNQDRFIVEDVVKFGSAFRFGLEAGSKPELLLAMSCLCKGNPEALLVCNGFKDADYIALALVARKLALNTVIVLEQEEELDLVINLSQKLSVHPVIGVRAKLRTKHAGHFGSTSGEKGKFGLTTIQILRVVRKLEQAGMLDSLQLLHFHIGSQIPSTDLLADGVSEAAQIYCELVRLGAHMRVIDIGGGLGIDYDGSKSSESDISVGYGLEEYAMAVVRAVQHVCDRKSVKHPVICSESGRALVSHHSILIFEAVSASVHDSPATSLSLQRFVEGLSEEARVDYQNLAAAAVSGEYETCLRFADQLKQRCVDQFKEGSLGIEQLADVDGLCDLVSKEVGATDPVRTYHVNLSVFTCIPDFWGIGQLFPIVPIHRLDQRPGARGILSDLTCDSDGKIDKFIGGESSLPLHELEGSDVVFGGSGKYYLGMFLGGAYEEALGGLHNLFGGPSVVRVLQSDGPHSFAVTRAMPGPSCGDVLRVMQHEPELMFETLKHRAEECGHEDGMTNGSLASGLALSFHKMPYLVAGSSCCMTNSGYYYGNEDNYNRAADSAAGDDDHWSYCFA

SEQ ID NO: 7611 - protein, 729 aa, Trifolium pratense
MPALACFVDAAAAVLPPPSGYALAGDSTLPPPLTFTTATTDGVDDDSDSASNWSPSLSSKLFKIDGWGFPYFGVNNAGDIAVRPHGAATMSHQEIDLLKVVKKASDPKCCGGLGLQLPLVVRFPDVLKNRLESIQGAFDGAIQLQGYESHYQGVYPVKCNQDRFVVEDIVEFGSGFRFGLEAGSKPELLLAMSCLCKGNREAFLICNGFKDSEYISLALVARKLALNTVIVLEQEEELDMVVEISNKLCIRPVIGVRAKLRTKHSGHFGSTSGDKGKFGLTTIQILRVVKKLEQLDMLDCLQLLHFHIGSQIPTTELLADGVGEAAQIYCELLRLGAQMRVLDIGGGLGIDYDGSKSGDSDISVAYGIEEYAAAVVHAVKYVCDRRNVNHPVICSESGRAIVSHHSVLIFEAIGASSNKAPSLSSIGLQYLGEGLSEEALVDYQNISAATLRGEHEACLLYTDQFKKRCVEQFKQGTLGIEQLAAVDGLCDLITETIGAKDLVKKYHMNLSVFTSIPDFWSIDQLFPIVPIHRLDEKPTARGILSDLTCDSDGKIDKFIGGESSLPLHELEGHGGGYYLGMFLGGAYEEALGGLHNLFGGPSVVRVLQSDGPHGFAVTRAVSGPSCADVLRVMQHEPQLMFETLKHRALEFCEQHDDDSVVNAAGLANSLARSFDNMPYLVSSTTCCLNALTNNDGFYYCSGDDFSAADSASVVTSVAGEDEHWNYCCA

SEQ ID NO: 7612 - protein, 725 aa, Prunus persica
MPALACCVDAAVAPPGYAFAGDSSLPAPPFSGVPPATTAVTTDSSHWSPSLSSDLYRIDAWGGPYFTVNSSGNVSVRPHGSATLPHQEIDLLKIVKKVSDPKPDCGLGLQLPLIVRLPDVLKNRLESLQGAFDLAIQSHDYGSHYQGVFPVKCNQDRFVVEDIVRFGSPFRFGLEAGSKPELLLAMSCLCKGNPEALLICNGFKDFEYISLALFARKLALNTVIVLEQEEELDVVIDLSKKLGVRPVIGARAKLKTKHSGHFGSTSGEKGKFGLTTTQILRVVKKLDQLGLLDCFQLLHFHIGSQIPSTALLADGVSEAAQIYCELVRLGAHMKFIDIGGGLGIDYDGSKSSDSEISVSYSLEEYAAAVVRAVLNVCDRKSVKHPVICSESGRALVSHHSVMIFEAISSSACDDVPPMSAFALQYFIEGLTEEARADYRNLSAAAIRGEYEACLTYADQLKQRCIDQFKEGSLGIEQLATVDGLCDMVSKAIGASDPVRTYHVNLSVFTSIPDFWGIGQTFPIVPIHRLDQRPAVRGILSDLTCDSDGKIDKFIGGESSLPLHELEGNGGASGGGQKYYLGMFLGGAYQEALGGVHNLFGGPSVVRVSQSDGPHSFAVTLAVPGPSCSDVLRVMQHEPELMFETLKHRAEEYGQGDDGGMASAAVATSLARSFHNMPYLVAASSCCLTAMNNHGLYYCSEDDYDVVADSAGGGGGEEDQWSYCCA

SEQ ID NO: 7613 - protein, 733 aa, Nicotiana tabacum
MPALGCCVDAAVSPPPGYSFLGDSSLPAPEIFPSGVPPSTNTAVATTTTTHWSPAHSSALYSIDGWGAPYFTVNSSGDISVKPHGTDTLPHQEIDLLKVVKKASDPKNLGGLGLQFPLVVRFPDILKNRLESLQSVFDYAVQSQGYEAHYQGVYPVKCNQDRFVVEDIVKFGSGFRFGLEAGSKPELLLAMSCLCKGSHEGLLVCNGFKDAEYISLALVARKLMLNTVIVLEQEEELDLVIDISKKMAVRPVIGLRAKLRTKHSGHFGSTSGEKGKFGLTTTQIVRVVKKLEESGMLDCLQLLHFHIGSQIPSTALLADGVGEAAQIYCELVRLGAGMKYIDCGGGLGIDYDGTKSCDSDCSVGYGLQEYASTVVQAVRFVCDRKNVKHPVICSESGRAIVSHHSVLIFEAVSSTTTRSQELSSVDLQSFVEKLNDDARADYRNLSAAAIRGEYDTCVLYADQLKQRCVEQFKDGDLDIEQLAAVDGICDFVSKAIGASDPVRTYHVNLSIFTSVPDFWAIDQLFPIVPIHKLDERPVVRGILSDLTCDSDGKIDKFIGGESSLPLHELGSNGGGGGDGGKYYLGMFLGGAYEEALGGLHNLFGGPSVLRVSQSDSPHSFAVTCAVPGPSCADVLRAMQHEPELMFETLKHRAEEFVHNDDEQEEDKGLAFASLASSLAQSFNNMPYLVTNSSCCLTAAANNGGYYYCNDENIVGVGAESAAAEEELWPYCVA

SEQ ID NO: 7614 - protein, 613 aa, Vitis vinifera
  misc_feature (186)..(186): Xaa can be any naturally occurring amino acid
MKIVKKVSDPKSAGGLGLQLPLIVRLPDVLQNRLESLQSAFDFAIQSQGYESHYQGVFPVKCNQDRFIVEDVVKFGSAFRFGLEAGSKPELLLAMSCLCKGNPEALLVCNGFKDADYIALALVARKLALNTVIVLEQEEELDLVINLSQKLSVHPVIGVRAKLRTKHAGHFGSTSGEKGKFGLTTXQILRVVRKLEQAGMLDSLQLLHFHIGSQIPSTDLLADGVSEAAQIYCELVRLGAHMRVIDIGGGLGIDYDGSKSSESDISVGYGLEEYAMAVSVKHPVICSESGRALVSHHSILIFEAVSASVHDSPATSLSLQRFVEGLSEEARVDYQNLAAAAVSGEYETCLRFADQLKQRCVDQFKEGSLGIEQLADVDGLCDLVSKEVGATDPVRTYHVNLSVFTCIPDFWGIGQLFPIVPIHRLDQRPGARGILSDLTCDSDGKIDKFIGGESSLPLHELEGSDVVFGGSGKYYLGMFLGGAYEEALGGLHNLFGGPSVVRVLQSDGPHSFAVTRAMPGPSCGDVLRVMQHEPELMFETLKHRAEECGHEDGMTNGSLASGLALSFHKMPYLVAGSSCCMTNSGYYYGNEDNYNRAADSAAGDDDHWSYCFA

SEQ ID NO: 7615 - protein, 724 aa, Datura stramonium
MPALGCCVDAAVSPPLGYAFSWDSSLPAPEFFSSGVPPSTNETAAHTAGSHWSPDLSSALYRVDGWGAPYFSINSSGDISVRPHGTDTLPHQEIDLLKVGKKASDPKHLGGLGLQLPLVVRFPDVLKNRLESLQSAFDMAVHSQGYEAHYQGVYPVKCNQDRFVVEDIVKFGSPYRFGLEAGSKPELLLAMSCLSKGSADALLVCNGFKDTEYISLALVARKLLLNTVIVLEQEEELDLVIDISRKMAVRPVIGLRAKLRTKHSGHFGSTSGEKGKFGLTTTQILRVVKKLDESGMLDCLQLLHFHIGSQIPSTDLLADGVGEATQIYSELARLGAGMKFIDIGGGLGIDYDGTKSSDSDVSVGYGIEEYASAVVQAVQYVCDRKGVKHPVICSESGRAIVSHHSILILEAVSASTGHASPQLSSGGLQSLAETLNEDARADYRNLSAAAVRGEYDTCLLYSDQLKQRCVEQFKEGSLDIEQLAAVDSICDLVSKAIGVADPIRTYHVNLSVFTSIPDFWAFGQLFPIVPIHRLDEKPVMRGILSDLTCDSDGKVDKFIGGESSLPLHELGSDGGRYYLGMFLGGAYEEALGGLHNLFGGPSVVRVLQSDSPHSFAVTRSVPGPSCADVLRAMQFEPELMFETLKHRAEEYLEQEEKEEDKSMSFASLTSSLAQSFHNMPYLVAPSSCCFTAATGNNGGYYYYSEDKAADCATGEDDIWSYCTA

SEQ ID NO: 7616 - protein, 259 aa, Glycine max
MGFQKSRPMKCQKKTLWRSQKSLRALLHPRASHSVISGTVKKPIGAKKAVKSGGLGARKLTKKPSESLYEQKPEEPPAPVPSSTNSMPAGPSPTSRFEYVENVQSSDLNTGGSHVLSHVSPPKSSSFFADFGMDGGFPKKSGPSSSKVQIQETDEARRKFSNAKSISSSQFFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 7617 - protein, 474 aa, Glycine max; identical to SEQ ID NO: 6472

SEQ ID NO: 7618 - protein, 470 aa, Vigna angularis; identical to SEQ ID NO: 6475

SEQ ID NO: 7619 - protein, 453 aa, Glycine max
MAFSAAAAAADNSGKDDDGPHKGFKQSRPMNLVIARSPVFTVPPGLSPSGFLNSPGFFSPQSPFGMSHQQALAQVTAQAVLAQSHMHMQADYQMPAVTAPTEPPVRQLSFALNEASEQQVVSCVSSVSEPRNAQLEAPELSQADKKYQPSSQAIDKPADDGYNWRKYGQKQVKGSEYPRSYYKCTHLNCVVKKKVERAPDGHITEIIYKGQHNHEKPQANRRAKDNSDSNGNVTVQPKSESNSQGWVGQLNKFSEKIPDSSVAKSDQTSNQGAPPRQLLPGSSESEEVGDVDNREEADDGEPNPKRRNTDVGVSEVPLSQKTVTEPKIIVQTRSEVDLLDDGYRWRKYGQKVVKGNPHPRSYYKCTSAGCNVRKHVERASMDPKAVITTYEGKHNHDVPAARNSSHNTASSNSMPLKPHNVVPEKHPLLKDMDFGSTDQRPVHLRLKEEQIIV

SEQ ID NO: 7620 - protein, 320 aa, Glycine max
MDSSSINSNSKEITMEIPSLVRLYKDGTIERLQNSPIVPPTLQDPTSSKDVVISGDPLISARLFLPNRIRSQQEGHKVPILVYFHGGGFFFESAFNQLHHNYFNKFVSVADVLVVSVEYRLAPETLLPAAYDDCWDALKWVATNTEPWLVKHGDFNRVFIGGDSAGANIVHNIAMRAGAEALPGGVKLLGAFLSHSYFYGSRPIGSEPVAGHQQSVPYLVWDFVYPSAPGGIDNPMINPMVTGAPSLAGLGCSKILVCVAEKDLIKDRGVAYYEAVKKSGWQGEAELFEVEGEDHAFHIHNPQTQNAMKMIKRLSDFLLH

SEQ ID NO: 7621 - protein, 235 aa, Glycine max
MGRGKIEIKRIDNASSRQVTFSKRRTGLFKKAQELSILCDAEVAVIVFSNTGKLFEFSSSGMKRTLSRYNKCLGSTDAAVAEIKTQKEDSKMVEILREEIAKLETKQLQLVGKDLTGLGLKELQNLEQQLNEGLLSVKARKLEQSRVQEQRVMLENETLRRQIEELRCLFPQSESMVPFQYQHTEGKNTFVDTGARYLNLANNCGNEKGSSDTSFHLGLPAGVQEEGPQERNLFK

SEQ ID NO: 7622 - protein, 492 aa, Glycine max
MASAASATFPVTTACFNTNTVDARKSSFFEFKPLNRSNKVPADFNNHVSKQSTQVEGPGKAQSFASSPLVESEITVPSNELSLSSPVQMVSSSASAPVDVDLDEINHKGNTATGLQASHVEVRGSGLSVAAEKTSDDGYNWRKYGQKLVKGSEFPRSYYKCTHPNCEVKKLFERSHDGQITEIVYKGTHDHPKPQPSCRYSTGTVMSIQGERSDKASMAGRDDKATAMYGQVSHAAEPNSTPESSPVATNDDGLEGVAGFVSNRTNEEVDNDDPFSKRRKMELGNVDITPVVKPIREPRVVVQTLSEVDILDDGYRWRKYGQKVVRGNPNPRSYYKCTNAGCPVRKHVERASHDPKAVITTYEGKHNHDVPAARNSSHDMAVPAAAAGGQTRTKLEESDTISLDLGMGISSAAEHRSNGQGKMLHSEFGDTQTHTSSSNFKFVHTTSAPVYFGVLNNSSNPFGSRDNRSDGPSLNRSSYPCPQSMGRILMGP

SEQ ID NO: 7623 - protein, 493 aa, Glycine max
MHGSMASAAFPVTTACFDTNTVDDRKSSFFEFKPLSRSNMVPADFNNHVSKQSTQVEGPGKTQSFASSPLVESEIAVPSNELSLSSPVQKVSSSASAPVDVDLDDINHKGNTATGLQASHVEVRGSGLSVAAEKTSDDGYNWRKYGQKLVKGSEFPRSYYKCTHPNCEVKKLFERSHDGQITEIVYKGTHDHPKPQPSCRYSTGTVLSIQGERSDKASMAGRDDKATAMYGQVSHAAEPNSTPESSPVATNDDGLEGVAGFVSNRTNEEVDNDDPFSKRRKMELGNVDITPVVKPIREPRVVVQTLSEVDILDDGYRWRKYGQKVVRGNPNPRSYYKCTNAGCPVRKHVERASHDPKAVITTYEGKHNHDVPAARNSSHDMAVPAAAAGGQTRTKLEESDTISLDLGMGISSAAEHRSNGQGKMLHSEFGDTQTHTSSSNFKFVHTTSAPVYFGVLHNSSNPFGSRDNRSDGPSLNRSSYPCPQSMGRILMGP

SEQ ID NO: 7624 - protein, 488 aa, Retama raetam
MVEPSPTTGSFSKLLQTVHGSMPSAASATFPVTTACFNTNTVEERKSNIFEFKPHNKSNMVPADFKNHVSEQSIQAEGPGKAQSFASSPLIECEIDVPSNELSLSSPVQMVSSGASTPVEVDSDELNHKGNTITVLQASQVEEVKGSGLPVAPERASDDGYNWRKYGQKLVKGSEFPRSYYKCTHPNCEVKKLLECSHDGQITEIVYKGMHDHPKPQPSRRYSVSMQEERSGKASLAGRDAEPNSTPDLSSVATNDDSREGADRTNDEVDDDDPFSKRRKMELGFADITHVVKPIREPRVVVKTLSEVDILDDGYRWRKYGQKVVRGNPNPRSYYKCTNAGCPVRKHVERASHDPKAVITTYEGKHNHDVPAARNSSHDMAGPAGVVGGQTRIKLEESDSISLDRGMGISSAAENRSNGQGKMLLSEFGNSQTQTSNSNFKFVHTTAGPVYFGVNPYGSIENRSDGPSLNHASSYPCSQNIGRILTGP

SEQ ID NO: 7625 - protein, 320 aa, Glycine max
MASLKLPEVVPSPTQDSERLRKAFQGFGTDEKAVILVLGHRNAQQRKKIGETYQQLYNESLVDRLHSELSGDFRNAVILWTYDPPERHARLAKDALKAKKGIKHLQVLVEIACASTPNHLVAVRQAYCSLFDCSLEEDIIASVAPALRKLLVSLVSSFRYDKVAVNLEVAKEEASKLHEAINSKQLDNDHIIWILSTRNLFQLRETFACYNNLYGNTLEQDIKKCGNGDLESFLHTVIWCIDCPEKHFAKVVRDSIVGFGTDEDSLNRAIVTRAEIDLLNVRFEYANVYKSSLDDDVIGDTSGYYKDFLMTLLGKGPDGE

SEQ ID NO: 7626 - protein, 493 aa, Glycine max; identical to SEQ ID NO: 7623

SEQ ID NO: 7627 - protein, 492 aa, Glycine max; identical to SEQ ID NO: 7622

SEQ ID NO: 7628 - protein, 201 aa, Glycine max
MASAGDVFRQGLPEVCAAGKLHVLAVDDSHVDRKVIERLLKISSCKVTVVESGSRALQYLGLDGEKSSIGLDSVKVNLIMTDYSMPGMTGYELLKKIKESSVFREVPVVVMSSENILTRIDSCLEEGAEEFLLKPVKLSDVKRVTDFIMRGEGMKGVKISKKRSRSDDCIPSLSTAFSSVSHPCDISSPPSPCVLQPKNLD

SEQ ID NO: 7629 - protein, 279 aa, Vitis vinifera
MEGNSGGNDVELLCKTLQVEHKLFYFDLKENPRGRYLKISEKTSATRSTIIVPFSGISWFLDLFNYYVNSDEQDVFSKELQLDTKVFYFDIGENRRGRFLKVSEASVSRNRSTIIVPAGSTRDEGWAAFRNILAEINEASRLFILPNQQSSEPSERLVGLSDDVGAGFISGHSTQPAPASELNVERSVELPAQDEIGNLGVSKVIRADQKRFFFDLGSNNRGHFLRISEVAGSDRSSIILPLSGLKQFHEMVGHFVEITKDRIEGMTGANVRTVDPPQR

SEQ ID NO: 7630 - protein, 291 aa, Vitis vinifera
MRPEEEELLLPLLLVYHYCRNGQMEGNSGGNDVELLCKTLQVEHKLFYFDLKENPRGRYLKISEKTSATRSTIIVPFSGISWFLDLFNYYVNSDEQDVFYFDIGENRRGRFLKVSEASVSRNRSTIIVPAGSTRDEGWAAFRNILAEINEASRLFILPNQQSSEPSERLVGLSDDVGAGFISGHSTQPAPASELNVERSVELPAQDEIGNLGVSKVIRADQKRFFFDLGSNNRGHFLRISEVAGSDRSSIILPLSGLKQFHEMVGHFVEITKDRIEGMTGANVRTVDPPQR

SEQ ID NO: 7631 - protein, 286 aa, Glycine max
MEGNSGGGGGGGGGNDVELLCKTLQVEHKLFYFDLKENPRGRYLKISEKTSATRSTIIVPFSGISWFLDLFNYYVNSDDQDLFSKELQLDTKVFYFDIGENRRGRFLKVSEASVSRNRSTIIVPAGSSRDEGWAAFRNILAEINEASRLFILPNQQNSESSEHLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMAVANVRTIDPPQR

SEQ ID NO: 7632 - protein, 269 aa, Populus trichocarpa
MCKTLQVEHKLFYFDLKENPRGRYLKISEKTSATRSTIIVPFSGISWFLDLFNYYVNNSADDQDLFSKELQLDTKVFYFDIGENRRGRFLKVSEASVSRNRSTIIVPAGSSRDEGWAAFRNILAEINEASRLFMLPNQQSSETSERLVGLSDDVGAGFISGHSSQSVTTSELNVDRSVELPPQDEIGNMAVSKVIRVDQKRFFFDLGSNNRGHFLRISEVAGNDRSSIILPLSGLKQFHEIVGHFVEITKDRIEGMTGANVRTVDPPQR

SEQ ID NO: 7633 - protein, 256 aa, Vitis vinifera
MEGNSGGNDVELLCKTLQKTSATRSTIIVPFSGISWFLDLFNYYVNSDEQDVFSKELQLDTKVFYFDIGENRRGRFLKVSEASVSRNRSTIIVPAGSTRDEGWAAFRNILAEINEASRLFILPNQQSSEPSERLVGLSDDVGAGFISGHSTQPAPASELNVERSVELPAQDEIGNLGVSKVIRADQKRFFFDLGSNNRGHFLRISEVAGSDRSSIILPLSGLKQFHEMVGHFVEITKDRIEGMTGANVRTVDPPQR

SEQ ID NO: 7634 - protein, 282 aa, Ricinus communis
MEGNSGGGGNNNSTGGTGTGMGVGTGGGGDVELMCKTLQVEHKLFYFDLKENPRGRYLKISEKTSATRSTIIVPFSGISWFLDLFNYYVFYFDIGENRRGRFLKVSEASVSRNRSTIIVPAGSTRDEGWAAFRNILAEINETSRLFILPNQQNSEPSERLVGLSDDVGAGFISGHSNQPAPASELNVDRSVELPAQEDIGNMGVSKVIRADQKRFFFDLGSNNRGHFLRISEVAGSDRSSIILPLSGLKQFHEIVGHFVEITKDRIEGMTGANVRTVDPPQR

SEQ ID NO: 7635 - protein, 317 aa, Populus trichocarpa
MEGNSGGGSGSGAAAAGGGGGGNDVELMCKTLQVEHKLFYFDLKENPRGRYLKISEKTSATRSTIIVPFSGISWFLDLFNHYVDNSADDQDLFSKELQLDTKAFFLIPTPSLLPLSLITNSVFYFDIGENRRGRFLKVSEASVSRNRSTIIIPAGSSRDEGWAAFRNILAEINEASRLFLLPNQVTCSETSEQLVGLSDDVGAGFISGHSSQSPAPTSELNVDRSVDLPPQDEIGNLGVSKVIRVDQKRFFFDLGSNNRGHFLRISEVAGNDRSSIILPLSGLKQFHEIVGHFVEITKDRIEGMTGANIRTIDPPRR

SEQ ID NO: 7636 - protein, 295 aa, Arabidopsis thaliana
MEANSGGGGGAEGGRAVTGGGGGGGGSDVELVSKTLQVEHKLFYFDLKENPRGRYLKISEKTSATRSTIIVPSSGISWFLDLFNYYVNSEEHELFSKELQLDSKVFYFDIGENRRGRFLKVSEASVSRNRSTIIVPAGSSPDEGWAAFRNILAEIHEASGLFVMPNQKPSDGQEHLVDDVGAGFIPGHGSQQPSSSEHNVDRTIDSPGQEETGMTGVSKVIRADQKRFFFDLGNNNRGHFLRISEVAGSDRSSIILPLSGLKQFHEVIGHFVEITKDKIEGMTGANVRTVDPPQR

SEQ ID NO: 7637 - protein, 296 aa, Arabidopsis thaliana
MEANSGGGGGAEGGRAVTGGGGGGGGSDVELVSKTLQVEHKLFYFDLKENPRGRYLKISEKTSATRSTIIVPSSGISWFLDLFNYYVNSEEHELFSKELQLDSKVFYFDIGENRRGRFLKVSEASVSRNRSTIIVPAGSSPDEGWAAFRNILAEIHEASGLFVMPNQVKPSDGQEHLVDDVGAGFIPGHGSQQPSSSEHNVDRTIDSPGQEETGMTGVSKVIRADQKRFFFDLGNNNRGHFLRISEVAGSDRSSIILPLSGLKQFHEVIGHFVEITKDKIEGMTGANVRTVDPPQR

SEQ ID NO: 7638 - protein, 287 aa, Arabidopsis lyrata subsp. lyrata
MEANSGGGAEGGRAATGGGGGSDVELVSKTLQVEHKLFYFDLKENPRGRYLKISEKTSATRSTIIVPSSGISWFLDLFNYYVNSEEHELFSKELQLDSKVFYFDIGENRRGRFLKVSEASVSRNRSTIIVPAGSSPDEGWAAFRNILAEIHEASGLFVMPNKVKPSDGQEHLVDDVGAGFIPGHGSQQPSSSEHNVDRSVDSPGQEETVSKVIRADQKRFFFDLGNNNRGHFLRISEVAGSDRSSIILPLSGLKQFHEVIGHFVEITKDKIEGMTGANVRTVDPPQR

SEQ ID NO: 7639 - protein, 345 aa, Glycine max
MSGLIERLPDAVAIRCLARVPFYFHPVLELVSRSWQAAIRSPELFKARQEVGSTEDLLCVCAFDPENLWQLYDPMRDLWITLPVLPSKIRHLSNFGAVSTAGKLFVIGGGSDAVDPLTGDQDGCFATDEVWSYDPVVRQWAPRASMLVPRSMFACCVLNGKIVVAGGFTSCRKSISQAEMYDPDKDVWIPMPDLHRTHNSACSGVVIGGKVYVLHKDLSTVQVLDNAGPGWTVEECVWLQGQMAVVGDALYVMSHGLIFKQDKEERKVVGSASEFRKRIGFAMTGLGDDLYVIGGFIGPDRWNWDIKPLSEVDVLTLGSERPTWRQAAPMTRCHGPILGCTLLRI

SEQ ID NO: 7640 - protein, 344 aa, Glycine max
MSGLIEGLPDAVAIRCLAWVPFYLHPKLELVSRAWRAVVRGPELFKARQELGSSEDLLCVCAFEPENLWQLYDPQRDLWITLPVLPSRIRHLSHFGAVSTAGKLFVIGGGSDAVDPLTGDQDGCFATNEVWSYDPVVRQWSPRAAMLVPRSMFACCVMNGKIVVAGGFTSCRKSISQAEIYDPEKDVWIPMPDLHRTHNSACSGVVIGGKVHVLHKDMSTVQVLDNAGQWTVEEYGWLHGQMAVIRDALYVISHGLIIKQDKKMRKVVGSASEFRRRIGFAMIGLGDELYVIGGVIGPDRWNWDIKPLSDVDVLTLASERPTWRQAAPMTRCGGTIFGCTQLRI

SEQ ID NO: 7641 - protein, 345 aa, Populus trichocarpa
MSELIEGLPDAVAIRCIARVPFYLHPKLELVSRSWRAVVRSPELFKARQEVGSAEDLLCVCAFDPENLWQLYDPHRDLWITLPVLPSKIRHLAHFGVVSSAGKLFVLGGGSDAVDPLTGDQDGSFATNEVWSYDPVLRQWAARASMLVPRAMFACGTLNGKIVVAGGFTSCRKSISQAEMYDPEKDVWIPIPDLHRTHNSTCSGVVIGGKLHVLHRGLSTVQVLDNVGSGWTVEDYGWLQGPMAVVHDALYVMSHGLIFKQEGKTRKVVVSASEFRKRIGFAMMGLGDDIYVIGGVIGPDRWNWDIRPMSDVDILTVGGDRPTWRQATPMTRCRGTILGCTQLRI

SEQ ID NO: 7642 - protein, 345 aa, Ricinus communis
MSELIEGLPDAIAIRCIARVPFYLHPKLELVSHSWRSAIRSPELFKARQEVGSAEDLLCVCAFEPENLWQLYDPLRDLWITLPVLPSKIRHLAHFGVVSTAGKLYVLGGGSDAVDPLTGDQDGNFATNEVWSYDPVIRQWALRASMLVPRAMFACCVLKGKIVVAGGFTSCRKSISQAEMYDPEKDVWIPIPDLHRTHNSACSGIVIGGKVHILHKGLSAVQVLDNVGAGWTVEDYNWLQGPMAVVHGALYVMSHGLICKQEGKVRKVVVSASEFRRRIGFAMTGLGDDIYVIGGVIGPDRWNWDIKPMSDVDILAVGGERPTWRQAAPMSRCRGTILGCAQLRI

SEQ ID NO: 7643 - protein, 345 aa, Populus trichocarpa
MSELIEGLPDAVAIRCIARVPFYLHPKLEVVSRSWQAAVRSTELFKARQEVGSAEDLLCVCAFDPENLWQLYDPLRDLWITLPILPSKIRHLAHFGVVCSAGKLFVLGGGSDAVDPLTGDQDGSFATNEVWSYDPVLREWAARASMLVPRAMFACCALNGKIVVAGGFTSCQKSISQAEMYDPEKDVWVPIPDLHRTHNSACSGVVIGGKLHVLHRGLSTVQVLDSIGSGWTVEDYGWLQGPMAVVHDALYVMSHGLIVKQEGKTRKVVVSASEFRKRIGFAMTGLGDEMYVIGGVIGPDRWNWDIKPVSDVDILTVGGERPTWRQATPMTRCRGTIRGCAQLRI

SEQ ID NO: 7644 - protein, 345 aa, Vitis vinifera
MSGLIEGLPDAVALRCLAWVPFYLHPRLELVSRSWRDAIRGPELFKARQEVGSSEDLLCVCAFDPENLWQLYDPRKDLWISLPVLPSRIRHLAHFGAVSTAGKLFVLGGGSDAVDPLTGDQDGSFATNEVWSYDPIIRQWAPRAPMLVPRAMFACCVLDGKIVVAGGFTSCRKSISQAEIYDPEKDAWVSIPDLHRTHNSACSGVVLDGKVHVLHKGLTTVQILDKVGPGWRVEDYGWLQGPMAIVQGALYVMSHGIIFKQEREVKKMVVSASEFRRRIGFAMTGLRDEIYVIGGVIGPDRWNWDIKPLSDVDVLTIGSERPAWRQVSPMSQCRGTIFGCTQLRI

SEQ ID NO: 7645 - protein, 345 aa, Arabidopsis lyrata subsp. lyrata
MSGLLESIPDAVALRCLAHVPLHLHPNLELVSRSWRAAIRSAELFRVRQEVRSSEHLLCVCAFDPENIWQVYSPNCDRWLTLPLLPSRIRHLAHFGAVTTPGKLFVLGGGSDAVNPLTGDHDGTFATDEVWSYDFVLRRWTPLAPMLLPRAMFACCVLQGKIVVAGGFTTCRKSISGAEMYDPENDAWTSIPDLHRTHNSACSGLVVNGKVHVLHKGLSTVQVLESVKLGWAVKDYGWPQGPMAVVEDVLYVMSHGLVFKQEGDTWKMVASASEFKRRIGMAMTSLSEEVLIVGGVIGPDRLNWDIKPLSDVDVLTVGNDRPAWRRVAPMTRCRGTILGCTQLTI

SEQ ID NO: 7646 - protein, 279 aa, Vitis vinifera; identical to SEQ ID NO: 7629

SEQ ID NO: 7647 - protein, 336 aa, Glycine max
MDDAGHRENGRHKAADQYKSAQGQWLMQHQPSMKQIMAMIAERDAAIQERNLAISEKKAAYAERDMAYMQRDAAIAERNNAMLERDAIATLQYRETSLSSGSMPSCPPGCQISRGVKHVHHPQQQVHHIPNMGDASYNTREMHTTEVLPAAPIPSETGKSRRAKRPKEPKSAPPNKKTSKPSKKVKKESEDLNNMFGKAHEWKSGQEMVNGGDDLNKQLAVSKADWKGQDLGLNQVAYDESTMPAPVCSCTGVLRQCYKWGNGGWQSACCTTTLSMYPLPAVPNKRHARVGGRKMSGSAFNKLLSRLAAESHDLSNPVDLKDHWAKHGTNRYITIK

SEQ ID NO: 7648 - protein, 338 aa, Glycine max
MDDAGHRENGRHKAADQYKSAQRQWLMQHQPSMKQIMAIMAERDAAIQERNLAISEKKAAYAERDMAFMQRDAAIAERNNAILERDNAIATLQYRETSLSSGSMPSCPPGCQISRGVKHIHHPQQQVHHIPNMGDASYSTREMHTTDALPAAPIPSEAGKPRRAKRPKEPKSASPNKKTSKPAKKVKKESEDLNKVMFGKSHEWKSGQEMVNGGDDLNKQLTVSKADWKGQDLGLNQVAYDESTMPAPVCSCTGVLRQCYKWGNGGWQSACCTTTLSMYPLPAVPNKRHARVGGRKMSGSAFNKLLSRLAAEGHDLSNPVDLKDHWAKHGTNRYITIK

SEQ ID NO: 7649 - protein, 339 aa, Ricinus communis
MDDGGHRENGRHKADQYKTAQGQWLMQAQPSMKQIMAIMAERDAAIHERNMAISEKKAAIAERDMAFLQRDSAIAERNNAIMERDNAIATLQYRENSIPSGNMPSSCPPGCQISRGVKHMHHPQQHAHHMPHSSEASYSTREMQTSDTLPMSPVGSEAAKPRRVKRSKDAKMAPSNKKTSKSPRKIKRESEDLNKVMFGKSHEWKNGQDMGGGADDLNKQLVVASKSDWKGHDLGLNQIAFDESTMPAPVCSCTGVFRQCYKWGNGGWQSSCCTTTLSMHPLPAVPNKRHARVGGRKMSGSAFSKLLSRLAAEGYDLSSPVDLKEHWAKHGTNRYITIK

SEQ ID NO: 7650 - protein, 337 aa, Vitis vinifera
MDEGGHRENGRHKADPYKAVHSQWLMQHQPTMKQIMAIMAERDTAVQERNLALSEKKAAVAERDMAFLQRDTAIAERNNAIMERDNAIATLQYRENSLNGGNMSPCPPGCQISRGVKHMHHPQPHLHHPTHLSEAAYSAREMHIGDALPVSPVASEAAKSRRAKRPKEAKPMSSNKKASKPLKKPKREGEDLNKIVFGKSREWKGGQDMSSGGDDLNKQLVVSKSDWKGQDLGLNQVTFDESTMPAPVCSCTGVLRQCYKWGNGGWQSSCCTTTLSMYPLPAVPNKRHARVGGRKMSGSAFNKLLSRLAAEGHDLSIPVDLKDHWAKHGTNRYITIK

SEQ ID NO: 7651 - protein, 335 aa, Populus trichocarpa
MDDGVHRENGRHKADQYKTAQGQWLMQPQPSMKQIMAIMAERDAAIHERNMALSEKKAAVAERDMAFLQRDSAIAERNNALLERDNAIATLQYRENSFASANTSSSPPGYHNSRGVKHMHHQQQHIHLPHMNEGAYGTREMQTSDAVPISPVASEAAKPRRGKRPKDTQSTPSNKKTSKSPMKVKRESEDLNNMFGKSNEWKNGEDMNGGGDGLNKQLAASKSDWKGQDLGLNQVAFDETTMPAPVCSCTGFFRQCYKWGNGGWQSSCCTTALSMYPLPAVPNKRHARVGGRKMSGSAFSKLLSRLAAEGQDLSNPVDLKDHWAKHGTNRYITIK

SEQ ID NO: 7652 - protein, 318 aa, Medicago truncatula
MQQHQHQHPSMKQIMSIMAERDAAIQERNLALSEKKAALAERDMAFLQRDTAIAERNNALMERDNAIATLQFRENALANGGMSSCPPGCQISRGVKHIHHLPQQVNHLPNMGDSSYGTRELHTTDALPAAPVSLEVGKPPRRAKRPKESKSDSPNKKTPKSRKVKKEGDDLNKTMFANNKELEWKSSEEIINGDDDLNKQLAISKADWKPQDLALNQVAYDDSTMPAPACSCTGVLRQCYKWGNGGWQSACCTTTLSVYPLPAVPNKRHARVGGRKMSGSAFNKLLSRLAAEGHDLSHPVDLKDHWAKHGTNRYITIK

SEQ ID NO: 7653 - protein, 336 aa, Populus trichocarpa
MDDGGHRENGRHKADQYKTAQGQWLMQPQPSMKQIMAIMAERDAAIHERNMALSEKKAAITERDMAFLQRDSAIAERNNALLERDNAIATLQYRENSLPSGNMTTCPPGFHNSRGVKHMHHQQQQHTHHLPHMNEGPYGTREMQTSDALPVSPVASEVAKPQRGKRPKDAKATPSNKKTSKSPRKVKRESDDTDMFGKSHEWKNGQDMDGGGDDPNKQLAASKSDWKGQDLGLNQVAFDETTMPAPVCSCTGVFRQCYKWGNGGWQSSCCTTTLSMYPLPAVPNKRHARVGGRKMSGSAFSKLLSRLAAEGQDLSNPVDLKDHWAKHGTNRYITIK

SEQ ID NO: 7654 - protein, 342 aa, Arabidopsis thaliana
MDDGGHRENGRHKAAVQGQWLMQHQPSMKQVMSIIAERDAAIQERNLAISEKKAAVAERDMAFLQRDTAIAERNNAIMERDSALTALQYRENSMVTAPAANMSACPPGCQISRGVKHLHHPHMHHHHQQHHIPQLTENAYETREMEPNDGLPTSPPAGSTLESAKPKRGKRVNPKATTQTAANKRGPKNQRKVKKESEDDLNKIMFVKTTHDYTDEDSSKHILIGSKSDWKSQEMVGLNQVVYDETTMPPPVCSCTGVLRQCYKWGNGGWQSSCCTTTLSMYPLPALPNKRHARVGGRKMSGSAFNKLLSRLAAEGHHDLSNPVDLKDHWAKHGTNRYITIK

SEQ ID NO: 7655 - protein, 345 aa, Glycine max; identical to SEQ ID NO: 7639

SEQ ID NO: 7656 - protein, 253 aa, Glycine max
MDVKAAQRLQLSAVVQPERFGRRPPFSTCRLGVSREPQSLRVFVSPMMMRRRTTALEVSSSYDNISASILESGSVHAPLDEELILKNRSQETQPYLNGRCIYLVGMMGSGKTTVGKIMSQVLGYSFCDSDALVEEEVGGNSVVDIFEQHGETFFRNKETEVLHKLSLLHRLVISTGGGAVMRPINWKYMHKGVSVWLDVPVEALAQRIAAVGTNSRPLLNYEAGDPYTRAFMRLSAILKREVKHMPMPMPGSH

SEQ ID NO: 7657 - protein, 229 aa, Populus trichocarpa
MIGGGRIQLNGWQQAAVAVGSAVGALLDPRRADLIAALGETTGKHAFERVVERMKKSPEGRALLLERPRVISAQVGHAWDLPANTFGAAYASFMGSRNFSPDDRPPVRFMETEELAYVAMRAREVHDFWHTLFGLPTNLIGESALKVIEFEQMYLPMCLMSVVGGTARFTEKQRKSFFQHYFPWAVRAGLQSTDLMCVYYEKHFHEDLEDVRRKWGITPAPAAPNQDVP

SEQ ID NO: 7658 - protein, 229 aa, Populus trichocarpa
MIGGGKIRLNRWQQAAVAVGSAVGSLLDPRRADLIAALGETTGKPAFERVVERMKKSPEGRAVLLERPRVISAQVGHAWDLPANTFGAAYARFMGSRNFSPDDRPPVRFMETEELAYVAMRAREVHDFWHTLFGLPTNLIGESALKVIEFEQMYLPMCLMSVVGGTVRFTEKQRKLFFQHYFPWAIRAGMQSTDLMCVYYEKHFQEDLEDVRRKWGITPAPAAPNQNVP

SEQ ID NO: 7659 - protein, 227 aa, Vitis vinifera
MMIGGARVRLNGWQQAAVAMGSAIGALMDPRRADLIAALGETTGKPAFERVLERMKKSPEGQAILLDRPRVVSARVGHAWDMPANTFGAAYAKFMGSRNFSPDDRPPVRFMETDELAYVAMRAREVHDFWHTLFSLPTNLIGESALKVIEFEQMFLPMCLLSVIGGTARFSEKQRALFFQHYFPWATRAGMQCTDLMCIYYEQHFHEDLDDVRRKWGIVPAPPPPRQ

SEQ ID NO: 7660 - protein, 230 aa, Ricinus communis
MIAGGARVRLNRWQQAAVAVGSALGALLDPRRADLIAALGETTGKPAFERVLQRMKSSPEGRAVLLDRPRVVSANIGYAWDLPANTFGAAYARFMGSRNFSPDDRPLVRFMDTDELAYVAMRAREVHDFWHTLFDLPTNLVGESALKVIEFEQMYLPMCIMSVVGGTTRFNEKQRKLFLQHYFPWAVRAGMQCTDLMCVYYEKHFHEDLDDVRRKLGIIPAPAVPKQNAA

SEQ ID NO: 7661 - protein, 226 aa, Arabidopsis lyrata subsp. lyrata
MIIERARVPLSRWQQAAVAMGSAIGALVDPRRADLIAALGETTGKPAFEMVLERMKKSEEGRAILLERPRVVSEQVGHAWDLPENTFGAAYAKFMGSRNFSPDDRPPVRFMETDELAYVATRAREVHDLWHTLFGLPTNLIGESALKVIEFEQMYLPMCMLSVIGGTVRFNEKQRSMFLKHYFPWAVRAGRQCTDLMCVYYERHFSEDLEQVRRKWGIIPAPQHPK

SEQ ID NO: 7662 - protein, 226 aa, Arabidopsis thaliana
MIIERARVPLSRWQQAAVAMGSALGALVDPRRADLIAALGETTGKPAFEMVLERMKKSEEGRAILLERPRVVSEQVGHAWDLPENTFGAAYAKFMGSRNFSPDDRPPVRFMETDELAYVATRAREVHDLWHTLFGLPTNLIGESSLKVIEFEQMYLPMCMLSVIGGTVRFNEKQRSMFLKHYLPWAVRAGRQCTDLMCVYYERHFSEDLEQVRRKWGIIPAPQHPK

SEQ ID NO: 7663 - protein, 227 aa, Zea mays
MLGARVQLKGWQQAAVAFGSAFGALLDPRRADLIAALGETTGKPAFERVLQRMKNSAEGREVLSERPRVVSSQVSHAWDMPQNTFGAAYAQFMGSRNFSPDDRPPVRFMDTDELAYVATRAREVHDFWHVLFGLPTNLIGETALKVIEFEQMFLPMCMLSVVGGSARFSDKQRALFFQHYFPWATKAGLKCTDLMSVYYEKHFHEDLEEVRRNWGILPCPSPKKSSV

SEQ ID NO: 7664 - protein, 226 aa, Arabidopsis lyrata subsp. lyrata
MIIERARVPLRRWQQAAVAMGSAIGALVDPRRADLIAALGETTGKPAFEMVLERMKKSEEGRAILLERPRVVSEQVGHAWDLPDNTFGAAYAKFMGSRNFSPDDRPPVRFMETDELAYVATRAREVHDLWHTLFGLPTNLIGESALKVIEFEQMYLPMCMLSVIGGTVRFNEKQRSMFLKHYLPWAARAGRQCTDLMCVYYERHFSEDLEQVRRNWGIIPAPQHPK

SEQ ID NO: 7665 - protein, 227 aa, Oryza sativa Japonica Group
MQGARVNLKGWQQAAVAFGSAFGALLDPRRADLIAALGETTGKPAFQRVLQRMRNSAEGRDVLLERPRVISTQVSHAWDMPQNTFGAAYAQFMGSRNFSPDDRPPVRFMDTDELAYVATRAREVHDFWHVLFGLPTNLIGETALKVIEFEQMFLPMCMLSVVGGSARFNEKQRTLFFQHYFPWASKAGLKCTDLMSVYYEKHFHEDLDEVRRNWGIIPCPDPKRSSV

SEQ ID NO: 7666 - protein, 227 aa, Oryza sativa Indica Group
MQGARVNLKGWQQAAVAFGSAFGALLDPRRADLIAVLGETTGKPAFQRVLQRMRNSAEGRDVLLERPRVISTQVSHAWDMPQNTFGAAYAQFMGSRNFSPDDRPPVRFMDTDELAYVATRAREVHDFWHVLFGLPTNLIGETALKVIEFEQMFLPMCMLSVVGGSARFNEKQRTLFFQHYFPWASKAGLKCTDLMSVYYEKHFHEDLDEVRRNWGIIPCPDPKRSSV

SEQ ID NO: 7667 - protein, 131 aa, Glycine max
MASKGALLLCLNILFFTVVSSTYVPCNPPPKTPKHTPVPKPPSPKQPSCPKDTIKFGVCADVLGLINVQLGKPPKTPCCNLIQGLADLEAAVCLCTALKANVLGINLNVPVKLSLLLNYCGKGVPKGFVCA

SEQ ID NO: 7668 - protein, 131 aa, Glycine max
MASKAALLLCFNVLFFTVVSSTYVPCNPPPKTPKHPPVPKPPSPKQASCPKDTIKFGVCADVLGLINVQLGKPPKTPCCNLIEGLADLEAAVCLCTALKANVLGINLNVPVNLSLLLNYCGKGVPKGFVCY

SEQ ID NO: 7669 - protein, 131 aa, Glycine max
MASKAALLLCLNVLFFTVVSSTYVPCNPPPKTPKRPPVPKPPSPKLASCPKDTIKFGVCADVLGLINVQLGKPPKTPCCNLIQGLADLEAAVCLCTALKANVLGINLNVPVNLSLLLNYCGKGVPKGFVCY

SEQ ID NO: 7670 - protein, 131 aa, Glycine max
MTSKGAILLCLNVLFFTVVSSTYVPCNPPPKTPKHPPVPKPPSPKQVSCPKDTVKFGVCADVLGLINVQLGKPPKTPCCSLIQGLADLEAAVCLCTALKANVLGINLNVPVNLSLLLNYCGKGVPKGFVCY

SEQ ID NO: 7671 - protein, 131 aa, Cajanus cajan
MASKAALLLSLNILFFTVFSSSYVPCSPPPKVPKHPPVPKPPSTKSGTCPKDTLKFGVCANLLGLVNVNLGKPPKTPCCSLIEGLADLEAAVCLCTALKANVLGINLNVPVKLSLLLNVCGKKTPKDFICA

SEQ ID NO: 7672 - protein, 127 aa, Phaseolus vulgaris
MQMAPQANILFFTVVSSTYVPCNPPPKTPKHPPVPKPPSTKSGSCPENTLKFGVCADVLGLIGVELGKPPKTPCCNLIQGLADLEAAVCLCTALRANVLGINLNVPIKLNLLLNYCGKKTPKDFVCY

SEQ ID NO: 7673 - protein, 232 aa, Glycine max
MAASITLSRLVSSTLTTASFFPPITLPSKLSSLRLPTRRHPKPLRFSSSTITATISVGDKLPEATFSYLDSSGEVQTTTVSELTKGKKAVLFAVPGAFTPTCSQKHVPGFVEKSGELRAKGIDTIACISVNDAFVMKAWKEDLKVNEEVLLLSDGNGTFTKAIGVELDLSDKPVGLGVRSRRYALLAEDGVVKLFNLEEGGAFTFSGAQTSLMFFELFFLFRYSTLQLLLFS

SEQ ID NO: 7674 - protein, 120 aa, Glycine max
MATTFTFFRPTMIRASAGSPGRPDPSNRKPVSSNWWAPPFGWPADPDYIGPSQKTSYQSDPEREVGPGRPRSKFAAGCFTGKKAKELRKKTVETSTFHDIMYHSAIASRLASDVSKGYEK

SEQ ID NO: 7675 - protein, 258 aa, Glycine max
MASTKERENFVYVAKLAEQAERYEEMVEAMKNVAKLNVELTVEERNLLSVGYKNVVGARRASWRILSSIEQKEEAKGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGEEQKVDSARAAGGDDA

SEQ ID NO: 7676 - protein, 258 aa, Glycine max
MASTKERENFVYVAKLAEQAERYEEMVEAMKNVANLNVELTVEERNLLSVGYKNVVGARRASWRILSSIEQKEEAKGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGEEQKVDSARADGGDDA

SEQ ID NO: 7677 - protein, 259 aa, Glycine max
MASTKERENFVYVAKLAEQAERYEEMVEAMKNVAKLNVELTVEERNLLSVGYKNVVGARRASWRILSSIEQKEEAKGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGAEEQKVDSARAAGGDDA

SEQ ID NO: 7678 - protein, 259 aa, Glycine max
MASTKERENFVYTAKLAEQAERYEEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADRSMKAYQSASTTAEAELPPTHPIRLGLALNFSVFYYEILNSPERACHLAKQAFDEAIFELDTLSEEFYKDSTLIMQLLRDNLTLWTFDIPEEGGEEQKVDFARAAGGDNA

SEQ ID NO: 7679 - protein, 251 aa, Glycine max
MASTKERENFVYVAKLAEQAERYEEMVEAMKNVAKLNVELTVEERNLLSVGYKNVVGARRASWRILSSIEQKEEAEGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKHAFDEAISELDTLSEESYKDSTLIMQLLRTSHLWTLTSLSERQSGSAELLSD

SEQ ID NO: 7680 - protein, 260 aa, Ricinus communis
MDSSKDRETFVYVAKLAEQAERYDEMVESMKKVAKLDVELTVEERNLLSVGYKNVVGSRRASWRILSSIEQKEESKGNEANVKRIKEYRQKVESELSTICSDIMTVIDEHLIPSCTAGESTVFYYKMKGDYYRYLAEFKTGNDKKEAADQSLKAYETASTTAESELPPTHPIRLGLALNFSVFYYEIMNSPERACHLAKQAFDEAISELDTLSEESYKDSTLIMQLLRDNLTLWTSDIPEDGEDQKMETSGKAGGGEDAE

SEQ ID NO: 7681 - protein, 261 aa, Cicer arietinum
MASSKDRENFVYIAKLAEQAERYEEMVDSMKSVANLDVELTVEERNLLSVGYKNVIGARRASWRILSSIEQKEETKGNDVNAKRIKEYRHKVESELSNICNDVMRVIDEHLIPSAAAGESTVFYYKMKGDYYRYLAEFKTGNEKKEAADQSMKAYESATTAAEAELPPTHPIRLGLALNFSVFYYEILNSPERACHLAKQAFDEAISELDTLNEESYKDSTLIMQLLRDNLTLWTSDIPEDGEDSQKVNGTAKLGGGDDAE

SEQ ID NO: 7682 - protein, 254 aa, Vitis vinifera
MARENFVYIAKLAEQAERYDEMVDAMKKVAKLDVDLTVEERNLLSVGYKNVIGARRASWRILSSIEQKEEVRGNEQNAKRIKEYRQKVESELSGICSDIMTVIDEHLIPASTAGESTVFYYKMKGDYYRYLAEFKTGNERKEAADQSLKAYQTASTTAESDLSPTHPIRLGLALNFSVFYYEIMNSPERACHLAKQAFDEAISELDTLSEESYKDSTLIMQLLRDNLTLWTSDIPEDGEDQKMESSAKAGGDDE

SEQ ID NO: 7683 - protein, 261 aa, Vicia faba
MASTKDRENFVYIAKLAEQAERYEEMVDSMKNVANLDVELTIEERNLLSVGYKNVIGARRASWRILSSIEQKEESKGNDVNAKRIKEYRHKVETELSNICIDVMRVIDEHLIPSAAAGESTVFYYKMKGDYYRYLAEFKTGNEKKEAGDQSMKAYESATTAAEAELPPTHPIRLGLALNFSVFYYEILNSPERACHLAKQAFDEAISELDTLNEESYKDSTLIMQLLRDNLTLWTSDIPEDGEDSQKANGTAKFGGGDDAE

SEQ ID NO: 7684 - protein, 260 aa, Populus trichocarpa
MDSSKDRENFVYVAKLAEQAERYDEMVDAMKKVAKLDVELTVEERNLLSVGYKNVIGARRASWRILSSIEQKEESKGNETNVKRIKEYRKKVEAELTGVCNDIMTVIDEHLIPSSIPGESSVFYHKMKGDYYRYLAEFKSGNERKEAADQSLKAYETATSTAARDLSPTHPIRLGLALNFSVFYYEIMNSPERACHLAKQSFDEAISELDTLSEESYKDSTLIMQLLRDNLTLWTSDIPEDGEDQKMETSARAGGGEDAE

SEQ ID NO: 7685 - protein, 345 aa, Glycine max
MASSSPSPPSYLTHLPLHPSHQGESEKRVEDDESRVPIHIVTAATQLPVEFLEPSPQSKLVIGFDCEGVDLCRKGTLCVMQLAFPDAVYLVDAIEGGEELIIACKPALESNYITKVIHDCKRDSEALYFQFGIKLNNAVDTQIAYSLIEEQEGRKRLRDDYISFVGLLADPRYCGISYDEKEEVRVLLRQDPKFWTHRPLSEQMIRAAADDVRFLLYIYRQMMEKLNERSLWYLAVHGALYCRCFCLNSNNFADWPSLPSIPVDNLNADGNDLEEEILSVLDIPQGKMGLVIGKRGATILSIKRSCNAEILTGGPKGPPDKVFIIGPVKEVRKAEAMIRGRILDI

SEQ ID NO: 7686 - protein, 278 aa, Glycine max
MASSSPSHSYLTHLPLHPSHQGDSEKRVEDDESRVPIHIVTAASQLPVEFLEPSPQSKLVIGFDCEGVDLCRKGTLCVMQLAFPDAVYLVDAIEGGEELIIACKPALESNYITKVIHDCKRDSEALYFQFGIKLNNVVDTQIAYSLIEEQEGRKRLRDDYISFVGLLADPRYCGKSYDEKEEVRVLLRQDPKFWRHRPLSEQMVRAAADDVRFLLYIYHQMMEKLNERSLWYLAVRGVLYCRCFCLNSNNFADWPSLPPIPDNLNADGSDPKEEILSV

SEQ ID NO: 7687 - protein, 341 aa, Vitis vinifera
MASPSPSQPTYIPMPSDPGGKPIDHEGLLPLVPIHIVTLPSQLPIEFLEPSPERKLVIGFDCEGVDLCRHGTLCIMQIAFPDAIYLVDAIQGGEMLMKACKPALESSYITKVIHDCKRDSEALYFQFGIKLHNVVDTQIAYSLIEEQEGRKRLVDDYISFVGLLADPRYCGVSYLEKQEVRDLLRQNPDFWTHRPLSDLMVRAAADDVRFLLYIYHKMMEKLNERSLWYLAVRGALYCRCFCINDNDYADWPPLPPIPDNLIVEGNAPEEEILSVLHVPPGKMGRVIGRRGASILSVKESCNAEILIGGAKGPPDKVFIIGPVKQVRKAEAILRGRMLEMY

SEQ ID NO: 7688 - protein, 342 aa, Ricinus communis
MAASSSSHQTHIPLPSDSGGNKPLDHEAQLSLVPIHVVTDASQLPAEFLNPTPDKQLIIGFDCEGVDLCRHGTLCIMQIAFPDAIFLVDATQGGEMLLKACKPALESSYITKVIHDCKRDSEALYFQFGIKLHNVFDTQIAYSLIEEQEGRTKLPDDYISFVGLLADPRYCGISYLEKEEVRLLLRQDSNFWTYRPLSELMIRAAADDVRFLLYIYHKMIKKLNQRSLWYLAVRSALYCRCFCTNDNNYADWPSIPPIPGNLVGDGNAPEEEILSVLGVPPGKMGRVIGRRGASILSIKESCNAEIFIGGSKGPPDKVFIIGPVKQVRKAEAILRGKMLEIY

SEQ ID NO: 7689 - protein, 331 aa, Populus trichocarpa
MASSSSSHQTHTPLPSDPDHEVPIHVVTEPSQLPAEFLNPSAAKQLIIGFDCEGVDLCRHGTLCIMQLAFPDAIYLVDAIKGGESLIRACKPALESSHITKVIHDCKRDSEALYFQFGIKLHNVVDTQIAYSQIEEQEGRTRLPDDYISFVGLLADPRYCGISYLEKEEVRVLLRQDPMFWTYRPLSEMMIHAAADDVRFLLRIYYKMMEKLNQRSLWYLAVRGVLYCRCFCINENDYADWPHIPPIPDNLIIEDNAPEEEILSVLDVPPGKMGRVIGRRGASILSVKESCNAEIFIGGAKGPTDKVFIVGPVKQVRKAEAMLRGKMLDIF

SEQ ID NO: 7690 - protein, 341 aa, Arabidopsis thaliana
MASSSPTQLAHVPIPPEPGGRSPTQEANEPPVPIYIVTDPFQLPADFLNPSPEKKLVIGFDCEGVDLCRHGKLCIMQIAFSNAIYLVDVIEGGEVIMKACKPALESNYITKVIHDCKRDSEALYFQFGIRLHNVVDTQIAYSLIEEQEGRRRPLDDYISFVSLLADPRYCGISYEEKEEVRVLMRQDPKFWTYRPMTELMIRAAADDVRFLLYLYHKMMGKLNQRSLWHLAVRGALYCRCLCCMNDADFADWPTVPPIPDNLKSEDQCLEEEILSVLDVPPGKMGRVIGRKGASILAIKEACNAEILIGGAKGPPDKIFVIGPVREVRKAEAILRGRMIDY

SEQ ID NO: 7691 - protein, 342 aa, Arabidopsis lyrata subsp. lyrata
MASSSPTQLAHVPIPPEPGGRSLTQEANEPQVPIHIVTDPLQLPADFLNPSPEKKLVIGFDCEGVDLCRHGKLCIMQIAFSNAIYLVDVIEGGEVLMKACKPALESTYITKVIHDCKRDSEALYFQFGIRLHNVVDTQIAYSLIEEQEGRRRPLDDYISFVSLLADPRYCGISYEEKEEVRVLMRQDPKFWTYRPMTELMIRAAADDVRFLLYLYHKMMGKLNQRSLWHLAVRGALYCRCLCCMNDADFADWPTVPPIPDNLKSEDQCLEEEILSVLDVPPGKMGRVIGRKGASILAIKEACNSAEILIGGAKGPPDKIFVIGPVKEVRKAEAILRGRMIDY

SEQ ID NO: 7692 - protein, 336 aa, Vitis vinifera
MAFASPHQTYIPLPSDSGGQHPDHAALLSLVPIYIVTHASQLPKDFLVPSPVRQLVIGFDCEGVDLCRHGSLCIMQLAFPDAIYLVDAIQGGEKLMKACKPALESSYITKVIHDCKRDSEALYFQFGIKLHNVVDSQIAYSLIEEQQGRRRSPDDYISFVGLLADPRYCGISYLEKKEVRVLLKQDPKFWTYRPLSELMVRAAADDVRFLPYIYYKMMEELNEHSLWKLAVRGALYCRCFCVNDNEYADWPSLPNMPENLMVDGKAPEEEILSVLEIPQGKMGCVIGRKGASILSIKQCCKAEILIGGAKGPPDMVFIIGPVKEVRKAEAILRGRI

SEQ ID NO: 7693 - protein, 338 aa, Solanum tuberosum
MLRSHGVTQQTLPPDPGEKIQGEEAQFSTVPIHVVTNPSELPVEFLEPSAETQLVIGFDCEGVDLCRHGTLCIMQLAFPDAIYLVDAVQGGEAVVQACKPALESNYITKVIHDCKRDSEALYFQFGIKLHNVVDTQIAYSLINEQEGHARVPDCHISFVGLLADPRYCGVSYDEKEEVRVLLRQDPKYWTYRPLSEQMIRAAADDVRFLLHIYHKMVQKLNDKSLWNLAVRGALYCRCFCINDNHFADWPPLPPIPENIVADGSIPEEEVLSVVDVPPGKMGRVIGRRGASILSIKQSCDAEIFIGGAKGPPDKVFIIGPEKQARKAQAILMGKLLDF

SEQ ID NO: 7694 - protein, 367 aa, Vitis vinifera
MYPVIIFDRKKREKVEAWPEKEPDRVGGFGLMAFASPHQTYIPLPSDSGGQHPDHAALLSLVPIYIVTHASQLPKDFLVPSPVRQLVIGFDCEGVDLCRHGSLCIMQLAFPDAIYLVDAIQGGEKLMKACKPALESSYITKVIHDCKRDSEALYFQFGIKLHNVVDSQIAYSLIEEQQGRRRSPDDYISFVGLLADPRYCGISYLEKKEVRVLLKQDPKFWTYRPLSELMVRAAADDVRFLPYIYYKMMEELNEHSLWKLAVRGALYCRCFCVNDNEYADWPSLPNMPENLMVDGKAPEEEILSVLEIPQGKMGCVIGRKGASILSIKQCCKAEILIGGAKGPPDMVFIIGPVKEVRKAEAILRGRI

SEQ ID NO: 7695 - protein, 189 aa, Glycine max
MEIEASRPVVAKKVWNMVRVLFFMLRKGIAKSKIMVEFHLMLKRGKLALNNLILNHHYYNMQTSFFTCRSHHHSTFISPSDYEFSCSNSPAILTKRTNRFSTKSLSSVQKVLEILNNENNVNSPFPGFGKSPASVRQLRVTDSPFPLKDEEDSQVDVAAEEFIKNFYKDLNLQKKMAYLDSPYHISWNR

SEQ ID NO: 7696 - protein, 278 aa, Glycine max; identical to SEQ ID NO: 7686

SEQ ID NO: 7697 - protein, 345 aa, Glycine max; identical to SEQ ID NO: 7685

SEQ ID NO: 7698 - protein, 342 aa, Arabidopsis thaliana
MASSSPTQLAHVPIPPEPGGRSPTQEANEPPVPIYIVTDPFQLPADFLNPSPEKKLVIGFDCEGVDLCRHGKLCIMQIAFSNAIYLVDVIEGGEVIMKACKPALESNYITKVIHDCKRDSEALYFQFGIRLHNVVDTQIAYSLIEEQEGRRRPLDDYISFVSLLADPRYCGISYEEKEEVRVLMRQDPKFWTYRPMTELMIRAAADDVRFLLYLYHKMMGKLNQRSLWHLAVRGALYCRCLCCMNDADFADWPTVPPIPDNLKSEDQCLEEEILSVLDVPPGKMGRVIGRKGASILAIKEACNSAEILIGGAKGPPDKIFVIGPVREVRKAEAILRGRMIDY

SEQ ID NO: 7699 - protein, 371 aa, Glycine max
MAKRVFLYKDLVPFGAMVTMECLNVALNTLFKAATLRGMSYHVFVVYAYAVAAIVLIPGPFISQRCRSRVLPPLSFPLLRKIGLLGLIGCASQIVGYTGISFSSPTLSSAISNLVPAFTFLLAIIFRMEKVIVRNTTCQAKVLGTIVSITGAFVVTFYKGPPIIIVHTPSLSLHQPINTLNSVDRSWAIGGLLLTAEYILVPLWYIVQVQIMKVYPNELTVIFFYNLCVSIMAAIVAIFTETNAGAWKIGLDTALASIVCSGIFGSFVNNAVHTWVLRIKGPVYVAMFKPLSIAIAVALGVMFLGDTLHLGSLVGATVISIGFYTVMWGKATEENVDEDVPGQQSPPTTENVPLLQSYKTDTAEKKMHGSV

SEQ ID NO: 7700 - protein, 248 aa, Glycine max
MEVLSSHSPSSNDPFDFNRARISPYLSAPSSPKRFGQFYYLSAPSSPSKDFDLAAHDDDAFAFFVTGESKSPRSAAELFDGGKIKPLSEDDSSESAKSPLLPAKRSSIAQGKKAIREAFSTRKKKEEGDLSEEEQETRGRDRTASSSRVTRSLSPCNRISHYTWDEERNQSQSNKADSLSKTSRRWRLTDFLLFRSASEGRGSSKDPLRKFPTFYKKPEDPKASNPGPKTRRKEPLSAHELHYARKKA

SEQ ID NO: 7701 - protein, 254 aa, Phaseolus vulgaris var. nanus
  misc_feature (254)..(254): Xaa can be any naturally occurring amino acid
MGRKFFVGGNWKCNGTTEEVKKIVTTLNEAKVPGEDVVEVVVSPPFVFIPTVKTLLRPDFHVAAQNCWVRKGGAYTGEVSAEMLVNLGVPWVIIGHSERRQILQETNEFVGDKVAYALSQGLKVIACIGETLEQREAGTTAAVVAEQTKAIAAKVSNWDNVVLAYEPVWAIGTGKVATPAQAQEVHVDLRKWVHDNVSAEVAASVRIIYGGSVNGGNCKELAGQADVDGFLVGGASLKAEFVDIINSATVKKNX

SEQ ID NO: 7702 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 7703 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNELNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 7704 - protein, 252 aa, Glycine max
MGRKFFVGGNWKCNGTTEEVKKIVTTLNEAKVPGEDVVEVVVSPPFVFLPVVKSLLRPDFHVSAQNCWVRKGGAYTGEVSAEMLVNSGIPWVIIGHSERRQLLNESNEFVGDKVAYALQQGLKVIACIGETLEQREAGTRAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 7705 - protein, 254 aa, Vitis vinifera
MGRKFFIGGNWKCNGTVEEVKKIVTVLNEAEVPSEDIVEVVVSPPFVFLPLVKSLLRSDFQVAAQNCWIRRGGAFTGEISAEMLVNLGIPWVILGHSERRSLLAESNEFVGDKVAYALSQGLKVIACVGETLEQRESGSTMAVVAAQTKAIAEKVSSWDNIVLAYEPVWAIGTGKVATPAQAQEVHCELRKWLHDNAGDEVAASTRIIYGGSVNGANCKELTTQLDVDGFLVGGASLKPEFIDIIKSATVKKSA

SEQ ID NO: 7706 - protein, 254 aa, Gossypium hirsutum
MGRKFFVGGNWKCNGTTEEVNKIVSTLNAGEVPSQDVVEVVVSPPFVFLPLVKTSLRPDFHVAAQNCWVKKGGAFTGEVSAEMLVNLSIPWVIIGHSERRLILKESNEFVADKVAYALAQGLKVIACIGETLEQREAGSTVAVVAEQTKAIAAKISNWTDVVLAYEPVWAIGTGKVATPAQAQEVHCELRKWLQANVSPEVAASTRIIYGGSVTAANCKELAAQPDVDGFLVGGASLKPEFIDIIKSAEVKKNA

SEQ ID NO: 7707 - protein, 257 aa, Solanum tuberosum
MARKFFVGGNWKCNGTVEEVKKIVTTLSEAEVPSEDVVEVVISPPFVFLPLVKTLLRRDFSIAAQNCWVRKGGAFTGEVSAEMLVNLGIPWVILGHSERRLLLNESNDFVADKVAYALSQGLKVIACVGETLEQRESGSTMAVVAAQTKAIAEQVMHWSNVVLAYEPVWAIGTGKVATPAQAQEVHFELRKWLHVNVGAEVAASTRIIYGGSVNGANCKELAAQPDVDGFLVGGASLKPEFIDIIKSATVKTTAKSE

SEQ ID NO: 7708 - protein, 255 aa, Populus trichocarpa
MARKFFVGGNWKCNGTIEGVKKIVTMLNEAEVPSKDVVEVVVSPPFVFLPLVKSLQRPDFQVAAQNCWVRKGGAFTGEISAEMLVNLGIPWVILGHSERRSLLNESNEFVGDKVAYALSLGLKVIACIGETLQQRESGSAMAVVAAQTKAIADKASNWANVVLAYEPVWAIGTGKVATPDQAQEVHLELRKWLHDNVGAEVAATTRIIYGGSVNGANCKELAAQPDIDGFLVGGASLKREFIDIIKSLTVKKSQL

SEQ ID NO: 7709 - protein, 250 aa, Vitis vinifera
MGRKFFVGGNWKCNGTVEEVKKIVTVLNEAEVPSEDIVEVVVSPPFVFLPLVKSLLRSDFQVAAQNCWIRRGGAFTGEISAEMLVNLGIPWVILGHSERRSLLAESNEFVGDKVAYALSQGLKVIACVGETLEQRESGSTMAVVAAQTKAIAGWDNIVLAYEPVWAIGTGKVATPAQAQEVHCELRKWLHDNAGDEVAASTRIIYGGSVNGANCKELTTQLDVDGFLVGGASLKPEFIDIIKSATVKKSA

SEQ ID NO: 7710 - protein, 254 aa, Arabidopsis lyrata subsp. lyrata
MARKFFVGGNWKCNGTAEEVKKIVNTLNEAQVPSQDVVEVVVSPPYVFLPLVKSTLRSDFYVAAQNCWVKKGGAYTGEVSAEMLVNLDIPWVILGHSERRAILNESNEFVGDKVAYALAQGLKVIACVGETLEEREAGSTMDVVAAQTKAIADRVSNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 7711 - protein, 180 aa, Glycine max
MGRKFFVGGNWKCNGTTEEVKKIVTTLNEAKVLGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPA

SEQ ID NO: 7712 - protein, 253 aa, Glycine max; identical to SEQ ID NO: 7702

SEQ ID NO: 7713 - protein, 254 aa, Phaseolus vulgaris var. nanus; identical to SEQ ID NO: 7701
  misc_feature (254)..(254): Xaa can be any naturally occurring amino acid

SEQ ID NO: 7714 - protein, 254 aa, Vitis vinifera
MGRKFFVGGNWKCNGTGEEVKKIVSTLNAGEVPSGDVVEVVVSPPFVFLPLVKSTLRPDFHVAAQNCWVKKGGAFTGEISAEMLVNLGIPWVIIGHSERRLLLNESNEFVGEKVAYALSKGLKVIACVGETLEQRESGSTMEVVAAQTKAIADKVSNWANVVLAYEPVWAIGTGKVATPAQAQEVHSELRNWFQANASPEVAATIRIIYGGSVSGANCKELAAKPDVDGFLVGGASLKPEFIDIIKSAEVKKNC

SEQ ID NO: 7715 - protein, 386 aa, Phaseolus vulgaris
SHYQGVYPVKCNQDRFVVEDIVKFGSPFRFGLEAGSKPELLLAMSCLCKGNPDALLICNGFKDAEYISLALVANKLALNTVIVLEQEEEVDLIIELSKKLCIKPVIGLRAKLRTKHSGHFGGYFRRESKFGLTTAQILRVVKKLDLAGMLDCLQLLHFHIGSQIPSTALLADGVGEAAQIYCELVRLGANMRVIDIGGGLGIDYDGSKSCDSDISVGYSLEEYASAVVHAIQCVCDRRSVKNPVICSESGRAIVSHQSILVFEAVGTSTTVGGVSSAFSAPYVAGDLSEDYRFLSEAAFGGDYESCLAYTEELKERCVEQFKQGAVCMEQLAAVDGLCELVRKAVGAGEPVRRYHVNLSVFTSIPDAWGIEQVFPIIPIHRLDEKP

SEQ ID NO: 7716 - protein, 404 aa, Prunus persica
YQGVYPVKCNQDRFVVEDIVRFGSPFRFGLEAGSKPELLLAMSCLCKGNPEALLICNGFKDFEYISLALFARKLALNTVIVLEQEEELDVVIDLSKKLGVRPVIGARAKLKTKHSGHFGSTSGEKGKFGLTTTQILRVVKKLDQLGLLDCFQLLHFHIGSQIPSTALLADGVSEAAQIYCELVRLGAHMKFIDIGGGLGIDYDGSKSSDSEISVSYSLEEYAAAVVRAVLNVCDRKSVKHPVICSESGRALVSHHSVMIFEAISSSACDDVPPMSAFALQYFIEGLTEEARADYRNLSAAAIRGEYEACLTYADQLKQRCIDQFKEGSLGIEQLATVDGLCDMVSKAIGASDPVRTYHVNLSVFTSIPDFWGIGQTFPIVPIHRLDQRPAVRGILSDLTCDSDG

SEQ ID NO: 7717 - protein, 390 aa, Glycine max
MQEATKVIIIGAGTSGIATAGCLTKQSIPYIMLEREDCFASLWQKYTYDRLHLHLRKQVCELPHLPFPKSYPHYVPRKQFIDYLGNYVNHFEIKPLYQRAVELVEYDGWKGIWRVKAQNRRSGELEEYAGKYLVVASGETAEPRLPQIQGLESFNGKVIHSTAYKNGNEFKNKHVLVVGSGNSGMEIALDLSNFGAKPSIIVRSPVHFLSRDMMYYASLMLNYLSLSTVEKVLVMVSKVVYGDLSEYGIPYPSEGPFTMKMKYAKFPIIDVGTVKKIKSREIQVLPAEIKSIRGNEVLFQDGKSYTFDSIVFCTGFKRSTQKWLKGGDDLLNEDGFPKNSFPNHWKGRNGLYCVGLSRRGFFGANMDAQLVANDIASLIPQEEREGICVM

SEQ ID NO: 7718 - protein, 613 aa, Glycine max
MGESKFVSLAFLLVCLVVQRVWSHGYHPLSKVAVHKATVSLLDLAYIKASPAVLGLQEQTAEWVTLEYSSPIPSIGDWIGVFSPANFSASTCPKENRRVYPPLLCSAPIKYQYANYSSPLYKETGKGFLKLLLINQRSDFSFALFSGGLSNPKLVAVSDKIAFANPNAPLYPRLALGKSWNEMTVTWTSGYGINDAEPFVQWGPKEGDRMHSPAETLTFTRDSMCGAPARTVGWRDPGYIHTSHLKELWPNKIYEYRIGHKLNNVTYIWSGNYQFTAPPCPGQKSLQRVVIFGDMGKGEVDGSNEYNNFQHGSINTTQQLIQDLEDIDIVFHIGDICYANGYLPQWDQFTAQVEPIASAVPYMIASGNHERDWPGTGSFYENMDSGGECGVLAQTMFYTPASNRAKLWYSIDYGMFRFCIADTEHDWREGTEQYKFIEHCLASVDRQKQPWIIFLAHRVLGYSSCICYAEEGSFAEPMGRESFQKLWQKYKVDIAIYGHVHNYERTCPIYQNICTNEEKHHYKGRTLNGTIHVVAGGGGASLSAFTSLKTKWSIFKDYDYGFVKLTAFDHSNLLFEYKKSRDGKVYDSFKISRDYRDILACTMDSCPSITMAS

SEQ ID NO: 7719 - protein, 612 aa, Lupinus luteus
MGDSKFVFLGYLLVCSVLQLVWSHGDHPLSKVSIHRASLSLLDLAHIKVSPPILGLQGQTAEWVTLEYSSPIPSIDDWIGVFSPSNFSASACPAENRRVYPPLLCSAPIKYQYANYSNPQYSATGKGILKLQLINQRSDFSFAMFSGGLSNPKVVAISNKISFANPNAPVYPRLAMGKLWNEMTVTWTSGYGINEADPLVQWGPKGGDHIHSPAGTLTFTKDSLCGAPARTVGWRDPGFIHTSYLKELWPNRIYEYKIGHRLNNGTYIWSQNYQFRAAPFPGQKSLQRVAIFGDMGKDEVDGSNEYNNFQRGSLNTTQQLIQDLENIDMVFHIGDISYANGYLSQWDQFTAQVEPIASAVPYMIASGSHERDWPGTGSFYENMDSGGECGVLAQIMFYVPASNRAKFWYPIDYGMFRFRIADTEHDWREGTEQYKFIEHCLASVDRQKQPWLIFLAHRVLGYSSCICYAEEGSFAEPMGRESLQKLWQKYKVDIAIYGHVHNYERTCPIYQNICTSEEKHHYKGTLNGTIHIVAGGAGASLSTFTSLKTKWSIFKDYDHGFVKLTAFDHSNLLFEYKKSRDGKVYDSFKISRDYRDILACTVDSCPRTTLAS

SEQ ID NO: 7720 - protein, 672 aa, Vitis vinifera
MDPTSGSVDRKRNVLLKRKLKKVVLFYNSGFHCCCLQLQFSFPILSENINVFSYSTDFGGMRVFGASLLAILWALACIEGAISHGDQPLAKIAIHNAKFALHDQAYVKASPTVLGLGGQNTEFVTVEFSSPSPSVDDWIGVFSPANFSASTCLPEDIRVTPPLLCSAPIKYQYANYTSPNYKNTGKGSLKLQLINQRSDFSFALFSGGLVNPKLVAVSNSVAFANPNAPVYPRLAQGKVWNEMTVTWTSGYGINDAAPFIEWGLKGGDKVRSPAGTLTFDRRSMCGAPASTVGWRDPGYIHTSFLKELWPNLVYSYKLGHRLFNGTYIWSQQYQFRASPYPGQNSLQRVVIFGDMGKDEADGSNEYNQYQRGSLNTTKQLIEDLKNIDIVFHIGDICYANGYLSQWDQFTAQVESITSTVPYMIASGNHERDWPGTGSFYGNLDSGGECGVLAETMFYVPAENRAKFWYSTDFGMFRFCIADTEHDWREGTEQYRFIEHCLASVDRQKQPWLIFLAHRVLGYSSSSFYAEEGSFAEPMGRDDLQKLWQKYKVDIAMYGHVHNYERTCPIYQNICTNEEKHYYKGTLNGTIHVVAGGGGASLADFTTINTKWSIFKDYDYGFVKLTAFDHSNLLFEYKKSRDGKVYDSFRISRGYRDILACTVDSCPSSTLAS

SEQ ID NO: 7721 - protein, 614 aa, Populus trichocarpa
MMRGLELVFFAILLVLATLQVANSHGEQPLSRIAVHNTRLQLFENADIKASPSVLGLKGQNSEWVTLEYASPNPSNDDWIGVFSPANFSASTCNPDDGSKQAPPFLCTAPIKYQYANYSSPGYRKEGKGSLRLQLINQRSDFSFVLFSGGLTNPKVVAVSNKVAFTNPNAPVYPRLAQGKIWNEMTVTWTSGYGINEAEPFVEWGRKDGDHMRSPAGTLTFNRNSMCGAPARTVGWRDPGFIHTSFLKELWPNSVYTYKLGHKLFNGTYVWSQVYQFRASPYPGQSSVQRVVIFGDMGKDEADGSNEYNNFQRGSLNTTKQLIQDLKNIDIVFHIGDICYANGYLSQWDQFTAQVEPIASTVPYMIASGNHERDWPGTGSFYGNSDSGGECGVLAETMFYVPAENRAKFWYSTDYGMFRFCIADTEHDWREGTEQYKFIEHCLASADRQKQPWLIFLAHRVLGYSSATWYADQGSFEEPMGRESLQKLWQKYKVDIAMYGHVHNYERTCPIYQNICTSKEKFFYKGTLNGTIHVVAGGGGASLADFTPINTTWSYFKDHDYGFVKLTAFDHSNLLFEYKKSRDGEVYDSFKISRDYRDILACTVDSCPSMTLAS

SEQ ID NO: 7722 - protein, 615 aa, Ricinus communis
MVGLRFILSAIALLLAILLQEARSQGGQPFSRIAFHKTTFSLNGNAYVKASPSILGIRGQNSEWITVEYTSTNPSIADWIGVFSPANFSASSCNPESSSSKVAPPFLCSAPVKFQYANYSSPGYKDTGKGSLRLRLINQRSDFSFALFSGGLGNPKLVAVSNIVAFANPNAPVYPRLAQGKIWNEMTVTWTSGYGINEAEPFVEWGPKGGDLKRSPAGTLTFTPNSMCGSPARTVGWRDPGFIHTSFLKELWPNVLYKYKLGHKLLNGTYIWSQDYQFRASPYPGQSSLQRVVIFGDMGKDEIDGSNEYNNFQHGSLNTTKQLIQDLKNIDIVFHIGDICYANGYISQWDQFTSQVEPIASTVPYMIASGNHERDWPGTGSFYGNTDSGGECGVPAQTMFYVPTENRDNFWYSTDYGMFRFCIADTEHDWREGTEQYKFIEHCLASVDRQKQPWLVFLAHRVLGYSSASWYADEGSFEEPMGRESLQKLWQKYKVDIAIYGHVHNYERTCPIYQNICTNQEKHSYKGALNGTIHVVAGGGGASLADFTTINTTWSYFKDHDYGFVKLTAFDHSNLLFEYKKSRDGKVYDSFKISRDYRDILACTVDSCPSTTLAS

SEQ ID NO: 7723 - protein, 615 aa, Lupinus luteus
MMVEMEKSRMVFLYLLLVATFQQAVSDDTQPLSKVAIHKTVFAIDEHAYIKATPNVLGFEGHYTEWVTLQYSNNKPSIDDWIGVFSPANFSASTCPGENKMTNPPFLCSAPIKFQYANFSSHSYKDTGKGSLKLQLINQRSDFSFALFTGGLTNPKLIAVSNKVSFVNPNAPVYPRLAQGKTWDEITVTWTSGYDINDAEPFVEWGPKEGNLVKTPAGTLTFDRNTMCGAPARTVGWRDPGYIHTSFLKELWPNREYTYKLGHRLFNGTTIWSKEYHFKASPYPGQSSVQRVVIFGDMGKAEADGSNEYNNFQPGSLNTTKQIIQDLEDIDIVFHIGDLCYANGYISQWDQFTAQIEPIASTVPYMTASGNHERDWPGTGSFYGNLDSGGECGVPAQTMFFVPAENREKFWYSTDYGMFRFCIAHTELDWRKGTEQYEFIEKCLASVDRQKQPWLIFLAHRVLGYSSAGFYVQEGSFEEPMGREDLQHLWQKYKVDIAMYGHVHNYERTCPIYQNVCTNKEKHNYKGNLNGTIHVVVGGGGASLAEFAPINTTWSIFKDHDFGFVKLTAFDHSNLLLEYRKSSDGQVYDSFTISRDYRDILACSVDSCPTTTLAS

SEQ ID NO: 7724 - protein, 621 aa, Populus trichocarpa
MRGLGLVFFAFFLVLATLLQVTTSHGEQPLSRIVVQNTELHLSENAYVKASPSILGLKGQNFEWVTLEYASPNPSIDDWIGVFSPADFSAYFLSISTASTCTPDDGSKLAPPFLCTAPIKYQYANYSSPGYRKTGKGSLRLQLINQRSDFSSVLFSGGLSNPKLMAVSNKVAFTNPNAPVYPRLAQGKIWNEMTVTWTCGYGINEAEPFVEWGQKDGDRMHSLAGTLTFDRNSLCGAPARTVGWRDPGFIHTSFLKELWPNAVYTYKLGHKLFNGTYVWSQEYQFRASPYPGQSSVQRVVIFGDMGKDEADGSNEYNNYQRGSLNTTKQLSQDLKNIDIVFHIGDICYANGYLSQWDQFTAQVEPIASTVPYMVASGNHERDWPGTGSFYGNSDSGGECGVLAETMFYVPAENRANFWYSTDYGMLRFCRADTEHDWREATEQYKFIEHCLASVDRQKQPWLIFLAHRVLGYSFSTFYADEGSFEEPMGRESLQKLWQKYKVDIAIYGHAHNYERTCPIYQNICTSKEKSYYKGALNGTIHVAGGGGASLADFTPINTTWSYFKDHDYGFVKLTAFDHSNLLLEYKKSRDGKFYDSFKISRGYRDITVCTVDSCPSMTLAS

SEQ ID NO: 7725 - protein, 613 aa, Arabidopsis thaliana
MRESLVAILVTVISVLGAIHQVKSHEDQPLSGIAVHKITFGLNEKAYVKASPTVLGSNGQHSELVLVQYSSPKPSDDDWIGVFSPADFNASTCPGDNKMVQPPRLCSAPVKFQYANFSNPRYTNTGTGSLKLQLINQRSDFSFALFSGGLLNPKLVAISNKVAFENPNAPVYPRLALGKEWDEMTVTWTSGYGLNLAEPVVEWGVKGGERKLSPAGTLTFARNSMCGAPARTVGWRDPGYIHTAFLKELWPNSKYTYRVGHRLSNGALIWSKEYQFKSSPFPGQNSVQQVVIFGDMGKAEVDGSSEYNDFQRASLNTTKQLIKDLKKTDAVFHIGDICYANGYLSQWDQFIAQIEPIASTVPYMIASGNHERVWPNSGSFYEGLDSGGECGVPAETMFYVPAQNRAKVWYSSDYGMFRFCVADTEHDWREGTEQYNFIEHCLASVDRQKQPWLIFLAHRVLGYSSTYFYAEEGSFAEPMGRESLQKLWQKYKVDIAIYGHAHNYERTCPVYQSVCTSHEKSNYKAPLNGTIHIVAGGGGAGLAEFSDLQPNWSLFRDYDYGFLKLTAIDHSNLLFEYKKSSDGRVHDSFTISKDYRDILACAVDSCPATTLAS

SEQ ID NO: 7726 - protein, 613 aa, Arabidopsis lyrata subsp. lyrata
MRESLVAILVTVVSVLGAIQQVKSHKDQPLSGIAIHKITFDLNEKAYVKASPTVLGSNGQHSELVLVQYSSPKPSDDDWIGVFSPADFNASTCPGDNKMVQPPLLCSAPVKFQYANFSNPRYTNTGIGSLKLQLINQRSDFSFALFSGGLLNPKLVAISNKVAFENPNAPVYPRLALGKEWDEMTVTWTSGYGLHLAEPVVEWGVKGGELKLSPAGTLTFGRNSMCGAPARTVGWRDPGYIHTAFLKELWPNSKYTYRVGHRLSNGALIWSKEYQFKSSPFPGQNSLQQVVIFGDMGKAEVDGSNEYNDFQRASLNTTKQIIKDLKKTDAVFHIGDICYANGYLSQWDQFIAQIKPIASTVPYMIASGNHERDWPNSGSLYQGLDSGGECGVPAETMFHVPAQNRAKFWYSSDYGMFRFCVVDTEHDWREGTEQYNFIEHCLASVDRKKQPWLIFLAHRVLGYSSTSFYAEEGSFAEPMGRDTLQKLWQKYKVDIAVFGHAHNYERTCPVYQSVCTNHEKSNYKGPLNGTIHVVAGGGGAGLAAFSDLQPNWSLFRDYDYGFVKLTAFDYSNLLFEYKKSSDGRVHDSFTISRDYRDILACTVDSCPATTLAS

SEQ ID NO: 7727 - protein, 610 aa, Glycine max
MKPQLNVAVALVISLLCIQHSFCDEPSDTGLNKWKCRCSSLQGNKIYSLANCSKSCDCHPDAEENASIWTCECDPNGFPKVTADVHNLSCFNACNCTWGTVRKPLGSKKQISSKIVVIFLSICVICTTIAFLTSVVCHVYRRDKGPIQSPMISSDKETSYSSTTNLISHRTSSVPETKVAITSPISHITGCFQKAALLFGSQRETFHGNIIQFSFAELENATENFSTSNLIGLGGSSYVYRGRLKDGSNVAVKRIKDQRGPEADSEFFTEIELLSRLHHCHLVPLVGYCSELKGKNVQRLLVFEYMTNGNLRDRLDGILGQKMDWSTRVTIALGAARGLEYLHEAAAPRILHRDVKSTNILLDKNWQAKITDLGMAKNLRADDHPSCSDSPARMQGTFGYFAPEYAIVGRASLESDVFSFGVVLLELISGRQPIHKSAGKEESLVIWATSRLQDSRRALTELADPQLNGNFPEEELQIMAYLAKECLLLDPDTRPTMSEVVQILSSISPGKSRRRRTIPVSPFQEPEDLEKQRQAPPSIFPSRNLLPLDIDHNLHVGNENKDVHTVSSEHLKSLMLFTSKGESWHASDEEMVDLTEPRFESFYMINDNFP

SEQ ID NO: 7728 - protein, 612 aa, Glycine max
MKPQLKIALALVVSLLWIQQSFCDETSDTSSLNKWRCRCSFQGNQSYSLANCSKSCDCFSDSEESASVWTCVCDSNGFPQVAADGHSSNCFNACNCTWGTFSRPGGSKKHVSSKIVVVILLICVICTTMAFLVSLICHVYRKDRCTIHSPIFSMDKETSSGSTTNLISHRSGTSSVPETKYAMNSPIYHITGCFQKASFFFGNPKETYHGNIFPFSLAELENATENFSSSNLIGVGGSSYVYLGRLKDGSNVAVKRLKDQGGSEADSAFFKEIELLARLHHCHLVPLLGYCSELKGKHVQRLLVFDYMANGNLRDCLDGVSGKHVDWATRVMIAIGAARGLEYLHEAAAPRILHRDVKSTNILLDENWQAKITDLGMAKNLRSDDLPSCSNSPARMQGTFGYFAPEYAIVGRASLESDVFSFGVVLLELISGRHPIHKSTGKEESLVIWATPRLQDSRRVIRELVDPQLKGNFPEEEVQIMAYLAKECLLLDPDTRPTMSEVVQILLSISPGKSRRRRNIPASLFQEPEDAEKQRQSTPSKFPTHSSLPIYNDHNLSVENKNKAEDAVSAENMESLILLTSKSDGSRASEEEIVDLTEPRFESFCITNGNAP

SEQ ID NO: 7729 - protein, 178 aa, Glycine max
MRKGRGGGASAAAAAAVNGSVLKEPRYRGVRKRPWGRFAAEIRDPLKKARVWLGTFDSAEDAARAYDTAARNLRGSKAKTNFPLSPFCYQHPTTDPFFYAGFHDHQNNSNNNNDNLNNPQRPTSSGMSSTVESFSGPRPPTTTTTTTTPFLTTTRRYPRTPPLVPEDCHSDCDSSSPS

SEQ ID NO: 7730 - protein, 228 aa, Ricinus communis
MRRGRGAAVAAKQEAAQPNGSAPAPQNTPNGKEPRYRGVRKRPWGRFAAEIRDPWKKTRVWLGTFDSAEDAARAYDTAARTLRGPKAKTNFPINASQLSPFAYQNPPDPFVDYHHRVFTTNNGYESHPVNPQRPTSSSLSSTVESFSGPRPPPTTVGSQKRHHPRTPPVVPEDCHSDCDSSSSVVDDGDIASSSSLCYRKPLPFDLNFPPLDQVDFAGDDLQCTALCL

SEQ ID NO: 7731 - protein, 219 aa, Populus trichocarpa
MGRTRTTTKQAVDPNGSATQNMLVIAKEPRYRGVRKRPWGRFAAEIRDPWKKTRVWLGTFDSAEDAARAYDAAARTLRGAKAKTNFPISTTNQLFNHQNQNQSPTDPFLDHHSINPQRPTSSSLSSTVESFSGPRPPQPTTTTKSGNGPRRSHPRIPPVVPEDCHSDCDSSSSVVDDRDVASAASSLCRKPLPFDLNFPPLDQVDLGSGDDLHCTALCL

SEQ ID NO: 7732 - protein, 222 aa, Glycine max
MAPRDHKTSNAKANGNGNSGVKEVHFRGVRKRPWGRYAAEIRDPGKKSRVWLGTFDTAEEAARAYDAAAREFRGPKAKTNFPLPLENVKNSSPSQSSTVESSSRDRDVAADSSPLDLNLAPAAAASARFPFQHQFPVFTGAVPAANQVLYFDAVLRAGMAGPRGFAFGYNHHPVAASEFHATTSDSDSSSVIDLNHNEGEVKGNGSRIFDLDLNHPPPHEIA

SEQ ID NO: 7733 - protein, 305 aa, Glycine max
MKDCWFFDNNFNGLSDESLDDVMDMELLDLPLDFEDVETDAVEEQDWDAQLKLLEDPPPPLGVFPLQQSSAFCGQTRNENAKLGSKSFSASLAKTVRPAYGKTIPVQKVSLKGKDLLQFQTNSPVSVFESSSSSPSVENSNFELPVIPTKCPRTKRRRLSNISLLYSIPFILTSPAFQKFQRMDFSKSDIQTQPSGELLCKFKKKQRKKDIPLPTNKIEMKRSSSQESVAPRKCLHCEVTKTPQWREGPMGPKTLCNACGVRYRSGRLFAEYRPASSPTFVASLHSNSHKKVLEIRNRATQVTVR

SEQ ID NO: 7734 - protein, 147 aa, Medicago truncatula
MILAVLFANAEGNILIERFHGVPAEERLHWRSFLVKLGADNLRGVKNEELLVACHKSVYIVYTVLGDVSIYVVGKDAYDELALSEVIFTITSAVKDVCGKPPTERRFLDKYGRICLCLDEIVWKGYLENTEKDRIKRLIRLKPPTEF

SEQ ID NO: 7735 - protein, 147 aa, Glycine max
MILAVLFANAEGNILIERFHGVPAEERLHWRSFLVKLGADNLKGVKNEELLVACHKSVYIVYTVLGDVSIYVVGKDEYDELALSEVIFVITSAVKDVCGKPPSERLFLDKYGRICLCLDEIVWQGYLENTEKDRIKRLIRLKPPTEF

SEQ ID NO: 7736 - protein, 147 aa, Glycine max
MVLAVLFANAEGNILIERFHGVPAEERLHWRSFLVKLGADNLKGVKNEELLVACHKSVYIVYTVLGDVSIYVVGKDEYDELALSEVIFVITSAVKDVCGKLPSERLFLDKYGRICLCLDEIVWQGYLENTEKDRIKRLIRLKPPTEF

SEQ ID NO: 7737 - protein, 139 aa, Cicer arietinum
NAEGNILIERFHGVPAEERLHWRSFLVKLGADNLKGVKNEELLVACHKSVYIVYTILGDVSIYVVGKDEYDELALSEVIFTITSAVKDVCGKPPTERRFLDKYGRICLCLDEIVWKGYLENTEKERIKRLIRLKPPTEF

SEQ ID NO: 7738 - protein, 147 aa, Vitis vinifera
MLLAVLFANSEGNILVERFSGVPAEERLHWRSFLVKLGADNLKGVKNEELLVACHKSVYIVYTVLGDVSIYVVGKDEYDELALAEVIFVIISSVKDVCGKPPTERLFLDKYGKICLCLDEIVWKGMLENADKDRIRRLTRLKPPTEF

SEQ ID NO: 7739 - protein, 147 aa, Ricinus communis
MILAVLFANVEGNILIERFSGVPAEERLHWRSFLVKLGADNLKGVKNEELLVASHKSVYIVYTVLGDVSIFVVGKDEYDELALAEVIFAITSAVKDVCGKPPTERLFLDKYGKICLCLDEIVWKGLLENTDRDRIRRLMRLKPPTDF

SEQ ID NO: 7740 - protein, 147 aa, Populus trichocarpa
MILAVLFANVEGNILIERFSGVPAEERLHWRSFLVKLGADNLKGVRNEELLVASHKSVYIVYTVLGDVSIFIVGKDEYDELALTEVIFAITSALKDVCGKPPTERLFLDKYGKICLCLDEIVWKGLLENTDKERVRRLTRLKPPTEF

SEQ ID NO: 7741 - protein, 147 aa, Arabidopsis thaliana
MILAVLFANSVGNVLIERFNGVPAEERLHWRSFLVKLGADNLKGVKNEELLVACHKSVYIVYTMLGDVSIFLVGKDEYDELALAETIYIITAAVKDVCGKPPTERVFLDKYGRICLCLDEIVWNGLLENTDKDRIKRLIRLKPPSEV

SEQ ID NO: 7742 - protein, 147 aa, Oryza sativa Indica Group
MILAVLFSNSDGNILIERFHGVPAEERLHWRSFLVKLGADNLKGAKNEELLVASHKSVSIVYTMIGDVCLYIVGKDEYDELALAEVIFAITSAVKDVCGKPPTERLFLDKYGRICLCLDEIVWKGLLENTEKDRVRRLIRLKPPVEP

SEQ ID NO: 7743 - protein, 147 aa, Hordeum vulgare subsp. vulgare
MILAVLFANSEGNILIERFHGVPAEERLHWRSFLVKLGAENLKGAKSEELLVASHKSVSIVYTMIGDVCLYIVGKDEYDELALSEVIFAVTSAVKDVCAKPPTERLFLDKYGRICLCLDEIVWQGLLENTEKDRVRRLIRLKPPVEP

SEQ ID NO: 7744 - protein, 264 aa, Glycine max
MKALGVVGGSGAPVPVVCSSVRNHRFRVSFSSSPSSGPKTVEQVGIAAPKSEYKPGVFDDLFLNLFRNKLVQEVGWDSEKPGYDGLIEVANRLMMKGTTNTATVEAAVRILRSLFPPYLLELYKMLIVPIGGGKIAAMMVARVTVLTCQWLMGPCKLNSVDLPDGISCSSGVYVERCKYLEESKCVGICTNTCKFPTQSFFKDHMGVPLLMEPNFGDYSCQFKFGVLPPLDDTIVKDPCLEACPNASQRRTVARNIDITACPKT

SEQ ID NO: 7745 - protein, 265 aa, Glycine max
MKALGAVGGGGAPVPVVCSSVRNHRFRVSFSSSSPSPGPKTVEQVGIGALKSDYKPGVFDDLFLKLFRNKLVQEVGWDSKKAGYDGLIEVANRLMMKGTTNSDTVEAAVRILRSLFPPYLLELYKMLIAPIGGGKIAAMMVARVTVLTCQWLMGPCKVNSVDLPDGTSCSSGVYVERCKYLEESKCVGICTHTCKFPTQTFFKDHMGVPLLMEPNFADYSCQFKFGVLPPRDDTIVKGTLLGSMSKCKTTTNGCQNIDITACPKT

SEQ ID NO: 7746 - protein, 723 aa, Glycine max
MGSSRGHTLMEVGPDGVAVITIVNPPVNSLSFDVLRSLKESFDQAIQRDDVKAIVVTGAKGKFSGGFDISAFGGIQEAKERPKPGWISVEIITDTIEAARKPSVAAIDGLALGGGLEVAMACNARLSTPTAQLGLPELQLGIIPGFGGTQRLPRLVGLTKGLEMILASKPVKGKEAFSLGLVDGLVSPNDLVNTARQWALDMLGHRRPWIASLYKTEKLEPLGEAREILKFARAQARKRAPNLQHPLVCIDVIEAGIVAGPRAGLWKEAEAFEGLVRSDTCKSLVHVFFAQRGTSKVPGVTDCGLAPRQVKKVAIIGGGLMGSGIATALILSNYPVILKEVNEKFLDAGINRIKANLQSRVKKGKLTKENFEKTISLLKGSLDYESFRDVDMVIEAVIENISLKQQIFSDLEKYCPPHCILASNTSTIDLNLIGEKTKTQDRIVGAHFFSPAHVMPLLEIVRTKQTSAQVIVDVLDISKKIKKTPVVVGNCTGFAVNRMFFPYTQAGLLLVERGADVYQIDRVITKFGMPMGPFRLMDLVGFGVAIATGMQFIQNFPERTYKSMLISLLQEDKRAGETTHKGFYLYNDKRKASPDPELKNYIEKARSISGVSVDPKLAKLQEKDIIEMIFFPVVNEACRVLDEGIAVKAADLDISAIMGMGFPPYRGGIIFWADSLGSKYIYSRLEKWSELYGEFFKPCANLAARAAKGIPLSASVEQGKSRM

SEQ ID NO: 7747 - protein, 726 aa, Populus trichocarpa
MEGSRTKGRTTIEVGADGVALITIINPPVNSLSFDVLYSLKDSFEQALRRDDVKAIVITGAKGKFSGGFDISSFGGVQGGKSNEPKPGFISVEILSDTVEAAKKPSVAAIDGLALGGGLEVAMACHARISTSTAQLGLPELQLGLIPGFGGTQRLPRLVGISKALEMMLTSKPVKGEEAHALGLVDAVVSPNELVSTARQWALDILERRRPWIASLYKTEKLDSLGEAREIFKFAREQVRKRAPNLTHPIVCIDVIEHGIVSGPRDGLYKELESFHELVRSDTCKSLIHIFFAQRGTTKVPGITDLGLVPRRVKKVAVLGGGLMGSGIATALVLSNYPVILKEVNNQFLQAGIGRVRANLQSRVKKGRMTQEKFEKTMSLLKGALDYESFKDVDMVIEAVIENVSLKQQIFSDLEKYCPPHCILASNTSTIDLNLIGKQTKSQDRIIGAHFFSPAHVMPLLEIVRTKQTSPQVIVDLLDVGKKIRKTPVVVGNCTGFAVNRMFFPYTQAALLLVEHGADLYQIDKVITKFGMPMGPFRLVDLVGFGVAIATGTQFVVNFPERTYKSMLIPLMQEDKRAGETTRKGFYLYDDRRKAKPDPELRKYIEKARNISGVANDPKLAKLPEKDIVEMIFFPVVNEACRVFAEGIAVKAADLDISSLMGMGFPPYRGGIMFWADSLGSKYIYSRLEEWSKTYGEFFKPCAFLAERAAKGAPLSSPVDQAKSRL

SEQ ID NO: 7748 - protein, 724 aa, Vitis vinifera
MGRTPKGRTVMEVGADGVALITLINPPVNSLSFDVLNSLKESYEEALRRDDVKAIVITGAKGKFSGGFDITAFGGIQAGGEVSKPGFVSVEILTDTVEAARKPSVAAIDGLALGGGLEVAMGCHARISTPNAQLGLPELQLGIIPGFGGTQRLPRLVGLSKALEMMLMSKPVKGVDAHSLGLVDAVVAPDQLVKTARQWALDILECRRPWVHSLYKTDKLEPLGEAREILKFARTQAQKQAPNLKHPLLCIDVIEAGIVSGPVAGLWKEAEAFQELLHSDICKSLVHIFFAQRGTSKVPGIADLGLVPRRINKVAILGGGLMGSGIATALMLSNYPVILKEVNEKFLQAGIGRVRANLQSRVKKGAMTQEKFEKTFSLLKGVLDYESFKDVDMVIEAVIENVSLKQQIFADLEKFCPPHCILASNTSTIDLNLIGEKTRSHDRIVGAHFFSPAHVMPLLEIVRTQRTSPQVIVDLLDIGKKIKKTPVVVGNCTGFAVNRMFSPYTQAALLLVEHGADVYQIDRAITKFGMPMGPFRLVDLVGFGVAIATGGQFVQNFPERTYKSMLIPIMQEDKRAGETTRKGFYVYDDKRKASPDPELKKYVEKARGISGVAIDPKLMKLSDKDIVEMIFFPVVNEACRVYAEGIAVKAADLDIAGVMGMGFPPYRGGIMFWADSLGSKYIYSRLEAWSNLYGGFFKPCAYLAERAAKGAPLSSPLERAKPRL

SEQ ID NO: 7749 - protein, 765 aa, Vitis vinifera
MGRTPKGRTVMEVGADGVALITLINPPVNSLSFDECSLRLRFEVLLSFSRKWEEFIFLLDALKRKKGLPVKLHLPVLNSLKESYEEALRRDDVKAIVITGAKGKFSGGFDITAFGGIQAGGEVSKPGFVSVEILTDTVEAARKPSVAAIDGLALGGGLEVAMGCHARISTPNAQLGLPELQLGIIPGFGGTQRLPRLVGLSKALEMMLMSKPVKGVDAHSLGLVDAVVAPDQLVKTARQWALDILECRRPWVHSLYKTDKLEPLGEAREILKFARTQAQKQAPNLKHPLLCIDVIEAGIVSGPVAGLWKEAEAFQELLHSDICKSLVHIFFAQRGTSKVPGIADLGLVPRRINKVAILGGGLMGSGIATALMLSNYPVILKEVNEKFLQAGIGRVRANLQSRVKKGAMTQEKFEKTFSLLKGVLDYESFKDVDMVIEAVIENVSLKQQIFADLEKFCPPHCILASNTSTIDLNLIGEKTRSHDRIVGAHFFSPAHVMPLLEIVRTQRTSPQVIVDLLDIGKKIKKTPVVVGNCTGFAVNRMFSPYTQAALLLVEHGADVYQIDRAITKFGMPMGPFRLVDLVGFGVAIATGGQFVQNFPERTYKSMLIPIMQEDKRAGETTRKGFYVYDDKRKASPDPELKKYVEKARGISGVAIDPKLMKLSDKDIVEMIFFPVVNEACRVYAEGIAVKAADLDIAGVMGMGFPPYRGGIMFWADSLGSKYIYSRLEAWSNLYGGFFKPCAYLAERAAKGAPLSSPLERAKPRL

SEQ ID NO: 7750 - protein, 726 aa, Populus trichocarpa
MKGSRTKGTTTIEVGADGVALITLINPPVNALSSDVLNSLKDSYEQALRRDDVKAIVITGAKGKFSGGADISSFEEVQEGKVNEPKPDFIFSEVLGDTLEAAKKPSVAAIDGLALGGGLEVAMACHARISTPTAQLSLPELQLGLIPGFGGTQRLPRLVGITKALEMMLTSKPVKGEEAHALGLVDAVVSPNELVSTARQWALDIFECRRPWIASLYKTEKLDSLGEAREIFKFARAQAQKRAPNLLHPIVCINVVEHGIVSGPRAGLYKEFESFQELVRSDISKSLVHIFFALHGTTKVPGITDLGFVPRLVKKVAVLGGGLMGSGIATALILSNYPVILKEVNDQFLQAGIGRVRANLQSRVKKGKMTQEKFEKTMSLLKGSLDYESFKDVDMVIEAVIENVSLKQQIFSDLEKYCPPHCILASNTSTIDLNLIGKQTKSQDRIIGAHFFSPAHVMPLLEIVRTKQTSPQVIVDLLDVGKKIRKTPVVVGNCTGFAVNRMFFPYTQAAIFLVEHGVDLYQIDRVISKFGMPMGPFRLADLVGFGVAIATGMQFVENFPERTYKSMLLPLMQEDKRGGETTCKGFYLYDDRRKAKPDPELRKYIEKARSISGVAVDPKLAKLPEKDIVEMIFFPVVNEACRVFAEGIAVKAADLDIASLMGMGFPPYRGGIMFWADSFGSKYIYSRLEEWSKTYGEFFEPCAFLAERGAKGAPLSSPVEQAKSRL

SEQ ID NO: 7751 - protein, 725 aa, Capsicum chinense
MSSNTKGRTTIDVGADGVAVITIINPPVNSLALDVLYSLKENYEQALRRDDVKAIVVTGANGKFSGGFDISAFGKLQGGTVESPKPGFISVEILTDTVEAARKPSVAAIDGLALGGGLEVAMACHARISTPNAQLGLPELQLGVLPGFGGTQRLPRLVGLAKSLEMILTSKPVKGEEAVNLGLVDAVVPSNQLLGTARKWALDILECRKPWVASLHKTDKIEPLGEAREIFKFARVQTRKQAPNLQHLLVVIDVIEEGIVSGPLAGLWKEAEAFQALLHSDTCKALVNVFFAQRATTKVPGVTDLGLKPRRIKKVAILGGGLMGSGIATALLRSGYPVILKEVNDKFLQAGLGRVKANLQSSVKKGKMSQEKFEKTLSLLKGALDYEGFRDVDMVIEAVIENVSLKQQVFADLEKYCPSHCILASNTSTIDLNLIGEKTKSQDRIIGAHFFSPAHVMPLLEIVRTQKTSPQIIVDLLDVGKKIKKTPVVVGNCTGFAVNRMFFPYTQAALLLVERGADVFRIDRIITKFGMPMGPFRLCDLVGFGVAIATGGQFVMNFPERTYKSMLIPLMQEDKRAGETTRKGFYVYDDRRKASPDPEIKKYIEKAREMSGVTIDHKMAKLSDKDIIEMIFFPVVNEACRVLAEGIAVKSSDLDISAIMGMGFPPYRGGIIFWADTLGSKYICSRLDEWSRMYGDFFKPCSYLAERAAKGAPLSLTTDPAKSRL

SEQ ID NO: 7752 - protein, 725 aa, Cucumis sativus
MGSNAKGRTVMEVGTDGVAIITIINPPVNSLSFDVLFSLRDSYEQALRRDDVKAIVVTGAKGKFSGGFDITAFGVLQGGKGEQPNVRNISIEMITDIFEAARKPAVAAIDGLALGGGLEVAMACHARISTPTAQLGLPELQLGIIPGFGGTQRLPRLVGLSKALEMMLTSKPIKGQEAHSLGLVDAIVPPEELINTARRWALEILERRRPWVHSLHRTDKLESLAEARKIFNLARAQAKKQYPNLKHTIACIDAVETGVVSGPRAGLWKEAEEFQGLLHSDTCKSLIHIFFAQRSTTKVPGVTDLGLVPRQIKKVAIVGGGLMGSGIATALILSNYHVVLKEVNDKFLQAGIDRVRANLQSRVKKGNMTNEKFEKSISLLKGVLNYESFKDVDMVIEAVIENVSLKQQIFSDLEKYCPPHCMLATNTSTIDLELIGERIKSRDRIIGAHFFSPAHIMPLLEIVRTKHTAAQVIVDLLDVGKNIKKTPVVVGNCTGFAVNRMFFPYSQAAILLAEHGVDPYQIDRAISKFGMPMGPFRLCDLVGFGVAAATASQFVQAFPERTYKSMLIPLMQEDKNAGESTRKGFYVYDKNRKAGPNPELKKYIEKARNSSGVSVDPKLTKLPEKDIVEMIFFPVVNEACRVLAEGIAVKAADLDIAGVMGMGFPSYRGGLMFWADSLGSNYIYSRLEEWSKQYGGFFKPCGYLAERAVQGATLSAPGGHAKPRM

SEQ ID NO: 7753 - protein, 725 aa, Arabidopsis thaliana
MDSRTKGKTVMEVGGDGVAVITLINPPVNSLSFDVLYNLKSNYEEALSRNDVKAIVITGAKGRFSGGFDISGFGEMQKGNVKEPKAGYISIDIITDLLEAARKPSVAAIDGLALGGGLELAMACHARISAPAAQLGLPELQLGVIPGFGGTQRLPRLVGLTKALEMILTSKPVKAEEGHSLGLIDAVVPPAELVTTARRWALDIVGRRKPWVSSVSKTDKLPPLGEAREILTFAKAQTLKRAPNMKHPLMCLDAIEVGIVSGPRAGLEKEAEVASQVVKLDTTKGLIHVFFSQRGTAKVPGVTDRGLVPRKIKKVAIIGGGLMGSGIATALILSNYPVILKEVNEKFLEAGIGRVKANLQSRVRKGSMSQEKFEKTMSLLKGSLDYESFRDVDMVIEAVIENISLKQQIFADLEKYCPQHCILASNTSTIDLNKIGERTKSQDRIVGAHFFSPAHIMPLLEIVRTNHTSAQVIVDLLDVGKKIKKTPVVVGNCTGFAVNRMFFPYTQAAMFLVECGADPYLIDRAISKFGMPMGPFRLCDLVGFGVAIATATQFIENFSERTYKSMIIPLMQEDKRAGEATRKGFYLYDDKRKAKPDPELKKYIEKARSISGVKLDPKLANLSEKDIIEMTFFPVVNEACRVFAEGIAVKAADLDIAGIMGMGFPPYRGGIMFWADSIGSKYIYSRLDEWSKAYGEFFKPCAFLAERGSKGVLLSAPVKQASSRL

SEQ ID NO: 7754 - protein, 723 aa, Arabidopsis lyrata subsp. lyrata
MDSRTKGKTVMEVGGDGVAVITLINPPVNSLSFDVLYNLKSNYEEALSRIDVKAIVITGGRFSGGFDISGFGEMQKGTIKEPKAGYISIDIITDLLEAARKPSVAAIDGLALGGGLELAMACHARISAPAAQLGLPELQLGVIPGFGGTQRLPRLVGLTKALEMILTSKPVKAEEGHSLGLIDAVMPPAELLTTARRWALDIVERRKPWVSSVSKTDKLPSLGEAREILKFARGQTQKRAPNMKHPLMCLDAIEVGIVSGPRAGLEKEAEVASQVVKLDTTKSLIHVFFSQRGTAKVPGVTDRGLAPRKIKKVAIIGGGLMGSGIATALILSNYPVILKEVNEKFLEAGIGRVKANLQSRVRKGSMSQEKFEKTMSLLKGSLDYESFRDVDMVIEAVIENISLKQQIFADLEKYCPQHCILASNTSTIDLNKIGERTKSQDRIVGAHFFSPAHIMPLLEIVRTNHTSAQVIVDLLDVGKKIKKTPVVVGNCTGFAVNRMFFPYTQAAMFLVECGADPYLIDRAISKFGMPMGPFRLCDLVGFGVAIATATQFIENFSERTYKSMIIPLMQEDKRAGEATRKGFYLYDDKRKAKPDPELKKYIEKARSISGVKLDPKLANLSEKEIIEMTFFPVVNEACRVFAEGIAVKAADLDIAGIMGMGFPPYRGGIMFWADSIGSKYIYSRLDEWSKTYGEFFKPCAFLAERGSKGVPLSAPVKQASSRL

SEQ ID NO: 7755 - protein, 725 aa, Brassica napus
MASRTKGTTTIEVGADGVAVITLINPPVNSLSFDVLYSLKSNYEEALSRNDVKAIVVTGAKGKFSGGFDISGFGEIQKGTMKEPKVGYISIDILTDLLEAAKKPSVAAIDGLALGGGLELSMACHARISAPGAQLGLPELQLGVIPGFGGTQRLPRLVGLTKALEMILTSKPVKAEEGHSLGLIDAVVPPAELLNAARRWALDIAERRKPWVSSVLKTDKLPPLGEAREILKFAKDQTRRQAPNMKHPLMCLEAVEVGIVSGSRAGLEKEAQVGSEVINLDTTKGLIHVFFSQRGTTKVPGVTDRGLVPRKINKVAIIGGGLMGSGIATALILSNYSVILKEVNEKFLEAGIGRVKANLQSRVKKGKMSKEKFEKTMSLLKGSLDYESFRDVDMVIEAVIENISLKQQIFADLEKYCPQHCILASNTSTIDLNKIGERTKSQDRIIGAHFFSPAHVMPLLEIVRTNHTSAQVIVDLLDVGKKIRKTPVVVGNCTGFAVNRMFFPYTQAAMFLVEHGTDPYLIDKAVSKFGMPMGPFRLCDLVGFGVAIATATQFIENFPERTYKSMIIPLMQEDKRAGEATRKGFYLYDDRRKAKPDPEIKNYIDKARSVSGAKPDPKLEKLSEKEIIEMTFFPVVNEACRVFAEGIAVKAADLDIAGIFGMGFPPYRGGIMFWADSIGSKYIYSKLEEWSKAYGEFFKPCAFLAERGSKGAPLSAPLEQSRSRL

SEQ ID NO: 7756 - protein, 139 aa, Glycine max
MASSVMASVALKPAPFTVEKSSVRGLPSLSRNSSSFRVVASGGKKIKTDKPYGINGGMALREGVDASGRKGKGKGVYQFVDKYGANVDGYSPIYDTKDWSPTGDVYAGGTTGLAIWAVTLLGLLAGGALLVYNTSALAQ

SEQ ID NO: 7757 - protein, 138 aa, Glycine max
MASSVMASVALKPAPFTVEKSSVRGLPSLSRNSSSFRVVASGKKIKTDKPYGINGGMALRDGTDASGRKGKGKGVYQFVDKYGANVDGYSPIYDTKDWSPTGDVYAGGTTGLAIWAVTLLGLLAGGALLVYNTSALVQ

SEQ ID NO: 7758 - protein, 129 aa, Arachis hypogaea
LKPAPFTAERSSVRGIPSLSRASSSFKVVASGGKKIKTDKPYGINGGMNLRDGLDASGRKGKGKGVYQFVDKYGANVDGYSPIYDQKDWSPTGDVYTGGTTGLAIWAVTLVGLLAGGALLVYNTSALSQ

SEQ ID NO: 7759 - protein, 136 aa, Nicotiana tabacum
MASTVMSLKPAPFSVEKTAVKGLPSLARSSSSFRVQASGVKKLKTDKPYGINGSMSLRDGVDASGRKQKGKGVYQFVDKYGANVDGYSPIYNTDDWSPSGDVYVGGTTGLAIWAVTLVGILAGGALLVFNTSALAQ

SEQ ID NO: 7760 - protein, 138 aa, Solanum lycopersicum
MASTVMSSLSLKPTFTLEKISVKGLPSLTRSSSSFKVVASGVKKLKTDKPYGINGSMALRDGVDASGRKPKGKGVYQYVDKYGANVDGYSPIYNTDEWSPSGDVYVGGTTGLAIWAVTLLGILAGGALLVYNTSALAQ

SEQ ID NO: 7761 - protein, 138 aa, Solanum tuberosum
MASTVMSSLSLKPTFTLEKTSVKGLPSLARSSSSFKVVASGVKKLKTDKPYGINGSMALRDGVDASGRKPKGKGVYQYVDKYGANVDGYSPIYNTDEWSPSGDVYVGGTTGLAIWAVTLVGILAGGALLVYNTSALAQ

SEQ ID NO: 7762 - protein, 137 aa, Jatropha curcas
MATSVMASVSLKPSPFSVQKSSVRGLPKLSRRAFKVEAGGGKKIKTDKPYGIGGGMNLRNGLDASGRKATGKGVYQYVDKYGANVDGYSPIYNTDEWSPTGDVYAGGTTGLAIWAVTLLGILAGGALLVYNTSALAQ

SEQ ID NO: 7763 - protein, 138 aa, Solanum tuberosum
MASTVMSSLSLKPTFTLEKTSVKGLPSLARSSSPFKVVASGVKKLKTDKPYGINGSMALRDGLDASGRKPKGKGVYQYVDKYGANVDGYSPIYNTDEWSPSGDVYVGGTTGLAIWAVTLVGILAGGALLVYNTSALAQ

SEQ ID NO: 7764 - protein, 137 aa, Populus trichocarpa
MAASVMASLSLKPSPFTVEKSSVRGLPTLSRRTFKIEASGVKKIKTDTPYGTGGGMNLRDGLDASGRKPKGKGVYQYVDKYGANVDGYSPIYNTDEWSPTGDVYAGGKTGLLIWAVTLAGILAGGALLVYSTSALAQ

SEQ ID NO: 7765 - protein, 137 aa, Populus trichocarpa x Populus deltoides
MAASVMASLSLKPSPFTVEKSSVRGLPTLSRRSFKIEASGVKKIKTDTPYGTGGGMNLRDGLDASGRKPKGKGVYQYVDKYGANVDGYSPIYNTDEWSPSGDVYAGGKTGLLIWAVTLAGILAGGALLVYSTSALAQ

SEQ ID NO: 7766 - protein, 394 aa, Medicago truncatula
MSDDEREEKELDLTSPDVVTKYKTAAEIVNKALKLVISECKPKAKVVDICEKGDSFIREQTSNVYKNVKKKIERGVAFPTCISVNNTICHFSPLASDETVLDEGDIVKIDLACHIDGFIAAVAHTHVLQEGPVTGRAADVIAAANTAAEVALRLVRPGKKNKDVSDAIQKVAAAYDCKIVEGVLSHQLKQFVIDGNKVVLSISNPDTRVDDAEFEENEVYAIDIVTSTGEGKPKLLDEKQTTIYKRAVDKSYHLKMKASRFIFSEISQKFPIMPFSARALEEKRVRLGLVECMNHELLQPYPVLHEKPGDFVAHIKFTVLLMPNGSDRVTSHPLQELQPTKTIDDPEIKAWLALGTKTKKKGGGKKKKGKEEDKADETAEAEPVDSTNEATSQE

SEQ ID NO: 7767 - protein, 395 aa, Ammopiptanthus mongolicus
MSDDEREEKELDLSSPEVVTKYKTAAEIVNKALKLVISECKPKAKIVDLCEKGDSYIREQTGNVYKNVKRKIERGVAFPTCISVNNTVCHFSPLASDETVLEEGDILKIDMACHIDGFIAAVAHTHVLEEGPVTGRAADVITAANTAAEVALRLVRPGKKNKDVTDAIQKVAAAYDCKIVEGVLSHQMKQFVIDGNKVVLSASNPDTRVDEAEFEENEVYAIDIVTSTGEGKPKLLDEKQTTIYKRAVDKSYHLKMKASRFIFSEISQNFPIMPFSARALEEKRARLGLVECVNHELLQPYPVLHEKPGDYVAHIKFTVLLMPNGSDRVTSYPLQELQPTKTIDDPEIKAWLALGTKTKKKGGGKKKKGKKGEDKADESAEAEPMDSTNGATPQD

SEQ ID NO: 7768 - protein, 394 aa, Glycine max
MSDDEREEKELDLSSAEVVTKYKTAAEIVNKALKLVISECKPKAKIVDICEKGDSYIREQTGNVYKNVKRKIERGVAFPTCLSINNVVCHFSPLASDEAVLEEGDILKIDMACHIDGFIAVVAHTHVLQEGPVTGRAADVIAAANTAAEVALRLVRPGKKNKDVSDAIQKVAAAYDCKIVEGVLSHQMKQFVIDGNKVVLSLSNPDTRVDEAEFEENEVYAIDIVTSTGDGKPKLLDEKQTTIYKRAVDKSYHLKMKASRFIFSEISQKFPIMPFSARALEEKRARLGLVECVNHELLQPYPVLHEKPGDFVAHIKFTVLLMPNGSDRITTHPLQELQPTKTIDDPDIKAWLALGTKTKKKGGGKKKKGKKGEKADESAEAEPMDSTNEATPQE

SEQ ID NO: 7769 - protein, 394 aa, Vitis vinifera
MSDDEREEKELDLTSPEVVTKYKSAAEIANKALQLVLSECKPKAKIVDICEKGDSFIREQTGNMYKNVKKKIERGVAFPTCISVNNTVCHFSPLASDETVLEDGDMLKIDLGCHIDGFIAVVAHTHVLQGGPVMGRAADVLAAANTAAEVALRLVRPGRKNKDVTEAIQKVAAAYDCKIVEGVLSHQLKQFVIDGNKVVLSVPSPETRVEDAEFEENEVYAVDIVTSTGDGKPRLLDEKQTTIYKRAVDKSYHLKMKASRFIFSEISQKFPIMPFSARALEEKRARLGLVECVNHDLLQPYPVLHEKPGDYVAHIKFTVLLMPNGSDRITSHSLQELQPTKTTDDPEIKAWLALGTKTKKKGGGKKKKGKKGDKPEESAEAEPMDATTNGASQE

SEQ ID NO: 7770 - protein, 394 aa, Ricinus communis
MSDDEREEKELDLTSPEVVTKYKSAAEIVNKALQLVISECKPKAKIVDLCEKGDAFIREQTGNMYKNVKKKIERGVAFPTCVSVNNTVCHCSPLASDETLLEEGDVVKIDMGCHIDGFIAVVGHTHVLQAGPVTGRAADVIAAANTAAEVALRLVRPGKKNKDVTEAIQKVAAAYDCKIVEGVLSHQLKQFVIDGNKVILSVSNPETRVDDAEFEENEVYAIDIVTTTGEGKPKLLDEKHTTIYKRAVDKNYHLKMKASRFIFSEISQKFPIMPFTARALEEKRARLGLVECVNHDLLQPYPVLHEKPGDIVAHIKFTVLLMPNGSDRITSHSLQELQPTKTIDDPEIKAWLALGTKTKKKGGGKKKKAKKGDKAEESTEAEPMDATNGAETQE

SEQ ID NO: 7771 - protein, 396 aa, Populus trichocarpa
MSSDDEREERELDLTSPEVITKYKSAAEIVNKALQLVISECKPKAKIVDICEKGDSFIREQTGNMYKNVKKKIERGVAFPTCVSVNNTICHFSPLASDESVLEEGDIVKIDLGCHIDGFIAVVGHTHALQSGPVTGRAADVIAAANTAAEVALRLVRPGKKNKDVTEAIQKVAAAYDCKIVEGVLSHQLKQFVIDGNKVILSVSNPDTRVDDAEFEENEVYAVDIVTSTGEGKPKLLDEKSTTIYKRAVDKNYHLKMKSSRFIFSEINQKFPIMPFTARALEEKRARLGLLECVNHDLLQPYPVLHEKPGDYVAHIKFTVLLMPNGSDRITSHSLQELQPSKTIDDPEIKAWLALGTKTKKKGGGKKKKAKKSGEKAESTEAEPMDATTNGAAAQE

SEQ ID NO: 7772 - protein, 402 aa, Vitis vinifera
MSDDEREEKELDLTSPEVVTKYKSAAEIANKALQLVLSECKPKAKIVDICEKGDSFIREQTGNMYKNVKKKIERGVAFPTCISVNNTVCHFSPLASDETVLEDGDMLKIDLGCHIDGFIAVVAHTHVLQGGPVMGRAADVLAAANTAAEVALRLVRPGRKNKDVTEAIQKVAAAYDCKIVEGVLSHQLKQFVIDGNKVVLSVPSPETRVEDAEFEENEVYAVDIVTSTGDGKPRLLDEKQTTIYKRAVDKSYHLKMKASRFIFSEISQKFPIMPFSARALEEKRARLGLVECVNHDLLQPYPVLHEKPAETWVGYAGDYVAHIKFTVLLMPNGSDRITSHSLQELQPTKTTDDPEIKAWLALGTKTKKKGGGKKKKGKKGDKPEESAEAEPMDATTNGASQE

SEQ ID NO: 7773 - protein, 390 aa, Glycine max
MSDDEREEKELDLTSPEVVTKYKSAAEIVNRALQLVISECKPKAKIVDLCEKGDSYIREQTGSMYKNVKRKIERGVAFPTCVSVNNTVCHFSPLASDETVLEDGDIVKIDMACHIDGFIAAVAHTHVLQEGPVTGRAADALAAANTAAEVALRLVRPGRKNKDVTEAIQKIAAAYDCKIVEGVLSHQMKQFVIDGNKVVLSVSNPDTRVDDAEFEENEVYAIDIVASTGDGKPKLLDEKQTTIYKRAVDKSYHLKMKASRFIFSEISQKFPIMPFSARALEEKRARLGLVECVNHELLQPYPVLHEKPGDYVAHIKFTVLLMPNGSDRVTSHSLQELQPTKTIDDPEIKACLALGTKTKKKGGGKKKKGKKGAEAEPMDATNDATPQEQD

SEQ ID NO: 7774 - protein, 387 aa, Solanum tuberosum
  misc_feature (333)..(333): Xaa can be any naturally occurring amino acid
MSDDEREEKELDLTSPEVVTKYKSAAEIVNKALQLVLSECKPKVKIVDLCEKGDAFIKEQTGNMYKNVKKKIERGVAFPTCISVNNTVCHFSPLASDETIVEEGDILKIDMGCHIDGFIAVVGHTHVLHEGPVTGRAADVIAAANTAAEVALRLVRPGKKNSDVTEAIQKVAAAYDCKIVEGVLSHQMKQFVIDGNKVVLSVSNPDTRVDEAEFEENEVYSIDIVTSTGDGKPKLLDEKQTTIYKRAVDKSYNLKMKASRFIFSEINQKFPIMPFTARDLEEKRARLGLVECVNHELLQPYPVLHEKPGDLVAHIKFTVLLMPNGSDRVTSHXLQELQPTKTTENEPEIKAWLALPTKTKKKGGGKKKKGKKGDKVEEASQAEPMEG

SEQ ID NO: 7775 - protein, 412 aa, Populus trichocarpa
MSSDDEREERELDLTSPEVVTKYKSAAEIVNKALQLAISECKPKVKIVDICEKADSYIREQSGNMYKNVKKKIERGVAFPTCVSVNNTVCHFSPLASDESVLEEGDVVKIDMGCHIDGFIAVVGHTHVLQLGPVTGRAADVIAAANTAAEVALRLVRPGKKNKDVTEAIQKVAAAYDCKIVEGVLSHQLKQFVIDGNKVILSVSNPDTRVDDAEFEENEVYAVDIFTSTGEGKPKLLDEKTTTIYKRAVDKNYHLKMKSSRFIFSEINQKFPIMPFSARALEEKRARLGLVECVNHDLLQPYPVLHEKPGDCVAHIKFTVLLMPNGSDRITSHALQELQPTKTIDDPEIKAWLALGTKTKKKGGGKKKKAKKAGEKAEEATEAEPMDATEAEPMDATEAEPMDATTNGATAV

SEQ ID NO: 7776 - protein, 209 aa, Glycine max
MNPSFPSKSFMYVVLIFCFLGATRLYASDPYLTLDYYASSCPTVFDIVRKEMECAVLSDPRNAAMIVRLHFHDCFVQGCDGSVLLDDTITLKGEKNAATNIHSLKGLGIVDKIKNIVESECPGIVSCADILTIAARDAVILVGGPYWDVPVGRKDSVTANFDLANTNLATPDESLLSIIAKFLYQGLSVTDMVALAEPTPLAWHSVRIS

SEQ ID NO: 7777 - protein, 726 aa, Populus trichocarpa; identical to SEQ ID NO: 7747

SEQ ID NO: 7778 - protein, 723 aa, Glycine max; identical to SEQ ID NO: 7746

SEQ ID NO: 7779 - protein, 395 aa, Ammopiptanthus mongolicus; identical to SEQ ID NO: 7767

SEQ ID NO: 7780 - protein, 394 aa, Medicago truncatula; identical to SEQ ID NO: 7766

SEQ ID NO: 7781 - protein, 280 aa, Glycine max
MACHIDGFIAAVAHTHVLHEGPVTGRAADAIAAANTAAEVALRLVRPGRKNKDVTEAIQKVAAAYDCKIVEGVLSHQMKQFVIDGNKVVLSVSNPDTRVDDAEFEENEVYAIDIVASTGDGKPKLLDEKQTTIYKRAVDKSSHLKMKASRFIFSEISQKFPIMPFSARALEEKRARLGLVECVNHELLQPYPVLHEKPGDDVAHIKFTVLLMPNGSDRVTSHPLQELQPTKTIDDPEIKAWLALGTKTKKKGGGKKKKGKKGAEAEPMEATNGATPQEQD

SEQ ID NO: 7782 - protein, 198 aa, Glycine max
  misc_feature (158)..(158): Xaa can be any naturally occurring amino acid
MSAQVGVRTRARAALAMEAATASSAQPSSKRKKIYDTNHVAKLSKTPRTSSSSFFIPATVTEIVQERCLSPTSSEIPASCCSSNGSIGLDEDRIKLLDLEVESAQVETSTCNGGQEIERREMKSSSELRENSQEPEPMEINSHRALSKAKAMPTELEXEEFFVAAEKDIQKRFQDKYNYDIVKDVPLEGRYEWVQLKP

SEQ ID NO: 7783 - protein, 195 aa, Glycine max
MSSQVGVRTRARAALAMEAATASSAQPSSKRKKIYDTNHVAKLSKTPRTSSSSFFIPATVTEIVQERCLSPTSSEIPASCCSSNGSIGLDEDRIKLLDLEVESAQVETSTCNGGQEIERREMKSSSELRENSQEPEPMEINSHRALSKAKAMPTELELEEFFVAAEKDIQKRFQDKYNYDIVKDVPLEDATSGFS

SEQ ID NO: 7784 - protein, 205 aa, Glycine max
MSAQVGVRTRAQAALAMEAVSSAEPSSKRKKISNSTNQEPKLSKTPRTSSSSAVKPATVTEMVRPVSPEMVQQRCLSPTSSEIPASCCSSNGSIGLDQDRIKLLDLEVESAQVETSTCNGGHEIERREMKRSSELRENSQEPEPMEINSHRVLSKAKAMPTELELEEFFAASEKDIQKRFQDRYNYDIVKDVPLEGRYEWVQLKP

SEQ ID NO: 7785 - protein, 202 aa, Glycine max
MSAQVGVRTRAQAALAMEAVSSAEPSSKRKKISNSTNQEPKLSKTPRTSSSSAVKPATVTEMVQPVSPEMVQQRCLSPTSSEIPASCCSSNGSIGLDQDRIKLLDLEVESAQVETSTCNGGHEIERREMKRSSELRENSQEPEPMEINSHRVLSKAKAMPTELELEEFFAASEKDIQKRFQDRYNYDIVKDVPLEDATSGFS

SEQ ID NO: 7786 - protein, 198 aa, Glycine max; identical to SEQ ID NO: 7782
  misc_feature (158)..(158): Xaa can be any naturally occurring amino acid

SEQ ID NO: 7787 - protein, 322 aa, Glycine max
MKTKLLLLMLLMLLLILHKPTWFLASAYPLAPSPQVPPFSPFPTSMSASSPGIVMGAEQQHMDSHKKMVIAVAVVSTSLGAVILCLLCIWIYYTKYPSKSKGKNVQRSDAEKGLASSPFLSKFSSIKLVGKKGCVPIIDYKQIEKATGNFKEINILGKGGFGCVYKAHLDDNLDVAVKKLHCENQYAEQEFENEVDLLSKIQHPNVISLLGCSSNEDTRIIVYELMHNGSLETQLHGPSHGSALTWHLRIKIALDTARGLKYLHEHCYPPVIHRDLKSSNILLDTKFNAKLSDFGLAITNGSQNKNNLKLSGTLGTLPRSIF

SEQ ID NO: 7788 - protein, 391 aa, Glycine max
MDSHKKMVIAVAVAGTSLGAVILCVLCIWIYYTKYPSKSKGKNVQRSDAEKGLASSPFLSKFSSIKLVGKKGCVPIIDYKQIEKATGNFKEINILGKGGFGCVYKAHLDDNLDVAVKKLHCENQYAEQEFENEVDLLSKIQHPNVISLLGCSSNEDTKIIVYELMHNGSLETQLHGPSHGSALTWHLRIKIALDTARGLKYLHEHCYPPVIHRDLKSSNILLDTKFNAKLSDFGLAITNGSQNKNNLKLSGTLGYVAPEYLLDGKLTDKSDVYAFGVVLLELLLGKKPVEKLAQAQCQSIVTLAMPQLTDRSKLPNIVDPVIKNTMDPKHLYQVAAVAVLCVQPEPSYRPLIADVLHSLIPLVPVELGGTLKVSQLPKQVLPADPPEDSSQ

SEQ ID NO: 7789 - protein, 363 aa, Glycine max
MKNLQTSEELQSSTQASHEPKSEQPNNHTTDAPVTDTGSASATSNDSKKVSRQDIEFVQNLIERCLQLYMNKDEVVKTLLTRAKIDPGFTTLVWQKLEEENADFFRAYYIRLKLKKQILLFNHLLEHQYHLMKCPMPAKVPLAPIQNGIHPMPVNNLPMGYPVLQQPPMPATGQPHIDSMGCGLSSCHVVNGVPASGNFHPIRMNSGNDMMMDHSAPDMVPVIPPNGTMSSVSEMPVSPTSVASSGHFPFTASEIPGMGADTSALDTAFTSDVASSVGLQLAADGGNGISRSLDQIQWNFSLSDLTADLPNLGDLGALGNYPGSPFLPSDSDILLESPDQQDIVDDFFVNFEPPCSQSDEEKS

SEQ ID NO: 7790 - protein, 362 aa, Populus trichocarpa
MKTLQSAQEQSSTQVSQDSQSEQQNNHNIEPPVADSGSKSASSNDSRKVSRQDIELVQNLIERCLQLYMNRDEVVKTLLTRARIDPGFTTLVWQKLEEENADFFRAYYIRLKLKKQILLFNYLLEHQYHLMKYPVATKVPLAPIQNGIHPMPVNNLPMGYPVLQQPPMATPGQPHLDSMGCGVSSCHVVNGVPAPGNFHPIRMNSGNDMVMENSATDTTHVVPPSSTISSLSEMPVSPTSVASSGHFPFTASDMAGMGVDTALDTTFTSDVASSVGLQLGQDGGAGNSRSLDQIQWNFSLSDLTADLSNLGDLGALGNYPGSPFLPSDSEILLDSPENEDIVEEFFVDSVPGPPSQSDEERS

SEQ ID NO: 7791 - protein, 362 aa, Populus trichocarpa
MKTLQSAQEQSTQISQDSQSEQQNNHKTEAPVADSSSISASSNDSRKVSRQDIELVQNLIERCLQLYMNRDEVVKTLLTRARIDPGFTTLVWQKLEEENADFFRAYYIRLKLKKQILLFNHLLERQYHLMKYPVPSKVPLAPIQNGVHPMPVNNLPMGYPVLQQPQMPAPGQPHLDSMSCGISSCHVVNGIPAPGNFHPIRMNSGNDMVMGNSAADTAPVVPPSSAISSMSEMPLSPTSVTSNGHFPFNASDMSGMGVDTSALYTAFASDAASSVGLQLGPDGGAGNSRSLEQIQWTFSLSDLTADLSNLGDLGALGNYPGSPFLPSDSEILLDSPENEDIVEEFFVDSVPGPPYQSDEEKS

SEQ ID NO: 7792 - protein, 368 aa, Vitis vinifera
MKTLQSAQEIQSSTQVSHESQSDHQNNTAEAPVADSGSICISSNDSRKVSREDIELVQNLIERCLQLYMNRDEVVKTLLSRARIDPGFTTLVWQKLEEENADFFRAYYIRLKLKKQIILFNHLLEHQAHLTNYHVSPKVPLAPIQNGIHPMPVNNLPMGYPVLQQPPIPAPGQPHIDSMGCGISSCHVVNGVPAPGNFHPMRMNSGNDMVRDTSTADVAPVIPPSSAMSSMSEMPVSPTSVASSGHFPFTASDISGMGVEASALETAFTSDVASSVGLQLPPDGGPGNSRDSLRALAPIPWNFSLSDLTADLSNLGDLGALGNYPGSPFLGSDSDILLDSPEQEDIVEEFFVDSVPGPPNAQSDEEKS

SEQ ID NO: 7793 - protein, 363 aa, Arabidopsis thaliana
MKNGQELQSSTQVSHESQGEQKVNLSVEAPIQDSGSVSASSNDGRKVSRQDIELVQNLIERCLQLYMSRDEVVKTLLTRARIDPGFTTLVWQKLEEENAEFFRAYYIRLKLKKQIVVFNHLLEHQYHLTKYNVHSKVPLVPMQNGIHPMASVNNMPMGYPVLQHPQMHAQGHPHLDPMSCGMSSCHVVNGVPAPANFQPMRINSGNDMVIDTTMAEPTPMIPPNSGMSDMPVSPASVASSGHFPFAASDMSGMGMDTSALDSAFTSDVGTSVGLQLGSDGGAGNSRDPLRPFDQIPWNFSLSDLTADLSNLGDLGALGNYPGSPFLPSDSEILLDSPEQEDIDEFFVDSIPGPPCSQSEEDKS

SEQ ID NO: 7794 - protein, 361 aa, Arabidopsis lyrata subsp. lyrata
MKNEQSSSTQVSLESQGEQKVNQSIEAPIQDSGSVSASSNDGRKVSRQDIELVQNLIERCLQLYMNRDEVVKTLLTRARIDPGFTTLVWQKLEEENEEFFRAYYIRLKLKKQIVVFNYLLEHQYHLTKYHVHPKVPLVPMQNGIHPMASVNNMPMGYPVLQHPQMHAQGHPHLDPMSCAMSSCHVVNGVPAPANFQPIRINSGNDMVIDTTMAEPTPMIPPNSGMSDMPVSPASVASSGHFPFAASDMSGMGMDTSALDSAFTSDVATSVGLQLGSDGGAGNSRDPLRPFDQIPWNFSLSDLTADLSNLGDLGALGNYPGSPFLPSDSEILLDSPEQEDIDEFFVDSVPGPPCSQSEEDKS

SEQ ID NO: 7795 - protein, 368 aa, Solanum demissum
MKAEKKLLPNNTEKKPSIQASHEAQNDQQNHTADTPVADAGSVSASGNDNRKVSREDIELVQNLIERCLQLYMNKDEVVKTLLNRARIDPGFTTLVWQKLEEENADFFRAYYIRLKLKKQIILFNHLLEHQYHLMKYPVPPKVPLAPMQNGISTMPVNNLPMGYPVLQQSPVPSAGQPHLDPMGMSSCHVVNGVPAPGNYHPMRMNSGNDMVIDTNVSDVAAAVPPGNAMSSMSDMAVSPTSVASSGHFPFTTSEISGMGVDTLALDAAFPSDVASSVGLQLPPDNGVGNSRDSLRSLAQIPWNFSLSDLTADLSNLGDLGPLGNYPGSAYLPSDSDILLDSPEQDDIAKVIRCNVDAVVFTTTTYPV

SEQ ID NO: 7796 - protein, 358 aa, Arabidopsis lyrata subsp. lyrata
MKNGQCAQELQSSTQASHDSQGEQKTNLSIDAPIQDSGSVSASSNDSRKVSRQDIELVQNLIERCLQLYMNRDEVVKTLLTRARIDPGFTTLVWQKLEEENADFFRAYYIRLKLKKQIILFNHLLEHQYHLMKYSPGPPKIPLAPIQNGMHPMAPVNMPMGYPVLQHPQMHVPGHPHLDAMGVSSCHVVNGVPAPANFHPLRMNTANDMVIDTTANDATPQVIPPNSGGMPEMVASPASVASSGHFPFAASDMSGMVMDTSVLDSAFTSDVGPDGEGAGNSRDSLRSFDQIPWNFSLSDLTADLSNLGDLGALGNYPGSPFLPSDSEIFLDSPEQEDIEEFFVDSVPGPRSNSDEEKP

SEQ ID NO: 7797 - protein, 359 aa, Arabidopsis thaliana
MKNGQCAQELQSSTQASHDSQGDQKTNLSIDAPIQDSGSVSASSNDSRKVSRQDIELVQNLIERCLQLYMNRDEVVKTLLTRARIDPGFTTLVWQKLEEENADFFRAYYIRLKLKKQIILFNHLLEHQYHLMKYPPGPPKVPLAPIQNGMHPMAPVNMPMGYPVLQHPQMHVPGHPHHLDAMGVSSCHVVNGVPAPANFHPLRMNTANDMVIDTTANDATPQVIPPNSGAMPEMVASPASVASSGHFPFAASDMSGMVMDTSVLDSAFTSDVGPDGEGAGNSRDSLRSFDQIPWNFSLSDLTADLSNLGDLGALGNYPGSPFLPSDSEIFLDSPEQEDIEEFFVDSVPGPRSNSDEEKP

SEQ ID NO: 7798 - protein, 664 aa, Ricinus communis
MEGVDHLAEERNKAQFDVDEMKIVWAGSRHAFDVADRMARLVASDPAFRKDNRAMLSRKELFKNTLRKAAHAWKRIIELRLSEEEASKLRTFVDEPAYTDLHWGMFVPAIKGQGTEEQQKKWLPLAHKMQIIGCYAQTELGHGSNVQGLETTATFDLETDEFVIHSPTLTSSKWWPGGLGKVSTHAVVYARLITEGREHGVHGFIVQLRSLDDHMPLPGITVGDIGMKFGSGAYNTMDNGVLRFDHVRIPRNQMLMRVMQVTREGKCVQSKVPRQLIYGTMVYVRQTIVADASAALSRAVCIATRYSAVRRQFGSNDGGVETQVIDYKTQQSRLFPLLASAYAFRFVGEWLKWLYTDVTQRLQANDFSTLPEAHACTAGLKSLTTSFTADAIEECRKLCGGHGYLTASGLPELFAVYVPACTYEGDNVVLLLQVARFLMKTVSQLGSGKKPVGTTAYMARVEHLLQCRCGAQKAEDWLKPNVILEAFEARAARMCVTRAQSLSHYPNPEEGFAELSADLVEAAVAHCQLIVVSKFIEKLQQEIPGKGVKQQLQILCYMYALNLLHKHQGDFLSTGCITPKQASLANDQLRSLYSQVRPNAIALVDAFNYTDHYLGSVLGCYDGNVYPKLYEEAWKDPLNDSVIPDGYNEYVRPMLKQQLRNARL

SEQ ID NO: 7799 - protein, 664 aa, Populus trichocarpa
MKGVDHLAHERNKTEFDVDAMKIVWAGSRHAFELSDRMARLVASDPAFQKDGRTRLGRKELFKNTLRKAAHAWKRILELRLTEEEAGWLRSFVDEPSFTDLHWGMFIPAIKGQGTDEQQQKWLPLAYKMQIIGCYAQTELGHGSNVQGLETTATFDPETDEFVIHSPTLTSSKWWPGGLGKVSTHAIVYARLITNGQEHGVHGFIVQLRSLDDHMPLPGLTIGDIGMKFGNGAYNTMDNGVLKFDHIRIPRNQMLMRVLQVTREGKCVQSNVPRQLIYGTMVFVRQTIVADASTALSRAVCIATRYSAVRRQFGSQDGGMETQVIDYKTQQSRLFPLLASAYAFRFVGEWLKWLYTDVTQRLQANDFSTLPEAHACTAGLKSLTTTATADAIEECRKLCGGHGYLCASGLPELFAVYVPACTYEGDNVVLLLQVARFLMKTVSQLGSGKKPVGTTAYLGRVQDLLQCCCDVQTAEDWLKPSVVLEAFEARSARMCVARAQNLSKFENPEDGFAELSADLVEAAVAHCQLIVVSKFIDKLQQDIPGKGVNQQLQNLCYIYALNLLHKYLGDFLSTGCITPKQASLANDQLRSLYSKIRPNAIALADAFNYTDHYLGSVLGRYDGNVYPKLYEEAWKDPLNDSVVPDGYHEYVHPMLKQQLRNARL

SEQ ID NO: 7800 - protein, 664 aa, Vitis vinifera
  misc_feature (41)..(41): X can be Leucine or Isoleucine
MEGIDYHEGERSKAEFDVEEMKIVWAGSREVFEVSDRMGRXVASDEAFRKDNRTMLSRKDLFKNTLRKAAHAWKRIIELRLSEQEASWLRFYIDEPAFTDLHWGMFVPAIKGQGTDEQQQKWLPLAYKMQIIGCYAQTELGHGSNVQGLETTATFDSQSDEFVIHSPTLTSSKWWPGGLGKVSTHAVVYARLITDGQDHGVHGFIVQLRSLEDHLPLPGITIGDIGMKFGNGGYNSMDNGVLRFDHVRIPRDQMLMRVFQVTREGKCVQSNVPRQLVYGTMVFVRQTIVSDASSALSRAVCIATRYSVVRRQFGSQNGGPETQVIDYKTQQSRLFPLLASAYAFRFVGQWLKWLYMDVTQRLQANDFSTLPEAHACTAGLKSLTTSATADGIEECRKLCGGHGYLCSSGLPELFAVYVPACTYEGDNIVLLLQVARFLMKTVSQLGSGKQPVGTTAYMGRVADLMQCCCAVQRAEDWLNPSVILEAFEARSARMSVACAQNLSKFANSEEGFAELSADLVEAAVAHCQLIVVSKFIEKLQEDIPGKGVKRQLEILCNIYALYLLHKYVGDFLSTSCITPKQASLANEQLRSLYAQARPNAIALVDAFNYTDHYLSSILGCYDGNVYPKLYDAAWKDPLNASVVPDGYQQYIRPMLKQQLRNARL

SEQ ID NO: 7801 - protein, 665 aa, Glycine max
MEGMVDHLAFERNNSQFDVDEMKIVWAGSRHAFEVSDKMARLVASDPAFRKDDRVVLDRKALFKNTLRKAAYAWKRIIELRLSEEEAAMLRSFVDQPAFTDLHWGMFVPAIKGQGTEEQQKKWLPLAHKMQIIGCYAQTELGHGSNVQGLETTATFDPRTDEFVIHSPTLTSSKWWPGGLGKVSTHAVVYARLITDGQDHGVHGFIVQLRSLDDHLPLPGITVGDIGMKFGNGAYNSMDNGMLRFDHVRIPRNQMLMRVSQVTREGKYVQSSVPRQLVYGTMVYVRQTIVSDASVALSRAVCIATRYSAVRRQFGSKEGGLETQVIDYKTQQARLFPLLASAYAFRFVGEWLKWLYMDVMKRLQASDFSTLPEAHACTAGLKSLTTSATADGIEECRKLCGGHGYLCSSGLPELFAVYIPTCTYEGDNTVLLLQVARHLIKTISQLGSRNKPVGTTSYIGRVEQLMQYRSDVQKVEDWLKPNAVLGAFEARAAKKVVACAQNLSKFTNPEEGFQELSVDLVEAAVAHCQLIVVSKFIEKLQQDIPGKGVKQQLELLCSIYALFLLHKHLGDFLATGCITPKQGSLANELLRSLYSQVRPNAIALVDAFNYTDHYLGSVLGRYDGDVYPKLYEEAWKDPLNDSVVPDGFQEYIRPMLKQQLRNARL

SEQ ID NO: 7802 - protein, 664 aa, Gossypium hirsutum
MEALDYHAEERRKAEFDLEEMKIVWAGSRQNYEISDRMARLVASDPVFRKDNRTMLSRKDLFKDTLRKAAHAWKRIIELRLSEEEAHMLRSYVDQPAFTDLHWGMFLPAIKGQGTEEQHEKWLPMAYKMQIIGCYAQTELGHGSNVQGLETTATFDPQTDEFVIHSPTLTSSKWWPGGLGKVSTHAVVYARLITGAQDHGVHGFIVQLRSLDDHSPLPGITVGDIGMKFGSGAYNSMDNGLLRFDHVRIPRNQMLMRVSQVTREGKFVQSDVPRQLVYGTMVYVRQTIVSDASCALARAVCIATRYSAVRRQFGSQNGGPETQVIDYKTQQSRLFPLLASAYAFRFVGEWLKWLYTDVTQRLQANDFSTLPEAHACTAGLKSMTTSVTADAIEECRKLCGGHGYLSNSGLPELFAVYIPTCTYEGDNVVLLLQVARFLMKTVSQLGSGKKPVGTTAYMGRAEHLMQCHCEVERAEDWLKPSVILEAFEARAFRMSIACAKNLSKFSNPEDGFSELSPDLLEAAIAHCQLIVVSKYIEKLQQDIPGKGVKRQLEILCNVYASHLLHKHLGDFVTTSCITPKQGALANEQLRLLYSQVRPNAITLVDAFNYTDHYLGSVLGCYNGNVYQRLYEEAWKDPLNDTVVPDGYLEYVRPILKQHIRTARL

SEQ ID NO: 7803 - protein, 639 aa, Populus trichocarpa
MEGVDILPHERSKKQFDVDAMKIVWAGSRQAFEVSDRMARLVASDPAFQKDNRSRLGRKELFKNTLRKATYAWKRIIELRLTEEEAGRLRFFVDEPAFTDLHWGMFVPAIKGQGTEEQQQKWLPLAYKMQIIGCYAQTELGHGSNVQGLETTATFDPDKDEFVIHSPTLTSSKWWPGGLGKVSTHAVVYARLITNGEEHGVHGFIVQLRSLDDHMPLPGITIGDIGMKFGNGAYNTVTREGKCVQSNVPRQLIYGTMVFVRQTIVADASSALSRAVCIATRYSAVRRQFGSQDGVETQVIDYKTQQNRLFPLLASAYAFRFVGEWLKWLYTDVTQRLQANDFSTLPEAHACTAGLKSLTTTATADAIEECRKLCGGHGYLCASGLPELFAVYVPACTYEGDNVVLLLQVARFLVKTVSQLGSGKEPIGTTAYLGRVQDLMQCCCEVQTAEDWLKPSVMLEAFEARSARMCVARAQNLSKFANPEDGFAELSADLVEAAVAHCQLIVVSKFFDKLQQDIPGNGVKQQLQNLCYIYALNLLHKHLGDFLSTGCITPKQASLANDQLRSLYSQVRPNAIALVDAFNYTDHYLGSVLGRYDGNVYPKLYEEAWKDPLNDSVLPDGYNEYIRPMLKQQLHNARL

SEQ ID NO: 7804 - protein, 683 aa, Solanum lycopersicum
MRGSHHHHHHGSACELVREMEGVDYLADERKKAGFDVDEMKIVWAGSRHDFELTDRISKLVASDPGFSKEGRTMLPRKELFKNTLRKAAYAWKRIIELRLSQEEATMLRRYVDEPAFTDLHWGMFIPAIKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYVQSDIPRQLLYGTMVYVRQSIVADASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTISQLGTGKKPVGTVSYMGRIEHLMQCRSDVKQAEDWLKPSAVLEAFEARSARMSVACAKNLSKFENQEEGFAELAADLVEAAVAHCQLIVVSKYIEKLQQNIPGKGVKQQLEVLCGIYSLFILHKHQGDFLGTGYITSKQGSLANDQLRALYSQLRPNAVSLVDAFNYTDHYLGSILGRYDGNVYPKLYEAAWKDPLNKSDIADGFHEYIRPLLKQQLRTAKL

SEQ ID NO: 7805 - protein, 664 aa, Solanum lycopersicum
MEGVDYLADERKKAGFDVDEMKIVWAGSRHDFELTDRISKLVASDPGFSKEGRTMLPRKELFKNTLRKAAYAWKRIIELRLSQEEATMLRRYVDEPAFTDLHWGMFIPAIKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYVQSDIPRQLLYGTMVYVRQSIVADASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTISQLGTGKKPVGTVSYMGRIEHLMQCRSDVKQAEDWLKPSAVLEAFEARSARMSVACAKNLSKFENQEEGFAELAADLVEAAVAHCQLIVVSKYIEKLQQNIPGKGVKQQLEVLCGIYSLFILHKHQGDFLGTGYITSKQGSLANDQLRALYSQLRPNAVSLVDAFNYTDHYLGSILGRYDGNVYPKLYEAAWKDPLNKSDIADGFHEYIRPLLKQQLRTAKL

SEQ ID NO: 7806 - protein, 664 aa, Solanum cheesmaniae
MEGVDYLADERKKAGFDVDEMKIVWAGSRHDFELTDRISKLVASDPGFSKEGRTMLPRKELFKNTLRKAAYAWKRIIELRLSQEEATMLRRYVDEPAFTDLHWGMFIPAIKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYIQSDIPRQLLYGTMVYVRQSIVADASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTISQLGTGKKPVGTVSYMGRIEHLMQCRSDVKQAEDWLKPSAVLEAFEARSARMSVACAKNLSKFENQEEGFAELAADLVEAAVAHCQLIVVSKYIEKLQQNIPGKGVKQQLEVLCGIYSLFILHKHQGDFLGTGYITSKQGSLANDQLRALYSQLRPNAVSLVDAFNYTDHYLGSILGRYDGNVYPKLYEAAWKDPLNKSDIADGFHEYIRPLLKQQLRTAKL

SEQ ID NO: 7807 - protein, 664 aa, Arabidopsis lyrata subsp. lyrata
MEGVDHLADERNKAEFDVEEMKIVWAGSRHAFEVSDRIARLVASDPVFEKSNRARLSRKELFKSTLRKCAHAFKRIIELRLNEEEAGRLRHFIDQPAYVDLHWGMFVPAIKGQGTEEQQKKWLSLASKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGKYVPSDVPKQLVYGTMVYVRQAIVADASIALSRAVCIATRYSAVRRQFGAHNGGIETQVIDYKTQQNRLFPLLASAYAFRFVGEWLKWLYTDVTERLAASDFATLPEAHACTAGLKSLTTTATADAIEECRKLCGGHGYLWCSGLPELFAVYVPACTYEGDNVVLQLQVARFLMKTVAQLGSGKVPVGTTAYMGRAAHLLQCRSGVQKAEDWLNPDAVLEAFEARALRMAVTCAKNLSKFENQEQGFQELLADLVEAAIAHCQLIVVSKFIAKLEQDIGGKGVKKQLNNLCYIYALYLLHKYLGDFLSTNSITPKQASLANDQLRSLYSQVRPNAVALVDAFNYTDHYLNSVLGRYDGNVYPKLFEEAWKDPLNDSVVPDGYHEYLRPVLKQQLRTARL

SEQ ID NO: 7808 - protein, 204 aa, Cicer arietinum
MATTKVYIVYYSTYGHVHKLAEEIQKGAASVEGVEAKLWQVPETLPEDVLGKMGAPPKSDVPIITPNELPEADGLLFGFPTRFGMMAAQFKAFMDATGGLWRTQALAGKPAGIFYSTGSQGGGQETTPLTSITQLVHHGLIFVPIGYTFGAGMFEIEKVKGGSPYGAGTYAGDGSRQPTELELAQAFHQGKYFAGIAKKLKGSQ

SEQ ID NO: 7809 - protein, 205 aa, Glycine max
MATTKVYIVYYSTYGHVEKLAEEIKKGAGSVEGVEAKLWQVPETLSEEVLGKMGAPPKSDVPIITPNELPEADGLLLGFPTRFGQMAAQFKAFMDATGGLWRTQALAGKPAGIFYSTGSQGGGQETTPLTSITQLVHHGMIFVPIGYTFGAGMFEMENVKGGSPYGAGTYAGDGSRQPTELELAQAFHQGKYFAGITKKLKGSSQ

SEQ ID NO: 7810 - protein, 207 aa, Glycine max
MATTTTKVYIVYYSMYGHVEKLAEEIKKGAASVEGVEAKLWQVPETLPQEVLGKMGAPPKSDVPIITPNELPEADGLLLGFPTRFGLMAAQFKAFLDATGGLWRTQALAGKPAGIFYSTGSQGGGQETTPLTSITQLVHHGMIFVPIGYTFGAGMFEMENVKGGSPYGAGTYAGDGSRQPTELELAQAFHQGKYFAGIAKKLKGSSQ

SEQ ID NO: 7811 - protein, 203 aa, Glycine max
MATKVYIVYYSTYGHVEKLAREIEKGAASVEGVEAKLWQVPETLPEEVLAKLGAPPKSDVPIITPNELPEADGFLFGFPTRFGSMAAQFKAFFDATGGLWRTQALAGKAAGFFYSTSSQGGGQETTPLTSITQLVHHGLIFVPIGYTFGGGMFELEKVKGGSPYGAGTYAGDGSRQPSELELAQAFHQGKYFAGIAKKLKGSQ

SEQ ID NO: 7812 - protein, 203 aa, Ricinus communis
MATKVYVVYYSTYGHVEKLAEEIKKGAESVEGVEVKLWQVPETLSEEVLGKMGAPPKSDVPIITPNELAEADGLLFGFPTRFGMMAAQFKAFMDATGGLWRTQALAGKPAGIFYSTGTQGGGQETTPLTAITQLVHHGMVFVPIGYSFGAGMFEMEQVKGGSPYGAGTFAGDGSRQPSELELAQALHQGKYFAGIAKKFKGTA

SEQ ID NO: 7813 - protein, 203 aa, Ricinus communis
MATKVYIVYYSMYGHVEKLAEEIKKGAASVEGVEAKLWQVPETLPEEVLGKMSAPPKSDVPIITPNELAEADGFVFGFPTRFGMMSAQFKAFLDATGGLWRTQQLAGKPAGIFYSTGSQGGGQETTALTAITQLVHHGMLFVPIGYTFGAGMFEMEKVKGGSPYGAGTYAGDGSRQPSELELEQAFHQGKYFAGITKKLKGSA

SEQ ID NO: 7814 - protein, 204 aa, Prunus armeniaca
MATKVYIVYYSMYGHVEKLAEEILKGAASVEGVEAKLWQVAETLQDDVLGKMGAPPKSEVPIISPNDLSEADGLLFGFPTRFGMMAAQFKAFFDSTGGLWRTQALAGKPAGIFYSTGSQGGGQETTALTAITQLVHHGMVFVPIGYSFGAGMFEMEQIKGGSPYGAGTYAGDGTRQPSELELQQAFHQGKYFAGIAKKLKGSTV

SEQ ID NO: 7815 - protein, 203 aa, Vitis vinifera
MVTKVYIVYYSMYGHVEKLAEEIKKGAASVEGVEAKLWQVPETLPEEVLGKMSAPPKSDTPIITPTDLAEADGFVFGFPTRFGMMAAQFKAFLDATGGLWRTQQLAGKPAGIFYSTGSQGGGQETTALTAITQLVHHGMIFVPIGYTFGAGMFEMEKVKGGSPYGAGTFAGDGSRQPSELELEQAFHQGKYIAGITKKLKEAA

SEQ ID NO: 7816 - protein, 203 aa, Gossypium hirsutum
MATKVYIVYYSMYGHVEKLAEEIKKGAASVEGVEAKLWQVPETLSDEILGKMSAPPKSDVPIITPHDLPEADGFIFGFPTRFGMMSAQFKAFMDATGGLWRTQQLAGKPAGIFYSTGSQGGGQETTPLTAITQLVHHGMIFVPIGYSFGAGMFEMEQVKGGSPYGAGTYAGDGTRMPSELEFAQAFHQGKYIAGITKKLKTAA

SEQ ID NO: 7817 - protein, 205 aa, Arabidopsis lyrata subsp. lyrata
MATKVYIVYYSMYGHVEKLAQEIRKGAASVDGVEAKLWQVPETLQEDVLSKMSAPPKSDAPIITPNELAEADGFVFGFPTRFGMMAAQFKAFLDATGGLWRTQQLAGKPAGIFYSTGSQGGGQETTALTAITQLVHHGMIFVPIGYTFGAGMFEMENVKGGSPYGAGTFAGDGSRQPTELELEQAFHQGKYIAAISKKLKGPAAT

SEQ ID NO: 7818 - protein, 322 aa, Glycine max; identical to SEQ ID NO: 7787

SEQ ID NO: 7819 - protein, 391 aa, Glycine max; identical to SEQ ID NO: 7788

SEQ ID NO: 7820 - protein, 455 aa, Vitis vinifera
MKFFLLILPLLQSIWSFHFSIVEAISDPPLSSISAPLSSPPIGATSPISSSMAAFSPAIQEGSEENQKDSHKKTFIALTVASAALGVTILILLSLWIHKKCSQKSHKSNAQSSDAEKALTLGPLLAKFNTMKVIGRKGYVSFIDYKVLETATNNFQESNILGEGGFGCVYKARLDDNSHVAVKKIDGRGQDAEREFENEVDLLTKIQHPNIISLLGYSSHEESKFLVYELMQNGSLETELHGPSHGSSLTWHIRMKIALDAARGLEYLHEHCNPPVIHRDLKSSNILLDSNFNAKLSDFGLAVIDGPQNKNNLKLSGTLGYLAPEYLLDGKLTDKSDVYAFGVVLLELLLGRKPVEKLAPAQCQSIVTWAMPQLTDRSKLPGIVDPVVRDTMDLKHLYQVAAVAVLCVQPEPSYRPLITDVLHSLIPLVPVELGGMLKVTQQAPPINTTAPSAGG

SEQ ID NO: 7821 - protein, 455 aa, Vitis vinifera
MKFFLLILPLLQSIWSFHFSIVEAISDPPLSSISAPLSSPPIGATSPISSSMAAFSPAIQEGSEENQKDSHKKTFIALTVASAALGVTILILLSLWIHKKCSQKSHKSNAQSSDAEKALTLGPLLAKFNTMKVIGRKGSVSCIDYKVLETATNNFQESNILGEGGFGCVYKARLDDNSHVAVKKIDGRGQDAEREFENEVDLLTKIQHPNIISLLGYSSHEESKFLVYELMQNGSLETELHGPSHGSSLTWHIRMKIALDAARGLEYLHEHCNPPVIHRDLKSSNILLDSNFNAKLSDFGLAVIDGPQNKNNLKLSGTLGYLAPEYLLDGKLTDKSDVYAFGVVLLELLLGRKPVEKLAPAQCQSIVTWAMPQLTDRSKLPGIVDPVVRDTMDLKHLYQVAAVAVLCVQPEPSYRPLITDVLHSLIPLVPVELGGMLKVTQQAPPINTTAPSAGG

SEQ ID NO: 7822 - protein, 240 aa, Glycine max
KAAASGSSLNPQGSLTLSRDLSRKTVDEVWKDMQLKKVTNRDKKIQERQATLGEMTLEDFLVKAGVVAEALPTKGGAMSGVDSNGAFSQHGHWLQYQQLSSSTQQPNVMGGYVAGHAIQQPFQVGVNLVLDAAYSEQPASLMGTLSDTQTPGRKRGASGVVVEKTVERRQKRMIKNRESAARSRARRQAYTQELEIKVSRLEEENERLRRLNEMERALPSVPPPEPKPKQQLRRTSSAIF

SEQ ID NO: 7823 - protein, 443 aa, Glycine max
MGKGNMELETNKVYDYEDARGDVEVPDTAHQISTDSWFQVAFILTTGINSAFVLGYPGTVMVPLGWIGGVIGLILATMVSLYANALIAYLHELGGQRHIRYRDLAGFIYGKKAYNLTWVLQYINLFMINTGYIILAGSALKATYVLFRDDGLLKLPYCIAIGGFVCAMFAICIPHLSALGIWLGFSTVFSLAYIVISFVLSLKDGLQSPPRDYEIPGDGVSKIFTIIGASANLVFAFNTGMLPEIQATIRQPVVKNMMKALYFQFTVGVLPLYLVVFTGYWAYGSSTEVYLLNSVNGPVWVKASANITAFLQSVIALHIFASPMYEFLDTKYGIKGSALNAKNLSFRVVVRGGYLAFNTFVAAFLPFLGDFMSLTGAISTFPLTFILANHMYLKAKKDKLNSSQKLWHRFNIGFFAIMPLAATISAIRLISVDSKTYHVFADL

SEQ ID NO: 7824 - protein, 442 aa, Vigna unguiculata
MGRGDIELEPNKVYDHHGAPDVEVPSTAHQISSDSWFQVGFILTTGINSAYVLGYSGTVMVPLGWIGGVVGLVLATIISLYANALIAQLHEHGGQRHIRYRDLAGFVYGKKAYSLTWALQYVNLFMINTGYIILAGSALKATYVLFRDDGLLKLPYCIAIAGLVCAMFAICIPHLSALGIWLGFSTIFSLVYIIIAFLLSLKDGLHSPPRDYNLLGDGFSKVFTIIGASANLVFAFNTGMLPEIQATIRQPVVKNMMRALYFQFTVGVLPLYLVTFTGYWAYGSKTSVYLLNSVNGPVWVKAFANITAFLQSVIALHIFASPMYEFLDTKYGIKGSALNVKNMSFRIVVRGGYLAFNTFVSAFLPFLGDFMSLTGAISTFPLTFILANHMYLKAKKDKLTTSQKLWHWLNIGFFSIMSFVATIAAIRLIAVDSKNYHVFADV

SEQ ID NO: 7825 - protein, 441 aa, Vitis vinifera
MEGPSSESRAPKANGEAHSAVEIPETAHQISKDSWLQVGFVLTTGINSAFVLGYSGTTMVPLGWAGGVIGFLLAAGISLYANSLVAKLHEFGGKRHIRYRDLAGYIYGKKAYTLTWALQYVNLFMINTGYLILAGQALKAVYVLFRDDGGMKLPYFIAIGGFVCAIFAIGIPHLSALGIWLGFSTCLSLIYIVIAFVLSLTDGIKAPSRDYSIPGTEASKVFSIIGAAANLVFAFNTGMLPEIQATIRQPVVKNMMKALYFQFTAGILPLYAVVFMGYWAYGSTTSTYLLNSVSGPVWVKTMANLAAFLQTVIALHIFASPMYEYMDTRYGITGSTLSFRNLSFRILVRGGYLAINTLVSAMLPFLGDFMSLTGAISTFPLTFVLANHMYLVAKDKKLNSLQKLWHWLNVCFFGCMSIAAAVAALRLIAVDSKTYNLFADL

SEQ ID NO: 7826 - protein, 471 aa, Vitis vinifera
MTYQHISEAGTLLAAEEEEEEGEEAVQELMMEGPSSESRAPKANGEAHSAVEIPETAHQISKDSWLQVGFVLTTGINSAFVLGYSGTTMVPLGWAGGVIGFLLAAGISLYANSLVAKLHEFGGKRHIRYRDLAGYIYGKKAYTLTWALQYVNLFMINTGYLILAGQALKAVYVLFRDDGGMKLPYFIAIGGFVCAIFAIGIPHLSALGIWLGFSTCLSLIYIVIAFVLSLTDGIKAPSRDYSIPGTEASKVFSIIGAAANLVFAFNTGMLPEIQATIRQPVVKNMMKALYFQFTAGILPLYAVVFMGYWAYGSTTSTYLLNSVSGPVWVKTMANLAAFLQTVIALHIFASPMYEYMDTRYGITGSTLSFRNLSFRILVRGGYLAINTLVSAMLPFLGDFMSLTGAISTFPLTFVLANHMYLVAKDKKLNSLQKLWHWLNVCFFGCMSIAAAVAALRLIAVDSKTYNLFADL

SEQ ID NO: 7827 - protein, 445 aa, Populus trichocarpa
MEVNGDGAGNSTRPRKVFDEDNSAVEIPETAHQISSDSWFQVGFVLTTGINSAYVLGYSGTIMVPLGWIPGVVGLIIATAISLYANSLIAELHEFGGRRHIRYRDLAGFIYGRKAYSLTWGLQYVNLFMINTGYIILAGSALKAVYVLFSDDHVMKLPYFIAISGFVCALFAMSIPHLSALRLWLGVSTVFSLIYIVVAFVLSVKDGIEAPARDYSIPGTTRSKIFTTIGASANLVFAFNTGMLPEIQATIKQPVVSNMMKSLYFQFSAGVLPMYAVTFIGYWAYGSSTSSYLLSSVNGPVWVKALANISAFLQTVIALHIFASPMYEYLDTKYGIIGSPFSIRNLSFRVGVRGGYLTINTLVAALLPFLGDFMSLTGAISTFPLTFILANHMYLKAKKNKLTSLQKLWHWFNVYFFGLMSIAAAVSALRLIAVDSKTYHVFADL

SEQ ID NO: 7828 - protein, 442 aa, Arabidopsis thaliana
MTATEAKNRKINVGDGDDVVDIEIPDTAHQISSDSWFQVAFVLTTGINSAYVLGYSGTIMVPLGWIGGVVGLLIATAISLYANTLIAKLHEFGGRRHIRYRDLAGFIYGRKAYHLTWGLQYVNLFMINCGFIILAGSALKAVYVLFRDDHTMKLPHFIAIAGLICAIFAIGIPHLSALGVWLGVSTFLSLIYIVVAIVLSVRDGVKTPSRDYEIQGSSLSKLFTITGAAANLVFAFNTGMLPEIQATVRQPVVKNMMKALYFQFTAGVLPMYAVTFIGYWAYGSSTSTYLLNSVNGPLWVKALANVSAILQSVISLHIFASPTYEYMDTKYGIKGNPFAIKNLLFRIMARGGYIAVSTLISALLPFLGDFMSLTGAVSTFPLTFILANHMYYKAKNNKLNAMQKLWHWLNVVFFSLMSVAAAIAAVRLIAVDSKNFHVFADL

SEQ ID NO: 7829 - protein, 442 aa, Arabidopsis lyrata subsp. lyrata
MTATEAKNRKINVGDGDDVVDIEIPDTAHQISSDSWFQVAFVLTTGINSAYVLGYSGTIMVPLGWIGGVVGLILATAISLYANTLIAKLHEFGGRRHIRYRDLAGFIYGRKAYHLTWGLQYVNLFMINCGFIILAGSALKAVYVLFRDDHTMKLPHFIAIAGLICAIFAIGIPHLSALGVWLAVSTFLSLIYIVVAIVLSVRDGVKTPSRDYEIQGSSLSKLFTITGAAANLVFAFNTGMLPEIQATVRQPVVKNMMKALYFQFTAGVLPMYAVTFIGYWAYGSSTSTYLLNSVNGPLWVKALANISAILQSVISLHIFASPTYEYMDTKFGIKGNPFAIKNLLFRIMARGGYIAVSTLISALLPFLGDFMSLTGAVSTFPLTFILANHMYYKAKNNKLNAMQKLWHWLNVVFFSLMSVAAAIAAVRLIAVDSKNFHVFADL

SEQ ID NO: 7830 - protein, 442 aa, Arabidopsis thaliana
MTATEAKNRKINVGDGDDVVDIEIPDTAHQISSDSWFQVAFVLTTGINSAYVLGYSGTIMVPLGWIGGVVGLLIATAISLYTNTLIAKLHEFGGRRHIRYRDLAGFIYGRKAYHLTWGLQYVNLFMINCGFIILAGSALKAVYVLFRDDHTMKLPHFIAIAGLICAIFAIGIPHLSALGVWLGVSTFLSLIYIVVAIVLSVRDGVKTPSRDYEIQGSSLSKLFTITGAAANLVFAFNTGMLPEIQATVRQPVVKNMMKALYFQFTAGVLPMYAVTFIGYWAYGSSTSTYLLNSVNGPLWVKALANVSAILQSVISLHIFASPTYEYMDTKYGIKGNPFAIKNLLFRIMARGGYIAVSTLISALLPFLGDFMSLTGAVSTFPLTFILANHMYYKAKNNKLNAMQKLWHWLNVVFFSLMSVAAAIAAVRLIAVDSKNFHVFADL

SEQ ID NO: 7831 - protein, 439 aa, Arabidopsis thaliana
MDTSEARNRKVVAVEQFDLEVPETAHQISSDSWFQVAFVLTTGINSAYVLGYSGTVMVPLGWIGGVVGLILATAISLYANTLIAKLHEFGGKRHIRYRDLAGFIYGKKMYRVTWGLQYVNLFMINCGFIILAGSALKAVYVLFRDDSLMKLPHFIAIAGVVCAIFAIGIPHLSALGIWLGVSTILSIIYIIVAIVLSAKDGVNKPERDYNIQGSSINKLFTITGAAANLVFAFNTGMLPEIQATVKQPVVKNMMKALYFQFTVGVLPMYAVTFIGYWAYGSSTSTYLLNSVSGPVWVKALANISAFLQSVISLHIFASPTYEYMDTKYGVKGSPLAMKNLLFRTVARGSYIAVSTLLSALLPFLGDFMSLTGAISTFPLTFILANHMYLVAMNDELSLVQKLWHWLNVCFFGLMSLAAAIAAVRLISVDSKNFHVFADV

SEQ ID NO: 7832 - protein, 439 aa, Arabidopsis lyrata subsp. lyrata
MDTSEARNRKVVAVEKFELEVPETAHQISSDSWFQIAFVLTTGINSAYVLGYSGTVMVPLGWIGGVVGLILATAISLYANTLIAKLHEFGGKRHIRYRDLAGFIYGKKMYRVTWGLQYVNLFMINCGFIILAGSALKAVYVLFRDDSLMKLPHFIAIAGVVCAIFAIGIPHLSALGIWLGVSTILSIIYIVVAIVLSAKDGVNKPERDYNIQGSSINKLFTITGAAANLVFAFNTGMLPEIQATVKQPVVRNMMKALYFQFTVGVLPMYAVTFIGYWAYGSSTSTYLLNSVSGPLWVKALANISAFLQSVISLHIFASPTYEYMDTKYGVKGSPLALKNLLFRTVARGSYIAVSTLLSALLPFLGDFMSLTGAISTFPLTFILANHMYLVAMNDKLSLVQKLWHWLNVCVFGLMSLAAAIAAVRLISVDSKNFHVFADV

SEQ ID NO: 7833 - protein, 174 aa, Glycine max
MAFSQVITTLLFALAIARISPSACQTVEGKVSCTDCADNYDFSGIKVSVKCEGVKNLAMATTEDKGFSQVDLPSDQTKPPSVNCFTKLLGGPNTNLYASKKNLVSQIVKGKEKNTYTISTPLSFFTSCPQNTECKAANYNQFGSSKTFDLPLPREWGLAPSSFYVPFFPIIGIP

SEQ ID NO: 7834 - protein, 443 aa, Glycine max; identical to SEQ ID NO: 7823

SEQ ID NO: 7835 - protein, 302 aa, Glycine max
MPLLTSSLFNMVPLFSLLLFSLMIRYSTSQDPPSPGYYPSSKISPVSFGEGFRNLWGPQHQKLDQDSLTIWLDSYSGSGFKSLHSYRSGYFGAAIKLQPGYTAGVITSLYLSNNQDYPGHHDEIDIEFLGTTPDKPYVLQTNVYVRGSGDGNIIGREMRIHLWFDPTQDFHNYAILWEPSEIIFLVDDVPIRSYPRKSDATFPSREMYVYGSIWDASSWATEGGKYKADYNYQPFFGRYKNFKIQGCTTEASTSCQPPSPSPPGYGSLSPQQLSAMQWVQNNYLVYDYCHDPGRDHTLTPEC

SEQ ID NO: 7836 - protein, 302 aa, Glycine max
MPSSLSSFLRMAPILSLLVLSCVICSSSAQGPPSPGYYPSSKISPVSFYQGFRNLWGSQHQRLDQGSLTIWLDSNSGSGFKSLHSYRSGYFGAAIKLQPGYTAGVITSLYLSNNQDHPGNHDEIDIEFLGTTPDKPYVLQTNVYIRGSGDGNIIGREMKFHLWFDPTQDFHNYGILWKPNEIIFFVDDVPIRRYPRKSDATYPSRPMYVYGSIWDASSWATEDGKYKANYNYQPFVGRYKNFKLQGCTSESSASCKPPSFSPSGFGSLSPQQFRAMQWVQNNYMVYNYCHDPRRDHTFIPEC

SEQ ID NO: 7837 - protein, 301 aa, Vigna angularis
MSSSLSSFLPMLPVLFLLVLSCMIYSGSAQGPPSPGYYPSSKISPISFNQGFKNLWGPQHQRIDQGSLTIWLDTSTGSGFKSLHSYKSGYFGAAIKLQPGYTAGVITSLYLSNNQDHPGNHDEIDIEFLGTTPDKPYVLQTNVYIRGSGDGNIIGREMRFHLWFDPTQDFHNYAVLWKPSELIFFVDDVPIRRYPRKSEATYPTRPMYVYGSIWDASSWATEGGKYKADYRYQPFVGRYKNFRLQGCTSESSASCHPPSTSSGFGSLSPQQFRAMQWVQTNYMVYNYCHDPRRDHNLIPEC

SEQ ID NO: 7838 - protein, 294 aa, Litchi chinensis
MAAIVVYLLLILMISSNTGAQGGPPSPGYNPSSRVSSLGFNQGFKNLWGPQHQRLDQDTLTIWLDQSSGSGFKSLQSYRSGYFGAAMKLQPGYTAGVITSLYLSNNQDHPGNHDEIDFEFLGNTTGKPYTLQTNVYIRGSGDGNIIGRELRFHLWFDPTQDFHNYAILWTPSEIIFLADDVPIRRYPRKSDATFPLRPMYLYGSIWDASSWATEDGKYKADYQYQPFVGRYKNFKLGGCTADAPASCTPPSASPSGSGGLSQQQIAAMQWVQRNYLVYNYCSDPKRDHTLVPEC

SEQ ID NO: 7839 - protein, 297 aa, Carica papaya
MAKLSCVLMAPLLFSFLLILMVSSQGPPSPGYYPTSRFPSLGFDQGFRNRWGPQHQRVEQGVLTIWLDSTSGSGFKSLHTYQSGYFGAAIKLQPGYTAGVITSFYLSNNEDYPGNHDEIDIEFLGTTPGEPYTLQTNVFIRGSGDRNIVGREVKFHLWFDPTQDFHNYAILWTPSEIVFFVDDVPIRRYPRKSDATFPLRTMWVYGSIWDASSWATDDGKYKADYQYQPFVGRYKNFKIAACRADGQASCRPPSVSPSGFGVLSPQQESAMEWAQRNSLVYNYCLDPKRDHTPTPEC

SEQ ID NO: 7840 - protein, 293 aa, Ricinus communis
MASLLHFLPLILLMTSSSSIAQTPPSPGYYPGSRISSIGFDQGYRNLWGPQHQRLDQGTLTIWLDSSSGSGYKSLQPYRSGYFGASIKLQPGYTAGVITSFYLSNNEDYPGNHDEIDIEFLGTTPGKPYTLQTNVYIKGSGDGKIIGREMKFHLWFDPTQDFHQYAIMWTPNEIIFFVDDVPIRRYPRKSDSTFPLRPMWIYGSIWDASSWATEDGKYKADYSYQPFIGRYQNFKISGCTTNGSPTCRPPSTSPFGSGLSQQQYSTMEWVQRNYLAYDYCRDPKRDHTQTPEC

SEQ ID NO: 7841 - protein, 295 aa, Tropaeolum majus
MPPNILSIFLHLLPILMFSSSCLGQGPPSPGYYPSSQITSLGFDQGYTNLWGPQHQRVDQGSLTIWLDSTSGSGFKSINRYRSGYFGANIKLQSGYTAGVITSFYLSNNQDYPGKHDEIDIEFLGTIPGKPYTLQTNVFIEGSGDYNIIGREMRIHLWFDPTQDYHNYAIYWTPSEIIFFVDDVPIRRYPRKSDATFPLRPLWVYGSVWDASSWATENGKYKADYRYQPFVGKYEDFKLGSCTVEAASSCNPASVSPYGQLSQQQVAAMEWVQKNYMVYNYCDDPTRDHTLTPEC

SEQ ID NO: 7842 - protein, 291 aa, Vitis vinifera
MAPLLCLLILMITTCSDAQGPPSPGFSPSSKFSPISFNQGFRNLWGSQHQTIDQGLLTIWLDSTSGSGFKSLKPYRSGYFSAAIKLQPGYTAGVITSFYLSNNEDYPGNHDEIDIEFLGTTLDKPYTLQTNVYMKGSGDGRLIGREVKIHLWFDPTEDFHNYAILWTPDEIIFLVDDVPVRRYPRKNDATFPARPMWVYGSIWDASSWATEDGKYKADYRYQPFIGRYKNFKLGGCTTDAAASCRPPSISPSSAGGLSQQQYSAMESVQKNYVVYDYCQDPKRDHSQIPEC

SEQ ID NO: 7843 - protein, 442 aa, Vigna unguiculata; identical to SEQ ID NO: 7824

SEQ ID NO: 7844 - protein, 227 aa, Glycine max
MVREKIQIKKIDNATARQVTFSKRRRGLFKKAEELSVMCDADVALIIFSSTGKLFEYSSSSMKEILERHHLHSKNLARMEQPSLELQLVENSNCSRLSKEVAEKSHQLRQLRGEDLQGLNIEELQQLERSLETGLGRVIEKKGEKIMSEITDLQRKGMLLMEENERLKRHVAGIINGQRHGGAESENFVMDEGQSSESVTYVCNSTGPPQDFESSDTSLKLGLPYSG

SEQ ID NO: 7845 - protein, 227 aa, Populus trichocarpa
MARERIQIKKIDNATARQVTFSKRRRGLFKKAEELSVLCDADVALIIFSSTGKLFEFSSSSMKEILERHNLHSKNLEKLEQPSLELQLVEDSTCSRLSKEVAEKSHQLRQMRGEDLRGLDIDELLQLEKSLEAGLSCVIEKKGEKIMNEITDLQRKGMQLMEENERLKQQVVEISNGRKHVTADSENVGYEEGQSSESVTNVCNSNGPLHDYESSDTSLKLGLPFSN

SEQ ID NO: 7846 - protein, 227 aa, Vitis vinifera
MAREKIQIKKIDNATARQVTFSKRRRGLFKKAEELSVLCDADVALIIFSSTGKLFEFSSSSMKEILEKHSLQSKNLEKLEQPSLELQLVENNNHSRLSKEVADKSHKLRQMRGEELQGLNIEDLQQLEKSLEAGLSRVIQKKGERIMKEITDLQSKGVQLMEENERLRQQVVEISNRRRQVAGDSENMFHEEGQSSESVTNVSNSNGPPQDYESSDTSLKLGLPYSG

SEQ ID NO: 7847 - protein, 215 aa, Pisum sativum
MAREKIQIKKIENATARQVTFSKRRRGLFKKAEELSVLCDADVALIIFSSTGKLFEYSNLSMREILERHHLHSKNLAKMEEPSLELQLVENSNCTRLNKEIAEKSHQLRQMRGEDLQGMNVEQLQHLERSLEIGLGRVIENKGEKTMMEIQHLQRKGRQLMEENDRLKRHVTGMMNNGKIVGGVECENVVIEEGQSSESITNVYNSTGPPQDYES

SEQ ID NO: 7848 - protein, 233 aa, Petunia x hybrida
MAREKIQIKKIDNATARQVTFSKRRRGLFKKAEELSVLCDADVALIIFSSTGKLFEYSSSSMKEILERRDLHSKNLEKLDQPSLELQLVENSNYSRLSREISEKSHRLRQMRGEELQGLSIEELQQLERTLEAGLGRVIERKGDKIMREINQLQQKGLELMEENEKLRQQVMEISNNGYKNPAAAVVAVELENAANEEGQSSESVTNACNSTGPPQDDDSSDTSLKLGLPYSG

SEQ ID NO: 7849 - protein, 229 aa, Antirrhinum majus
MAREKIQIKKIDNTTARQVTFSKRRRGLFKKAEELAVLCDADVALIIFSSTGKLFEYASSSMKEILERHNLHSKNLGKMEQPSLELQLVEDSNCTRLSNEVAERSQQLRRMRGEELQGLNMEELQRLERSLEVGLSRVLDKKGEKIMNEINQLQEKGMQLMQENQRLKQQVVDISNYQQITATPDSEIIHVYEEGQSSESVTYTCNSTGLPQDYDCSDTYLKLGLPYSG

SEQ ID NO: 7850 - protein, 229 aa, Misopates orontium
MAREKIQIKKIDNTTARQVTFSKRRRGLFKKAEELAVLCDADVALIIFSSTGKLFEYASSSMKEILERHNLHSKNLGKMEQPSLELQLVEDSNCARLSREVAERSQQLRRMRGEELQGLNIEELQRLERSLEVGLSRVLDKKGEKIMNEINQLQEKGQQLMQENQRLKQQVVDISNCQQITATPDSEIIHLYEEGQSSESVTYTCNSTGLPQDYDCSDTYLKLGLPYSG

SEQ ID NO: 7851 - protein, 224 aa, Malus x domestica
MAREKIQIKKIDNATARQVTFSKRRRGLLKKAEELSVLCDADIALIIFSSTGKLFEYASSSMKEILERHNLHSKNLEKLEQPSLQLQLVENSNYTRLSKEIAAKSHQLRQMRGEEIQGLNLEELQQLEKSLETGLGRVIEKKSEKIMKEIGDLQRNGMQLMEENERLRQQVAEKSDGRRLVQVDSENMFTEEGQSSESVTNPCNSNNGPQDYDSSDTSLKLGCV

SEQ ID NO: 7852 - protein, 227 aa, Paulownia kawakamii
MAREKIQIKKIDNATARQVTFSKRRRGIFKKAEELSVLCDADVGLIIFSSTGKLFEYASSSMKEILGRHNLHSKNLDKLEQPSLELQLVEDSNYSRLSKEVAERSHQLRRMRGEELQGLSIEKLQHLKKSLESGLSRVIEKKGEKIMKGDQSTSRKGKQLMEENERLRQQVADISNDCKNNAASDSENIVYDEGQSSESVNACNSVGPPQDYDSSDTSLKLGLPYSG

SEQ ID NO: 7853 - protein, 227 aa, Eucalyptus occidentalis
MAREKIQIKKITNATARQVTFSKRRRGLFKKAEELSVLCDADVALIVFSSSGKLFEYCSSSMKEILERHHSHSENLGKLDQPSLKLQLVENGDYSRLSKEVAEKGHQLRQMRGEELQGLNIDELQQLEKSLEAGLNRVIEKKGEKIMKEITDLQQKGAKLMEENKRLKQQVTEISGRKTTATDSETIINEEGLSSESITNVCSSSSGPPQEDDSSDISLKLGLPYNG

SEQ ID NO: 7854 - protein, 405 aa, Arachis hypogaea
MASATLSVAKPALQGNGGKGFSEFSGLRNSSSSYLPFSRKTSDDFHSIISFQTSAVGSSGGYRKGVTEAKLKVAINGFGRIGRNFLRCWHGRKDSPLDVIAINDTGGVKQASHLLKYDSTLGIFDADVKPVGEDAISVDGKVIKVVSNRNPANLPWKELGVDLVIEGTGVFVDREGAGKHIQAGAKKVLITAPGKGDIPTYVVGVNADAYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAAFRESAEKELNGILSVCDEPLVSVDFRCTDVSSTVDSSLTMVMGDDMVKVIAWYDNEWGYSQRVVDLADIVANSWK

SEQ ID NO: 7855 - protein, 404 aa, Ricinus communis
MASATFSVAKPSLQGNGKGFQEFSGLRNSSAFLPFSKKTSDDFLSVVAFQTSAVGSSNGGYRKTVAEAKLKVAINGFGRIGRNFLRCWHGRKDSPLDVIAINDTGGVKQASHLLKYDSTLGIFDADVKPVGTDGISVDGKVIQVVSDRNPANLPWKDLGIDLVIEGTGVFVDREGAGKHIQAGAKKVLITAPGKGDIPTYVVGVNADGYSADEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVEKKTFAEEVNAAFRESADKELKGILSVCDEPLVSVDFRCTDVSSTVDSSLTMVMGDDMVKVIAWYDNEWGYSQRVVDLADIVANNWK

SEQ ID NO: 7856 - protein, 403 aa, Glycine max
MASATLSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSNVISVDGKEIKVVSDRNPANLPWKDLGIDLVIEGTGVFVDREGAGKHIQAGAKKVLITAPGKGDIPTYVVGVNEYDYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAAFRESADNELKGILSVCDEPLVSVDFRCTDVSSTVDSSLTMVMGDDMVKVIAWYDNEWGYSQRAVDLADIVANKWK

SEQ ID NO: 7857 - protein, 403 aa, Glycine max
MASATFSVAKPALQANGKGFSEFSGLRSSSGFLPFSRKSSEDFHSVIAFQTYAVGSSGGYKKGVTEAKLKVAINGFGRIGRNFLRCWHGRKDSPLDVIAINDTGGVKQASHLLKYDSILGTFDADVKPVGSNVISVDGKEIKVVSDRNPANLPWKDLGIDLVIEGTGVFVDREGAGKHIQAGAKKVLITAPGKGDIPTYVVGVNEYDYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNAAFRESADNELKGILSVCDEPLVSVDFRCTDVSSTVDSSLTMVMGDDMVKVIAWYDNEWGYSQRVVDLADIVANKWK

SEQ ID NO: 7858 - protein, 405 aa, Pisum sativum
MASATFSVAKPAIKANGKGFSEFSGLRNSSRHLPFSRKSSDDFHSLVTFQTNAVGSSGGHKKSLVVEAKQLKVAINGFGRIGRNFLRCWHGRKDSPLDVIAINDTGGVKQASHLLKYDSTLGIFDADVKPVGTDGISVDGKVIKVVSDRNPANLPWKELGIDLVIEGTGVFVDREGAGRHITAGAKKVLITAPGKGDIPTYVVGVNADAYTHADDIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEAFRESAAKELTGILSVCDEPLVSVDFRCTDVSSTVDSSLTMVMGDDLVKVIAWYDNEWGYSQRVVDLADIVANNWK

SEQ ID NO: 7859 - protein, 405 aa, Pisum sativum
MASATFSVAKPAIKANGKGFSEFSGLRNSSRHLPFSRKSSDDFHSLVTFQTNAVGSSGGHKKSLVVEAKQLKVAINGFGRIGRNFLRCWHGRKDSPLDVIAINDTGGVKQASHLLKYDSTLGIFDADVKPVGTDGISVDGKVIKVVSDRNPANLPWKELGIDLVIEGTGVFVDREGAGRHITAGAKKVLITAPRKGDIPTYVVGVNADAYTHADDIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEAFRESAAKELTGILSVCDEPLVSVDFRCTDVSSTVDSSLTMVMGDDLVKVIAWYDNEWGYSQRVVDLADIVANNWK

SEQ ID NO: 7860 - protein, 404 aa, Medicago sativa
MASATFSVANPALKVNGKGFSEFSGLRNSSGYLPFSRKTSDDFHSVISVQTNAVGSSGRSRKGVVVEAKIKVAINGFGRTGRNFLRCWHGRKDSPLDVIAINDTGGVKQASHLLKYDSTLGIFDADVKPVGTDGISVDGKVIKVVSDRNPANLPWGELGIDLVIEGTGVFVDREGAGKHITAGAKKVLITAPGKGDIPTYVVGVNADGYNHADDIISNASCTTNCLAPFVKVLDQKFGIIKGTMTTTHSYTGDQRLLDASHRDLRRARAAALNIVPTSTGAAKAVALVLPSLKGKLNGIALRVPTPNVSVVDLVVQVSKKTFAEEVNEAFRDSAAKELSGILSVCDEPLVSVDFRCTDVSSTVDSSLTMVMGDDMVKVIAWYDNEWGYSQRVVDLADIVANNWK

SEQ ID NO: 7861 - protein, 400 aa, Thellungiella halophila
MASATFSVPKPSLQGFTEFSGLRSSSASLPFGKKLSSDEFVSVVTFQTSAMGSSGGYRKGVTEAKLKVAISGFGRIGRNFLRCWHGRKDSPLDVIAINDTGGVKQASHLLKYDSTLGIFDADVKPSGDAALSVDGKIIQVVSNRNPSNLPWKELGIDIVIEGTGVFVDREGAGKHIEAGAKKVIITAPGKGDIPTYVVGVNADAYNPDEPIISNASCTTNCLAPFVKVLDQKFGIIKGTMTTTPSYTGDQRLLDASHRDLRRARAAALNIVPTSTGAAKAVALVLPNLKGKLNGIALRVPTPNVSVVDLVVQVSKKTFAEEVNAAFRDAAEKELKGILEVCDEPLVSVDFRCSDVSSTIDSSLTMVMGDDMVKVIAWYDNEWGYSQRVVDLADIVANNWK

SEQ ID NO: 7862 - protein, 405 aa, Bruguiera gymnorhiza
MASATLSVAKPSHLQANGKGFTEFSGLRNSSAFLPFAKKTSDDFLSVVAFQTSALASSSGGYRRAAAEAKLKVAINGFGRIGRNFLRCWHGRKDSPLDVIAINDTGGVKQASHLLKYDSTLGIFEADVKPAGDSAISVDGKIIKVASNRNPVNLPWKEMEIDLVIEGTGVFVDREGAGKHIHAGAKNVLITAPGKGDIPTYVVGVNADAYNPDEPIISNASCTTNCLAPFVKVLDQKSGIIKGTMTTTHSYTGDQRLLDASHRDLRRARAAALNIVPTSTGAAKPVALVLPTLRGKLNGIALRVPTPNVSVVDLVVQVSKKTFAEEVNAAFRESADKELKGILSVCDEPLVSVDFRCRDVSSTVDSSLTMVMGDDMVKVIAWYDNEWGYFQRVVDLADVVAEKWK

SEQ ID NO: 7863 - protein, 401 aa, Mangifera indica
MASATFSVAKPSLQANGKGFTDFSGLRNSASLPFSRKTSEDFLSVIAFQTSAVGNSGYRKGAAEAKLKVAINGFGRIGRNFLRCWHGRKDSPLDVIAINDTGGVKQASHLLKYDSTLGIFDANVKPVGDNAISVDGKVIKVVTNRNPLDLPWGDLGVDLVIEGTGVFVDRDGAGKHIQAGAKKVLITAPGKGDIPTYVVGVNADAYNPDEPIISNASCTTNCLAPFVKVLDQKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFRESADKELKGILSVCDEPLVSVDFRCSDVSSTVDSSLTLVMGDDMVKVIAWYDNEWGYSQRVVDLADIVANKWK

SEQ ID NO: 7864 - protein, 405 aa, Arachis hypogaea; identical to SEQ ID NO: 7854

SEQ ID NO: 7865 - protein, 528 aa, Glycine max
MDASTALMILSAIAAYLIWFTFVTRSLKGPRVWPLFGSLPGLIQHANRMHDWIADNLRACGGTYQTCICALPFLARKQCLVTVTCDPKNLEHILKLRFDNYPKGPTWQSAFHDLLGEGIFNSDGDTWLFQRKTAALEFTTRTLRQAMARWVNRAIKHRFCPILATAQKENKSVDLQDLLLRLTFDNICGLAFGQDPQTLAVGLPDNAFALSFDRATEATLQRFILPEILWKLKRWLRLGMEVSLSRSLKHIDNYLSHIIKNRKLELLNGTGSHHDDLLSRFMRKKESYSEEFLQHVALNFILAGRDTSSVALSWFFWLCIKNPHVEEKILHELCSVLKFTRGDDISTWLEEPLVFEEVDRLVYLKAALSETLRLYPSVPEDSKHVVKDDVLPNGTFVPAGSAVTYSIYSVGRMKFIWGEDCLEFKPERWLSPEGDKIQVQDSYKFVSFNAGPRLCLGKDLAYLQMKSIAAAVLLRHRLAVAPGHRVEQKMSLTLFMKYGLRVNVYPRDLKPVLEKLTTTEGAITVGQK

SEQ ID NO: 7866 - protein, 545 aa, Vitis vinifera
MDASTVLLLLAIITAYLIWFRSITRSLKGPRVWPVVGSLPLLIQNANRMHEWIAENLRSCGGTYQTCICPIPFLARKQGLVTVTCDPKNLEHILKIRFDNYPKGPTWQAVFHDLLGEGIFNSDGETWRFQRKTAALEFTTRTLRQAMARWVTRAIKLRFCPILKKAQLEGKPVDLQDLLLRLTFDNICGLAFGKDPQTLAPGLPENSFATAFDRATEATLQRFILPEFIWKLKKWLRLGMEASLTHSLGHVDKYLSDVISTRKLELVSQQQGGSPHDDLLSRFMKKKEAYSDNFLQHVALNFILAGRDTSSVALSWFFWLVIQNPRVEEKILTEICTVLMETRGSDTSKWVEDPLVFEEVDRLIYLKAALSETLRLYPSVPEDSKHVVVDDVLPDGTFVPAGSAITYSIYSTGRMKFIWGEDCLEFRPERWLSADGKKIELQDSFKFVAFNAGPRICLGKDLAYLQMKSIAAAVLLRHRLTVAPGHRVEQKMSLTLFMKYGLKVNVQPRDLTPILANIPKAKPNTKVNGNVHNVYEVENLTGVAY

SEQ ID NO: 7867 - protein, 580 aa, Vitis vinifera
MDASTVLLLLAIITAYLIWFRSITRSLKGPRVWPVVGSLPLLIQNANRMHEWIAENLRSCGGTYQTCICPIPFLARKQGLVTVTCDPKNLEHILKIRFDNYPKGPTWQAVFHDLLGEGIFNSDGETWRFQRKTAALEFTTRTLRQAMARWVTRAIKLRFCPILKKAQLEGKPVDLQDLLLRLTFDNICGLAFGKDPQTLAPGLPENSFATAFDRATEATLQRFILPEFIWKLKKWLRLGMEASLTHSLGHVDKYLSDVISTRKLELVSQQQGGSPHDDLLSRFMKKKEAYSDNFLQHVALNFILAGRDTSSVALSWFFWLVIQNPRVEEKILTEICTVLMETRGSDTSKWVEDPLVFEEVDRLIYLKAALSETLRLYPSVPEDSKHVVVDDVLPDGTFVPAGSAITYSIYSTGRMKFIWGEDCLEFRPERWLSADGKKIELQDSFKFVAFNAGPRICLGKDLAYLQMKSIAAAVLLRHRLTVAPGHRVEQKMSLTLFMKYGLKVNVQPRDLTPILANIPKAKPNTKSHENLIFLEEVLSCGNILYSTLALSSRNQETIDFAWWIGMSDLSIYLVNYLGLM

SEQ ID NO: 7868 - protein, 545 aa, Ricinus communis
MLPMDVSMAPMILLAIVAYFLWWKFISRPLTGPRLWPLVGSLPGLIENANRMHDWIAHNLQSSGGTYQTCICAIPFLAQKQGLVTVTCDPKNLEHILKARFDNYPKGPTWQSVFHDLLGEGIFNSDGDTWLFQRKTAALEFTTRTLRQAMARWVNQAIKHRFCPILRCAQLQAQPVDLQDLLLRLTFDNICGLTFGKDPQTLSPDLPENGFAVSFDRATEATLQRFILPEVVWKLKKWFRLGMEVRLSQSLEHIDAYLSGIINTRKLELLNQKNGVGTGKPHDDLLSRFIKKKESYSDKFLQHVALNFILAGRDTSSVALSWFFWLVSQNPKVEEKILIEICIVLMETRGNDICKWLEEPLVFEEVDRLIYLKAALSETLRLYPSVPQDSKHVVSDDVLPNGTHVPAGSSITYSIYSVGRMKFIWGDDCLEFKPERWLSLDGKKMEVQDSYKFIAFNAGPRICLGKDLAYLQMKSISAAVLLRHRLSVAAGHRVEQKMSLTLFMKYGLKVNVHPRDLKPLVEVINKKGNIINGNREGIEWVAAGA

SEQ ID NO: 7869 - protein, 536 aa, Populus trichocarpa
MDISTASMILTAVVTYLIWLSFISRSMKGPRVWPLFGSLPGLIWHSSRMHDWIADNLRKCGGTYQTCVVAIPLLARRQSLVTVTCDPKNLEHILKARFDNYPKGPNWQSVFHDLLGDGIFNSDGETWLFQRKTAALEFTTRTLRQAMARWVSRAIKHRFCPILESAQQQAKPVDLQDMLLRLTFDNICGLAFGKDPQTLSLEFPENGFAVSFDTATEATLQRFILPEIVWKLRKSLRLGMEMSLSQSIDHIDAYLSDIINTRKLELVNQQKGGNENPHDDLLSRFMKKKESYSDKFLQHVALNFILAGRDTSSTALSWFFWLVSQNPKVEEKILIEICTVLMETRGNDTRKWLEEPLVFEEVDRLTYLKAALSETLRLYPSVPQDSKHVVADDVLPSGAFVPAGSSITYSIYAVGRMEFIWGDDCLEFKPERWLSLDGKKIEVPDSYRFLAFNAGPRICLGKDLAYLQMKSIAAALLLRHRISVVPGHRVEQKMSLTLFMKYGLMVNVHPRDLRPIVEKVCKNALTNSNHACGIES

SEQ ID NO: 7870 - protein, 553 aa, Petunia x hybrida
MEVSTTMMIVAIVAAYLLWFKSITKSMKGPKGPTMWPVVGSLPGLIENGNRMHEWIADNLRACSGTYQTCICAIPFLARKQLVTVTCDPKNLEHILKVRFDNYPKGPTWQAVFHDLLGEGIFNSDGDTWLFQRKTAALEFTTRTLRQAMGRWVNRAIKNRFCPILEMAQVQGKPVDLQDLLLRLTFDNICGLAFGKDPETLSPELPENNFATSFDRATEATLHRFIMPEFVWKLKKMLGLGLEVSLNNSLKQVDNYMTDVINTRKLELLNHQNGGPQHDDLLSRFMKKKESYSDKFLQHVALNFILAGRDTSSVALSWFFWLVSSNPRVEEKILVEICTILAETRGNDTSKWLEEPLVFEEVDQLMYLKAALSETLRLYPSVPEDSKHVISDDYLPDGTFVPAGSNITYSIYSTGRMKFIWGEDCLEFKPERWMSQDGDKFQVQDTFRFVAFNAGPRICLGKDLAYLQMKSIAAAVLLRHRLAVAPGHKVEQKMSLTLFMKDGLVMNVTPRDLTPILAKIEKFGKVESCAGEHHLINNGIHQPGSIAVNGIAA

SEQ ID NO: 7871 - protein, 565 aa, Populus trichocarpa
MDMSTALLLFAAVTTYLLWLTFISRSLKGPRVYPLLGSLPGLIENCDRLHDWIYDNLRACGGTYQTCICAIPFLAKKQGLVTVTCDPRNIEHLLKTRFDNYPKGPTWQAVFHDLLGEGIFNSDGDTWLFQRKTAALEFTTRTLRQAMARWVSRAIKLRFCPVLETAQLKGEQVDLQDLLLRLTFDNICGLAFGKDPQTCAPGLPENSFASAFDRATEASLQRFILPEVLWKLKKWLRLGLEVSLNRSLTQLDDYLTNVIDARKKELLNQQKDRNIPHDDLLSRFMKKKESYSDTFLQHVALNFILAGRDTSSVALSWFFWLLTQNPSVEEKILHEICTVLIKTRGDDVTKWVDEPLGFEEVDSLIYLKAALSETLRLYPSVPQDSKHVVADDVLPDGTFVPAGSSVTYSIYASGRMKTTWGEDCLEFKPERWLSSDGEKFIMHDSYKFVAFNAGPRICLGKDLAYLQMKSVAAAVLLRHRLSVVQGHKVEQKMSLTLFMKHGLKVNVHKRDLEGTAARIIKKGKEGESRQLLHGNNEAIAVRYNGGGCNGASESAAGKGAVVGVV

SEQ ID NO: 7872 - protein, 558 aa, Vitis vinifera
MDVFWASLFFMAITAYLLWFTFISRSLRGPRVWPLLGSLPGLIENSERMHEWIAENLRACGGTYQTCICAVPFLARKQGLVTVTCDPKNLEHILKTRFDNYPKGPTWQGVFHDLLGEGIFNSDGDTWLFQRKTAALEFTTRTLRQAMARWVSRAIKHRFCPILRAAQLEAKPVDLQDLLLRITFDNICGLTFGMDPQTLAPGLPENSFASAFDRATEASLQRFILPEVMWKLKKWLGLGMEVSLSRSIVHVENYLSKVINTRKVELLSQQKDGNPHDDLLSRFMKKKESYSDSFLQHVALNFILAGRDTSSVALSWFFWLVTQNPTVEKKILHEICTVLMGTRGSDTSKWVDEPLEFEELDRLIYLKAALSETLRLYPSVPEDSKHVVADDILPDGTFVPAGSSITYSVYSSGRMKSTWGEDWPEFRPERWLSADCQRFILHDQYKFVAFNAGPRICLGKDLAYLQMKSIAASVLLRHRLTVVAGHRVEQKMSLTLFMKYGLKVNVHERDLTAVVDGVRNEKASEVCGEEAVRVKCNGNCHASGSVVVGGSDVRLGVT

SEQ ID NO: 7873 - protein, 547 aa, Vitis vinifera
  misc_feature (99)..(99): Xaa can be any naturally occurring amino acid
  misc_feature (209)..(209): Xaa can be any naturally occurring amino acid
  misc_feature (512)..(512): Xaa can be any naturally occurring amino acid
  misc_feature (523)..(523): Xaa can be any naturally occurring amino acid
MAITAYLLWFTFISRSLRGPRVWPLLGSLPGLIENSERMHEWIAENLRACGGTYQTCICAVPFLARKQGLVTVTCDPKNLEHILKTRFDNYPKGPTWQXVFHDLLGEGIFNSDGDTWLFQRKTAALEFTTRTLRQAMARWVSRAIKHRFCPILRAAQLEAKPVDLQDLLLRITFDNICGLTFGMDPQTLAPGLPENSFASAFDRATEAXLQRFILPEVMWKLKKWLGLGMEVSLSRSIVHVENYLSKVINTRKVELLSQQKDGNPHDDLLSRFMKKKESYSDSFLQHVALNFILAGRDTSSVALSWFFWLVTQNPTVEKKILHEICTVLMGTRGSDTSKWVDEPLEFEELDRLIYLKAALSETLRLYPSVPEDSKHVVADDILPDGTFVPAGSSITYSVYSSGRMKSTWGEDWPEFRPERWLSADCQRFILHDQYKFVAFNAGPRICLGKDLAYLQMKSIAASVLLRHRLTVVAGHRVEQKMSLTLFMKYGLKVNVHERDLTAVVDGVRNEXASEVCGEEAVXVKCNVAAQQFLKAQLRLILIEHEG

SEQ ID NO: 7874 - protein, 524 aa, Arabidopsis lyrata subsp. lyrata
MEISTALMILSAITAYFLWLTFISRCLKGPRVWPILGSLPGLIENCERMHDWISDNLRACSGTYQTCICAIPFLAKKQGLVTVTCDPRNLEHILKNRFDNYPKGPTWQAVFHDLLGQGIFNSDGDTWLFQRKTAALEFTTRTLRQAMARWVNRAIKLRFLPILETARLGSEPIDLQDLLLRLTFDNICGLTFGKDPRTCAPGLPVNTFAVAFDRATEASLQRFILPEILWKFKRWLRLGLEVSLTRSLVQVDNYLSEIITTRKQEMMTQHNDGKHHDDLLSRFIKKKESYSDETLQRVALNFILAGRDTSSVALSWFFWLITQHPTIEDIILREICTVLIETRGDDVALWTDEPLSCEELDRLVYLKAALSETLRLYPSVPEDSKRAVKDDVLPDGTFVPAGSSVTYSIYSAGRMKSTWGEDCLEFKPERWISQSDGGRFINHDPFKFVAFNAGPRICLGKDLAYLQMKSIAAAVLLRHRLTVVTGHKVEQKMSLTLFMKYGLLVNVHERDLTVIAADLRVKTV

SEQ ID NO: 7875 - protein, 403 aa, Glycine max; identical to SEQ ID NO: 7857

SEQ ID NO: 7876 - protein, 405 aa, Arachis hypogaea; identical to SEQ ID NO: 7854

SEQ ID NO: 7877 - protein, 404 aa, Populus trichocarpa x Populus deltoides
MASATFSVAKPSLQASGKGFTDFSGLRSSSAFLPFTKKTSDDFVSVVAFQTSAMGNSSGGYRKSAAEAKIKVAINGFGRIGRNFLRCWHGRKDSPLDVIAINDTGGVKQASHLLKYDSTLGIFDADVKPVGDNAISVDGKVIKVVSSRNPLDLPWKDMEVDLVIEGTGVFVDREGAGKHITAGAKKVIITAPGKGDIPTYVVGVNADAYSPDEPIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEGFRESAEKELKGILSVCDEPLVSVDFRCSDVSSTVDSSLTMVMGDDMVKVIAWYDNEWGYSQRVVDLAHIVADQWK

SEQ ID NO: 7878 - protein, 366 aa, Glycine max
MEWCVSMPKIELHAHLNGSIRDSTLLELTKALIGKGAINFSEVEHIILKYNRSVEEVFKLFDLIHILTTEHNTVARITREVIEDFASENVVYLELRTTPKRNDSVGMSKRSYVEAVLKGLRSITSVDVDFIPHCEDSKTLFTPAPAIDGHARKRIFVRLLLSIDRRETTEAAMDTVKLALEMRPYGVVGIDLSGNPSIGDWTTYLPALKFAREQGLYVTLHCGELPNSKEIKNMLDFRPQRIGHACFFEDEHWRQLKSSNIPVEICLTSNVRTMTVPSIDVHHFAHLYNAKHPLVLCTDDSGVFSTCLSKEYKIAADSFGLGRREMFELSRNAVEYIFADSKIKEDLRRNFNSVAKKYGSVSTVSS

SEQ ID NO: 7879 - protein, 312 aa, Capsicum annuum
GINGFGRIGRNFLRCWHGRKDSPLEVIAINDSGGVKQASHLLKYDSTLGIFDADVKPVGTDGISVDGKVIKVVSDRNPINLPWKDLGVDLVIEGTGVFVDREGAGKHIQAGAKKVLITAPGKGDIPTYVVGVNADLYSPDEPIISNASCTTNCLAPFVKVLDEKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFRESADKELAGILSVCDEPLVSVDFRCSDVSSTVDASLTMVMGDDMVKVIAWYDN

SEQ ID NO: 7880 - protein, 314 aa, Capsicum annuum
GINGFGRIGRNFLRCWHGRKDSPLDVIAINDTGGVKQASHLLKYDSTLGIFEADVKPVGTDGISVDGKVIQVVSNRNPSNLPWGDLGIDLVIEGTGVFVDREGAGKHIQAGAKKVLITAPGKGDIPTYVVGVNADLYNPDEPIISNASCTTNCLAPFVKILDQKFGIIKGTMTTTHSYTGDQRLLDASHRDLRRARAAALNIVPTSTGAAKAVALVLPSLKGKLNGIALRVPTPNVSVVDLVVQVSKKTFAEEVNAAFREAADKELNGILSVCDEPLVSVDFRCSDVSSTVDASLTMVMGDDMVKVIAWYDNEW

SEQ ID NO: 7881 - protein, 392 aa, Nicotiana tabacum
NSSLQVSNKGFSEFSGLRTSSAIPFGRKTNDDLLSVVAFQTSVIGGGNSKRGVVEAKLKVAINGFGRIGRNFLRCWHGRKDSPLDVIAINDTGGVKQASHLLKYDSTLGIFDADVKPVGTDGISVDGKVIQVVSDRNPVNLPWGDLGIDLVIEGTGVFVDREGAGKHIQAGAKKVLITAPGKGDIPTYVVGVNADLYNPDEPIISNASCTTNCLAPFVKVLDQKFGIIKGTMTTTHSYTGDQRLLDASHRDLRRARAAALNIVPTSTGAAKAVALSSQALRGSSMALPLRVPTPNVSVVDLVVQVSKKTFAEEVNAAFREAADKELKGILDVCDEPLVSVDFRCSDVSSTVDASLTMVMGDDMVKVIAWYDNEWGYSQRVVDLADIVANQWK

SEQ ID NO: 7882 - protein, 221 aa, Glycine max
METSQPLSIESFSYSWLVNLRPSSLESLESSLRTSLDASDEASFIEMDPRMPPSKRFFKNSQDSKFDFPISQSPLTLVHADELFSNGYLMPLFVESLQMEEYESSDSNTSLVSSSSHAPTSEAPTGPSRCLSLKRCRTLSRRVFQKYLNFLRPLCRKLRVHKSSTEAVAKRGEAVKNRRYYSDTTSPRTSVAFSADDWRYSCDSESSIYEAVLHCKRSIGE

SEQ ID NO: 7883 - protein, 223 aa, Glycine max
METSQPLSIESFSYSWLVNLRPSALESLESSLRTPLDASDETSSFIEMDPRMPPSKRFFKNSQDSKFDFPISQSPLTLVHADELFSNGYLMPLFVESLQMEEYESSDSNTSLVSSSSHAPKSEAPTGPSRCLSLKKCRTLSRRVFQKYLNFLRPLCRKLRVHKPSIDAVAKRGEAVKNRRYYSDTATSPRISVAFSADDWRYSCDSESSIYEAVLHCKRSIGE

SEQ ID NO: 7884 - protein, 223 aa, Glycine max
MGTSHPLSIESFSYSWLVNLKPSLESLDGSLRTSLDASDETSSFIEMDPRMTPSKRFFRNSQDFKFDFPISQSPRTLVDADELFSNGYLMPLFVESLKMEAFEASDVIPSLPSSSHVPKSVVPNSHSRCPSLKRCKTLSRRIFLKYLNFLRPLYRRLRGGKSGSKPESVVKRTVSAKNRGYYSETSPRISVAYSADDWRKSCDSESSIYEAVLHCKRSIERMN

SEQ ID NO: 7885 - protein, 220 aa, Ricinus communis
METSQPLSIESFSYSWLVNLKPSLESLDSSLRASLDASDEASFIEMDPRMPPSKRFFRNSQDFKFDFPTSQSPLTVVHADELFSNGYVMPIFVDPLKIESYEVSDSASALPASSHAPKVVVSGRKTRCSSLRRCRTLSKQMFQKYFDFLRPLYRRIRGHRSSTRAEKMDTKVQVMKRWMYSAEASPRISVAYSVDDWRRSCDSESSIYEAVLHCKKSIEK

SEQ ID NO: 7886 - protein, 222 aa, Populus trichocarpa
METSQPLSIESFSYSWLVNLKPSLESLDNSLRASLDASDEASFIEMDPRMPPSKRFFRNSQDFKFDFPISQSPLTLVHADELFSNGYVMPLFVDPLKMEAYDVSDSTSALPTSSHAPKTVVSACKPQRCSSLRRCRRLSKQIVQKYMDFLRPLYRRIRGHRSSSRDENIDSKVQVMKNWVYSAETSPRISVAYSVDDCWRRSCDSESSIYEAVLHCKRSNGK

SEQ ID NO: 7887 - protein, 188 aa, Glycine max
MRSSSIRSFTIFTLFLIAILPHGHATTPTSKLRLKPLSSPFSTALETLQKQLGYTFKSIDLLRRAVTHASFSEENNKAFAILGASVIETSVSFHLLSRDVDLSSKELNRRLSQITNVDSSCAVDGTRLGLHKVVRVSPKTNSSAPAVVCGAFRAIFGAVAIDTGKSDDAGNVFWNLHGGGDLGVAVAL

SEQ ID NO: 7888 - protein, 332 aa, Medicago truncatula
MAKDPVRVLVTGAAGQIGYALVPMIARGVMLGPDQPVILHMLDIAPAAESLNGVKMELVDAAFPLLKGVVATTDVVEACTGVNIAVMVGGFPRKEGMERKDVMSKNVSIYKSQASALEKHAAANCKVLVVANPANTNALILKEFAPSIPERNISCLTRLDHNRALGQISERLNVQVSDVKNVIIWGNHSSTQYPDVNHATVNTPAGEKPVRELVSDDAWLNGEFISTVQQRGAAIIKARKLSSALSAASAACDHIRDWVLGTPQGTFVSMGVYSDGSYNVPSGLIYSFPVTCANGEWKIVQGLSIDEFSRKKLDLTAEELSEEKNLAYSCLS

SEQ ID NO: 7889 - protein, 332 aa, Medicago sativa
MAKDPVRVLVTGAAGQIGYALVPMIARGVMLGPDQPVILHMLDIAPAAESLNGVKMELVDAAFPLLKGVVATTDVVEACTGVNIAVMVGGFPRKEGMERKDVMSKNVSIYKSQASALEKHAAANCKVLVVANPANTNALILKEFAPSIPERNISCLTRLDHNRALGQISERLNVQVSDVKNVIIWGNHSSTQYPDVNHATVNTPAGEKPVRQLVSDDAWLNGEFISTVQQRGAAIIKARKLSSALSAASAACDHIRDWVLGTPQGTFVSMGVYSDGSYNVPSGLIYSFPVTCANGEWKIVQGLSIDEFSRKKLDLTAEELTEEKNLAHSCLS

SEQ ID NO: 7890 - protein, 332 aa, Cicer arietinum
MAKDPVRVLVTGAAGQIGYALVPMIARGVMLGPDQPVILHMLDIPPAAESLNGVKMELVDAAFPLLKGVVATTDVVEACTGVNIAVMVGGFPRKEGMERKDVMSKNVSIYKSQASALEQHAAANCKVLVVANPANTNALILKEFAPSIPEKNISCLTRLDHNRALGQISERLSVQVSEIKNVIIWGNHSSTQYPDVTHATVKTPAGEKPVRELVSDDAWLNGEFIPTVQQRGAAIIKARKLSSALSAASAACDHIRDWVLGTPEGTFVSMGVYSDGSYNVPAGLIYSFPVTCAGGEWKIVQGLSIDEFSRKKLDLTAEELSEEKNLAYSCLS

SEQ ID NO: 7891 - protein, 332 aa, Glycine max
MAKDPVRVLVTGAAGQIGYALVPMIARGVMLGPDQPVILHMLDIPPAAESLNGVKMELVDAAFPLLKGVVATTDVVEACTGVNIAVMVGGFPRKEGMERKDVMTKNVSIYKSQASALEKHAAANCKVLVVANPANTNALILKEFAPSIPEKNISCLTRLDHNRALGQISERLTVQVSDVKNVIIWGNHSSTQYPDVNHATVATSAGEKPVRELIADDAWLNGEFITTVQQRGAAIIKARKLSSALSAASAACDHIRDWVLGTPQGTWVSMGVYSDGSYNVPAGLIYSFPVTCANGEWAIVQGLSIDEFSRKKLDLTAKELFEEKALAYSCLN

SEQ ID NO: 7892 - protein, 332 aa, Populus trichocarpa
MAKEPARVLVTGAAGQIGYALVPMIARGVMLGPDQPVILHMLDIPPAAEALNGVKMELVDAAFPLLKGVVATTDVVEACTGVNIAVMVGGFPRKEGMERKDVMSKNVSIYKSQASALEKHAAANCKVLVVANPANTNALILKEFAPSIPEKNITCLTRLDHNRALGQISERLNVQVSDVKNVIIWGNHSSTQYPDVNHATVKTPAGEKPVRELVKDDAWLNAEFITTVQQRGAAIIKARKLSSALSAASSACDHIHDWVLGTPEGTWVSMGVYSDGSYNVPAGLIYSFPVTCQNGEWKIVQGLSIDEFSRKKLDLTADELSEEKALAYSCLT

SEQ ID NO: 7893 - protein, 332 aa, Ricinus communis
MAKEPVRVLVTGAAGQIGYALVPMIARGVMLGPDQPVILHMLDIPPAAEALNGVKMELVDAAFPLLKGVVATTDVVEACTGVNVAVMVGGFPRKEGMERKDVMSKNVSIYKSQASALEKHAAANCKVLVVANPANTNALILREFAPSIPEKNITCLTRLDHNRALGQISERLNVQVSDVKNVIIWGNHSSTQYPDVNHATVKTPSGEKPVKELVNDDAWLHGDFISTVQQRGAAIIKARKLSSALSAASSACDHIRNWVLGTPEGTWVSMGVYSDGSYNVPSGLIYSFPVTCQNGEWKIVQGLSIDEFSRKKLDSTAEELSEEKALAYSCLS

SEQ ID NO: 7894 - protein, 332 aa, Lupinus angustifolius
MAKDPVRVLVTGAAGQIGYALVPMIARGVMLGSDQPVILHLLDIPPAAESLNGVKMELVDAAFPLLKGVVATTDAVEACTGVNIAVMVGGFPRKEGMERKDVMSKNVSIYKSQASALEKHAAANCKVLVVANPANTNALILKEFAPSIPEKNISCLTRLDHNRALGQISERLNVQVSDVKNVIIWGNHSSSQYPDVNHATVTTPAGEKPVRELVADDAWLNSEFIATVQQRGAAIIKARKLSSALSAASAACDHIRDWVLGTPEGTWVSMGVYSDGSYNVPAGLIYSFPVTTQNGEWKIVQGLAIDEFSRKKLDLTAEELSEEKALAYSCLS

SEQ ID NO: 7895 - protein, 332 aa, Populus trichocarpa
MAKEPVRVLVTGAAGQIGYALVPMIARGVMLGPDQPVILHMLDIPPAAEALNGVKMELVDAAFPLLKGVVATTDVVEACTGVNIAVMVGGFPRKEGMERKDVMSKNVSIYKSQASALEKHAAANCKVLVVANPANTNALILKEFAPSISEKNITCLTRLDHNRALGQISERLSVQVCDVKNVIIWGNHSSSQYPDVNHATVKTPAGEKPVRELVKDDEWLNAEFITTVQQRGAAIIKARKLSSALSAASSACDHIRDWVLGTPEGTWVSMGVYSDGSYNVPAGLIYSFPVTCQNGEWKIVQGLSIDEFSRKKLDLTADELSEEKALAYSCLS

SEQ ID NO: 7896 - protein, 332 aa, Plantago major
MAKDPVRVLVTGAAGQIGYALVPMIARGIMLGPDQPVILHMLDIAPAAEALNGVKMELVDAAFPLLKGVVATTDAVEACTGVNVAVMVGGFPRKEGMERKDVMSKNVSIYKSQASALEKHAAANCKVLVVANPANTNALILKEFAPSIPEKNITCLTRLDHNRALGQVSERLSVQVSDVKNCIIWGNHSSSQYPDVNHATVKTPAGDKPVRELVADDQWLNTEFISTVQQRGAAIIKARKFSSALSAASSACDHIRDWVLGTPEGTWVSMGVYSDGSYNVPAGLIYSFPVTCKNGEWSIVQGLPIDEFSRKKLDLTAQELSEEKELAYSCLS

SEQ ID NO: 7897 - protein, 332 aa, Solanum tuberosum
MAKDPVRVLVTGAAGQIGYALVPMIARGVMLGADQPVILHMLDIPPAAEALNGVKMELVDAAFPLLKGVVATTDAVEACTGVNVAVMVGGFPRKEGMERKDVMSKNVSIYKSQASALEKHAAPNCKVLVVANPANTNALILKEFAPSIPEKNITCLTRLDHNRALGQISERLSVQVSDVKNVIIWGNHSSSQYPDVNHATVTTPAGDKPVRELVADDAWLNGEFISTVQQRGAAIIKARKLSSALSAASSACDHIRDWVLGTPEGTFVSMGVYSDGSYNVPAGLIYSFPVTCKNGEWSIVQDLPIDEFSRKKLDLTAEELSEEKALAYSCLT

SEQ ID NO: 7898 - protein, 230 aa, Ricinus communis
MVKSEQKIQSETSAKPMATSPSSSASTKKKYKGVRMRSWGSWVSEIRAPNQKTRIWLGSYSTAEAAARAYDAALLCLKGSSANLNFPITSSHYIPDTVMSPKSIQRIAAAAANSFTDNATATATTATTPVSSPPQPSSLQSPSSSSSSSSISSPSSCDQLDVYDDVSLMQSFGTYSHDEYSWYNFDDQLSSPKFLDQMFINNGAASSFNPPPMMIDDFFEDDFRLWSFAE

SEQ ID NO: 7899 - protein, 214 aa, Populus trichocarpa
MVKNEHKIQSETSTPMPTSSSACKKKKYKGVRMRSWGSWVSEIRAPNQKTRIWLGSYSTPEAAARAYDAALLCLKGSSANLNFPITSSHYIPDAVMSPKSIQRVAAAAANSSEDNPTTPQVSSLPLPSSSSSSSSILSSPSMVSSPSDQPDDYMSLMESFETDNEPIPMLDSWYNFDGLQSPKYIDQMFNGVSFNPPMIDDFYEGDIRLWSFAE

SEQ ID NO: 7900 - protein, 215 aa, Populus trichocarpa
MVKNEHKIQSETSTPMPTSSSACKKKKYKGVRMRSWGSWVSEIRAPNQKTRIWLGSYSTPEAAARAYDAALLCLKGSSANLNFPITSSHYIPDAVMSPKSIQRVAAAAANSSEDNPTTPQVSSLPLPSSSSSSSSSILSSPSMVSSPSDQPDDYMSLMESFETDNEPIPMLDSWYNFDGLQSPKYIDQMFNGVSFNPPMIDDFYEGDIRLWSFAE

SEQ ID NO: 7901 - protein, 218 aa, Glycine max
METEERNQKDCKASEPEFFLQWGNRKRLRCVRVKDPRISARLNGGIRRKLGSAMEHHRSGLTVPEKEHHHHHHHQQLNRLTRNSDGAILRSSAGETRKSASPEKEDRYYTTRGSAEENGKVTGGEGINGEERALVWPKLYITLSSKEKEEDFLAMKGCKLPQRPKKRAKIIQRSLLLVSPGAWLTDMCQERYEVREKKSNKKRPRGLKAMGSMESDSE

SEQ ID NO: 7902 - protein, 217 aa, Populus trichocarpa
MEKEERNQRASCKSLEPEFFLQWGNKKRLRCVRVRDPQIISRRSDGVFRRKITSRIDRFVVSSATTEKDTSLLQSNRITRNSEAAVLRSSVAENRKSSSPEKEDRYYTTRGSVGLDENGKVSMDGNNGDDKAHVWPKLYTTLSSKEKEEDFMAMKGCKLPQRPKKRAKIIQRSLLLVSPGAWLTDMCQERYEVREKKSSKKRPRGLKAMGSMESDSE

SEQ ID NO: 7903 - protein, 214 aa, Vitis vinifera
MEKEEKSQRTYKGPETDFFLQWGNRKRLRCVRVKDPNVSVRSNGAIRRKITSRIDRSVVTGSEKESAHLQPSRFTRNTEGATLRSVTNENRKSGSSEKEDRYYTTRGSAGMDDNGKVSVEGGGGGDDRGLVWPKLYISLSSKEKEEDFMAMKGCKLPQRPKKRAKIIQRSLLLVSPGAWLSDMCQERYEVREKKTSKKRPRGLKAMGSMESDSE

SEQ ID NO: 7904 - protein, 225 aa, Populus trichocarpa
MLLPLDMEKEERNQRATCKGLEPEFFLQWGNKKRLRCVRVRDPQIISQRSDGVFRRKTTSRIDRFVVSSATTEKDTYLPQSNRLTRNSEAAILRSSVTENRKSSSPEKEDRCYTTRGSGILDENGKVSMDGNNGDDKGHVWPKLFITLSSKEKEEDFMAMKGCKLPQRPKKRAKIIQRSLLLVSPGAWLTDMCQERYEVREKKSSTSKKRPRGLKAMGSMESDSE

SEQ ID NO: 7905 - protein, 219 aa, Populus trichocarpa
MEKEERNQRATCKGLEPEFFLQWGNKKRLRCVRVRDPQIISQRSDGVFRRKTTSRIDRFVVSSATTEKDTYLPQSNRLTRNSEAAILRSSVTENRKSSSPEKEDRCYTTRGSGILDENGKVSMDGNNGDDKGHVWPKLFITLSSKEKEEDFMAMKGCKLPQRPKKRAKIIQRSLLLGSPGAWLTDMCQERYEVREKKSSTSKKRPRGLKAMGSMESDSE

SEQ ID NO: 7906 - protein, 222 aa, Ricinus communis
MDKEEKSQRVNKALEPDFFLQWGNKKRLRCVRVRDPQIISQRSDGVFRRKITTRIDRRVISSTTDKETSHPQSNHRLTRNSEAAAILRSSVTENKKSASPEKEDRYYTTRGSVVGVGVDENGKVSWDANNGDDNKGHVVWPKLYISLSSKEKEEDFMAMKGCKLPQRPKKRAKIIQRSLLLVSPGAWLTDMCQERYEVREKKSSKKRPRGLKAMGSMESDSE

SEQ ID NO: 7907 - protein, 204 aa, Cicer arietinum; identical to SEQ ID NO: 7808

SEQ ID NO: 7908 - protein, 205 aa, Glycine max; identical to SEQ ID NO: 7809

SEQ ID NO: 7909 - protein, 207 aa, Glycine max; identical to SEQ ID NO: 7810

SEQ ID NO: 7910 - protein, 203 aa, Glycine max; identical to SEQ ID NO: 7811

SEQ ID NO: 7911 - protein, 203 aa, Ricinus communis; identical to SEQ ID NO: 7812

SEQ ID NO: 7912 - protein, 203 aa, Ricinus communis; identical to SEQ ID NO: 7813

SEQ ID NO: 7913 - protein, 204 aa, Prunus armeniaca; identical to SEQ ID NO: 7814

SEQ ID NO: 7914 - protein, 203 aa, Vitis vinifera; identical to SEQ ID NO: 7815

SEQ ID NO: 7915 - protein, 203 aa, Gossypium hirsutum; identical to SEQ ID NO: 7816

SEQ ID NO: 7916 - protein, 205 aa, Arabidopsis lyrata subsp. lyrata; identical to SEQ ID NO: 7817

SEQ ID NO: 7917 - protein, 377 aa, Pisum sativum
MSVAELKERHIAATETVNNLRERLKQRRLSLLDTDIAGYARSQGRAPVTFGPTDILCCRTLQGHTGKVYSLDWTSEKNRIVSASQDGRLIVWNALTSQKTHAIKLPCAWVMTCAFSPTGQSVACGGLDSVCSIFNLNSPTDRDGNLNVSRMLSGHKGYVSSCQYVPGEDTHLITGSGDQTCVLWDITTGLRTSVFGGEFQSGHTADVLSISINGSNSKLFVSGSCDATARLWDTRVASRAVRTFHGHEGDVNSVKFFPDGNRFGTGSEDGTCRLFDIRTGHQLQVYNQQHQDNEMAHVTSIAFSISGRLLIAGYTNGDCYVWDTLLAKVVLNLGSLQNSHEGRITCLGMSADGSALCTGSWDTNLKIWAFGGHRKVI

SEQ ID NO: 7918 - protein, 377 aa, Pisum sativum
MSVADVKERHIAATETVNNLRERLKQRRLSLLDTDIAGYARSQGRAPVTLGPTDILCCRTLQGHTGKVYSLDWTSEKNRIVSASQDGRLIVWNALTSQKTHAIKLPCAWVMTCAFSPTGQSVACGGLDSVCSIFNLNSPTDRDGNLNVSRMLSGHKGYVSSCQYVPGEDTHLITGSGDQTCVLWDITTGLRTSVFGGEFQSGHTADVLSISINGSNSKLFVSGSCDATARLWDTRVASRAVRTFHGHEGDVNPVKFFPDGNRFGTGSEDGTCRLFDIRTGHQLQVYNQQHQDNEMAHVTSIAFSISGRLLIAGYTNGDCYVWDTLLAKVVLNLGSLQNSHEGRITCLGMSADGSALCTGSWDTNLKIWAFGGHRKVI

SEQ ID NO: 7919 - protein, 377 aa, Pisum sativum
MSVADVKERHIAATETVNNLRERLSRDRLSLLDTDIAGYARSQGRAPVTFGPTDILCCRTLQGHTGKVYSLDWTSEKNRIVSASQDGRLIVWNALTSQKTHAIKLPCAWVMTCAFSPTGQSVACGGLDSVCSIFNLNSPLDRDGNLNVSRMLSGHKGYVSSCQYVPGEDTHLITGSGDQTCVLWDITTGLRTSVFLGEFQSGHTADVLSISINGSNSKLFVSGSCDATARLWDTRVASRAVRTFHGHEGDVNSVKFFPDGNRFGTGSEDGTCRLFDIRTGHQLQVYNQQHQDNEMAHVTSIAFSISGRLLIAGYTNGDCYVWDTLLAKVVLNLGSLQNSHEGRITCLGMSADGSALCTGSWDTNLKIWAFGGHRKVI

SEQ ID NO: 7920 - protein, 377 aa, Glycine max
MSVTELKERHLAATETVNSLRERLKERRLSLLDTDIAGYARSQGRSPVTFGPTDLVCCRTLQGHAGKVYSLDWTSEKNRIVSASQDGRLIVWNALTSQKTHAIKLPCAWVMTCAFSPTGQSVACGGLDSVCSLFNLNSPTDRDGNLAVSRMLSGHKGYVSSCQYVPDEDTHLITGSGDQTCVLWDITTGLRTSVFGGEFQSGHTADVLSISINGSNSRMFVSGSCDSTARLWDTRVASRAVQTFHGHQGDVNTVKFFPDGNRFGTGSDDGTCRLFDIRTGHQLQVYHRQHGDNEAAHVTSIAFSMSGRLLFAGYTNGDCYVWDTLLAKVVLNLGSLQNTHEGRISCLGLSADGSALCTGSWDTNLKIWAFGGYRRVN

SEQ ID NO: 7921 - protein, 377 aa, Populus trichocarpa
MSVSELKERHVAATETVNSLGERLKQKRLLLLDTDIAGHARAQGRNPVSFGPTDLVCCRILQGHTGKVYSLDWTPEKNRIVSASQDGRLIVWNALTSQKTHAIKLPCAWVMTCAFSPAGQSVACGGLDSVCSIFNLNSPTDKDGNLTVSRMLSGHKGYVSSCQYVPDEDTHLITSSGDQTCVLWDITTGLRTSVFGGEFQSGHTADVLSVSISGSNSRMFVSGSCDSTARLWDTRVASRAVRTFHGHEGDVNAVKFFPDGNRFGTGSDDGTCRLFDVRTGHQLQVYYQQHGDNEIAHVTSIAFSISGRLLFAGYSNGDCYVWDTLLAEVVLNLGSLQNSHEGRISCLGLSADGSALCTGSWDTNLKIWAFGGHRKVI

SEQ ID NO: 7922 - protein, 377 aa, Vitis vinifera
MSVAELKERHMAATETVNSLRERLKQKRLLLLDTDVAGYARAQGKSPVTFGPTDLVCCRTLQGHTGKVYSLDWTTEKNRIVSASQDGRLIVWNALTSQKTHAIKLPCAWVMTCAFSPSGQSVACGGLDSVCSIFNLNSPTDKDGNLAMSKMLSGHKGYVSSCQYVPDEDTHLITSSGDQTCVLWDITTGLRTSVFGGEFQSGHTADVLSVSISGSNSRMFVSGSCDATARLWDTRAASRAVRTFHGHEGDVNTVRFFPDGNRFGTGSDDGTCRLFDIRTGHQLQVYYQEHGDNEAPHVTSIAFSISGRLLFAGYSNGDCYVWDTLLAKVVLNLGSLQNSHDSRISCLGLSADGSALCTGSWDTNLKIWAFGGHRRVI

SEQ ID NO: 7923 - protein, 377 aa, Ricinus communis
MSVAELKARHVAATETVNTLRERLKQKRLLLLDTDVAGYARAQGKTPVSFGPTDLVCCRTLQGHTGKVYSLDWTAEKNRIVSASQDGRLIVWNALTSQKTHAIKLPCAWVMTCAFSPTGQSVACGGLDSVCSIFNLNSPTEKDGNLPVSKMLSGHKGYVSACQYVPDEDTHLITSSGDQTCVLWDITTGLRTSVFGGEFQSGHTADVLSVSINGSNSRMFVSGSCDSTARLWDTRVASRAVRTFHGHEGDVSAVKFFPDGNRFGTGSDDGTCRLFDIRTGHQLQVYYQQHNDNEVPHVTSIAFSISGRLLFAGYSNGDCYVWDTLLAQVVLDLGSLQNSHEGRISCLGLSADGSALCTGSYDTNLKIWAFGGHRKVI

SEQ ID NO: 7924 - protein, 377 aa, Populus trichocarpa
MSVSELKERHVAATETVNSLRERLKQKRLLLLDTDMARYARAQERSPVSFGPTDLVCCRTLQGHTGKVYSLDWTPERNRIVSASQDGRLIVWNALTSQKTHAIKLPCAWVMTCAFSPTGQSVACGGLDSVCSIFNLNSPTDKDGNLPVSRMLSGHKGYVSSCQYVPDEDTHLITSSGDQTCVLWDITTGIRTSVFGGEFQSGHTADVLSVSINGSNSRMFVSGSCDSTARLWDTRVASRAVRTFHGHEGDVNAVKFFPDGNRFGTGSDDGTCRLFDIRTGHQLQVYYHQHGDTEIPHVTSIAFSISGRLLFAGYSNGDCYVWDTLLAEAVLNLGSLQNSHEGRITCLGLSADGSALCTGSWDTNLKIWAFGGHRQVI

SEQ ID NO: 7925 - protein, 377 aa, Solanum tuberosum
MSVAELKERHMAATQTVNDLREKLKQKRLQLLDTDVSGYAKRQGKSPVTFGPTDLVCCRILQGHTGKVYSLDWTPEKNRIVSASQDGRLIVWNALTSQKTHAIKLPCAWVMTCAFSPSGQSVACGGLDSACSIFNLNSPIDKDGIHPVSRMLSGHKGYVSSCQYVPDEDTHLITSSGDQTCVLWDITTGLRTSVFGGEFQSGHTADVLSVSISSSNPKLFVSGSCDTTARLWDTRVASRAQRTFHGHESDVNTVKFFPDGNRFGTGSDDGSCRLFDIRTGHQLQVYNQPHGDGDIPHVTSMAFSISGRLLFVGYSNGDCYVWDTLLAKVVLNLGSVQNSHEGRISCLGLSADGSALCTGSWDTNLKIWAFGGHRSVV

SEQ ID NO: 7926 - protein, 377 aa, Nicotiana tabacum
MSVTELKERHMAATQTVNDLREKLKQKRLQLLDTDVSGYARSQGKTPVTFGPTDLVCCRILQGHTGKVYSLDWTPEKNRIVSASQDGRLIVWNALTSQKTHAIKLPCAWVMTCAFSPSGQSVACGGLDSVCSIFNLNSPIDKDGNHPVSRMLSGHKGYVSSCQYVPDEDTHLITSSGDQTCVLWDITTGLRTSVFGGEFQSGHTADVQSVSISSSNPRLFVSGSCDTTARLWDTRVASRAQRTFYGHEGDVNTVKFFPDGNRFGTGSEDGTCRLFDIRTEHQLQVYYQPHGDGDIPHVTSMAFSISGRLLFVGYSNGDCYVWDTLLAKVVLNLGGVQNSHEGRISCLGLSADGSALCTGSWDTNLKIWAFGGHRSVI

SEQ ID NO: 7927 - protein, 211 aa, Medicago truncatula
MASTASRFIKCVTVGDGAVGKTCMLICYTSNKFPTDYIPTVFDNFSANVVVEGITVNLGLWDTAGQEDYNRLRPLSYRGADVFVLAFSLVSRASYENVFKKWIPELQHFAPGVPVVLVGTKLDLREDRHYLADHPGMVPVTTEQGEELRKQIGATYYIECSSKTQQNVKGVFDAAIRMVIKPPQKQHEKRKKARRGCFLNVLCGRSIVRHK

SEQ ID NO: 7928 - protein, 212 aa, Glycine max
MASATAPRFIKCVTVGDGAVGKTCMLICYTSNKFPTDYIPTVFDNFSANVVVEGITVNLGLWDTAGQEDYNRLRPLSYRGADVFVLAFSLVSRASYENVLKKWIPELQHFAPGIPLVLVGTKSDLREDKHYMADHPSLVPVTTDQGEELRKHIGATYYIECSSKTQQNMKAVFDAAIRMVIKPPQKQNEKRKKKPRGCFLNVLCRRNIVRLK

SEQ ID NO: 7929 - protein, 211 aa, Populus trichocarpa
MASSASRFIKCVTVGDGAVGKTCMLICYTSNKFPTDYIPTVFDNFSANVVVEGTTVNLGLWDTAGQEDYNRLRPLSYRGADVFVLAFSLVSRASYENVLKKWIPELQHYAPGIPIVLVGAKLDLREDKHYLADHPGLVPVTTAQGEELRKQIGAAYYVECSSKTQQNVKAVFDAAIKVVIKPAQKQKERKKKPRRGCLLNVFCGRRLVCLK

SEQ ID NO: 7930 - protein, 211 aa, Populus trichocarpa
MASSASRFIKCVTVGDGAVGKTCMLICYTSNKFPTDYIPTVFDNFSANVAVEGTTVNLGLWDTAGQEDYNRLRPLSYRGADVFVLAFSLVSRASYENVLKKWIPELQHYAPGVPVVLVGTKLDLREDKHYLADHPGLVPVTMAQGEELRKQIGAAYYIECSSKTQQNVKAVFDAAIKVVIKPAQKQKERKKKPRRGCLLNVFCGRRLLCLE

SEQ ID NO: 7931 - protein, 210 aa, Aquilaria microcarpa
MASSASRFIKCVTVGDGAVGKTCMLICYTSNKFPTDYVPTVFDNFSANVIVEGTTVNLGLWDTAGQEDYNRLRPLSYRGADVFVLAFSLVSRASYENVLKKWIPELQHYAPGVPVVLVGTKLDLREDKHYLADHPGSVPVTTAQGEELRKQIGAAYYIECSSKTQQNVKAVFDAAIRVVIKPPQKQKEKKQKQNRGCLINVFCGRNLVFS

SEQ ID NO: 7932 - protein, 214 aa, Oryza sativa Japonica Group
MASSASRFIKCVTVGDGAVGKTCMLICYTSNKFPTDYIPTVFDNFSANVVVDSTTVNLGLWDTAGQEDYNRLRPLSYRGADVFVLAFSLVSRASYENIMKKWIPELQHYAPGVPIVLVGTKLDLREDKHYLLDHPGMIPVTTAQGEELRKQIGAAYYIECSSKTQQNVKGVFDAAIKVVIQPPTKQREKKKKKSRQGCSMMNMFRGRKMSCFKS

SEQ ID NO: 7933 - protein, 215 aa, Arabidopsis thaliana
MASSASKFIKCVTVGDGAVGKTCMLICYTSNKFPTDYIPTVFDNFSANVVVEGTTVNLGLWDTAGQEDYNRLRPLSYRGADVFVLSFSLVSRASYENVFKKWIPELQHFAPGVPLVLVGTKLDLREDKHYLADHPGLSPVTTAQGEELRKLIGATYYIECSSKTQQNVKAVFDSAIKEVIKPLVKQKEKTKKKKKQKSNHGCLSNVLCGRIVTRH

SEQ ID NO: 7934 - protein, 208 aa, Arabidopsis thaliana
MASSASKFIKCVTVGDGAVGKTCMLICYTSNKFPTDYIPTVFDNFSVNVVVEGITVNLGLWDTAGQEDYNRLRPLSYRGADVFVLAFSLISRASYENVFKKWIPELQHFAPGVPIVLVGTKMDLREDRHYLSDHPGLSPVTTSQGEELRKHIGATYYIECSSKTQQNVKAVFDAAIKVVIKPAVKQKEKKKKQKPRSGCLSNILCGKN

SEQ ID NO: 7935 - protein, 210 aa, Nicotiana tabacum
MASSASRFIKCVTVGDGAVGKTCMLICYTSNKFPTDYVPTVFDNFSANVVVEGTTVNLGLWDTAGQEDYNRLRPLSYRGADVFVLAFSLVSRASYENILKKWIPELQHYAPGIPVVLAGTKLDLREDKHFLADHPGLVPVTTAQGEELRKQIGAAYYIECSSKTQQNVKAVFDAAIKVVIKPPQKQKEKKKQRRGCLMNVMCGRKLVCLK

SEQ ID NO: 7936 - protein, 211 aa, Ricinus communis
MAASASRFIKCVTVGDGAVGKTCMLICYTSNKFPTDYIPTVFDNFSANVVVEGTTVNLGLWDTAGQEDYNRLRPLSYRGADVFVLAFSLVSRASYENVLKKWVPELQHYAPGVPIVLVGTKLDLREDKHYLADHPGLTPVTTTQGEELRKQIGAAYYVECSSKTQQNVKAVFDASIKVVIKPAPKQKEKKKKPSRGCLLNVFCGRRLVCLR

SEQ ID NO: 7937 - protein, 308 aa, Glycine max
MQFPHQFGTTTNSPFPHPSFQNQQHQMISFGSSQQHNNLAYPPIIASDSSSLLHQHHHHQQQHQQHQQQLLQYWSDALNLSPRGMLTRLGPDGRPLFRLPTQPINTTKLYRGVRQRHWGKWVAEIRLPRNRTRLWLGTFDTAEDAAMAYDREAFKLRGENARLNFPELFLNKDKKEEQQQQEQEASSPVLSAIAKQHEPSSEHRDVPIEESNENDSGDATVSDDQVHATTESSEGVSQEMVWGEMSAWFNAIPAAWGPGSPMWDDLDATNNLLCQSHIPFSNPNQQELNDAERQEQNTGPGYLWKDQD

SEQ ID NO: 7938 - protein, 307 aa, Glycine max
MQFPHQFGTTTNSPFPHPSFQNQQHQMISFGSSQQHNNLAYPPIIARDSSSLVHHHHQQQQQHQQQLLQYWSGALNLSPRGMLTRLGPDGRPLFSPPTQRINTTKLYRGVRQRHWGKWVAEIRLPRNRTRLWLGTFDTAEDAAMAYDREAFKQRGENARLNFPELFFNKDKKEQGEEEASSPVLSAIAKQNEPPPAHHRDVTIEESNENDSGDATVSDEVHAPAATASSEGVSQELVWGEMSAWFNAIPAAWGPGSPMWDDLDATNNLLCQSHIPFSNPNQQQFNDADDAQRQEQNTGPGYLWKDQD

SEQ ID NO: 7939 - protein, 307 aa, Glycine max
MQFPHQFGTSPNSPFPHPSFQNQQHQMISFGSSQQHNNLAYPPIIARDSSSLVHHHHQQQQQHQQQLLQYWSGALNLSPRGMLTRLGPDGRPLFSPPTQRINTTKLYRGVRQRHWGKWVAEIRLPRNRTRLWLGTFDTAEDAAMAYDREAFKQRGENARLNFPELFFNKDKKEQGEEEASSPVLSAIAKQNEPPPAHHRDVTIEESNENDSGDATVSDEVHAPAATASSEGVSQELVWGEMSAWFNAIPAAWGPGSPMWDDLDATNNLLCQSHIPFSNPNQQQFNDADDAQRQEQNAGPGYLWKDKG

SEQ ID NO: 7940 - protein, 211 aa, Medicago truncatula; identical to SEQ ID NO: 7927

SEQ ID NO: 7941 - protein, 163 aa, Glycine max
MDDTETKGRIEETVRRILQESDMDEVTESKIRKQASEHLGLDLSQPYFKAFVKQVVKAFLQEEEQRQKQQQQDEDEEEELGGASKGKEYDDEGDLIICRLSDKRRVTIQDFRGKTLVSIREYYKKDGKELPTSKGISLTEEQWSAFKKNVPAIEKAIKKMESS

SEQ ID NO: 7942 - protein, 166 aa, Glycine max
MDDAETKGRIEETVRRVLQESDMDEVTESKIRKQASEQLGLDLSQPHFKAFVKQVVKAFLQEEEQRQQQQQQDEDDDDEEEEQGGVSKGKEYDDEGDLIICRLSDKRRVPIQDFRGKTLVSIREYYKKDGKELPTSKGISLTEEQWSTFKKNVPAIEKAIKKMESS

SEQ ID NO: 7943 - protein, 1036 aa, Arachis hypogaea
MTDTTDDIAEEISFQSFDDDCRLLGNLLNDILQREVGTTVVDKLERIRVLAQSGCNMRQAGIVDMAEMLEKQLASELSKMTLEEALTLARAFSHYLTLMGIAETHHRVRKRGNNIAQTAKSCDDIFNQLVQGGVSPDELYDTVCKQEVEIVLTAHPTQINRRTLQYKHIRIAHLLDYNDRPDLTIEDREMVIEDLVREITSIWQTDELRRQKPTPVDEARAGLNIVEQSLWKAVPHYLHRVSNALKKHTGKPLPLTCTPIKFGSWMGGDRDGNPNVTAKVTKDVSLLSRWMAIDLYIREVDSLRFELSMNQCSESLSRLAHEILEEANLENRHENWNQPVSRSQSLPKQLPARAHLPSFAENGEAQHPRLDIPGPDHSQHNHKEGEVSSTLFKIGETSANSGASAAAISPSSSFNSIQQLGQRKSSAGSQIGRSSFQKLMEPKLPQLPGIAPYRVVLGNVKDKLERSRRRLELLLEDVSCDNDPLDYYETTDQLLEPLLLCYESLQSCGSGVLADGRLADLIRRVATFGMVLMKLDLRQESGRHAETIDAITKYLDLGTYSEWDEEKKLEFLTRELKGKRPLVPHSIEVPHEVKEVLDTFRIAAELGSDSLGAYVISMASNASDVLAVELLQKDARLSVAGDLGRECPGGTLRVVPLFETVKDLRGAGSVIRKLLSIDWYREHVIKNHNGHQEVMVGYSDSGKDAGRFTAAWELYKAQEDVVAACNEYGIKVTLFHGRGGSIGRGGGPTYLAIQSQPPGSVMGTLRSTEQGEMIDAKFGLPQIAVRQLEIYTTAVLLATLRPPHPPREEKWRKVIEEISNISCQCYRSVVYENPEFLSYFHEATPEAELGFLNIGSRPARRKSSKGIGHLRAIPWLFAWTQTRFVLPAWLGVGAGLKGACEKGHTEELKEMYKEWPFFQSTIDLIEMVLGKADIPIAKHYDEVLVSKERQELGRELRSELMTAEKFVLVISGHEKLQQNNRSLRRLIENRLPFLNPLNMLQVEILKRLRREDDNRKIRDALLITINGIAAGMKNTG

SEQ ID NO: 7944 - protein, 1032 aa, Glycine max
MTDITGDIAEEISFQSFDDDCRLLGNLLNDILQREVGTNLLDKIERTRVLAQSGCNMRQAGIVNMAEMLEKQLASELSKMTLEEAFTLARAFSHYLTLMGIAETHHRVRKGGNMAQIAKSCDDIFNQLVQGGVPPEELYDTVCKREVEIVLTAHPTQINRRTLQFKHIRIAHLLDYNDRPDLSTEDREMVIEDLVREITSIWQTDELRRQKPTPVDEARAGFNIVEQSLWKAVPHYLRRVSNALKKHTGKPLPLTCTPIKFGSWMGGDRDGNPNVTAKVTKDVSLLSRWMAIDLYIREVDSLRFELSMNQCSDRLSRLAHEILEAKHENRRENWNQSANRSLTLPTQLPARAHLPSIAENGESRHPRLDIPAPDYMQSNHKDGGVSVSSTTSKLANPNTRLPGTSSANSSASSAALGQKKLYAESQTGKSTFQKLLEPMLPQLPGIAPYRIVLGNVKDKLEKSRRRLEILLEDVACDYDPLDYYETSDQLLEPLLLCYESLQSCGSGVLADGRLADLIRRVATFGMVLMKLDLRQESGRHAEALDAITQYLDMGTYSEWDEEKKLDFLTRELKGKRPLVPVSIEVHPDVKEVLDTFRIAAELGSDSLGAYVISMASNASDVLAVELLQKDARLAAIGELGKACPGGTLRVVPLFETVKDLRGAGSVIRKLLSIDWYHEHIVKNHNGHQEVMVGYSDSGKDAGRFTAAWELYKAQEDVVAACNDYGIKVTLFHGRGGSIGRGGGPTYLAIQSQPPGSVMGTLRSTEQGEMVEAKFGLPQIAVRQLEIYTTAVLLATLRPPIPPREEKWRNVMEEISNISCQCDRNVVYENPEFLAYFHEATPEAELGFLNIGSRPTRRKSSVGIGHLRAIPWLFAWTQTRFVLPAWLGVGAGLKGACEKGYTEELKAMYKEWPFFQSTIDLIEMVLGKADIPIAKHYDEVLVTKERQELGHELRSELMTAEKFVMVISGHEKLQQNNRSLRRLIENRLPFLNPLNMLQVEILKRLRRDDDNRKIRDALLITINGIAAGMKNTG

SEQ ID NO: 7945 - protein, 1052 aa, Ricinus communis
MTDTTDDIAEEISFQSFDDDCKLLGNLLNDVLQREVGSKFMEKLERNRILAQSACNMRLAGIEDTAELLEKQLALEISRMTLEEALTLARAFSHYLNLMGIAETHHRVRKARSMTHLSKSCDDIFNQLLQSGISAEELYDTVCKQEVEIVLTAHPTQINRRTLQYKHIRIAHLLDYNDRPDLTHEDREMLIEDLVREITSIWQTDELRRHKPTPVDEARAGLNIVEQSLWKALPHYLRRVSTALKKHTGKPLPLTCTPIRFGSWMGGDRDGNPNVTAKVTRDVSLLSRWMAVDLYIREVDSLRFELSMVQCSDRLLKVANDILIEETSSEDHHESWNQPASRSQTKFPRKSLPTQLPPRADLPACTECNDGESQYPKLELPGTDYMPFNRQEALGSSYSESSSQDINHGLPKTTGNGSVANSSGSPRASFSSAQLVAQRKLFAESKIGRSSFQKLLEPSLPQRPGIAPYRIVLGNVKDKLMRTRRRLELLLEDLPCEYDQWDYYETTDQLLDPLLLCYESLQSCGAGVLADGRLADLIRRVATFGMVLMKLDLRQESGRHADTLDAITKYLEMGTYSEWDEEKKLEFLTRELKGKRPLVPPTIEVAPDVKEVLDAFRVAAELGSDSLGAYVISMASNASDVLAVELLQKDARLAVSGELGRPCPGGTLRVVPLFETVKDLRGAGSVIRKLLSIDWYREHIIKNHNGHQEVMVGYSDSGKDAGRFTAAWELYKAQEDVVAACNDFGIKVTLFHGRGGSIGRGGGPTYLAIQSQPPGSVMGTLRSTEQGEMVQAKFGLPHTAIRQLEIYTTAVLLATLRPPHPPREEQWRNVMEEISKISCQNYRSTVYENPEFLAYFHEATPQAELGFLNIGSRPTRRKSSTGIGHLRAIPWVFAWTQTRFVLPAWLGVGAGLKGACEKGFTEDLKAMYKEWPFFQSTIDLIEMVLGKADIPIAKHYDEVLVSESRRELGAELRSELLTTEKYVLVVSGHEKLSQNNRSLRRLIESRLPYLNPMNMLQVEVLKRLRRDDDNNKLRDALLITINGIAAGMRNTG

SEQ ID NO: 7946 - protein, 1061 aa, Vitis vinifera
MTDTTDDIAEEISFQSFDDDCRLLGSLLNEVLQREVGSNFMEKVERNRILAQSACNMRASGIEDTAELLEKQLISEISQMNLEEALTLARAFSHYLNLMGIAETHHRLRKARNVAHMSKSCDDIFNQLLQGGVSPEELYNTVCKQEVEIVLTAHPTQINRRTLQYKHIRIAHLLDYNDRPNLGHEDREMLIEDLVREITSIWQTDELRRQKPTVVDEARAGLNIVEQSLWRAVPHYLRRVSNALKKHTGKSLPLTCTPIKFGSWMGGDRDGNPNVTAEVTRDVSLLSRWMAIDLYIREVDSLRFELSMNRCSDSLSRLAHEILEKETSSVDRNESRNQPLNRSQLKPYSQLGPTLPRQLPAGADLPSCTECKDGESKYPKLEFPGTDYMPLNRQDVKAASSSDTSFQDSNKDFGKTYGNGTVANSSNSQSAATPRTVSFSSGQLLSQRKLFSESQLGRSSFQKLLEPSLPQRPGIAPYRIVLGNVKDKLMKTQRRLELLLEDLPCEHDPGDYYETADELLEPLLLCHESMQSCGSGILADGRLADLIRRVATFRMVLMKLDLRQESARHAETLDAITSYLDMGIYSEWDEERKLDFLTRELKGKRPLVPPTIEVVADVKEVLDTFRVAAEIGSDSFGAYVISMASNASDVLAVELLQKDARLAVCGELGRPCSGGTLRVVPLFETVKDLRGAGAVIRKLLSIDWYREHIIKNHNGHQEVMVGYSDSGKDAGRFTAAWELYKAQEDVVAACNEYGIKVTLFHGRGGSIGRGGGPTYLAIQSQPPGSVMGTLRSTEQGEMVQAKFGLPHTAVRQLEIYTTAVLLATMRPPLPPREEKWRNLMEEISKISGQCYRSTVYENPEFLAYFHEATPQAELGFLNIGSRPTRRKSSTGIGHLRAIPWVFAWTQTRFVLPAWLGVGSGLKGVCEKGHKEDLIAMYKEWPFFQSTIDLIEMVLGKADITIAKHYDEVLVSPSRQELGADLRRELLTTGKFVLVVTGHDKLSQNNRSLRRLIESRLPFLNPMNMLQVEILRRLRRDDDNNKLRDALLITINGIAAGMRNTG

SEQ ID NO: 7947 - protein, 1069 aa, Vitis vinifera
  misc_feature (462)..(462): Xaa can be any naturally occurring amino acid
  misc_feature (673)..(673): Xaa can be any naturally occurring amino acid
MTDTTDDIAEEISFQSFDDDCRLLGSLLNEVLQREVGSNFMEKVERNRILAQSACNMRASGIEDTAELLEKQLISEISQMNLEEALTLARAFSHYLNLMGIAETHHRLRKARNVAHMSKSCDDIFNQLLQGGVSPEELYNTVCKQEVEIVLTAHPTQINRRTLQYKHIRIAHLLDYNDRPNLGHEDREMLIEDLVREITSIWQTDELRRQKPTVVDEARAGLNIVEQSLWRAVPHYLRRVSNALKKHTGKSLPLTCTPIKFGSWMGGDRDGNPNVTAEVTRDVSLLSRWMAIDLYIREVDSLRFELSMNRCSDSLSRLAHEILEKETSSVDRNESRNQPLNRSQLKPYSQLGPTLPRQLPAGADLPSCTECKDGESKYPKLEFPGTDYMPLNRQVKQILGKLIFLCGICLPSMDVKAASSSDTSFQDSNKDFGKTYGNGTVANSSNSHSGQLLSQRKLFSEXQLGRSSFQKLLEPSLPQRPGIAPYRIVLGNVKDKLMKTQRRLELLLEDLPCEHDPGDYYETADELLEPLLLCHESMQSCGSGILADGRLADLIRRVATFRMVLMKLDLRQESARHAETLDAITSYLDMGIYSEWDEERKLDFLTRELKGKRPLVPPTIEVVADVKEVLDTFRVAAEIGSDSFGAYVISMASNASDVLAVELLQKDARLAVXGELGRPCSGGTLRVVPLFETVKDLRGAGAVIRKLLSIDWYREHIIKNHNGHQEVMVGYSDSGKDAGRFTAAWELYKAQEDVVAACNEYGIKVTLFHGRGGSIGRGGGPTYLAIQSQPPGSVMGTLRSTEQGEMVQAKFGLPHTAVRQLEIYTTAVLLATMRPPLPPREEKWRNLMEEISKISGQCYRSTVYENPEFLAYFHEATPQAELGFLNIGSRPTRRKSSTGIGHLRAIPWVFAWTQTRFVLPAWLGVGSGLKGVCEKGHKEDLIAMYKEWPFFQSTIDLIEMVLGKADITIAKHYDEVLVSPSRQELGADLRRELLTTGKFVLVVTGHDKLSQNNRSLRRLIESRLPFLNPMNMLQVEILRRLRRDDDNNKLRDALLITINGIAAGMRNTG

SEQ ID NO: 7948 - protein, 1061 aa, Arabidopsis lyrata subsp. lyrata
MTDTTDDIAEEISFQSFEDDCKLLGSLFNDVLQREVGTDFMEKIERTRVLAQSALNLRLAGIEDTAELLEKQLTSEISKMSLEEALTLARAFSHFLNLMGIAETHHRVRKVCNVPQLSRSCNDVFSKLLQGGISPDELYDTVCKQEVEIVLTAHPTQINRRTLQYKHIRMAHLLEYNDRPDLGLEDRETVIEDLVREITSLWQTDELRRQKPTPVDEARSGLNIVEQSLWKAVPHYLRRVSSSLKKLTGKPLPLTCTPIKFGSWMGGDRDGNPNVKAKVTKEVSLMSRWMAIDLYIREIDSLRFELSMNRCSDRLSRLADEILEKEASGQDHLECWGPNAGRSQQKFPSQQGLSLPTQLPPRADLPSCTECGESQYPKLEVPVTDYTPLNRQVKHSSKDSDICLICFVTYGQSLQIRIANGTSVNSNGSQQSLTPRGSSSSSSQLLQKKLFAESQNGRTSFQKLLEPTPPKRAGIAPYRIVLGEVKEKLLKTRRLLELLLEGLPCEYDPWDYYETSDQLLEPLLLCYESLQSSDAGVLADGRLSDLIRRVATFGMVLMKLDLRQEAARHSEALDAITTYLDMGTYSEWNEEKKLEFLTRELKGKRPLVPPNIEVGPEVKEVLDTFRVAAELGSESLGAYVISMASNASDVLAVELLQKDARLAVSGDLGRPCPAGTLRVVPLFETVKDLRDAGSVIRKLLSIDWYREHIQKNHTGHQEVMVGYSDSGKDAGRFAAAWELYKAQEDVVAACNEFGIKITLFHGRGGSIGRGGGPTYLAIQSQPPGSVMGTLRSTEQGEMVQAKFGLPQTAVRQLEIYTTAVLLATLQPPQPPREEKWRSLMEDISNISCQNYRSTVYENPEFLSYFQEATPQAELGFLNIGSRPTRRKSSSGIGHLRAIPWVFAWTQTRFVLPAWLGVGAGLKGVCEKGHADDLQAMYKEWPFFQSTIDLIEMVLAKADIPIAKHYDEELVSENRRGIGSELRKELLTTEKYVLVISGHEKLSENNRSLKKLIESRLPYLNPMNMLQVEILKRLRRDDDNNKLRDALLITINGIAAGMRNTG

SEQ ID NO: 7949 - protein, 1032 aa, Arabidopsis lyrata subsp. lyrata
MTDTTDDIAEEISFQSFEDDCKLLGSLFHDVLQREVGNPFMEKVERIRILAQSALNLRMAGIEDTANLLEKQLTSEISKMPLEEALTLARTFTHSLNLMGIADTHHRMHKVHNVTQLARSCDDIFSQLLQSGISPEELYNTVCKQEVEIVLTAHPTQINRRTLQYKHLRIAHLLEYNTRSDLSLEDRETLIEDLVREITSLWQTDELRRQKPTPVDEARAGLNIVEQSLWKAVPHYLRRVSTSLKKFTGKPLPLTCTPIKFGSWMGGDRDGNPNVTAKVTKEVSLLSRWMAIDLYIREVDSLRFELSTDRCSDRFSRLADEILEKDYDRGQSNFQKQQSSSSLPTQLPARAHLPSCIDFGESRHTKFEIATTDYMPPNLQKQNEQDFPESNWEKTDNGSQSGLTSRGSFSSTSQLLLQRKLFEESQVGKTSFQKLLEPPPLKRAGSAPYRIVLGEVKEKLVKTRRLLELLIEGLPCEYDPLNSYEKSDQLLEPLLLCYESLQSSGASVLADGRLADLIRRVSTFGMVLVKLDLRQESARHSEALDAITTYLDMGTYSEWDEEKKLEFLTRELKGKRPLVPPCIKVGPDVKEVLDTFRVAAELGSESLGAYVISMASNASDVLAVELLQKDARLAITSEHGKPCPGGTLRVVPLFETVNDLRAAGPSIRKLLSIDWYREHVQKNHNGHQEVMVGYSDSGKDAGRFTAAWELYKAQENVVAACNEFGIKITLFHGRGGSIGRGGGPTYLAIQSQPPGSVMGSLRSTEQGEMVQAKFGIPQTAVRQLEVYTTAVLLATLKPPQPPREEKWRNLMEEISTISCQHYRSTVYENPEFLSYFHESTPQAELGFLNIGSRPTRRKSSSGIGHLRAIPWVFAWTQTRFVLPAWLGVGAGLKGVSEKGHADDLQEMYKEWPFFQSTLELIEMVLAKADIPMTKHYDEQLVSEKRRGLGNELRKELMTTEKYVLVISGHEKLLQNNKSLKKLIESRLPYLNAMNMLQVEILKRLRRDEDNNKLRDALLITINGIAAGMRNTG

SEQ ID NO: 7950 - protein, 1032 aa, Arabidopsis thaliana
MTDTTDDIAEEISFQSFEDDCKLLGSLFHDVLQREVGNPFMEKVERIRILAQSALNLRMAGIEDTANLLEKQLTSEISKMPLEEALTLARTFTHSLNLMGIADTHHRMHKVHNVTQLARSCDDIFSQLLQSGISPDELYKTVCKQEVEIVLTAHPTQINRRTLQYKHIRIAHLLEYNTRSDLSVEDRETLIEDLVREITSLWQTDELRRQKPTPVDEARAGLNIVEQSLWKAVPQYLRRVSNSLKKFTGKPLPLTCTPMKFGSWMGGDRDGNPNVTAKVTKEVSLLSRWMAIDLYIREVDSLRFELSTDRCSDRFSRLADKILEKDYDRGKSNFQKQQSSSCLPTQLPARAHLPACIDFGESRHTKFEIATTDYMPPNLQKQNEQDFSESDWEKIDNGSRSGLTSRGSFSSTSQLLLQRKLFEESQVGKTSFQKLLEPPPLKRAGSAPYRIVLGEVKEKLVKTRRLLELLIEGLPCEYDPKNSYETSDQLLEPLLLCYESLQSSGARVLADGRLADLIRRVSTFGMVLVKLDLRQEAARHSEALDAITTYLDMGTYSEWDEEKKLEFLTRELKGKRPLVPQCIKVGPDVKEVLDTFRVAAELGSESLGAYVISMASNASDVLAVELLQKDARLALTSEHGKPCPGGTLRVVPLFETVNDLRAAGPSIRKLLSIDWYREHIQKNHNGHQEVMVGYSDSGKDAGRFTAAWELYKAQENVVAACNEFGIKITLFHGRGGSIGRGGGPTYLAIQSQPPGSVMGSLRSTEQGEMVQAKFGIPQTAVRQLEVYTTAVLLATLKPPQPPREEKWRNLMEEISGISCQHYRSTVYENPEFLSYFHEATPQAELGFLNIGSRPTRRKSSSGIGHLRAIPWVFAWTQTRFVLPAWLGVGAGLKGVSEKGHADDLKEMYKEWPFFQSTLELIEMVLAKADIPMTKHYDEQLVSEKRRGLGTELRKELMTTEKYVLVISGHEKLLQDNKSLKKLIDSRLPYLNAMNMLQVEILKRLRRDEDNNKLRDALLITINGIAAGMRNTG

SEQ ID NO: 7951 - protein, 1051 aa, Brassica napus
MTDTTDDIAEEISFQSFEDDCKLLGSLFNDVLQREVGSDFMEKIERTRVLAQSALNLRLAGIEDTAELLETQLTSEISNMSLEEALTLARAFSHFLNLMGIAETHHRVRRVRNLPQLSRSCNDVFSNLLQSGVSPDELYDTVCKQGVEIVLTAHPTQINRRTLQYKHIRMAHLLEYNDRPDLGFEDRETVIEDMVREITSLWQTDELRRQKPTPVDEARAGLNIVEQSLWKAVPHYLCRVSSSLKKLTGKPLPLTCTPIKFGSWMGGDRDGNPNVTAKVTKEVSLMSRWMAIDLYIREIGSLRFELSMNRCSDRLSRLADEILEKEIAAQESWGTNVGRSQPKFPNQQGLSLPTQLPPRADLPLCAECGESQYPKLEVPVTDYIPLSRQDVQGISSDGYGPNLQIKTGNGHSVNSNGCQQSITPRGSSSSSSQLLLQKKLLADSQIGRTSFQKLLEPTPPKRAGIAPYRIVLGEVKEKLLKTRRLLELLLEGLPCEYDPWDYYETSDQLLEPLLLCYESLHASDSGVLADGRLADLIRRVATFGMVLMKLDLRQEAAKHSEALDAITTYLDMGTYSEWDEEKKLEFLTRELKGKRPLVPPNIEVGPEVKEVLDTFRVAAELGSESLGAYVISMASNASDVLAVELLQKDARLAVTGELGRPCPAGTLRVVPLFETVKDLRGAGSVIRKLLSIDWYREHIEKNHTGHQEVMVGYSDSGKDAGRFTAAWELYKAQEDVVAACNEFGIKVTLFHGRGGSIGRGGGPTYLAIQSQPPGSVMGTLRSTEQGEMVQAKFGIPQTAVRQLEIYTTAVLLATLEPPQPPREKKWRNLMEEISTISSQNYKGTVYENPEFISYFHEATPQAELGYLNIGSRPARRKSSTGIGHLRAIPWVFAWTQTRFVLPAWLGVGAGLKGVSEKGYADDIQEMYKEWPFFQSTIDLIEMVLAKADIPITKLYDEQLVSENRRGLGDMLRKELMTTEKYVLVITGREKLLESNKSLKKLIESRLPYLNAMNMLQVEVLKRLRRDEDNNKLRDALLITINGIAAGMRNTG

SEQ ID NO: 7952 - protein, 1073 aa, Picea sitchensis
MTDTTDDIAEEISFQAFEDDCRLLGSLLNDVLQREVGQQFTEKVERERILAQSACNMRIAGIEDAAEVLEKKLALELSSMTLEEAASLARAFSHYLNLMGIAETHHRVRRIKNTVQLSKSCDDIFSKMIQSGTSPEDLYSAVCDQEVEIVLTAHPTQINRRTLQYKHLRIAHLLEYNDRADLSHEEREMLIEDLRREVTSLWQTDELRRHKPTPVDEARSGLHIVEQSLWKAVPHYLRRVSAALKKHTGRPLPLTCTPIRFGSWMGGDRDGNPKVTAKVTRDVCFLARWMAADLYIREIDSLRFELSMNRCNDELAKFAYEILEAENQYEERHQESGFHQTSHRVHAKHSVSHSPALPTQLPAGADMPACTECNDGESQLPILEFPVTDHSDSFESGHNAESSVTLLKSSPSRTSEKYEDGKLDVDVRTINISTNASSTGTGTGIASASSTAGFGFSSPRKKTSEFNVGKSSFDKIINPSIPQRPDIAPYRIVLGHVREKLISTRRRIEEILEGIPWDYDPSQYYEKSAQLLEPLMLCYESMQSCGSEILADGRLADLIRRVSTFGMILMKLDLRQESGKHSETLDAITEYLDMGTYSEWDEEKKLEFLVTELKGKRPLVPPTIEVSAEVREVLDTFRVAAELGSESLGAYVISMASKASDILAVELLQKDARLAVSGELGRPCPHTTLRVVPLFETVKDLRGAGSVIRKLLSIDWYRNHIIENDNGHQEVMVGYSDSGKDSGRFTAAWELYKAQEDVVAACKEFGIKVTLFHGRGGSIGRGGGPTYLAIQSQPPGSLMGTLRSTEQGEMVQAKFGLAQTAVRQLEIYTTAVLLATLHPPDPPRSANWREVMEKISEISRQYYRSTVYENEQFLEYFREATPEAELGNLNIGSRPTRRKKSSGIGHLRAIPWIFAWTQTRFVLPAWLGVGAGLEAACAKGYKEELQAMYREWPFFQCTIDLIEMVLAKSDISIAKHYDEVLVSPCRQKLGGELREAFCMTEKYVLLVSGHEKLTENNKSLKRLIESRLPFLNPINMIQVEILRRLRRDVNNPKLRDALLITINGIAAGMRNTG

SEQ ID NO: 7953 - protein, 262 aa, Glycine max
MGFPRKSLFLLLFLILFTNLAESASDYTTLVYKGCSKETFTDPNGVYSQALSSLFGSLVSQSTKAKFFKATAGSGQSSMTGLFQCRDDLSNSDCYNCVSRLPVLSDKLCGKTTAARIQLLGCYMLYEVVGFTQISGMQILYKTCGGTNAAGRGFEERRDTAFSVMENGVVTGHGFYATSYQSLYVMGQCEGDVGDSDCGECVKSAVQRAQVECGSSISGQVYLHKCFISYSYYPNGVPGRHSSSASSSSNSYSSSSSSSGNN

SEQ ID NO: 7954 - protein, 304 aa, Glycine max
MGFTRKPMFPVLLVLFITSLLEPPHVAESTSSDYSTLVYKGCSKEPFTDPNGVYSQALSALFGSLVSQSTKAKFYKTTSGSGQNTITGLFQCRGDLTNSDCYNCVSRLPVLCDKLCGKTTAARVQLLGCYILYEVAGFSQISGMQMLYKTCGATNAAGRGFEERRDTAFSVMENGVVSGHGFYTTSYQSLYVMGQCEGDVGDSDCGECVKNAVQRAQVECGSSISGQVFLHKCFISYSYYPNGVPSRSFFSSSASYSSSSSGQNPGKTAAIILGGAVAVAFLVILLLFARSLKKKHDGMSYVRQ

SEQ ID NO: 7955 - protein, 294 aa, Populus trichocarpa
MGFPLKPFSCFFFLCLLSVNLSQSALDYSTLVYKGCAKQAFQDPNGVYSQAISALFGSLVSQSTKTKFFKTTTGTGQTTITGLFQCRGDLSNTDCYNCVSKLPVLTDKLCGKTIAARIQLYGCYILYEVAGFTQISGMEMLYKTCGATNVAGSGFEERRDTAFSVMQNGVVSSHGFYATNYQSMYVLGQCEGDVGDSDCGECVKTAVQRAQVECGNSISGQIYLHKCFISYSYYPNGVPRRSSSSSSSSNSFSSGTGQNTGKTVAVIVGGAAGVGFLVICLLFARGLLKKHDDF

SEQ ID NO: 7956 - protein, 249 aa, Glycine max
MADSEKYNKKPSSSSFFSSPRLFTNFTPKGFHETETMMSPTSTLDSKPFSGFKNPFWSETNSPRTPVSEHKRYWDKLGSKGIGLGLVDALVDEEKHGEVSSKSESRMVVFGSQLKIQIPPLSPSESSKFVAEKGNSSSGVADANSQRVFMGCLSASEMELSEDYTRVISRGPNPRTTHIFDNCIIESSCFELGCSASSVKENGCFLDQTSYHSRSFLSVCFHCKKNLGQGKDIYMYRGERAFCSNECRY

SEQ ID NO: 7957 - protein, 541 aa, Medicago truncatula
MVERKVIPIAIAVLFFFIASSSFVHASDEADDAIFYESFDGDFDSRWIVSEKEEYNGVWKHSKSEGHDDFGLLVSEPARKYAIVKELDEPVILKDGSVVLRFETRLQNGLECGGAYIKYLQPQESGWKPKGFDNESPYSVMFGPDRCGATNKVHFIFRHKNPKTGKYVEHHLKFPPSVPSDKLSHVYTAILKPDNELRILVDGEEKKKANFLSEEDFEPSLIPSKTIPDPDDNKPEDWDERAKIPDPEAVKPEDWDEDAPMEIIDEEAEKPEGWLDDEPEEIDDPEATKPEDWDDEEDGEWEAPKIENPKCETAPGCGEWKRPTKRNPAYKGKWSAPFIDNPAYKGIWKPQEIPNPEYFELEKPDFEPIAAIGIEIWTMQDGILFDNVLIAKDDKIAESYRETTWKPKFNIEKEKQKAEEEAAAESEGIAGYQKKAFDLLYKIADIPFLSGQKDKIIEIIEKGEKQPNLTIGILASVVVVFVTIFFRLIFGGKKPAKVEAKVEKKTNTERTETSQAGGENEDNKEKEETANAPRRRPKRDN

SEQ ID NO: 7958 - protein, 546 aa, Glycine max
MGERKGIPMALGLLAMILFFIASSSSHLVRASDDADDAIFYESFDEDFDGRWIVSDKEDYNGVWKHAKSDGHDDYGLLVSEQARKYAIVKELAESVSLKDGTVVLQFETRLQNGLECGGAYIKYLRPQESGWKPKEFDNESPYSIMFGPDKCGATNKVHFIFKHKNPKSGEYVEHHLKYPPSVPSDKLTHVYTAILKPDNELQILIDGEEKKKANFLSSEDFEPPLIPSKTIPDPDDKKPEDWDERAKIPDPSAVKPDDWDEDAPMEILDEEAEKPEGWLDDEPEEIDDPEATKPEDWDDEEDGEWEAPKIENPKCEAAPGCGEWKRPTKRNPAYKGKWSAPYIDNPSYKGIWKPREIPNPEYFELAKPDFEPIAAIGIEIWTMQDGILFDNVLIANDDKVAESYRETTWKPKFTVEKDKLKAEEEAATGSDGISGFQKKVFDLLYKIADIPFLSEHKSKIFDLIEKAEKQPNLTIGILVAVVVVFVSIFFRLIFGGKKPAKVEKKPERTEASNNQGSGENEENKEKEKQKEEASNAARRRPRRET

SEQ ID NO: 7959 - protein, 546 aa, Glycine max
MGERKGIPMALGLLAMILFFIASSSSHLVRASGDADDAIFYESFDEDFDGRWIVSDKEDYNGVWKHAKSDGHDDYGLLVSEQARKYAIVKELAESVSLKDGTVVLQFETRLQNGLECGGAYIKYLRPQESGWKPKEFDNESPYSIMFGPDKCGATNKVHFIFKHKNPKSGEYVEHHLKYPPSVPSDKLTHVYTAILKPDNELQILIDGEEKKKANFLSSEDFEPPLIPSKTIPDPDDKKPEDWDERAKIPDPSAVKPDDWDEDAPMEILDEEAENPEGWLDDEPEEIDDPEATKPEDWDDEEDGEWEAPKIENPKCEAAPGCGEWKRPTKRNPAYKGKWSAPYIDNPSYKGIWKPREIPNPEYFELAKPDFEPIAAIGIEIWTMQDGILFDNVLIANDDKVAESYRETTWKPKFTVEKDKLKAEEEAATGSDGISGFQKKVFDLLYKIADIPFLSEHKSKIFDLIEKAEKQPNLTIGILVAVVVVFVSIFLRLIFGGKKPAKVEKKPERTEASNNQGSGENEENKEKEKQKEEASNAARRRPRRET

SEQ ID NO: 7960 - protein, 551 aa, Pisum sativum
MVDRKEIPLAMGLLAVLLFFVASSSSFHLVRASDEVDDAIFYESFDEDFDNRWIVSGKEEYNGVWKHSKSEGHDDFGLLVSEPARKYAIVKELDAPVSLKDGTVVLQFETRLQNGLECGGAYIKYLQTQESGWKPKGFDNESGYSIMFGPDRCGATNKVHFIFRHKNPKTGKHVEHHLKFPPSVPSDKLSHVYTAVLKDDNEVSILIDGEEKKKANFLSSEDFEPALIPSKTIPDPDDKKPEDWDERAKIPDPEAVKPEDWDEDAPREIIDEEAEKPEPWLDHEPEVDDPEAKPEDWDDEEDGEWEAPKIENPKCEAAPGCGEWKRPTKSNPAYKGKWSAPYIDNPNYKGIWKPQEIPNPEYFELEKPDFEPIAAIGIEIWTMQDGILFDNVLIAKDDKIAESYRETTWKPKFNIEKEKQKHEEEAAAAAAARSESEGIAGIQKKAFDLLYKIADIAFLSGQKEKIIEIIEKGEKQPNLTIGIIVSVVIVFVSIFFRLIFGGKKPANVEANVEKKKTNTETTSKQDGGEKEDNKEKEETANPPRRRPKRDN

SEQ ID NO: 7961 - protein, 533 aa, Brassica napus
MRDRQLFSAVLLVLAFVSLQKLCYCDDQTVLYESFDEAFDGRWIVSKNGDYEGVWKHEKSEGHDDYGLLVSEKARKYGIVKVLDEPLNLKDGTIVLQYEVRFQEGLECGGAYLKYLRPQEAGWTPEGFDSESPYSIMFGPDKCGATNKVHFILKHKNPKSGEYVEHHLKFPPSVPYDKLSHVYTAILKPDNEVRILVDGEEKKKANLLSGEDFEPALIPDKTIPDPEDKKPEDWDERAKIPDPNAVKPEDWDEDAPMEIEDDEAEKPEGWLDDEPEEVDDPEATKPEDWDDEEDGMWEAPKIDNPKCEAAPGCGEWKRPMKKNPAYKGKWSAPMIDNPAYKGIWKPRDIPNPDYFELDRPDYEPIAAIGIEIWTMQDGILFDNILIAKDEKVAESYRQTTWKPKFDVEKEKQKEEEKAAESADGLKSYQKVVFDLLNKVADISFLSAYKSKITELIEKAEEQPNLTIGVLVSIVIVFFSLFIKLIFGGKKASPAASVEKKKPEVGESSKSGDESEKKEETAAAPRKRQPRRDN

SEQ ID NO: 7962 - protein, 529 aa, Arabidopsis lyrata subsp. lyrata
MRQRQLFSGFLLLLAFVSFQKLCYCDDQTVLYESFDEPFDGRWIVSKNSDYEGVWKHAKSEGHEDYGLLVSEKARKYGIVKELDEPLNLKEGTVVLQYEVRFQEGLECGGAYLKYLRPQEAGWTPQGFDSESPYSIMFGPDKCGATNKVHFILKHKNPKSGEYVEHHLKFPPSVPYDKLSHVYTAILKPDNEVRILVDGEEKKKANLLSGEDFEPALIPAKTIPDPEDKKPEDWDERAKIPDPNAVKPDDWDEDAPMEIEDEEAEKPEGWLDDEPEEVDDPEATKPEDWDDEEDGMWEAPKIDNPKCEAAPGCGEWKRPMKRNPAYKGKWSSPLIDNPAYKGIWKPKDIPNPDYFELDRPDYEPIAAIGIEIWTMQDGILFDNILIAKDEKVAETYRQTTWKPKFDVEKEKQKAEEEAAGSADGLKSYQKVVFDLLNKVADLSFLSAYKSKITELIEKAEQQPNLTIGVLVSIVVVFFSLFLKLIFGGKKAAPVEKKKPEVAESSKSGDEAEKKEETAAPRKRQPRRDN

SEQ ID NO: 7963 - protein, 530 aa, Arabidopsis thaliana
MRQRQLFSVFLLLLAFVSFQKLCYCDDQTVLYESFDEPFDGRWIVSKNSDYEGVWKHAKSEGHEDYGLLVSEKARKYGIVKELDEPLNLKEGTVVLQYEVRFQEGLECGGAYLKYLRPQEAGWTPQGFDSESPYSIMFGPDKCGGTNKVHFILKHKNPKSGEYVEHHLKFPPSVPYDKLSHVYTAILKPDNEVRILVDGEEKKKANLLSGEDFEPALIPAKTIPDPEDKKPEDWDERAKIPDPNAVKPEDWDEDAPMEIEDEEAEKPEGWLDDEPEEVDDPEATKPEDWDDEEDGMWEAPKIDNPKCEAAPGCGEWKRPMKRNPAYKGKWSSPLIDNPAYKGIWKPRDIPNPDYFELDRPDYEPIAAIGIEIWTMQDGILFDNILIAKDEKVAETYRQTTWKPKFDVEKEKQKAEEEAAGSADGLKSYQKVVFDLLNKVADLSFLSAYKSKITELIEKAEQQPNLTIGVLVAIVVVFFSLFLKLIFGGKKAAAPVEKKKPEVAESSKSGDEAEKKEETAAPRKRQPRRDN

SEQ ID NO: 7964 - protein, 542 aa, Ricinus communis
MGEAKRISLRLALVFLVAFVSFVQLRADSDDNKIFYESFEDSFEGRWTLSAKDDYKGEWKHAKSEGHDEYGLLVSEKARKYAIVKELDEPATLKDGTIVLQFETRFQNGLECGGAYLKYLRPQEAGWTPKDFDNDSPYSIMFGPDKCGATNKVHFILKHKNPKSGEYIEHHLKYPPSVPSDKLTHVYTAILKPDNELRILVDGEEKKKANFLSSDDFEPPLVPAKTIPDPDDKKPEDWDERAKIPDPNAVKPDDWDEDAPMEIVDEDAEKPEGWLDDEPEEIDDPDAAKPEDWDDEEDGEWEAPKIDNPKCETAPGCGEWKRPMKRNPAYKGKWHAPLIDNPNYKGIWKPQEIPNPNYFELEKPDFEPIAAVGIEIWTMQDGILFGHILIADDEKVAESLRQTAWKPKFDAEKEKQKAEDAAAGSDGLAGFQKKVFDLLYQVADIPFLSEHKDKIIDIIEKGEKQPNLTIGILVSIVVVIFTVLFKILFGGKKPAKVEEKPAPAAETSKKEESSGEKAEENEKEDAAAAAAPPRRRQARREN

SEQ ID NO: 7965 - protein, 539 aa, Vitis vinifera
MGEGKRVSLLPLYVVFAVIACASLQLCASDSIFYESFDDDFEGRWIVSEKEDYKGVWKHAKSDGHEDHGLLVSEKARKYAIVKELDEAVSLKDGTAVLQFETRLQNGLECGGAYLKYLRPQDATWKSKEFDNESPYSIMFGPDKCGSTNKVHFIVKHKNPKSGEYIEHHLKYPPSVPSDKLSHVYTAILKPDHEVRILIDGEEKKKANFLSSEDFEPPFIPAKTIPDPDDKKPEDWDERPKIPDPNAVKPDDWDEDAPMEIEDEEAVKPEGWLDDEPEEIDDPEASKPEDWDDEEDGEWEAPKIDNPKCEIAPGCGEWKKPLKRNPAYKGKWHAPLIDNPNYKGIWKPQQIPNPDYFELDHPDIEPVAAIGIEIWTMQDGILFDNILITSDEKTAESYRETTWKPKFEVEKEKQKAEDAAAGFDVPSGFQKKVFDLLYKIADISFLNAYKPKLLDLIEKGEKQPNLTIGILVSIVIVFLTIIFKIIFGGKKPVKITRQTNNSTVAETSNDQGSSREKEEENEEEDTNAPPRKRSTRREN

SEQ ID NO: 7966 - protein, 539 aa, Vitis vinifera
  misc_feature (493)..(493): Xaa can be any naturally occurring amino acid
MGEGKRVSLLPLYVVFAVIACASLQLCASDSIFYESFDDDFEGRWIVSEKEDYKGVWKHAKSDGHEDHGLLVSEKARKYAIVKELDEAVSLKDGTAVLQFETRLQNGLECGGAYLKYLRPQDATWKSKEFDNESPYSIMFGPDKCGSTNKVHFIVKHKNPKSGEYIEHHLKYPPSVPSDKLSHVYTAILKPDHEVRILIDGEEKKKANFLSSEDFEPPFIPAKTIPDPDDKKPEDWDERPKIPDPNAVKPDDWDEDAPMEIEDEEAVKPEGWLDDEPEEIDDPEASKPEDWDDEEDGEWEAPKIDNPKCEIAPGCGEWKKPLKRNPAYKGKWHAPLIDNPNYKGIWKPQQIPNPDYFELDHPDIEPVAAIGIEIWTMQDGILFDNILITSDEKTAESYRETTWKPKFEVEKEKQKAEDAAAGFDVPSGFQKKVFDLLYKIADISFLNAYKPKLLDLIEKGEKQPNLTIGILVSIVIVFLTIIFKIIFGGKKPXKITRQTNNSTVAETSNDQGSSREKEEENEEEDTNAPPRKRSTRREN

SEQ ID NO: 7967 - protein, 186 aa, Glycine max
MAFRGFALCLVAVIVATMWSQNAAQSGCTNTLTSLSPCLNYIMGSSPTPSASCCSQLSSIVQSSPQCLCSVLNGGGSTFGITINQTLALSLPGACEVQTPPVSQCQAGNGPTTPSTAPVGSPSGSSAESPQGSITPSALDFPSGAGSKTVPSIDGGSSDGSAIKVPFHLVLYLLALVSCALTFTKF

SEQ ID NO: 7968 - protein, 362 aa, Glycine max
MGEEAMEGVISSKGMGFGENTSSSGVCPMMMMPLVTSHHVGHHPLNHPILNNPNPNEHTNTLFLPMPCTNNNHHPNRNNHNSNATELGYFMEIPNNNNDGSSSSPSSAVKAKIMAHPHYHRLLAAYVNCQKVGAPPEVVGRLEEACASAAVIMAGGTASIGEDPALDQFMEAYCEMLIKYEQELSKPFKEAMLFLQRIECQFKSLTISSSLDTTACNEAIDRNGPSEDVDVQTNIIDPQAEDQELKGQLLRKYRGYLGSLKQEFTKKRKKGKLPKEARQQLLEWWSRHYKWPYPSESQKLALAESTGLDQKQINNWFINQRKRHWKPSEDMQFVVVDPSHPHYYMENVLGNPFPMDLSHPML

SEQ ID NO: 7969 - protein, 371 aa, Pisum sativum
MEGSSNGSSSYVMAAFGENSGGLCPPMMMMPLVTSSHHHPINSNNNNANNTSCLFLPIPNSTNNNNHYTNNNNSNNTMLQNNHHTTQNTPGLGYYFMDNHNNNGASSSSSSSAVKAKIMAHPHYHRLLEAYINCQKVGAPSEVVTRLEEACASAVRMGGDAVGSGCIGEDPALDQFMEAYCEMLIKYEQELSKPLKEAMLFLQRIEVQFKNLTVSSSSDNIACNEGGDRNGSSEEDQVDLYNNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPTHPHYYMDNVLTNSFPMDLSNTML

SEQ ID NO: 7970 - protein, 379 aa, Glycine max
MEGGSSSSNGTSYLLAFGENNSGGLCPMTMMPLVTSHHAGHHPINPSNNNNVNTNCLFIPNCSNSTGTPSIMLHNNHNNNKTDDDDNNNNTGLGYYFMESDHHHHHHGNNNNNGSSSSSSSSAVKAKIMAHPHYHRLLAAYVNCQKVGAPPEVVARLEEACASAATMAGGDAAAGSSCIGEDPALDQFMEAYCEMLTKYEQELSKPLKEAMLFLQRIECQFKNLTISSSDFASNEGGDRNGSSEEDVDLHNMIDPQAEDRDLKGQLLRKYSGYLGSLKQEFMKKRKKGKLPKEARQQLLEWWNRHYKWPYPSESQKLALAESTGLDQKQINNWFINQRKRHWKPSEDMQFVVMDPSHPHYYMDNVLGNPFPMDLSHPML

SEQ ID NO: 7971 - protein, 361 aa, Populus tremula x Populus alba
MEGGDGGSSTTSCMMAFGDNSNGLCPMMMTPLMSSSSAHHHHRANEGDSSVSNTLFLPLPPTNNQGHNRIHSNASGSSSMIIDDHNHNNTVTATGCYFMDNNDGSSSSVKAKIMAHPHYHRLLAAYANCQKVGAPPEVVARLEEACASAASMAPANTGCIGEDPALDQFMEAYCEMLTKYEQELSKPLKEAMLFLQRVECQFKALTVSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 7972 - protein, 353 aa, Ricinus communis
MEGGSNSTSCMMAFGDNSNGLCPMMMMMPLMTSSHQHHHHHHHPNADLSSNTLFLPLPPTNNQDQNRNSSSGSSMILDDHNPNTNTGCYFMDNNDAAAASVKAKIMAHPHYHRLLAAYINCQKVGAPPEVVTRLEEACASAATMGQAGTSCIGEDPALDQFMEAYCEMLTKYEQELSKPFKEAMLFLQRVECQFKALTVASPNSALGEASDRNGSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDATHPHYYMDNVLGNPFPMDISPALL

SEQ ID NO: 7973 - protein, 373 aa, Populus trichocarpa x Populus deltoides
MEGGGGDGGSSTTSCMMAFGDNSNGLCPMMMMTPLMSSSSSAHHQHPHHHHRANEGDSSISNTLFLPLPPTNNQGHNRIHSNASGSSSMIIDDHNRNHNNNTVTATGCYFMDNNDGSSSSVKAKIMAHPHYHRLLAAYANCQKVGAPPEVVARLEEACASAASIAPANTGCIGEDPALDQFMEAYCEMLTKYEQELSKPLKEAMLFLQRVECQFKALTLSSPISGCGDGNDRNVSSEEEVDVNNNFIDPQAEDQELKGQLLRRYSGYLGSLKQEFMKKRKKGKLPKEARQQLLDWWSRHYKWPYPSESQKLALAESTGLDQKQINNWFINQRKRHWKPSEDMQFVVMDAGHPHYYMDNVLGNPFPMDISPTLL

SEQ ID NO: 7974 - protein, 374 aa, Medicago truncatula
MEGSSNGSCSYVMGAFGENSGGLCPPMMMMPLVTSSHHNAHHPINSNNNNTNANNTTGLFLPIPNSTNNNNNHYTNCNNNTSSIMLQNNHQNTPGLGYYFMDNINNHGSSSSSSSSVKSKIMAHPHYHRLLEAYINCQKVGAPSEVVARLEEACATAVRMGGDAVGSGCLGEDPALDQFMEAYCEMLIKYEQELSKPLKEAMLFLQRIEVQFKNLTVSSSSDNIACSEGGDRNGSSEEDHVDLYNNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLTNSYPMDLSNTML

SEQ ID NO: 7975 - protein, 383 aa, Prunus persica
MEGGSNGTCSMMAFGENSSSNGGGLCPMMMVPALMTSHHSHHHHHQHHHPTNPTNADPNTTTPFQLPQLPPSNHNRNSSTSSFIFNDHHPNNNNNHPAAAAACYFMDNNNSNHDGSSSSSSSVKAKIMAHPHYHRLLASYINCQKVGAPPEVVARLERACASAASIGQMMSSSSGSGCLGEDPALDQFMEAYCEMLTKYEQELSKPFKEAMIFLQRIESQFKALTLSSSSDSAVCGDGLDRNGSSEEEVDVNNNFIDPQAEDRELKGQLLRKYSGYLGSLKQEFMKERKKGKLPKEARQQLLDWWSRHYKWPYPSESQKLALAESTGLDQKQINNWFINQRKRHWKPSEDMQFVVVDATHPGHYYMDTVLGNPFPMDISRTLL

SEQ ID NO: 7976 - protein, 381 aa, Medicago truncatula
MEGSSNGSCSYVMGAFGENSGGLCPPMMMMPLVTSSHHNAHHPINSNNNNNNNNNNTNANNTTGLFLPIPNSTNNNNNHYTNCNNNTSSIMLQNNHQNTPGLGYYFMDNINNHGSSSSSSSSSVKSKIMAHPHYHRLLEAYINCQKVGAPSEVVARLEEACATAVRMGGDAVGSGCLGEDPALDQFMEAYCEMLIKYEQELSKPLKEAMLFLQRIEVQFKNLTVSSSSDNIACSEGGDRNGSSEEDHVDLYNNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLTNSYPMDLSNTML

SEQ ID NO: 7977 - protein, 361 aa, Vitis vinifera
MEGGSSSTACLMAFGDNSSNGLCPMMMMPLMTTSNPNAADANTLFLPLPPNHNHDLNRNSSRGSSLILENHNHNQHTTTTSTNNHHGSDPGCYFMETHGNNDGSTSSVKAKIMAHPHYHRLLAAYANCQKVGAPPEVVARLEEACASEAAMVRTGTSCIGEDPALDQFMEAYCEMLTKYEQELSKPFKEAMLFLSRVECQFKALTVSSSDSAGGEGLDRNGSSEEEVDVNNNFIDPQAEDRELKGQLLRKYSGYLSSLKQEFMKKRKKGKLPKEARQQLLDWWSRHYKWPYPSESQKLALAESTGLDQKQINNWFINQRKRHWKPSEDMQFVVMDATHPGHYYMDNVLGNPFPMDLSPTLL

SEQ ID NO: 7978 - protein, 387 aa, Ricinus communis
MATTSSKESSSSSTTEGGGGGHGNKIKGVPTHGGRYVQYNAYGNLFEVSSKYVPPIRPIGRGAYGIVCAAVNSETREEVAIKKIGNAFDNRVDAKRTLREIKLLRHMDHENIIAIRDIIRPPKKEAFNDVYIVYELMDTDLHHIIRSDQPLTDDHCQYFLYQLLRGLKYVHSAHVLHRDLKPSNLLLNANCDLKIGDFGLARTTSETDFMTEYVVTRWYRAPELLLNCSEYTAAIDIWSVGCILGEIVTREPLFPGKDYVHQLRLITELIGSPDDASLGFLRSDNARRYVRQLPQYRKQNFTLRFPNVSAGAADLLEKMLVFDPNKRITVEEALCHPYLSSLHDINDEPVCPRPFHFDFEHPSCTEEHIKDLIWRESMKFNPDPPTH

SEQ ID NO: 7979 - protein, 362 aa, Populus trichocarpa
SKIKGVLTHGGRYVQYNVYGNLFEVSSKYVPPIRPIGRGAYGIVCAAVNSDTHEEVAIKKIGNAFDNRIDAKRTLREIMLLRHMDHENVIAIRDITRPPKKEAFNDVYIVYELMDTDLHQIIRSDQALNDDHCQYFLYQLLRGLKYVHSANVLHRDLKPSNLLLNSNCDLKIGDFGLARTTSETDFMTEYVVTRWYRAPELLLNCSEYTAAIDIWSVGCILGEIMTREPLFPGKDYVHQLRLITELIGSPDDASLGFLRSNNARRYVRQLPQYKKQNFSARFPNMSPGAVDLLEKMLVFDPNNRITVDEALCHSYLSSLHDINDEPVCPRPFHFDFEHPSCTEEHIKELIWRESVKFNPDLP

SEQ ID NO: 7980 - protein, 377 aa, Populus trichocarpa
MTVEKGGGAVRRNGSEIKGLLTHGGRYVQYNVYGNLFEVSSKYVPPVRPIGRGAYGIVCAAVNSETHEEVAIKKIGNAFDNRIDAKRTLREIKLLCHMDHENVIAMRDIIRPPKMEAFNDVYIVYELMDTDLHQIIRSEQSLNDDHCQYFLYQLLRGLKYVHSANVLHRDLKPSNLLLNSNCDLKIGDFGLARTTAETDFMTEYVVTRWYRAPELLLNCSEYTAAIDIWSVGCILGEIMTREPLFPGKDYVHQLRLITELIGSPDDASLGFLRSNNARRYVRQLPQYKKKIFSATFPNMSPGAIDLLEKMLVFDPSNRITVDEALCHQYLSSLHAINDEPVCPRPFHFDFEQPSCTEEHIKELIWRESMKFNPDPSC

SEQ ID NO: 7981 - protein, 375 aa, Vitis vinifera
MSMDASSGSGDGGNIKGVPTHGGRYVRYNVYGNFFEVSAKYVPPIRPVGRGAYGIVCAAVNSETHEEVAIKKIGNAFDNRIDAKRTLREIKLLRHMDHENVIAIKDIIRPPKKETFNDVYIVYELMDTDLHQIICSNQSLTDDHCQYFLYQLLRGLKYVHSANVLHRDLKPSNLLLNANCDLKIGDFGLARTTSETDFMTEYVVTRWYRAPELLLNCSEYTAAIDIWSVGCILGEIMTREPLFPGKDYVHQLRLITELLGSPDDASLGFLRSNNARRYVRQLPQYPKQQISARFPNMSPSAVDLLEKMLVFDPTKRITVDEALCHPYLSSLHDINDEPVCPSPFSFDFEQSSITEENIKELIWRESVKFNPDPTH

SEQ ID NO: 7982 - protein, 374 aa, Petroselinum crispum
MESSSAATADHTHIKGVPTHGGRYVQYNVYGNLFEVSRKYVPPIRPVGRGAYGIVCAAMNSDTREEVAIKKIGNAFDNRIDAKRTLREIKLLRHMNHENVIAIKDIIRPPQIESFNDVYIVYELMDTDLHQIIRSNQQLTDDHCRYFLYQLLRGLKYVHSANVLHRDLKPSNLLLNANCDLKIGDFGLARTTSETDFMTEYVVTRWYRAPELLLNCSEYTAAIDIWSVGCILGEVMTRQPLFPGKDYVHQLRLITELIGSPDDASLGFLRSDNARRYVRQLPQYPKQQFSARFLNKSPGALDLLEKMLIFDPNRRITVDEALCHPYLAALHDINEEPVCPRPFSFDFEQPTCTEENIKELIWKESVKFNPDPIL

SEQ ID NO: 7983 - protein, 372 aa, Populus trichocarpa
MSSLESSSGGDPNIKGIPTHGGRYVQYNVYGNLFEVSMKYVPPIRPVGRGAYGIVCAAVNAETREEVAIKKIGNAFDNRIDAKRTLREIKLLRHMDHENVIAIKDIIRPPQTENFNDVYIVYELMDTDLHQIIRSNQQLTDDHCRYFLYQLLRGLKYVHSANVLHRDLKPSNLFLNANCDLKIGDFGLARTTSETDFMTEYVVTRWYRAPELLLNCSEYTAAIDIWSVGCILGEILTRQPLFPGKDYVHQLRLVTELIGSPDDSCLGFLRSENARRYVRQLPQYPRQNFAARFPNISAGAADLLEKMLVFDPNRRITVDEALCHPYLAPLHDINEEPVCPRPFLFDFEQPSFTEENIKELIWMESVNFNPGP

SEQ ID NO: 7984 - protein, 375 aa, Vitis vinifera
MSMESSAGSVEGNIRGVSTHGGRYVQYNVYGNLFEVSRKYVPPIRPVGRGAYGIVCAAMNSETREEVAIKKIGNAFDNRIDAKRTLREIKLLRHMDHENVIVLKDIIRPPKRENFNDVYIVYELMDTDLHQIIRSNQPLNDDHCRYFLYQVLRGLKYVHSANVLHRDLKPSNLLLNANCDLKIGDFGLARTTSETDFMTEYVVTRWYRAPELLLNCSEYTAAIDIWSVGCILGEIMTRQPLFPGRDYVHQLRLITELIGSPDDSSLGFLRSDNARRYVRQLPQYPRQQFQARFPNMSPGAIDLLEKMLVFDPNRRITVEGALSHPYLAPLHDINEEPVCPRPFVFDFEQPSFTEENIKELIWRESVKFNPDPPVH

SEQ ID NO: 7985 - protein, 370 aa, Ricinus communis
MESSAGSSEHNVRGLPTHGGRYVQYNIYGNLFEVSRKYVPPIRPVGRGANGIVCAAKNAETQEEVAIKKIGNAFDNRIDAKRTLREIKLLRHMDHENIVAIKDIIRPPQKENFNDVYIVSELMDTDLHHIIRSNQSLTDDHCRYFLYQLLRGLKYVHSAHVLHRDLKPSNLLLNANCDLKIADFGLARTTSETDFMTEYVVTRWYRAPELLLNCSEYTAAIDIWSVGCILGEIMTRQPLFPGKDYVHQLRLITELIGSPDDNSLGFLRSDNARRYVRQLPQYPRKNFATRFPNMSSGAIDLLERMLVFDPNRRITVDEALCHPYLAPLHDINEEPVCPRPFNFDFEQPSFTEENIKELIWRESVKFNPDP

SEQ ID NO: 7986 - protein, 375 aa, Glycine max
MGSKGKRKEQESIITRVMAHGGRYVQYNVYGNLFEVSSKYVPPIRPVGRGAYGIVCAAVNCDTHEEVAIKKIGNAFDNIIDAKRTLREIKLLRHMDHENIIAIRDIIRPPRKDAFNDVYIVYELMDTDLHQIIRSDQPLNDDHCQYFLYQLLRGLKYVHSANILHRDLKPSNLLLNSNCDLKIADFGLARTTSETDFMTEYVVTRWYRAPELLLNCSEYTSAIDVWSVGCIFGEIMTREPLFPGKDYVHQLRLITELLGSPDDASLGFLRSGNAKRYVRQLPQYRKQNFSARFPNMSPEALDLLEKMLIFDPNKRITVDEALCHPYLSSLHDINDEPVGPGQFNFDFEQPTCTEEHIKELIWRESVKYNPDPPSQ

SEQ ID NO: 7987 - protein, 371 aa, Medicago sativa
MSVESAENNIRGVPTHGGRYLQYNIYGNLFEVSRKYVPPIRSVGRGAYGIVCAAVNAETREEVAIKKIGNAFDNRIDAKRTLREIKLLRHMDHENVMSIKDIIRPPQKENFNHVYIVSELMDTDLHQIIRSNQPMTDDHCRYFVYQLLRGLKYVHSANVLHRDLKPSNLLLNANCDLKIGDFGLARTTSETDFMTEYVVTRWYRAPELLLNCSDYTAAIDIWSVGCILGEIVTRQPLFPGRDYVHQLRLVTELIGSPDDASLGFLRSENARRYVRQLPQYPKQNFSARFPNMSPGAVDLLEKMLIFDPSKRIKVDEALCHPYMAPLHDINEEPVCARPFSFDFEEPMFTEEDIKELIWKESVRFNPDPPIN

SEQ ID NO: 7988 - protein, 216 aa, Hevea brasiliensis
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKQRLADTDSKAEPTTIKINQPDQAGGAGQAGQKSACCGS

SEQ ID NO: 7989 - protein, 216 aa, Hevea brasiliensis
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADKYGIKFFETSAKTNLNVEEVFFSIARDIKQRLADTDSKAEPQTIKINQPDQAGGANQAAQKSACCGS

SEQ ID NO: 7990 - protein, 216 aa, Vitis vinifera
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKQRLADTDSRAEPTAIRINQPDQASGVGQTAQKSACCGS

SEQ ID NO: 7991 - protein, 216 aa, Vitis vinifera
  misc_feature (202)..(202): Xaa can be any naturally occurring amino acid
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKQRLADTDSRAEPTAIRINQPDQAXGVGQTAQKSACCGS

SEQ ID NO: 7992 - protein, 216 aa, Ricinus communis
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKQRLADTDSRAEPQTIKINQPDQAGSASQAAPKSACCGS

SEQ ID NO: 7993 - protein, 216 aa, Nicotiana tabacum
MATPPARARADYDYLIKLLLIGDSGVGKSCLLLRFSDGSFTTSFITTIGIDFKIRTIELDSKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNMNVEEVFFSIARDIKQRLAESDSKAEPQTIRINQPDQAAGAAQSAQKSACCGS

SEQ ID NO: 7994 - protein, 216 aa, Hevea brasiliensis
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKKRLAETDSKAEPQTIKINQPDQAASGGQAAQKSACCGS

SEQ ID NO: 7995 - protein, 216 aa, Nicotiana tabacum
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNMNVEEVFFSIARDIKQRLAESDSKAEPQTIRINQPDQAAGASQSVQKSACCGS

SEQ ID NO: 7996 - protein, 216 aa, Vitis vinifera
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKVLVGNKADMDESKRAVPTSKGQALADEYGIKFFETSAKTNLNVEEVFFSIAKDIKQRLAETDSKAEPQTIKINQPDQAANGGQAPQKSACCGS

SEQ ID NO: 7997 - protein, 214 aa, Glycine max
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDEASFNNIRNWIRNIEQHASDNVNKILVGNKADMDESKRAVPTSKGQALADEYGIKFFETSAKTNLNVEEVFFSIARDIKQRLADTDTKAEPSTIKINQDQSGGAGQAAQKSACCG

SEQ ID NO: 7998 - protein, 389 aa, Medicago truncatula
MFCGVVSTSFTSILPRKQHHSTPFSPFKSIQCSLPGAVAEPKTNNATEPLLLNAVRGLDVERPPVWLMRQAGRYMKSYQIICEKYPSFRERSENVDLVVEISLQPWKVFQPDGVILFSDILTPLSGMNIPFDIVKGKGPVIFDPVHSAGQVDQVREFIPEESVPYVGEALSILRKEVDNKSAVLGFVGAPFTLASYVVEGGSSKHFSKIKRLAFSEPKILHSLLQKFTTSMARYIQYQADNGAQAVQIFDSWATELSPVDFERFSLPYLKQIIDTVKKSHPELPLILYASGSGGLLERIALTGVDVVSLDWTVDMADGRRRLGPNVAIQGNVDPGVLFGSKELITDRIHDTVRKAGRGKHILNLGHGIVVGTPEENVAHFFEVAKGIKY

SEQ ID NO: 7999 - protein, 387 aa, Glycine max
MLCVNTAFTSFLPRKSICFFSSKSTTPISCTLQGTVAEPKSTAAGEPLLLNAVRGIDVERPPVWLMRQAGRYMKSYQTICEKYPSFRERSENVDLVVEISLQPWHVFKPDGVILFSDILTPLSGMNIPFDIVKGKGPVIFDPIHTAAQVDQVREFIPEESVPYVGEALTILRKEVDNKAAVLGFVGAPFTLASYVVEGGSSKNFSKIKRLAFSESKILHSLLQKFTTSMARYIQYQADNGAQAVQIFDSWATELSPVDFEEFSLPYLKQIIDTVKKSHPNLPLILYASGSGGLLERLALTGVDVVSLDWTVDMADGRRRLGPNIAVQGNVDPGVLFGSKEFITDRINDTVRKAGRGKHILNLGHGIKVGTPEENVAHFFEVAKSIRY

SEQ ID NO: 8000 - protein, 389 aa, Ricinus communis
MSCICSISSISSFSTLYSSPRKSVSKPPIIHCSLPGTVAEPKPASVAEPLLLNAVRGEDVERPPVWLMRQAGRYMKSYQIICEKYPSFRERSENVDLVVEISLQPWNVFKPDGVILFSDILTPLSGMNIPFDIVKGKGPIIFNPLRTAEDVDQVREFVPEESVPYVGESLTILRKEVDNKAAVLGFVGAPFTLASYCVEGGSSKHFSKIKRLAFSQPEVLHALLQKFATSMAKYVQYQADNGAQAVQIFDSWATELSPVDFEQFSLPYLKQIVDTVKKTHPNLPLILYASGSGGLLERLALTGVDVVSLDWTVDMAEGRRRLGPDMAVQGNVDPGVLFGSKEFITNRINDVVRKAGKGKHILNLGHGIVVGTPEENVAHFFEVAKGIRY

SEQ ID NO: 8001 - protein, 392 aa, Vitis vinifera
MSCIYSSSISSFSALSTSLRSRSPSPSNSKPRIYCALGGTVAEPIIINATEPLLLTAVRGEDVERPPVWLMRQAGRYMKSYQIICEKYPSFRERSENVDLVVEISLQPWKVFKPDGVILFSDILTPLSGMNIPFDIIKGKGPVIFNPLRTADDVEQVREFVPEDSVPYVGEALTILRKEVDNAAAVLGFVGAPFTLASYVVEGGSSKHFSKIKRLAFSQPKVLHALLQKFTTSMAKYIQYQADNGAQAVQIFDSWATELSPVDFEEFSLPYLKQIVDSVKQTHPNLPLILYASGSGGLLERLPLTGVDVVSLDWTVDMAEGRRRLGTDVAVQGNIDPGVLFGSKEFITNRINDTVRKAGKGKHILNLGHGIVVGTPEENVAHFFEVARGIRY

SEQ ID NO: 8002 - protein, 403 aa, Populus trichocarpa
MSSICSFTSSISSISPFTSPRKSLNYNNKYTPIIHSSLQGTVAEPKASSVAEPLLLNAVRGEDVERPPVWLMRQAGRNWFTSYAHVSFKMSYQIICEKHPSFRERSENVDLVVEISLQPWKVFRPDGVILFSDILTPLSGMNIPFDIVKGKGPVIFNPLRTADDVDQVREFVPEESVPYVGEALTVLRKEVENKAAVLGFVGAPFTLASYVVEGGSSKHFTKIKRLAFSQPKVLHALLQKFATSMAKYIQYQADSGAQTVQIFDSWATELSPVDFEEFSLPYLKQIVDTVKQSHPNLPLILYASGSGGLLERLALTGVDVVSLDWSVDMAEGRKRLGPDVAVQGNVDPGVLFGSKEFITNRIYDVVKKAGKGKHILNLGHGIVVGTPEENVAHFFEVAKGIRY

SEQ ID NO: 8003 - protein, 391 aa, Nicotiana tabacum
MMSCNYSFSSISPSSKSAFTSPSNFNLNPRLICCSAGGTVAEPKAINATQPLLLDAVRGKEVERPPVWLMRQAGRYMKSYQLLCEKYPLFRDRSENVDLVVEISLQPWKVFRPDGVILFSDILTPLSGMNIPFDIIKGKGPVIFDPLRTAADVEKVREFIPEKSVPYVGEALTILRKEVNNQAAVLGFVGAPFTLASYVVEGGSSKNFTKIKRLAFAEPKVLHALLQKFATSMAKYIRYQADSGAQAVQIFDSWATELSPVDFEEFSLPYLKQIVDSVKLTHPNLPLILYASGSGGLLERLPLTGVDVVSLDWTVDMADGRRRLGPNVAIQGNVDPGVLFGSKEFITNRINDTVKKAGKGKHILNLGHGIKVGTPEENFAHFFEIAKGLRY

SEQ ID NO: 8004 - protein, 353 aa, Nicotiana tabacum
TVAEPKAINATQPLLLDAVRGKEVERPPVWLMRQAGRYMKSYQLLCEKYPLFRDRSENVDLVVEISLQPWKVFRPDGVILFSDILTPLSGMNIPFDIIKGKGPVIFDPLRTAADVEKVREFIPEKSVPYVGEALTILRKEVNNQAAVLGFVGAPFTLASYVVEGGSSKNFTKIKRLAFAEPKVLHALLQKFATSMAKYIRYQADSGAQAVQIFDSWATELSPVDFEEFSLPYLKQIVDSVKLTHPNLPLILYASGSGGLLERLPLTGVDVVSLDWTVDMADGRRRLGPNVAIQGNVDPGVLFGSKEFITNRINDTVKKAGKGKHILNLGHGIKVGTPEENFAHFFEIAKGLRY

SEQ ID NO: 8005 - protein, 459 aa, Vitis vinifera
MSCIYSSSISSFSALSTSLRSRSPSPSNSKPRIYCALGGTVAEPIIINATEPLLLTAVRGEDVERPPVWLMRQAGRYMKSYQIICEKYPSFRERSENVDLVVEISLQPWKVFKPDGVILFSDILTPLSGMNIPFDIIKGKGPVIFNPLRTADDVEQVREFVPEDSVPYVGEALTILRKEVDNAAAVLGFVGAPFTLASYVVEGGSSKHFSKIKRLAFSQPKVLHALLQKFTTSMAKYIQYQADNGAQAVQIFDSWATELSPVDFEEFSLPYLKQIVDSVKQTHPNLPLILYASGSGGLLERLPLTGVDVVSLDWTVDMAEGRRRLGTDVAVQGNIDPGVLFGSKEFITNRINDTVRKAGKGKHILNLGHGICKSSTLPLLYWPASLNAKTRECRKMCVNAGNCCSEAHEILSPLGHPLFILDEVGHASQSTFELYARMHIETTSCSISLVLNRDLVEDG

SEQ ID NO: 8006 - protein, 394 aa, Arabidopsis lyrata subsp. lyrata
MSILQVSTSSLSSSILLSISPRKSLSSPKSCRIVRCSVEGTTVTERKVSAISEPLLLRAVKGEVVDRPPVWLMRQAGRYMKSYQTLCEKYPSFRDRSENADLVVEISLQPWKVFKPDGVILFSDILTPLSGMNIPFDIVKGKGPIIFNPPQSAADVDQVREFIPEESVPYVGEALRRLRNEVNNEAAVLGFVGAPFTLSSYVIEGGSSKNFTQIKRLAFSQPKVLHALLQKFTTSMITYIRYQADSGAQAVQIFDSWATELSPVDFEEFSLPYLKQIVEAVKQTHPNLPLILYASGSGGLLERLARTGVDVVSLDWTVDMAEGRDRLGRDLAVQGNVDPGVLFGSKEFITSRIHDTVKKAGRDKHILNLGHGIKVGTPEENVAHFFEVAQGIRY

SEQ ID NO: 8007 - protein, 390 aa, Oryza sativa Japonica Group
MATACPPLSLQPAYLSGRSARARRPPPAVRCSAVGEVMAETAAVGTAEEPLLVSAIKGRKVERPPVWLMRQAGRYMKSYQLLCERHPSFRERSENVDLVVEISLQPWKVFKPDGVILFSDILTPLPGMNIPFDIVKGKGPVIFDPLRTAAAVNEVREFVPEEWVPYVGQALNILREEVNNEAAVLGFVGAPFTLASYCVEGGSSKNFSKIKKMAFSEPEILHNLLQKFTTSMANYIKYQADNGAQAVQIFDSWATELSPVDFEEFSLPYLKQIVDSVKETHPELPLILYASGSGGLLERLPLTGVDVVSLDWTVDMAEGRKRLGSNIAVQGNVDPGVLFGSKEFISKRIFDTVQKAGNSGHVLNLGHGIKVGTPEENVAHFFEVAKGIRY

SEQ ID NO: 8008 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHFVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 8009 - protein, 380 aa, Phaseolus acutifolius
MSSTAGQVIKCKAAVAWEAGKPLVMEEVEVAPPKAGEVRLKILYTSLCHTDVYFWEAKGQTPLFPRIFGHEAGGIVESVGEGVTHLKPGDHALPVFTGECGECAHCKSEESNMCDLLRINTDRGVMIHDSQTRFSIKGQPIYHSVGTSTFSEYTVVHAGCVAKVNPAAPLDKICVLSCGICTGLGATVNVAKPKPGSSVAIFGLGAVGLAAAEGARISGASRIIGVDLVSSRFEEAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPLVVEQYMNGELELDKFITHTVPFSEINKAFDYMLKGESIRCIIRMGE

SEQ ID NO: 8010 - protein, 380 aa, Lotus corniculatus
MSSTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 8011 - protein, 380 aa, Lotus japonicus
MSTTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 8012 - protein, 380 aa, Trifolium repens
MSNTAGQVIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCNLLRINTDRGVMINDNKSRFSIKGQPVHHFVGTSTFSEYTVVHAGCVAKINPDAPLDKVCILSCGICTGLGATVNVAKPKPGSSVAIFGLGAVGLAAAEGARMSGASRIIGVDLVSSRFELAKKFGVNEFVNPKDHDKPVQQVIAEMTDGGVDRAVECTGSIQAMISAFECVHDGWGVAVLVGVPKKDDAFKTHPMNFLNERTLKGTFYGNYKPRTDLPNVVEQYMKGELELEKFITHSIPFSEINKAFDYMLKGESIRCIIRMEE

SEQ ID NO: 8013 - protein, 380 aa, Pisum sativum
MSNTVGQIIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCDLLRINTDRGVMLNDNKSRFSIKGQPVHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKEHDKPVQQVIAEMTNGGVDRAVECTGSIQAMISAFECVHDGWGVAVLVGVPSKDDAFKTHPMNFLNERTLKGTFYGNYKPRTDLPNVVEKYMKGELELEKFITHTVPFSEINKAFDYMLKGESIRCIIKMEE

SEQ ID NO: 8014 - protein, 380 aa, Populus trichocarpa
MSSTAGQVIRCKAAVAWEAGKPLVMEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSIKGQPIYHFVGTSTFSEYTVVHVGCVAKINPAAPLDKVCVLSCGISTGLGATLNVAKPKKGSSVAIFGLGAVGLAAAEGARIAGASRIIGVDLNSNRFDEAKKFGVTEFVNPKDHNKPVQEVIAEMTNGGVDRSVECTGSINAMISAFECVHDGWGVAVLVGVPNKDDSFKTHPMNVLNERTLKGTFFGNYKPRSDLPSVVEKYMNKELELEKFITHEVPFSEINKAFEYMLSGAGLRCIIRMGA

SEQ ID NO: 8015 - protein, 380 aa, Populus trichocarpa
MSSTAGQVIRCKAAVAWEAGKPLVMEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSIRGQPIYHFVGTSTFSEYTVVHVGCLAKINPAAPLDKVCILSCGVSTGLGATLNVAKPKKGSSVAIFGLGAVGLAAAEGARIAGASRIIGVDLNSNRFNEAKKFGVTEFVNPKDYKKPVQEVIAEMTNGGVDRSVECTGSINAMISAFECVHDGWGVAVLVGVPNKDDSFKTHPMSFLNEKTLKGTFFGNYKPRSDLPSVVEMYMNKELELEKFITHEVPFSEINKAFDYMLSGASLRCIIRMEA

SEQ ID NO: 8016 - protein, 380 aa, Populus trichocarpa
MSSTAGQVICCKAAVAWEAGKPLVIEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSIRGQPIYHFVGTSTFSEYTVVHVGCVAKINPAAPLDKVCVLSCGISTGLGATLNVAKPKKGSSVAIFGLGAVGLAAAEGARIAGASRIIGVDLNSNRFDEAKKFGVTEFVNPKDHNKPVQEVIAEMTNGGVDRSVECTGSVNAMISAFECVHDGWGVAVLVGVPNKDDSFKTHPMNVLNERTLKGTFFGNYKPRSDLPSVVEKYMNKELELEKFITHEVPFSEINKAFEYMLSGAGLRCIIRMGA

SEQ ID NO: 8017 - protein, 380 aa, Populus trichocarpa
MSSTAGQVICCKAAVAWEAGKPLVIEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSIRGQPIYHFVGTSTFSEYTVVHVGCVAKINPAAPLDKVCVLSCGISTGLGATLNVAKPKKGSSIAIFGLGAVGLAAAEGARIAGASRIIGVDLNSNRFDEAKKFGVTEFVNPKDHNKPVQEVIAEMTNGGVDRSVECTGSVNAMISAFECVHDGWGVAVLVGVPNKDDSFKTHPMNVLNERTLKGTFFGNYKPRSDLPSVVEKYMNKELELEKFITHEVPFSEINKAFEYMLSGAGLRCIIRMGA

SEQ ID NO: 8018 - protein, 189 aa, Glycine max
MVTEEEISEAVQSLLRESNPSRFTTLNQVVEELQAKLGHDLTHKIDFITAQINLLFGSRQPPQNPHRQLQQPKDHFAPPPNPNFHSAPVSVGFQLQNFSSSNAVVAAATAADASRIEAPSAPVVVEGNQVPKESTQTKVKRRGGPGGLTKICGVSPELQVIVGQPALSRTEIVKQLWAYIRKNNLQDPS

SEQ ID NO: 8019 - protein, 511 aa, Glycine max
MVTTTVDSSSNHHSPTAADTSNNFPQKTMPSPWAQVVRGADAEPNDQSPPSSSSSSSLDSINSNGPAVQTSDIAVKPAWKKPEANGVAEVGPVMGAHSWPDLSESTKPTAKLTSDSSVKTAADEESTTTPQGPVTSDPPQKQATANAKPSPTPAMNYGMANRQRSMKQRGGANGNNVGSGPVQNNFSGTTPNLPPPPPPPPFPVLLMPPSTFAHGIPGAPVPTPRDPYRNNNWDARPQHGGFMPPMNEHRSPSHRGNAGHHPRGEGPYHNSYGNRRDQDRVGYANTRDAHVNQQRMPPRGLMRPPPPNPAPFMGPQPMRPLANPAGFPEYYYFPTLQFEPFGGMPFFTHAPPPAMFYPVAETPLTNTIANQIDYYFSDANLVKDEYLRSNMDEQGWVPISLIASFPRVRSLTSNIKLILDSLRTSTFVEVQGDKLRRRTEWMKWLPSVQLLAKSGSISPSESSSNNLAADFEKITVDDAKVNAKPTANDDAAGESSTQSQVPNDATTVSSN

SEQ ID NO: 8020 - protein, 436 aa, Glycine max
MVTTTVDSSSNHYSPTAATAAADTSNNFPRKNLPSPWAQVVRGADAEPNHQSPPSSSSSSFSSLDSINSNGPAVQTSDTTVKPAWKKPESNGVSEVGPVMGAHSWPDLSESTKPTAKLTSDSSVKTAADEESLTTTPQDPVNSDSPQKQAIGNANPSPTPAMNYGMANRQRSMKQRGGGNAGHHPRGDGPYHNSYGSRRDQDRGGYANTRDAHVNQQRMPPRGLMRPPPPNPAPFMGPQPMRPFANPAGFPEFYYFPTLQFEPFGGMPFFTHAPPPAMFFPVAETPLTNTIANQIDYYFSDANLVKDEYLRSNMDEQGWVPITLIASFPRVRSLTSNIKLILDSLRTSTVVEVQGDKLRRCNEWMKWLPSAQLRANSGSISPSGSSSNNLAADFEKITVDEAISHKVNTEPTTNEDAAGESSTQSQVPNDATVSSN

SEQ ID NO: 8021 - protein, 74 aa, Glycine max
YPLVDKLEHETAAKVTGMLLEMDQPEVLHLIESPDALKAKVVEAMDVLRKVTQQQSNSPADQLASLSLNDNVES

SEQ ID NO: 8022 - protein, 630 aa, Glycine max
MAQVLENPTIDAAASGANPSLTTISLYVGDLHHDVNDPQLYDLFNQVAQVVSVRICRDVATQQSLGYGYVNFSNAHDAAKAIDVLNFTPLNGKIIRIMYSIRDPSARKSGAANVFIKNLDKAIDHKALYDTFSAFGNILSCKVATDASGQSKGHGFVQFESEESAQNAIDKLNGMLINDKQVFVGPFLRKQDRESALSGTKFNNVFVKNLLDSMTEADLERIFGEYGAITSAVVMRDVDGKSKGFGFVNFANVDDAAKAVEALNGKNFDGKEWYVGKAQKKSERELELKGQHEQITKETVDKYHGTNLYIKNLDDSVGDEELMELFSEFGTITSCKVMRDPNGISRGSGFVSFSIAEGATRALGEMNGKMVAGKPLYVALAQRKEDRRARLQAQFSQSRPAAITPNVSPRMPLYPLGAPAIGQQFLYGQAAPATIPQAAFGYQQHFVPGMRPGGAPNFYVPLVQQGQQGQRPGGHRGSGPMQQLQQPLPLMHQQMLPRGHVYRYPSGSNMQNIQLAGVPGGMVTYGIGQQMPTQALASALANATPEQQRTMLGEALYPLVDKLEHEAAAKVTGMLLEMDQPEVLHLIESPDALKAKVVEAMDVLKKVTQQQSNSPADQLASLSLNDNVES

SEQ ID NO: 8023 - protein, 654 aa, Vitis vinifera
MAQVQVQAQAQPPVSAANGGASNGGGNQFVSTSLYVGDLESNVTDSHLYDLFGQLGPVVSVRVCRDLSTRRSLGYGYVNYGNTQDAARALDMLNFTPLNGKPIRIMYSFRDPSIRRSGTANIFIKNLDKAIDNKALYDTFSTFGAILSCKIATDASGQSKGYGFVQFDNEESAKNATDKLNGMLLNDKQVYVGPFVRKQERESATNKTKFNNVYVKNLLESTTDEDLKNIFGEYGPITSAVVMQDGDGKSKCFGFVNFENADDAARSVEALNGKKFDDKEWYVGKAQKKTEREVELKGRFEQSLKEAVDKFQGLNLYVKNLDDSIADDKLRELFSEFGTITSCKVMRDPNGISRGSGFVAFSTAEEASRALADMNGKMVASKPLYVALAQRKEDRRARLQAQFSQMRPAAMAPSVGPRMSMYPPGAPGLGQQLFYGQGPPALIPPQPGFGYQHQLVPGMRPGAAPMPNFFVPMVQPGQPNQRPGGRRSGTGPVQQTQQPLPLMQQQMLPRGRVYRYPPGRNMADVPIPGVPGGMLSAPYDMAGMPFRDAAVSQPMPIGALATALANAPPDQQRTLLGENLYPLVDQLEHEMAAKVTGMLLEMDQTEVLHLLESPEALKAKVAEAMEVLRNVAQQQANNPTDRMASLSLNDTLTS

SEQ ID NO: 8024 - protein, 642 aa, Jatropha curcas
MAQVQVQPQAPVSAPNGVVSNGVNQFVPTSLYVGDLEQNVTETQLYDLFNQHGQVVSIRVCRDLTSRRSLGYGYVNYNNVHDAAQAIEVLNFTPVNGKPIRIMYSYRDPTIRKSGTGNIYIKNLDKAIDNKALHDTFSAFGSILSCKVATDSLGQSLGYGFVQFDNEESAKNAIDKLNGMLLNDKQVYVGPFLRKQERESAIDKATFNNVYVKNLSETTTEEDLKKIFGEYGTITSAVVMRDGNGKSRCFGFVNFENPDDAAQSVEALNGKTFDEKEWYVGKAQKKSEREVELKGRFEQTLKETVDKFQGLNLYVKNLDDSITDDKLKELFSEFGTITSCKVMRDPNGVSRGSGFVAFSTAEEASRALTEMNGKMVVSKPLYVALAQRKEERRARLQAQYSQIRPAMAPPIGPRMPIYPPGTPGIGHQLFYGQGPPAIVPPQPGFGYQQQLVPGMRPNFFVPMVQPGQQAQRPSGRRSGAGAVQPQQPLPMMQPQMLPRGRVYRYPPGRSMPDVPMAGLPGGMLPVPYDMGGMPFRDGAFSQPVQTGALATALANAMPEQQRTLLGENLYPLVDQLEHENAAKVTGMLLEMDQTEVLHLLESPESLKAKVAEAMEVLRTVQQQVNSPTDRMATLSLNDSLVS

SEQ ID NO: 8025 - protein, 640 aa, Vitis vinifera
MAQIQAAVAGPNGVANTASLYVGDLDVNITDSQLYDLFIQAGQVLSVRVCRDLSTRRSLGYGYVNYSNPQDAARALDLLNFTPLNGKPIRIMYSHRDPSIRKSGTANIFIKNLDKSIDNKALHDTFSAFGNILSCKIATDPSGQSKGYGFVQFDNEESAQNAIDKLNGMLINDKQVYVGQFLRKQERETALNKTKFNNVYVKNLSESTTEEDLKNIFGEFGIITSVVVMRDGDGKSKCFGFVNFENADDAAEAVEALNGKKFDEKEWYVGKAQKKYERELELKGRFEQSMKEVVDKFQGVNLYIKNLDDSIGDDKLKELFSEFGTITSCKVMRDPSGISRGSGFVAFSTSEEASRALTEMNGKMVVSKPLYVALAQRKEERRARLQAQFSQMRPVSMAPSVAPRMPMYPPGAPGLGQQLFYGQGPPAIIPPQAGFGYQQQLVPGMRPGGAPMPNFFVPLVQQGQQGQRPGGRRGAGPVQQNQQPVPLMQQQMLPRGGRVYRYPPGRNMPDVPMPGVAGGMLSIPYDMGGVPLRDAAIGQPMPISALASALANATPDQQRTMLGESLYPLVDQLEHEMAAKVTGMLLEMDQTEVLHLLESPEALKSKVAEAMDVLRNVAQQQANSPTEQLASLSLNDSLVP

SEQ ID NO: 8026 - protein, 642 aa, Jatropha curcas
MSQVQSQPQGPVSAPVGMASNGGNQFVSTSLYVGDLEQNVTETQLYDLFNQLGQIVSIRVCRDLTSRRSLGYGYVNYNNVHDAAQALEVLNFTPVNGKPIRIMYSYRDPTIRKSGAGNIYIKNLDKAIDNKALHDTFSAFGNILSCKVATDSAGQSLGYGFVQFDNEESAKNAIDKLNGMLLNDKQVYVGPFLRRQERESGTDKTKFNNVYVKNLSETTTEEDLKKIFGEYGAITSAVVMRDGDGKSRCFGFVNFENPDDAARSVEALNGKTFDEKEWYVGKAQKKSEREVELKGQFEQTLKETVDKFEGLNLYVKNLDDSITDDKLKELFSEFGTITSCKVMRDPNGVSKGSGFVAYSTAEEASKALTEMNGKMIVSKPLYVALAQRKEERRARLQAQFSQMRPAMAPAVGPRMPMYPHGTPGIGQQLFYGQGPPAIVPPQPGFGYQQQLVPGMRPNFFVPMVQPGQQAQRPSGRRSGAGPVQPQQPLPMMQPQMLPRGRVYRYPPGRSMPDVPMAGLPGGMLPVPYDMGGMPFRDGAFSQPMQTGALATALANATPEQQRTLLGENLYPLVDQLEHENAAKVTGMLLEMDQTEVLHLLESPESLEAKVAEAMEVLRTVQQQANSPTNRMATLSLNENLVS

SEQ ID NO: 8027 - protein, 657 aa, Populus trichocarpa
MAQIQVHQAAAPVPGPNGVAAGPGAIQFVPTSLYVGDLDFNVTDSQLYDLFNQVGQVVSVRVCRDLSTRRSLGYGYVNYSNPQDAARALDVLNFTPLNNKPLRIMYSHRDPSIRKSGMANIFIKNLDKTIDHKALHDTFSSFGNILSCKVATDASGQSKGYGFVQFDSEEAAQNAIDKLNGMLINDKQVYVGNFLRKQERDSALSNIKFNNIYVKNLAESTTDEDLKSIFEEHGAITSAVVMRDADGKSKCFGFVNFENVDDAAKAVEALNGKKFDDKEWYVGKAQKKSERELELKGRFEQSLESVEKYQAVNLYIKNLDDSVNDEKLKELFSDFGTITSCKVMHDPSGISRGSGFVAFSTPEEASRALAELNGKMVVSKPLYVAPAQRKEERRARLQAQFSQMRPVAMAPSVAPRMQMYPPGAPGLGQQFLYGQGPPAMIPQAGFGYQQQLVPGMRPGGAPMPNFFVPLVQQGQQGQRPGGRRGGGPVQQTQQPVPLMQQQMLPRGRVYRYPPGRNMPDVPMPGVAGGMLSVPYDMGVMPIRDAAGGQPMPITALATALANATPEQQRTMLGEGLYPLVDQLEHDSAAKVTGMLLEMDQTEVLHLLESPEALKAKVAEAMEVLRTVAAQQQINNPADHLASLSLNENLVSLVCLVD

SEQ ID NO: 8028 - protein, 632 aa, Populus trichocarpa
AAGPGAIQFVPTSLYVGDLDFNVTDSQLYDVFNQVGQVVSVRVCRDLSTRRSLGYGYVNYSNPQDAARALDVLNFTPLNNKPIRIMYSHRDPSIRKSGMANIFIKNLDKGIDHKALHDTFSSFGNILSCKVATDASGQSKGYGFVQFDSEEAAQNAIDKLNGMLVNDKQVYVGHFLRKQDRDGALYSIKFNNVFVKNLAESTTDEELKNIFAEHGAITSAVVMRDADGKSKCFGFVNFESADDAAKAVEALNGKKIDGEEWYVGKAQKKSERELELKGRFEQSMKETVDKFQGLNLYIKNLDDSINDEKLKELFSDFGAITSCKVMRDPSGISRGSGFVAFSTPEEASRALAEMNGKMLISKPLYVALAQRKEERRARLQAQFSQMRPVTMAPSVASRMPMYPPGAPGMGQQFLYGQGPPAMMPPQAGFGYQQQLVPGMRPGGAPMPNFFVPLVQQGQQGQRPGGRRGGGPVQQTQQPVPLMQQQMLPRGRVYRYPPGRNMPDVPMPGVAGGMLSVPYDMGGMPIRDAAQPMPITALATALANATPEQQRTMLGESLYPIVDQLEHDSAAKVTGMLLEMDQTEVLHLLESPEALKAKVAEAMEVLRTVAAQQQINNQADQLGSLSLNDNLVS

SEQ ID NO: 8029 - protein, 621 aa, Vitis vinifera
MAQIQAAVAGPNGVANTASLYVGDLDVNITDSQLYDLFIQAGQVLSVRVCRDLSTRRSLGYGYVNYSNPQDAARALDLLNFTPLNGKPIRIMYSHRDPSIRKSGTANIFIKNLDKSIDNKALHDTFSAFGNILSCKIATDPSGQSKGYGFVQFDNEESAQNAIDKLNGMLINDKQVYVGQFLRKQERETALNKTKFNNVYVKNLSESTTEEDLKNIFGEFGIITSVVVMRDGDGKSKCFGFVNFENADDAAEAVEALNGKKFDEKEWYVGKAQKKYERELELKGRFEQSMKEVVDKFQGVNLYIKNLDDSIGDDKLKELFSEFGTITSCKVMRDPSGISRGSGFVAFSTSEEASRALTEMNGKMVVSKPLYVALAQRKEERRARLQAQFSQMRPVSMAPSVAPRMPMYPPGAPGLGQQLFYGQGPPAIIPPQAGFGYQQQLVPGMRPGGAPMPNFFVPLVQQGQQGQRPGGRRGAGPVQQNQQPVPLMQQQMLPRGGRVYRYPPGRNMPDVPMPDAAIGQPMPISALASALANATPDQQRTMLGESLYPLVDQLEHEMAAKVTGMLLEMDQTEVLHLLESPEALKSKVAEAMDVLRNVAQQQANSPTEQLASLSLNDSLVP

SEQ ID NO: 8030 - protein, 658 aa, Ricinus communis
MAQIQVQHQSAAAAAPIPGANGAAAAAGSGSVPYMPTSLYVGDLDLNVTDSQLYDVFNQVGQVVSVRVCRDLTTRRSLGYGYVNYTSPQDAARALDILNFTPFNNKPIRIMYSHRDPSIRKSGTGNIFIKNLDKTIDHKALHDTFSSFGNILSCKVATDSSGQSRGYGFVQFDNEEAAQNAIDKLNGMLLNDKQVYVGHFLRKHERDSASNKKFNNVYVKNLSESTTEEDLKNIFGEYGEITSAVIMRDADGKSKCFGFVNFENTDAAAKAVESLNGKKIDDKEWYVGKAQKKSERELELKSQFEQSMKEAVDKYQGVNLYIKNLDDSISDENLKELFSDFGMITSCKVMRDPSGISRGSGFVAFSTPEEASRALAEMNGKMVVSKPLYVALAQRKEERRARLQAQFSQMRPVAMAPSVGPRMPIYSPGAPGMGQQFLYGQGPPTMIPPQGGFGYQQQLVPGIRPGGAPMPNFFVPMVQQGQQGQRHGGRRGAVPVQQNQQPVPLMHQQMLPRGRVYRYPPGRNMPDVPMPGVAGGMLSVPYDMGGMPIRDAAAGQPVPITALATALANASPEHQRTLLGESLYPLVDQLEHESAAKVTGMLLEMDQTEVLHLLESPEALKAKVAEAMEVLRSVAAQQHANNTADQLTSLSLNDGLVS

SEQ ID NO: 8031 - protein, 658 aa, Daucus carota
MAQIQVQPQQQQQQIPVSGSNGVSAGAAANAGGSNQFTTTSLYVGDLDQSVTDSQLYDLFNQVGQVVSVRVCRDLSTGRSLGYGYVNYSNQQDATRAIDVLNFTPLNNKTIRVSVSRRDPTDRKSGAGNIFIKNLDKSIDIKALHETFSSFGTIISCKIATDASGQSKGYGFVQYDSEEAAQTAIDKLNGMLMNDKQVYVGVFLRKQDRDSEMSKTKFNNIYVKNLSDSTSEDDLRKTFGEYGTITSVVVMRDADGKSKCFGFVNFENPEDAAKAVDALNGKKFDDKEWYVGKAQKKSEREVELKSRFEQTVKEQVDKYQGVNLYVKNLDDTIDDEKLKELFSEYGTITSCKVMRDPSGISRGSGFVAFSTPEEASRALGEMNGKMIVSKPLYVALAQRKEERRARLQAQFSQMRPVAMPPSMGPRMPMYSPGAPGMGQQLFYGQAPPAMIAPQAGFGYQQQLVPGMRPGGGPMPNFFMPMVQQGQQGQRPGGRRGAGPAQQTQQPVPMMPQQLMPRGRMYRFPPGRNVGDVTMPGVGGGMLPVPYNMGGMLPREAAMGQPMPITALASALANAPADQQRTMLGENLYPLVDQLEHDHAAKVTGMLLEMDQTEVLHLLESPDALKAKVAEAMDVLRNVSQPNVADQLGGLSLNENLVS

SEQ ID NO: 8032 - protein, 582 aa, Phaseolus vulgaris
MSSFSVRFLAPPCCPTSRSKTLLCASPTAAPAASEAVEASRLEPRVEERDGFWVLKEEYRGGISPQEKVKLEKDPMKLFMEGGIEDLAKMSLEEIESSKHTKDDIDVRLKWLGLFHRRKHHYGRFMMRLKLPNGVTTSSQTRYLASVIRKYGKDGCADVTTRQNWQIRGVVLPDVPEILKGLAEVGLTSLQSGMDNVRNSVGNPLAGIDPDEIVDTRPYNNLLSQFITANSLGNPAMSNLPRKWNVCVVGSHDLFEHPHINDLAYMPANNKDGRFGFNLLVGGFFSAKRCAEAIPLDAWVSADDVIPVCKAVLEAYRDLGFRGNRQKTRMMWLIDELGIEVFRSEVEKRMAGKQLERAQEDLVKKQWERRDYLGVHPQKQEGLSYVGIHIPVGRIQADEMDELALLADEYGSGELRLTVEQNIIIPNVDNSKLEALLQEPLLKHKFSPEPSLLMKTLVACTGNQFCGQAIIETKARALKVTEEVERQVAVTRPVRMHWTGCPNTCGQVQVADIGFMGCMARDENGKATEGVDIFLGGRIGSDSHLAELYKKGVPCKNLVPVVADILVKHFGAVQRNREEVED

SEQ ID NO: 8033 - protein, 588 aa, Glycine max
MSSSFSVRFLAPPSSCFPSSRPKTWLCAATTPTVAPATASSEVEASRLEPRVEERDGFWVLKEEYRGGISPQEKVKLEKDPMKLFMEGGIEDLAKMSLEEIESSKHTKDDIDVRLKWLGLFHRRKQHYGRFMMRLKLPNGVTTSAQTRYLASVIRKYGKDGCADVTTRQNWQIRGVVLPDVPEILKGLDEVGLTSLQSGMDNVRNPVGNPLAGIDPDEIVDTRPYNNLLSQFITANSRGNPAMSNLPRKWNVCVVGSHDLFEHPHINDLAYMPANKDGRFGFNLLVGGFFSAKRCAEAIPLDAWVSADDVIPLCKAVLEAYRDLGFRGNRQKTRMMWLIDELGIEVFRSEVEKRMPGKQLERASEEELVKKKWERRDYLGVHPQKQDGLSYVGIHIPVGRVQADDMDELARLVDKYGTGELRLTVEQNIIIPNVDSNKIDALLNEPLLKERFSPEPSLLMKTLVACTGNQFCGQAIIETKERALKVTEEVERQVAVTRPVRMHWTGCPNTCGQVQVADIGFMGCMARDENGKATEGVDIFLGGRIGSDSHLAEVYKKGVPCKNLVPIVVDILVKHFGAVQRNREEGED

SEQ ID NO: 8034 - protein, 605 aa, Glycine max
MYTFLLLLPIMSSSFSVRFLAPLPPSSSSCFPTSSLPKTWLCAAATPTVAPSTTTSSSEVEASRLEPRVEERDGFWVLKEEYRGGISPQEKVKLEKDPMKLFMEGGIEELAKMSLEEIESSKHTKDDIDVRLKWLGLFHRRKQHHGRFMMRLKLPNGVTTSAQTRYLASVIRKYGKDGCADVTTRQNWQIRGVVLPDVPEILKGLDEVGLTSLQSGMDNVRNPVGNPLAGIDPDEIVDTRPYNNLLSQFITANSRGNPAMSNLPRKWNVCVVGSHDLFEHPHINDLAYMPANKDGRFGFNLLVGGFFSAKRCAEAIPLDAWVSADDVIPLCKAVLEAYRDLGFRGNRQKTRMMWLIDELGIEVFRSEVEKRMPGKKLERASKEELVKKQWERRDYLGVHPQKQEGLSYVGIHIPVGRVQADDMDELARLADEYATGELRLTVEQNIIIPNVDNNKIDGLLNEPLLKGRFSPEPSLLMKTLVACTGNQFCGQAIIETKERALKVTEEVERQVAVTRPVRMHWTGCPNTCGQVQVADIGFMGCMARDDNGKATEGVDIFLGGRIGSDSHLAQVYKKGVPCKDLVPVVVDILVKHFGAVLRNREEGED

SEQ ID NO: 8035 - protein, 582 aa, Medicago truncatula
MSSFSVRFLTPPSITRPKTWLLSAATPSVAPVSTPQVDSSRLEPRVEEKDGYWVLKEEYRGGINPQEKVKIQKEPMKLFMEGGINDLANMSLEEIESSKLTKDDIDVRLKWLGLFHRRKHHYGRFMMRLKLPNGVTTSAQTRYLASVIKKYGKDGCADVTTRQNWQIRGVTLPDVPEILKGLAEVGLTSLQSGMDNVRNPVGNPLAGIDPDEIVDTRPYTNLLSQFITANSLGNPTITNLPRKWNVCVIGSHDLFEHPHINDLAYMPANKDGRFGFNLLVGGFFSPKRCAEAVPLDAWVSADDVIPLCKAVLETYRDLGTRGNRQKTRMMWLIDELGIEVFRSEVEKRMPEKKLERASKEELVQKQWERRDILGVHPQKQEGLSYVGIHVPVGRIQADEMDELARIADEYGTGELRLTVEQNIIIPNVENSKLEALLNEPLLKDKFSPEPSILMKTLVACTGNQFCGQAIIETKQRALKVTEEVERHVAVSKPVRMHWTGCPNTCGQVQVADIGFMGCMARDENGKATEGVDIFLGGRIGSDSHLAEVYKKAVPCKDLVPIVADILVKYFGAVQRNREEGDD

SEQ ID NO: 8036 - protein, 596 aa, Glycine max
MSSSFSVRFLAPLPPSSSSCFPTSSLPKTWLCAAATPTVVRNHHLLLEVEASRLEPRVEERDGFWVLKEEYRGGISPQEKVKLEKDPMKLFMEGGIEELAKMSLEEIESSKHTKDDIDVRLKWLGLFHRRKQHHGRFMMRLKLKLPNGVTTSAQTRYLASVIRKYGKDGCADVTTRQNWQIRGVVHPECPEILKGLDEVGLTSLQSPMDNVRNPVGNPLAGIDPDEIVDTRPYNNLLSQFITANSRGNPAMSNLPRKWNVCVVGSHDLFEHPHINDLAYMPANKDGRFGFNLLVGGFFSAKRCAEAIPLDAWVSADDVIPLCKAVLEAYRDLGFRGNRQKTRMMWLIDELGIEVFRSEVEKRMPGKKLERASKEELVKKQWERRDYLGVHPQKQEGLSYVGIHIPVGRVQADDMDELARLADEYATGELRLTVEQNIIIPNLDNNKIDGLLNEPLLKGRFSPEPSLLMKTLVACTGNQFCGQAIIETKERALKVTEEVERQVAVTRPVRMHWTGCPNTCGQVQVADIGFMGCMARDDNGKATEGVDIFLGGRIGSDSHLAQVYKKGVPCKDLVPVVVDILVKHFGAVLRNREEGED

SEQ ID NO: 8037 - protein, 582 aa, Lotus japonicus
MSSSFSIRFLAPPFPSTSRPKSCLSAATPAVAPTDAAVSRLEPRVEERNGYWVLKEEHRGGINPQEKVKLEKEPMALFMEGGIDELAKVSIEELDSSKLTKDDVDVRLKWLGLFHRRKHQYGRFMMRLKLPNGVTTSAQTRYLASVIRKYGKDGCADVTTRQNWQIRGVVLPDVPEILKGLAEVGLTSLQSGMDNVRNPVGNPLAGIDPDEIVDTRPYTNLLSHFITANSRGNPTVSNLPRKWNVCVVGSHDLFEHPHINDLAYMPANKDGRFGFNLLVGGFFSPKRCAEAIPLDAWVSAEDVIPVCKAILEMYRDLGTRGNRQKTRMMWLIDELGIEVFRSEVEKRMPLGQQLERASQEDLVQKQWERRDYFGANPQKQEGLSYVGIHIPVGRIQADEMDELARLADEYGTGELRLTVEQNIIIPNVENSKLSALLNEPLLKEKFSPEPSLLMKTLVACTGSQFCGQAIIETKARALKVTEEVERLVAVTRPVRMHWTGCPNTCGQVQVADIGFMGCMARDENGKPGEGVDIFLGGRIGSDSHLAEVYKKAVPCKDLVPIVADILVKHFGAVQRNREEGDD

SEQ ID NO: 8038 - protein, 588 aa, Gossypium hirsutum
MSSFSVRFFAPQQPLLPSTASSFKPKTWVMAAPTTAPATSVDVDGGRLEPRVEEREGYFVLKEKFRDGINPQEKIKIEKDPLKLFMEAGIDKLAKMSFEDLDKAKATKDDIDVRLKWLGLFHRRKHQYGRFMMRLKLPNGVTTSAQTRYLASVIRKYGKEGCADVTTRQNWQIRGAVLPDVPEILKGLDEVGLTSLQSGMDNVRNPVGNPLAGIDPEEIVDTRPYTNLLSQFITANSRGNPAVANLPRKWNVCVVGSHDLYEHPHINDLAYMPATKNGRFGFNLLVGGFFSAKRCDEAIPLDAWVSADDVIPLCKAVLEAYRDLGYRGNRQKTRMMWLIDELGIEVFRSEVAKRMPQKELERASDEGLVQKQWERRDYLGVHPQKQEGFSYIGIHIPVGRVQADDMDELARLADMYGSGELRLTVEQNIIIPNVENSKLEALPNEPLLKDRFSPQPSILMKGLVACTGNQFCGQAIIETKARALKVTEEVERLVSVSRPVRMHWAGCPNTCGQVQVADIGFMGCMARDENGKPCEGADIFLGGRIGSDSHLGELYKKGVPCKNLVPVVADILVEHFGAVPRQREEGED

SEQ ID NO: 8039 - protein, 587 aa, Ricinus communis
MSSLPSVRLLSPPLSSHSTRPTRSTRIFAAGPTVVQPVEVQVDAERLEPRVEEKDGYFVLKEKFRQGINPQEKVKIEKEPMKLFMENGIEELAKLSMEEIDQNKLTKDDIDVRLKWLGLFHRRKQQYGRFMMRLKLPNGVTTSEQTRYLASVIRKYGKDGCADVTTRQNWQIRGVVLSDVPDILKGLAEVGLTSLQSGMDNVRNPVGNPLAGIDPEEIVDTRPYTNLLTQFLTSNSQGNPAVSNLPRKWNVCVIGSHDLYEHPHINDLAYMPATKDGRFGFNLLVGGFFSAKRCAEAIPLDAWVSADDVIPVCKAVLEAYRDLGFRGNRQKTRMMWLIDEIGLEGFRSEVERRMPQQKLERASSEDLVQKQWERRDYFGVHPQSQEGFSYVGIHIPVGRVQADDMDELARLADTYGSGELRLTVEQNIIIPNIENSKIEALLQEPLLKHKFSPEPPILMKGLVACTGNEFCGQAIIETKARAMKVTEEVQRLVSVTQPVRMHWTGCPNTCGQVQVADIGFMGCMTRDENGKVCEGVDVFLGGRIGSDSHLGDVYKKSVPCKNLVPLVVDILVNNFGAVPREREELED

SEQ ID NO: 8040 - protein, 588 aa, Populus trichocarpa
MSSLSVRFLTPQLSPTVPSSSARPRTRLFAGPPTVAQPAETGVDAGRLEPRVEKKDGYYVLKEKFRQGINPQEKVKIEKEPMKLFMENGIEELAKLSMEEIDKEKSTKDDIDVRLKWLGLFHRRKHQYGRFMMRLKLPNGVTTSAQTRYLASVIRKYGKDGCADVTTRQNWQIRGVVLPDVPEILRGLAEVGLTSLQSGMDNVRNPVGNPLAGIDPDEIVDTRPYTNLLSQFITANSRGNPEFTNLPRKWNVCVVGSHDLYEHPHINDLAYMPAMKDGRFGFNLLVGGFFSPKRCAEAIPLDAWVSADDVLPSCKAVLEAYRDLGTRGNRQKTRMMWLIDELGIEGFRSEVVKRMPRQELERESSEDLVQKQWERRDYFGVHPQKQEGLSYAGLHIPVGRVQADDMDELARLADIYGTGELRLTVEQNIIIPNIEDSKIEALLKEPLLKDRFSPEPPLLMQGLVACTGKEFCGQAIIETKARAMKVTEEVQRLVSVSKPVRMHWTGCPNTCGQVQVADIGFMGCMARDENGKICEGADVYVGGRVGSDSHLGELYKKSVPCKDLVPLVVDILVKQFGAVPREREEVDD

SEQ ID NO: 8041 - protein, 588 aa, Populus trichocarpa
MSSLSVRFLTPQLSPTVPSSSARPRTRLFAGPPTVAQPAETGVDAGRLEPRVEKKDGYYVLKEKFRQGINPQEKVKIEKEPMKLFMENGIEELAKLSMEEIDKEKSTKDDIDVRLKWLGLFHRRKHQYGRFMMRLKLPNGVTTSAQTRYLASVIRKYGKDGCADVTTRQNWQIRGVVLPDVPEILRGLAEVGLTSLQSGMDNVRNPVGNPLAGIDPDEIVDTRPYTNLLSQFITANSRGNPEFTNLPRKWNVCVVGSHDLYEHPHINDLAYMPAMKDGRFGFNLLVGGFFSPKRCAEAIPLDAWVSADDVLPSCKAVLEAYRDLGTRGNRQKTRMMWLIDELGIEGFRSEVVKRMPRQELERESSEDLVQKQWERRDYFGVHPQKQEGLSYAGLHIPVGRVQADDMDELARLADIYGTGELRLTVEQNIIIPNIEDSKIEALLKEPLLKDRFSPEPPLLMQGLVACTGKEFCGQAIIETKARAMKVTEEVQRLVSVSKPVRMHWTGCPNTCGQVQVADIGFMGCMARDEKGKICEGADVYVGGRVGSDSHLGELYKKSVPCKDLVPLVVDILVKQFGAVPREREEVDD

SEQ ID NO: 8042 - protein, 504 aa, Vitis vinifera
MDLLAKSYTADDDDGPQHEAEDQNLDNSSPDSSPTRIALPSKSSAPKVDDTTLALAIANTNDKPIDPIQHVVPFNPTYDQLWAPIYGPAHPYAKDGIAQGMRNHKLGFRKIEKKKESESEENEDSPWAGKKEGLQTELTEEQKKYAEEYAKKKGEEKGAAEKGEFVTDKSTFHGKEERDYQGRSWIAPPKDAKATNDHCYIPKRLVHTWSGHTKGVSAIRFFPKHGHLILSAGMDTKVKIWDVFNSGKCMRTYMGHSKAVRDISFCNDGTKFLTAGYDKNIKYWDTETGQVISTFSTGKIPYVVKLNPDDDKQNILLAGMSDKKIVQWDMNTGQITQEYDQHLGAVNTITFVDNNRRFVTSSDDKSLRVWEFGIPVVIKYISEPHMHSMPSISLHPNTNWLAAQSLDNQILIYSTRERFQLNKKKRFAGHIAAGYACQVNFSPDGRFVMSGDGEGKCWFWDWKSCKVFRTLKCHEGVCIGCEWHPLEQSKVATCGWDGLIKYWD

SEQ ID NO: 8043 - protein, 573 aa, Populus trichocarpa
MDLLQNYQNDGELDQNPNSSPDSSPPRLLPSKSAAPKVDDTMLALTVANQMLSKPIDPVQHVVAFNPTYDQLWAPVLGPAHPYAKDGIAQGMRNHKLGFVEDAAIDSFVFDEQYNTFHKYGYAADPSASAGNNYIGDLDVLEKNNGISVYNIPQHEQKKRKIEKKTEAVEDDDDGMDKEEVENPATDAWLMKNRKSPWAGKKEGLQTELTEEQKKYAEEHARKKEEKAGGEKGELVADKTTFHGKEERDYQGRSWIAPPKDAKASNDHCYIPKRLVHTWSGHTKGVSAIRFFPKHGHLILSAGMDTKVKIWDVFNSGKCMRTYMGHSKAVRDISFCNDGSKFLTAGYDKNIKYWDTETGQVISSFSTGKIPYVVKLNPDDDKQNILLAGMSDKKIVQWDMNTGQITQEYDQHLGAVNTITFVDNNRRFVTSSDDKSLRVWEFGIPVVIKYISEPHMHSMPSISLHPNMNWLAAQSLDNQILIYSTRERFQLNKKKRFAGHIVAGYACQVNFSPDGRFVMSGDGEGKCWFWDWKSCKVFRTLKCHEGVCIGAEWHPLEQSKVATCGWDGLIKYW

SEQ ID NO: 8044 - protein, 574 aa, Glycine max
MDLLHQYSDGDDPDSPSENPSSPPRLLPGRSAAPNVDDTMLALTVASSSSALSRPIDPTQHLVGFNPSYDQLWAPIQGPAHPFAKDGIAQGMRNHKLGFVEDASIEPFLFDEQYNTFHKFGYAADPAANNFVGDLDALRDNNAVSVYNIPRHEHKKRRIEAKQKKKSEEDDDGDVNEEIENPASEAWIMKNKKSPWAGKKEGLQGELTEEQQKYAEEYAKKKGEEKSGLGGEKVEVVKDKSTFHGKEERDYQGRSWIAPPKDAKANSDRCYIPKRLIHTWSGHTKGVSAIRFFPKYGHLILSAGMDTKVKIWDVFNSGKCMRTYMGHSKAVRDICFSNDGTKFLSAGYDKNIKYWDTETGQVISTFATGKIPYVVKLNPDEDKQNVLLAGMSDKKIVQWDMNTGQITQEYDQHLGAVNTITFVDNNRRFVTSSDDKSLRVWEFGIPVVIKYISEPHMHSMPSISLHPNANWLAAQSLDNQILIYSTREKFQLNKRKRFGGHIVAGYACQVNFSPDGQYVMSGDGEGKCWFWDWKTCKVYRTLKCHEGVCIGCEWHPLEQSKVATCGWDGMIKYW

SEQ ID NO: 8045 - protein, 583 aa, Vitis vinifera
MDLLAKSYTADDDDGPQHEAEDQNLDNSSPDSSPTRIALPSKSSAPKVDDTTLALAIANTNDKPIDPIQHVVPFNPTYDQLWAPIYGPAHPYAKDGIAQGMRNHKLGFVENAAIEPFIFDEQYNTFHKYGYAADPSASAGNNYVGDLEALEKNDGISVYNIPQHEQKKRKIEKKKESESEENEDVDVEEVQNPATDTWLLKNKKSPWAGKKEGLQTELTEEQKKYAEEYAKKKGEEKGAAEKGEFVTDKSTFHGKEERDYQGRSWIAPPKDAKATNDHCYIPKRLVHTWSGHTKGVSAIRFFPKHGHLILSAGMDTKVKIWDVFNSGKCMRTYMGHSKAVRDISFCNDGTKFLTAGYDKNIKYWDTETGQVISTFSTGKIPYVVKLNPDDDKQNILLAGMSDKKIVQWDMNTGQITQEYDQHLGAVNTITFVDNNRRFVTSSDDKSLRVWEFGIPVVIKYISEPHMHSMPSISLHPNTNWLAAQSLDNQILIYSTRERFQLNKKKRFAGHIAAGYACQVNFSPDGRFVMSGDGEGKCWFWDWKSCKVFRTLKCHEGVCIGCEWHPLEQSKVATCGWDGLIKYW

SEQ ID NO: 8046 - protein, 581 aa, Populus trichocarpa
MDLLQNYHNDDELDEHGQNPNSSPDSSSPPRLLPSKSAAPKVDDTMLALTVANQTLSKPIDPVQHAVAFNPTYDQLWAPVLGPAHPYAKDGIAQGMRNHKLGFVENAAIDSFVFDEQYNTFHKYGYAADPSASAGNNYVGDLDTLEKTNGISVYNIPQHEQKKRKIEKKREVTEEEGDGDDVMDKEEVENPATDAWLMKNRKSPWAGKKEGLQTELSEEQQKYAEEHARKKAEKAGGEKGEVVADKTTFHGKEERDYQGRSWLAPPKDAKASNDHCYIPKRLVHTWSGHTKGVSAIRFFPKYGHLILSAGMDTKVKIWDVFNSGKCMRTYMGHSKAVRDISFCNDGTKFLTASYDKNIKYWDTETGQVISTFSTGKIPYVVKLNPDDDKQNILLAGMSDKKIVQWDMNSGQITQEYDQHLGAVNTITFVDNNRRFVTSSDDKSLRVWEFGIPVVIKYISEPHMHSMPAISLHPNSNWLAAQSLDNQILIYSTRERFQLNKKKRFAGHIVAGYACQVNFSPDGRFVMSGDGEGKCWFWDWKSCKVFRTLKCHEGVCIGCEWHPLEQSKVATCGWDGLIKYWD

SEQ ID NO: 8047 - protein, 580 aa, Glycine max
MDLLHQYSDGDDPDSPSQNPSSPPRLLAGRSAAPKVDDTMLALTVTSSSSAALSRPIDPTQHLVGFNPSYDQLWAPIQGPAHPFAKDGIAQGMRNHKLGFVEDASIEPFLFDEQYNTFHKFGYAADPAANNFVGDLDALRDNNAVSVYNIPRHEHKKRRIEAKEKKKSDENTGDDDDNNDEEENQNPASEAWITKNKKSPWAGKKEGLQGELTEEQQKYAEEYAKKKGEEKSGFGGEKVEVVKDKSTFHGKEEKDYQGRSWIAPPKDAKASNDHCYMPKRLIHTWSGHTKGVSAIRFFPKYGHLILSAGMDTKIKIWDVFNSGKCMRTYMGHSKAVRDICFSNDGTKFLSAGYDKNIKYWDTETGQVISTFATGKIPYVVKLNPDEDKQNVLLAGMSDKKIVQWDMNTGQITQEYDQHLGAVNTITFVDNNRRFVTSSDDKSLRVWEFGIPVVIKYISEPHMHSMPSISLHPNANWLAAQSLDNQILIYSTREKFQLNKKKRFGGHIVAGYACQVNFSPDGRFVMSGDGEGKCWFWDWKTCKVYRTLKCHEGVCIGCEWHPLEQSKVATCGWDGMIKYWD

SEQ ID NO: 8048 - protein, 583 aa, Medicago truncatula
MDLLNQYTDNNNDPDSPSQNPNSPENSPPRLLPSRSAAPKVDDTMLALTVADPKTLSKPIDPTQHLIAFNPTYDQLWAPIQGPSHPYAKDGLAQGMRNHKLGFVEDANIEPFLFDEQHNTFLKFGYAADPSASNYVGDFDALQKNNAASVYNIPHREQKKRKIESLKKKEDNDNEEDESNNDKQGAEIENPASEAWLLKNKKSPWAGKKEGLQGELTEDQKKYAEEHAKKKGEEKSGFGGEKVEAVTDKSTFHGKEERDYQGRSWIAPPKDAKASNDHCYIPKRLVHTWSGHTKGVSAIRFFPNSGHLILSAGMDTKVKIWDVFNTGKCMRTYMGHSKAVRDICFTNDGTKFLSAGYDKNIKYWDTETGQVISTFSTGKIPYVVKLNPDEDKQNVLLAGMSDKKIVQWDMNTGQITQEYDQHLGAVNTITFVDNNRRFVTSSDDKSLRVWEYGIPVVIKYISEPHMHSMPSISLHPNANWLAAQSLDNQILIYSTREKFQLNKKKRFAGHIVAGYACQVNFSPDGRFVMSGDGEGKCWFWDWKSCKVFRTLKCHEGVTIGCEWHPLEQSKVATCGWDGLIKYW

SEQ ID NO: 8049 - protein, 581 aa, Cucumis melo subsp. melo
MDLLQSYTDQNDDDGSPKQLTSSPEASPPRLIPSKTSAPKVDDTMLALTVANANQTLSKPIDPTQHLVAFNPTYDQLWAPIYGPSHPYAKDGIAQGMRNHKLGFVENASIEPFVFDEQYNTFHKYGYAADPSASAGNNYIGDMEALQKNDAISVYNIPQHEQKKRKIEKKKEMSENEDMEEEVNPAEVDNPASDVWLMKNRKSPWSGKKEGLQTELTEEQKKYAEEYAKKKGEEKGGEKGEVTADKSTFHGKEERDYQGRSWIAPPKDAKATNDHCYIPKRLVHTWSGHTKGVSAIRFFPKHGHLILSAGMDTKVKIWDVFNSGKCMRTYMGHSQAVRDISFCNDGSKFLTAGYDKKIKYWDTETGQVISTFSTGKIPYVVKLNPDDDKQNILLAGMSDKKIVQWDMNTGQITQEYDQHLGAVNTITFVDNNRRFVTSSDDKSLRVWEFGIPVVIKYISEPHMHSMPSISVHPNTNWLAAQSLDNQILIYSTRERFQLNKKKRFAGHIVAGYACQVNFSPDGRFVMSGDGEGKCWFWDWKTCKVFRTLKCHEGVCIGCEWHPLEQSKVATCGWDGLIKYWD

SEQ ID NO: 8050 - protein, 572 aa, Zea mays
MDLLQSSYAPDDASSPEASSAASSPDSSPLRLPSKSAAPAVDDTALALSSAASAARPLDPSLHLVAFNPTADQLWAPILGPQHPHAPISSASGNRNHKLGHVEDAAVLPFLFDEQYNTFHRFGYAADPSGLHIVGDAQPQAPEPDTVYNLAPSEHKRRRLLAKADNEAELAPPEAKNPASEEWILHNKQSPWAGKKEAPPAELTDEQKQYAEAHAAKKAEKEARLEGKSERTEVVVKTTFHGKEEKDYQGRSWITPPKDAKATNDHCYIPKRCVHEWVGHTKGVSAIRFFPKYGHLLLSASMDCKIKIWDVLGSRTCMRTYMGHSKAVRDISFSNDGTKFLSAGYDRNIQYWDTETGQVISTFSTGKVPYVVKLNPDEDKQHILLAGMSDKKIVQWDMKSGQITQEYDQHLGAVNTITFVDNNRRFVTSSDDKSLRVWEFGIPVVIKYISEPHMHSMPSMSLHPNSNWLAAQSLDNQILIYSTKERFQLNKKKRFAGHIVAGYACQVNFSPDGRFVMSGDGEGSCWFWDWKSCRRFKTLKCHNGVCIGCEWHPLETSKVATCGWDGVIKYWD

SEQ ID NO: 8051 - protein, 573 aa, Zea mays
MDLLQSSYAPDDASSPEASAAASSPDSSPLRLPSKSAAPAVDDTALALSSAASAARPLDSSLHLVAFNPTADQLWAPILGPQHPHAPISSASGNRNHKLGHVEDAAVLPFLFDEQYNTFHRFGYAADPSGLHIVGDAQPQAPEPDTVYNLAPSEHKRRRLLAKADNEAELAPPEAKNPASEEWILHNKQSPWAGKKEAPPAELTDEQKQYGGGARCQEGREGGPPRKGRARGQRLWSRTTFHGKEEKDYQGRSWITPPKDAKATNDHCYIPKRCVHEWVGHTKGVSAIRFFPKYGHLLLSASMDCKIKIWDVLGSRTCMRTYMGHSKAVRDISFSNDGTKFLSAGYDRNIQYWDTETGQVISTFSTGKVPYVVKLNPDEDKQHILLAGMSDKKIVQWDMKSGQITQEYDQHLGAVNTITFVDNNRRFVTSSDDKSLRVWEFGIPVVIKYISEPHMHSMPSMSLHPNSNWLAAQSLDNQILIYSTKERFQLNKKKRFAGHIVAGYACQVNFSPDGRFVMSGDGEGSCWFWDWKSCRRFKTLKCHNGVCIGCEWHPLETSKVATCGWDGVIKYWD

SEQ ID NO: 8052 - protein, 1206 aa, Glycine max
MSLLSRFFYKRPPDGLLELSDRVYVFDSCFSTEALPEGMYSLYLRQIISDLHEDFPESTFLALNFRDGDHRSRFSRVLCDLDATVVDYPKQYEGCPLLPLSLLHHFLRLCDSCLADPAALILLHCERGGWPLLAFLLAAFLVFRKAAQTGERRILEMVHKEAPKGLLQLLSALNPLPSQLRYVQYVARRNIGAEWPPPERALSLDCVILRGIPGFDGGNGCRPLFRIFGRNLLSKGGLSTQMIYNMHKKKKSLRHYRQADCDVIKIDIQCLVQGDVVLECVHLDLDLEREVMMFRVMFNTAFIRSNILMLNAENLDILWDSKERYPKGFRAEVLFGEVESISPPRAQTSILDGEVKGGLPIEAFSRVQELFSGVEWVESGDAAAVWLLKQLTVLNDAKELSRFQGRGSWYSSPADSDSENNESSTADSSDEAFDVIPKSYADPSKLLISDNPDLVHLAFENNGGDYVNLTSRTPDQSLTDNVSSPHHAPRKEYSPCSSPPSPSPVPATQPFPIPAPPPPTSNIQPDLAPPPPPHQIDQNVNNASTFPSPPPPPPPLVSNTPSQPPPPLGPVRTSSAPPPPPPPPGHVQTGSAPPPPPRSVQTGSAPLPPPPESVRTGLVPPPPPGPVRIGSAPPPPPPPPPPPPPPPPGPVRTGSVPPPPPPPPGHVRTGSAPPPPPPPPGPVRTGSAPPPPPPPPGPVQTGSAPPPPPPPPSIRTGSAPPPPPPPPSVRTGSAPPPPPPPLAPKPPGAPPPPPGRGTSPMPPPPPAVRAPGVAPPPGKASTTNVGRGRGTGGTVNAPKKTLLKPLHWVKVARAAKGSLWADSQKQDSGTRAPEIDISELESLFSAASTSDGSSTKGGGRRGPNINKPEKVQLVDLRRAYNCEIMLSKIKIPLPDMLIAVLALDSAVLDIDQVENLIKFCPTKEEMEMLKNYTGNKEMLGKCEQFFMELMKVPRVESKLRVFAFKINFSSQVNDLKLNLNTINNAAREVKESGKLRQIMQTILTLGNALNQGTARGSAVGFKLDSLLKLSDTRARNNKMTLMHYLCKLLAEKMPELLDFDKDLVHLEAASKIQLKALAEEMQAVSKGLEKVEQELAASENDGAISTGFRKVLKNFLDIAEADVRSLISLYSEVGRSADSLSQYFGEDPARCPFEQVTQILVVFVKMFNKSREENERQADAEKKKLEKEALKERTANNSLSKKDGVR

SEQ ID NO: 8053 - protein, 1226 aa, Glycine max
MSLLSRFFYKRPPDGLLEFSDRVYVFDSCFSTEALPDGMYSLYLRQILSDLHEDFPESSFVALNFRDGDHRSRFSRVLCDLDATFVVDYPKQYEGCPLLPLSLLHHFLRLCDSCLADPGALILLHCERGGWPLLAFLLAAFLVFRKAAQTGERRILEMVHKEAPKGLLQLLSALNPLPSQLRYVKYVARRNIGAEWPPPERALSLDCVILRGVPGFDGGNGCRPLFRIFGRNLLSKGGLSTQMIYNMHKKKKTLRHYRQADCDVIKIDIQCLVKGDVVLECVHLDLDPEREVMMFRVMFNTAFIRSNILMLNSENLDILWDSKERYPKGFRAEVLFGEVESISPPRAQTSILDGEVKGGLPIEAFSRVQELFSGVEWVESGDAAAAWLLKQLTVLNDAKELSRFQGRGSWYSSPADSDSENNESSTADSSDEAFDVIPKSYADPSKLLISDNPDLVHLAFENNGGDYVNLTSRTPDQSLTDNVSLPHHAPRKEYSPCSSPPSPSPVPATQPFPTPAPPLPTSMPIQPDLAPPLPPHQIDQNVNSASTLPSPPPPIVSNAPSQSPPPPPPPPLPPRSVQTGSAPPPPGPVRTGSVPPPPPPPGSVQTGSAPPPPPPPGPVRTGSVPPPPPPPGSVKTGSAPPPPPPPSPVRTGSAPPPPPPPPCPVRAGSAPSPPPPPPPPPGPVRTGSALPPPPPPPPPPGPVRTGSAPPPPPPPPLGPVPTGPALPPPPPPPPGPVRTGSAPPPPPPPSVRTGSTPPPPPPAPKPPGVLPPPPGRGASPMPPPPPAARAPGVAPPPGKASTANVGRGRGTGGTVNAPKKTLLKPLHWVKVARAAKGSLWADSQKQDSGTRAPEIDISELESLFSAASTSDGSSTKGGGRRGPNINKPEKVQLVDLRRAYNCEIMLSKIKIPLPDMLKAVLALDSAILDIDQVENLIKFCPTKEEMEMLKNYTGNKEMLGKCEQFFMELMKVPRVESKLRVFAFKITFSSQVNDLKLNLNTINNAAREVKESGKLRQIMQTILTLGNALNQGTTRGSAVGFKLDSLLKLSDTRARNNKMTLMHYLCKLLAEKMPELLDFDKDLVHLEAASRIQLKALAEEMQAVSKGLEKVEQELAASENDGAISTGFRKVLKNFLDIAEADVRSLISLYSEVGRSADSLSQYFGEDPARCPFEQVTQILVVFVKMFNKSREENERQADAEKKKLEKEALKERTANNLHSKKDGVR

SEQ ID NO: 8054 - protein, 325 aa, Glycine max; identical to SEQ ID NO: 7213

SEQ ID NO: 8055 - protein, 326 aa, Glycine max; identical to SEQ ID NO: 7212

SEQ ID NO: 8056 - protein, 372 aa, Medicago truncatula; identical to SEQ ID NO: 7214

SEQ ID NO: 8057 - protein, 2475 aa, Glycine max
MGRETEILSRLVANHLHLAQFEPLRGVLLALRARNRDLARDILQTIVARSGRVPNVAWSSSCPSPALLTFLSTLELLQMDNASSAWNFDEETLRLRAEFLLLVQDLIDLVSECDGEWGNCRSVLDRVLELGVKRLRVDADGENEIDGIGSGNGNAATVVEEAEFTSLRKLILEHARVFDALCVNVHRQIRHWESEDSGEGSEELEEEDVKVLRGIQRTVQVVHLDAMRESLESGDAEGAVSHIRFLHFDYGIEEQSEYRIVLKDLLKVVLSRSEKIGDTRNQLLQIYSEAISSNCSDIVQMLQSIHDELLSEEIEMDRVQTENFIPHPLVRLQRYLEEVKSGKNSDDKALFLNEVIRYCKTDMYHYARVSGLHVLECIMDTALSAVKREQLDVAGNVLQLFPLLQPLVATMGWDFLAGKIAARRKLMQLLWTSKSQVIRLEESSPYGNKTDEMTCVEHLCDTLCYQLDLASFVACVNSGQPWNSKFSLMLSGKEQLEFRDEDTYSDPFVENFVLERLSVQSPLRVLFDVVPGIKFQEAIDLISMQPIASTVEARKRKQDIELMHMRYALESTVLALGAMERSVSGEVETHQDLPLFHLKDLQNHLDAISNLPRKILMVNVIISMLHMDNISVNLMHCGLPGSNFKLSNAWSSEDSCSTGSERGNKMVISFTGLLLDILRHNIPSSMIELENTLDDGVSTTSRQALEWRISISKRFIEEWEWRLSILQHLLPLSERQWRWKEALTVLRAAPSKLLNLCMQKAKFDIGEEAVHRFSLSAEDKATLELAEWVDSACKTPSVDDVVSLVQDLDFSSLCSQLGLLATILLCIDVAATSAKSAKMSLQLLKQAENMLSDIYPGGSPKVGSTYWDQILEVGVISVSGRLLKRLQKFLEQENPPTLQEILSGEIVITSSKESHRQEQRERALALLHLMIEDAHMGKRQFLSGKLHNLARAVADEETEPSTTRGEGLYADQGVISNSDKDIVLGLGLRVVKQIPLSSTGGESTLQSTGYDIKDSGKRIFAPLSGKPMTYLSQFILHVAAIGDIVDGTDTTHDFNFFSIVYEWPKDLLTRLVFERGSTDAAGKVAEIMYADFVHEVISACVPPVYPPRSGHGWACIPVVPTFPKSSSDNKVLSPSSKDAKPNCYCRSSATPGVALYPLQLDVVKHLAKISPVRAVLACVFGSSILYNSSSSSISSSLSDGLLQAPDADRLFYEFALDQSERFPTLNRWIQMQTNLHRVSEFAVTANQTVDDGNVEARTSVKRVREHDTETESDADDIVSSSTIPVALTDLNSHGIEATDFWLDSSKSETAQIDTTVFLSFDWDNEQPYEKAVERLIDEGKLMDALALSDRFLRNGASDQLLQLVIERTEEIHSNSAQRQGFGGRNIWSNSWQYCLRLKDKQLAARLALRYVHSWELDAALDVLTMCSCHLPENDSTRKEVLQMKQALQRYSHILSADDHYASWQEVEADCKEDPEGLALRLAGKGAVSAALKVAESAGLSVDLRRELQGRQLVKLLTADPLNGGGPAEASRFLSSLRDTDDALPVAMGAMQLLPNLRSKQLLVHFFLKRREGNLSDVEISRLNSWALGLRVLAILPLPWQQRCSSLHEHPHLILEVLLMRKQLQSATLILKEFPSLRDNHVITTYATKAIAVSISSPPREHRISVSGSRPKQKTRSGAPQRSSFTSSLSNLQKEARRAFSWAPKNTVDKNAPKDVYRKRKSSGLSPSDRVAWEAMTGIQEDHISSFSTDGQERLPSVSIAEEWMLTGDPLKDESIRSSHRYESAPDITLFKALLGLCSDESVSAKIALDLCINQMKNVLSSQQLPENASMETIGRAYHATETFVQGLVYAKSLLRKLTGGSELPSNWDRNRDTDDASSDAGSSSVGSQSTDELSEILSQADVWLGRAELLQSLLGSGIAASLDDIADGQSSARLRDRLVADERYSMAVYTCKKCKIDVFPVWNAWGHALIRMERYGHARVKFKQALQLHKGDPGPVILEIINTIEGGPPVDVSAVRSMYEHLAKSAPTILDDSLSADSYLNILYMPSTFPRSERSRRSQVSANNNSVYSRDFEDGPRSNLDNVRYTECVTYLKEYARQQLLAFMFRHGHYHDACSLFFPPDEVPPPPQPSITSGVSSSSPQRLDSLATDYGTIDDLCELCIVYGAMPILEEVLSTRMSSTQSQDAVNQYTVTALARICLYCETHKHFNYLYRFQVIKNDHVAAGLCCIQLFVNSSSQEEAIRHLEHAKMHFDEGLSARHKGGESTKVVTKGLRGKSASEKLTEEGLVKFSARVSIQVEVVKSFNDSEGPQWKHSLFGNPNDPETFRRRCKIAEVLVEKNFDLAFQLIYEFNLPAVDIYAGVAASLAERKRGSQLTEFFRNIKGTIDDDDWDQVLGAAINVYANKHKERPDRLIDMLTSSHRKVLACVVCGRLKSAFQIASRSGSVADVQYVAHQALHANALPVLDMCKQWLAQYM

SEQ ID NO: 8058 - protein, 2483 aa, Vitis vinifera
MDKESQLLSRLAVNHLFLAQFEPFRAALLTLQIRNPSLARAILQTIVAHGARFDSILWSQSCPSPSLLTWLSTIELLQFSDSSSLWSFDSESLRLRAEFLLLVHTVSSRVSESARKREELRDTSDGLVDLVPVLDRIADLGLRRLKPDVGVSDGSGINANQGDTIFEETEFMGLRNVVLEFPEIFDALCWNIQRQFQWTEGSNTGLAITIRNEEKGMVDLEEGDARFLGLILRSVQITHLDAMKESMEKGDVDRAISHIQYLHFDCGVAEDEYRAGLQQLLKSVLSRREGLGDSWHLMREKLLQIYEGALSSNCTHLVQMIQVIQDEFLSEEIEMYRATDNNQMPPPLERFKRSFTESKLDANSNDKISSSSMATNSCMRDMYHYARVSELHVLECVMDTALSTIKREQLQEASNVLTLFPRLQPLVAVMGWDLLAGKTAERRKLMQLLWTIKTNVSCIEHLCDSLCYQLDLASFVACVNSGQSWNSKSSLLLSGRETMAIGEEDNQFDPFVENFVLERLSVQSSLRVLFDVVPGIKFQDAIELISMQPIASNLAAWKRMQDVELMHMRYALESVVLALGAMERSTIDETESYHQKAIYYLKDMRNHMEAINNIPRKILMVTIIVSLLHMDDISLNLTNCASPGSYSELDIRSAWERTDLTTYEGGNKMVTSFIELLLDVLHNNLPSAALEQDHALAGGVTTGGRQALEWKLSSARHFIDDWEWRLSILQSLLPLSERQWRWKEALTVLRAAPSELLNLCMQRAKYDIGEEAVHRFSLSPEDRATLELAEWVDGTFRRASVEDAVSRAADGTSAVQDLDFSSLRSQLGPLAAILLCIDVAATSVRSADMSLQLLNQAQVMLSDIYPGRAPKMGSTYWDQIHEVGVISVTRRVLKRLHEFLEQDKPPALPAILSGEIIISSSKETYRQGQRERALAILHQMIEDAHKGKRQFLSGKLHNLARAVADEETETRGEGPYTDRKVLLNFDKDGVLGLGLRAIKQTPSSAAGENNMQPVGYDIKDTGKRLFGPISAKPTTFLSQFILHIAAIGDIVDGTDTTHDFNFFSLVYEWPKDLLTRLVFDRGSTDAAGKVAEIMCADFVHEVISACVPPVYPPRSGHGWACIPVIPTCPKSNSENKVLSPSSREAKPNFYSRSSATPGVPLYPLQLDIVKHLVKLSPVRAVLACVFGSSILYNGNDSSLSSSLNSGLLQAPDADRLFYEFALDQSERFPTLNRWIQMQTNLHRVSEFAITAKHTDNDSMVIPEARTAIKRFREHDSDTESEVDDIVNSSNLSTTFTDFNSQTSVAPDNLWRDSPKHEISEDTTVFLSFDWENEVPYEKAVERLIDEGNLMDALALSDRFLRNGASDRLLQLLIERGEENHSGSGQPQGYGGPSIGSNSWQYCLRLKDKQLAARLALKYLHRWELDAALDVLTMCSCHLTQSDPIRNEVLQMRQALQRYNHILCADDHYSSWQEVAAECKEDPEGLALRLAGKGAVSAALEVAESAGLSIELRRELKGRQLVKLLTADPLNGGGPAEASRFLSSLCDSDDALPVAMGAMQLLPNLRSKQLLVHFFLKRRDGNLSDVEVSRLNSWALGLRVLAALPLPWQQRCSSLHEHPHLILEVLLMRKQLESASLILKEFPSLRNNNVIIAYAAKAVSISSPSREPRISVSGPRPKQKTRAGAPTRSSFSSSLSNLQKEARRAFSWTPRNTGEKAAPKDVYRKRKNSGLSPSERVAWEAMTGIQEDRVSSFSADGQERLPSVSISEEWMLTGDTNKDEAVRSSHRYESAPDIILFKALLSLCSDELVSAKGALDLCVNQMKNVLSSHQLPENATVETVGRAYHATETFVQGLFFARSLLRKLAGGSDLSSNPERSRDADDTSSDAGSSSMGSQSTDELSEVLSQAEIWLGRAELLQSLLGSGIAASLNDIADKESSARLRDRLIVDEQYSMAVYTCKKCKIDVFPVWNAWGHALIRMEHYAQARVKFKQALQLYKGDPAPVILEIINTIEGGPPVDVAAVRSMYDHLARSAPTILDDSLSADAYLNVLYMPSTFPRSERSRRALESASSNSIYSPDFEDGPRSNLDSLRYLECVNYLQEYARQHLLTFMFRHGHYNDGCMLFFPTNAVPPPPQPSNHGVVTSSSSPQRQDLLATDYGSIDDLCDMCIGYGAMSVLEEVISTRMLSTNLQDVAVNQYTAAALARICTYCETHKHFNYLYQFQVIKKDHVAAGLCCIQLFMNSSSQEEAIKHLEHAKMHFDEGLSARHKAGDSTKLVTKGIRGKSASEKLTEEGLVKFSARISIQVDVVKSFNDSDGPQWKHSFFGNPNDPETFRRRCEIAETLVEKNFDLAFRLIYEFNLPAVDIYAGVAASLAERKKGGQLTEFFRNIKGTIDDDDWDQVLGAAINVYANRHKERPDRLIDMLTSSHRKVLACVVCGRLKSAFQIASRSGSVADVQYVAHQALHANALPVLDMCKQWLAQYM

SEQ ID NO: 8059 - protein, 2295 aa, Medicago truncatula
MGKETETLCRLVANHLHLAQFEPLRGVLLALRTRNRDLTRHILQSIVARSAQFPNIAWSSSCSSPALLTYLSTLELLQLDDASSVWNFDSESLRLRGGEENDDDEVKLCTRVLDRVLELGFKRLRVDENGEIENEIEISVILIEEIELMSLRKLVLHCADVFEALSENIEKQIRRCDLEDNGLEVNVKDGDDDLKEDVDVKVLFGIQKMAQVVHLNAIRESLEGGDVEGAISHIRFVHFDYGLDQSEYRIVLKDLLKAVISRSEDFGESWLIMRNQILKIYSEALSSKCRDIVQMMQLAHKMRVSKHINTPKNPGTLGMQDSNTTSIPPLRLAQSIHDEVLSEEIEVDRVQTENFTPRPLVRLQNYLAQPKPGTNLDDKILSLNEVIRSCKTEMYHYARVSGVHVLECIMDTALSAVKREHLEEASSVLQLFPQLQPLVAAMGWDLLAGKIAARRKLMQLLWTSKSQVIRLEESSLYGNKSDEMSCVEHLCDTLCYQLDLASFVACVNSGQSWNSKLSLVRPGKEQVAFSDEDANSDHFVENFVLERLSVQTPIRVLFDVVPGIKFREAIELITMQPIASTLEAWKRKQDVELLHMRYALESSVLALGAMEKSMSDETETRQNVPLVHLKDLRSHLDAISNLPRKIFMVDVIISLLHMDNISANSMHCGSQESDSTLANASSSGNNSSARNEGGNKMVISFTSLLLDTLRQNIPSSVVELENTLDGDVRTTSRQALEWRMSISTRFIEEWEWRLSILQHLLPLSERQWRWKEALTVLRAAPSKLLNLCMQKAKFDIGEEAVHRFSLSAEDKATLELAEWVDSACKKSSVDDVVSRVQDLDFSSLRSQLGPLSTILLCIDVAATSAKSAGMSQQLLNQAQIMLSEIYPGGSPKAGSTYWDQILEVGVISVSRRLLKCLQEFLEQDKPPTLQAILSGEIVITSSKESHRQEQRERALALLHQMIEDAHVGKRQFLSGKLHNLARAVTDEETEPNATRGEGFYSERSFISNSDKDIALGLGLRVVKPIPLSSVGGETGPQSSGFDIKDSGKRIFSPLSSKPMTYLSQFILHVAAIGDIVDGTDTTHDFNFFSVVYEWPKDLLTRLVFERGSTDAAVKIAEIMCADFVHEVISACVPPVYTPRSGHGWACIPVVPSFPKSSSENKVLSPSSKDAKPNCYCRSSATPGVSLYPLELDVVKHLAKISPARAVLACVFGSCILYDSSSSSISSSLSDGLLQTPDADRLFYEFALDQSERYRPNFMCTAQAISLGTGDLILLLHTQYIEGVGGCNEGYPNAAIRWFPTLNRWIQMQTNLHRVSEFAVTANQTADDGNLEARSSVKRVREHDTETESDADDINSSTIPGALTDLNSQGVEAADFWHNSSKSEASQLDTTIFLSFDWDNEEPYQKAVERLIGEGKLMDALALSDRFLRNGASDQLLQLVIERAEEIHSNSAQRQGHGGHNIWSNSWQYCLRLKDKQLAARLALRYVHTWELDAALDVLTMCSCHLPQNDYTREEVLQMKQALQRYSHILSADDHHTSWQEVEAECKEDPEGLALRLAGKSAVSAALEVAESAGLSIDLRRELQGRQLVKLLTADPLNGGGPAEASRFLSSLRDTDDALPVAMGAMQLLPNLRSKQLLVHFFLKRREGNLSEAEISRLNSWALGLRVLSVLPVPWQQRCSSLHEHPHLILEVLLMRKQLQSAALILKEFPSLRDNHVVTTYATKAIAVSISSPPREHRISVSGSRPKQKARSGAPPKLSFTSSLSNLQKEARRAFSWAPKNAVEKNAPKDVYRKRKSSGLSPSDRVAWETMTGIQEDHISSFAADGQERLPAVSIVEEWMLSGDPLKDESIRTSHRYESAPDITLFKTLLALCSDESISAKIALDLCINQMKNVLSSLQMPENASMETIGRAYHATETFVQGLLYAKSLLRKLTGGSEFSSNWERSRDADDTSSDAGSSSVGSQSTDELSEILSQSDVWLGRAELLQSLLGSGIAASLDDIADGESSARLRDRLVVEERYSMAVYTCKKCKIDVFPVWNAWGHALIRMERYGHARVKFKQALQLYKGDPGPVVLEIINTIEGGPPVDVSAVRSMYEHLAKSAPTILDDSLSADSYLNILYMPSTFPRSERSRRSHVSANNNSTYNRDFEDGPRSNLDSIRYTECVNYLQDYGRQHLLRFMFRHGHYHDACYLFFPPDAVPPPPQPSIMSGMSSSSPQRLDSLATDYGTIDDLCELCIGYGAMPILEEVISTRISSTTSQDAAVNQYTVTALARICLYCETHKHFNYLYGFQVTFST

SEQ ID NO: 8060 - protein, 2515 aa, Ricinus communis
MASYNQNPRQMDKETELLSRLAVNHLHLAQFEPLRASLLALRSKNPDLALSILQTIVANAGRFDDILWSPSCPSPSLLTYLSTLELLHYTADSTSRTWSFDPGILKLRAEFLLLIQMLCDVVTEGMRKNVDLESIEREKENDDFSERDREELLNRRSEDLKDVSGELGESLRILDKFLELGIKRLKPDTLVDSIDAVANEEKKSVCLIEEIEIMCLRRQQLKGDDEVDSSGLAITVRTDEKMHMEEVEEVKVLNLIQRSVQLAHLVAMKECLEGGDEDGAVSHIRYLHLDRGVEEAEYRTVLQDLLLTVLSRREGYGDSWYAVQEKLLCIYGETLSTNCSQLVEIIQVIQDDLLRQEIETLRALDNNQIPPPLVRFQRYLAEMRMGADINDPCSSLNVAVSFCMRDMYHYARVSRLHVLECVMDMTLSAVKREQLQEASNVLMLFPRLRPLVAVMGWDLLSGKTAVRRKLMQVLWTSHKAQVLRLEESSLYSNQMDELDLASFVACVNSGRSWNSKSSLLLSGHQQIMSASEDTQSEPFVENFVLERLSVQSPLRVLFDVVPVIKFQDAVELISMQPIASTVEAWKRMQDIELMHMRYALESIVLALGVVGRYMTDERESHQQAALCHLKDLRNHLEAITNIPRKILMVNVVISLLHMDDISLNLTHRASPGSNSESSSTCPWEHDNAPSCEGGNELVISFTELLLDTLHRNLPQGAIEEHALNDSMNTGGRKALEWRISVAKHFIEDWQWRLSILQRLLPFSEHQWRWKEALTVLRAAPSKLLNLCMQRAKYDIGEEAVLRFSLSAEDRATLELAEWVDGAFKRVSESRLVEDAVSRAADGTSSGQDIDFASLRSQLVLHTCKLTCITMQAQVMLSEIYPGGSPKTGSTYWDQIHEVGIISVSRRVLKRLHELLEQDDNPGLQAILSGEIIISTSKELIRQGQKERALAMLHQMIEDAHMGKRQFLSGILLNCFVASGKIHNLARAITDEETELNLSKGDHQYIERKVMADLDKVGVLGLGLKVSKQVPVSSASGETSMQPVGYDIKDTGKRLFGPLSAKPTTYLSQFILHIAAIGDIVDGTDTTHDFNFFSLVYEWPKDLLTRLVFDRGSTDAAGKVADIMCADFVHEVISACVPPVYPPRSGHGWACIPVIPTCPKNCSDNKVLPFTSKEAKPNCYSRSSATSGVPLYPLQLDIVKHLVKISPVRAVLACVFGSGILNIGSDSSMSNSLDDALSPAPDTDRLFYEFALDQSERFPTLNRWIQMQTNRHRVSEFAVTCKQKANDGEVKADGRTAVKRMREHDSDTESEVDDAVGSNNISTALSDISSLSSQGGAASVPRQDSSQSDTVELDSTVYLSLDWENEEPYEKAVERLIGEGKLMDALALSDRFLREGASDQLLQLLIERGEETRSSSGQTQDYGGQSIWSNSWQYCLRLKNKQLAARLALKYMHRWELDAALDVLTMCSCHLPESDPDRNKIVQMRQALQRYSHILSADDHYSSWQEVEVECNADPEGLALRLAGKGAVSAALEVAESAGLSIDLRRELQGRQLVKLLTADPLSGGGPAEASRFLSSLRDSDDALPVAMGAMQLLPNLRSKQLLVHFFLKRRDGNLSDVEVSRLNSWALGLRVLAALPLPWQQRCSSLHEHPHLILEVLLMRKQLQSAALILKEFPSLRENSVIISYAAKAIAVSISCPSREPRISVSGTRPKPKTRTGVPARSSFSSSLSNLQKEARRAFSWAPRNTGEKNATKDVQRKRKNSGLSQSERVAWEAMAGIQEDRVSSYSGDGLERLPSVSIAEEWMLTGDASKDQAVRAAHRYESAPDIILFKALLSLCSDELASAKSALDLCMNQMMNVLSSQQLPENASMETIGRAYHATETFVQGLLYSKSLLRKLAGGSDLSSNCERNRDADDASSDAGSSSVGSQSMDELSEILLQADIWLGRAELLQSLLGSGIAASLDDIADKESSARLRDRLIVDERYSMAVYTCKKCKIDVFPVWNAWGHALIKMEHYAQARVKFKQALQLYKGDPAPVILEIINTIEGGPPVDVSAVRSMYEHLARSAPTILDDSLSADSYLNVLYMPSTFPRSERSRRSQESANNSSAFNSDFDDGPRSNLDSIRYVECVNYLQEYGCQHLLGFMFRHGHYTDACLLFFPPNSIPSPPQPSAMGVATSSSSPQRPDPLATDYGTFDDLCDLCIGYGAMSVLEEVISTRMTSAKQEDVAINQHTASALARICSYCETHKHFNYLYQFQVIKKDHVAAGLCCIQLFMNSSSQEEAVKHLENAKIHFDDGLSARHKSGDSTKLVIKGVRGKSASEKLTEEGLVKFSARVAIQLEVVKSSNDPDEPQWKHSLFGNPNDPETFRRRCEIAEKLVEKNFDLAFQVIYEFNLPAVDIYAGVAASLAERKKGSQLTEFFRNIKGTIDDDDWDQVLGAAINVYANKHKERPDRLIDMLTSSHRKVLACVVCGRLKSAFQIASRSGSVADVQYVAHQVQYVKCEMFADAVPVLQSF

SEQ ID NO: 8061 - protein, 2467 aa, Populus trichocarpa
MDKETDLLSRLAANHLHLAQFEPLRAILTSLRTKNPDLALAILQTIVSNSGRFDNILWSQSCPNPSLLTFLSTLELLQLNNPTSHTWRFDSVTLRLRVEFLLLIQLLIDRVTESLRKNVDLDRGAEEEEEEEEGFLDNFEGLKDGSGELEVLDKVLEFGVKRLKGDVDLDGNEVGGSGRGEGSSSGGVVAIEEGEMMCLRKVILDNADVFDALCWNVESQMKGMKVENENSGMEITVRGEESEKVEEEGVELFDLIRKCVQLAHVDAMKECSKEGDEGVFSHIRFLHLDRGLEESEYRIVLQDLLVRVLSTRKGYGTSWHDMQEKLLRIYEEALSSNCRHLIPLPLEHFQGYLMEMKLDEDSNDPSFSLSRAVSICMREMYHYARVSEVHILECFMDTALSAVKREQLQEASYFLTLFPRLRPLVAAMGWDLLAGKTTTRRKLMQLLWTSRKSQILRLEESATYGNQLDELDLASFVSCVNSGQSWNSKSSLLLSGNQQIISASEDNHSERFVENFVLERLSVQSPLRVLFDVVPTMKFQDAIELISMQPICSDIAAWKRMQDIELMHMRYALESTVLALGVMERCTTDERQSHHQVALCHLKDLRNHLEAITNIPRKILMVNVIISLLHMDDISLNLTHCASPGSNSESSSTCAWDHTDVTFCEGGKEMVISFTGLLLDILHRNLPPGLIEEHTPNDGMSIDGRQALEWRISIARDFIEDWQWRLSVLQRLLPLSECQWGWKEALTVLRAAPSKLLNLCMQRAKYDIGEEAVHRFSLSAEDRATLELAEWVDGAVRRASESRLVEDAVSRAVDGTSAVQDLDFSSLRSQLGSLAAAQVMLSEIYPGASPKIGSTYWDQILEVGIISVSRRVLKRLHEFLEQGDGPGLQAFLAGEIIISSSKELLRQGQRERTLAILHQMIEDAHRGKRQFLSGKLHNLARAIADEETEVNIVKGDNPYAERKLLSHFDKEGVLGLGLKVAKQTPKSSAGGETSMQPVGYDIKDTGKRLFGPLSAKPTTYLSQFILHIAAIGDIVDGTDTTHDFNFFSLVYEWPKDLLTRLVFDRGSTDAAGKVADIMCADFVHEVISACVPPVYPPRSGHAWACIPVAATFHKSYAENKVLSPACKEAKPNCYRSFSATPGIPLYPLQLDIVKHLVKISPVRAVLACVFGRSILYSGSDSSMSGSMDDGSLQEPDNDRLFYEFALDQSERFPTLNRWIQMQTNLHRVSEFAVTSGRKADAGEVKADTRVAIKRFRERDSDTESEVDDTFGSSTISTTLPDLGSQGGSAPEPQEDSSKSDAFELDTTAFLSLDWENEEPYEKAVERLIGEGKLMDALALSDRFLRDGASNQLLQLLIERREEDHPFSGPQGYGGHRIWSNSWQYCLRLKDKQLAARLALKYVLQRRKALQRYNHILTADDHYSSWQEYLLEFLFSFLNVFLIIVTFYFALCFYWSCQVEEECKEDPEGLALRLAGKGAVSAALEVAESAGLSTDLRRELKGRQLVKLLTADPLNGGGPAEASRFLSSLRDSDDALPVAMGAMQLLPNLRSKQLLVHFFLKRRDGNLSDVEVARLNSWALGLRVLAALPLPWQQRCSSLHEHPHLILEVLLMRKQLQSASLILKEFPSLRDNIVVVSYAAKAIAVIINSPAREPRISVSGTRPKPKTRAGVPTRSSFTSSLNNLQKEARRAFSWAPRNNGDKNATKDSYRKRKSSGLPPTERVAWEAMTGIQEDHASSYSADGQERLPPVSIAEEWMLTGDVIKDEAVRTSHRYESAPDIILFKALLSLCSDELMAAKSALDLCMNQMKNVLSARQLSENASTETIGRAYHATETFVQGLLYTKSLLRKLVGGSDLSSNSERSRDADDASSDAGNSSVGSQSTDEPSEILSQADIWLGRAELLQSLLGSGIAASLEDIADKESSARLRDRLIVDEQYSMAVYTCRKCKIDVFPVWNAWGHALIRMEHYAQARVKFKQALQLHKGDPTAIIQEIINTIEGGPPVDVSAVRSMYEHLARSAPTILDDSLSADSYLNVLNMPSTFPRSERSRRYQESANNNSAYSSEFEDGPRSNLDSVRYVECVNYLQEYARQHLLGFMFRHGHYTDACMLFFPQNAVPPPPQPSAMGVATSSSSPQRLDPLATDYGNIDDLCDLCIGYSAMNVLEEVISTRIASAKQQDVNQHTAAVLARICTYCETHRHFNYLYQFQVIKKDHVAAGLCCIQLFMNSFSQEEAVKHLENAKMHFDEGLSARYKGGDSTKLVTKGVRGKSASEKLTEEGLVKFSARVSIQVEVVKSSNDSDGPQWKHSLFGNPNDPETFRRRCEIAETLVEKNFDLAFQIIYEFNLPAVDIYAGVAASLAERKRGSQLTEFFRNIKGTIDDDDWDQVLGAAINIYANKHKERPDRLIGMLTSSHRKVLACVVCGRLKSAFQIASRSGSVADVQYVAHQALHANALPVLDMCKQWLAQYM

SEQ ID NO: 8062 - protein, 2751 aa, Vitis vinifera
MDKESQLLSRLAVNHLFLAQFEPFRAALLTLQIRNPSLARAILQTIVAHGARFDSILWSQSCPSPSLLTWLSTIELLQFSDSSSLWSFDSESLRLRAEFLLLVHTVSSRVSESARKVIDLDSIEKDGLNEGFESRADLLEQREELRDTSDGLVDLVPVLDRIADLGLRRLKPDVGVSDGSGINANQGDTIFEETEFMGLRNVVLEFPEIFDALCWNIQRQFQWTEGSNTGLAITIRNEEKGMVDLEEGDARFLGLILRSVQITHLDAMKESMEKGDVDRAISHIQYLHFDCGVAEDEYRYMDLFHFSNSVKAYDSDDFCKDSMYFNLAALGLKINLGKSEIISVGEVDDIEELAVEIACRVGSLPSQYLGLPLGAPNKASSVWDGVEERVRKRLALWKRQFIFKGGRITLIKSTLASIPIYQMSLFRMPKIVVKRLEKLQRDFLWGGGNMERKVHLVKWEIVCGDKGRGGLGLRKLGLLNKALLGKWIWRFACDRENLWKQVILAKFGQEDYGWRAGLQQLLKSVLSRREGLGDSWHLMREKLLQIYEGALSSNCTHLVQMIQVIQDEFLSEEIEMYRATDNNQMPPPLERFKRSFTESKLDANSNDKISSSSMATNSCMRDMYHYARVSELHVLECVMDTALSTIKREQLQEASNVLTLFPRLQPLVAVMGWDLLAGSLREKNECCHFFYKQLAEYITSLLILQVSCIEHLCDSLCYQLDLASFVACVNSGQSWNSKSSLLLSGRETMAIGEEDNQFDPFVENFVLERLSVQSSLRVLFDVVPGIKFQDAIELISMQPIASNLAAWKRMQDVELMHMRYALESVVLALGAMERSTIDETESYHQKAIYYLKDMRNHMEAINNIPRKILMVTIIVSLLHMDDISLNLTNCASPGSYSELDIRSAWERTDLTTYEGGNKMVTSFIELLLDVLHNNLPSAALEQDHALAGGVTTGGRQALEWKLSSARHFIDDWEWRLSILQSLLPLSERQWRWKEALTVLRAAPSELLNLCMQRAKYDIGEEAVHRFSLSPEDRATLELAEWVDGTFRRASVEDAVSRAADGTSAVQDLDFSSLRSQLGPLAAILLCIDVAATSVRSADMSLQLLNQAQVMLSDIYPGRAPKMGSTYWDQIHEVGVISVTRRVLKRLHEFLEQDKPPALPAILSGEIIISSSKETYRQGQRERALAILHQMIEDAHKGKRQFLSGTCFVFMCNTGKLHNLARAVADEETETRGEGPYTDRKVLLNFDKDGVLGLGLRAIKQTPSSAAGENNMQPVGYDIKDTGKRLFGPISAKPTTFLSQFILHIAAIGDIVDGTDTTHDFNFFSLVYEWPKDLLTRLVFDRGSTDAAGKVAEIMCADFVHEVISACVPPVYPPRSGHGWACIPVIPTCPKSNSENKVLSPSSREAKPNFYSRSSATPGVPLYPLQLDIVKHLVKLSPVRAVLACVFGSSILYNGNDSSLSSSLNSGLLQAPDADRLFYEFALDQSERFPTLNRWIQMQTNLHRVSEFAITAKHTDNDSMVIPEARTAIKRFREHDSDTESEVDDIVNSSNLSTTFTDFNSQTSVAPDNLWRDSPKHEISEDTTVFLSFDWENEVPYEKAVERLIDEGNLMDALALSDRFLRNGASDRLLQLLIERGEENHSGSGQPQGYGGPSIGSNSWQYCLRLKDKQLAARLALKYLHRWELDAALDVLTMCSCHLTQSDPIRNEVLQMRQALQRYNHILCADDHYSSWQEVAAECKEDPEGLALRLAGKGAVSAALEVAESAGLSIELRRELKGRQLVKLLTADPLNGGGPAEASRFLSSLCDSDDALPVAMGAMQLLPNLRSKQLLVHFFLKRRDGNLSDVEVSRLNSWALGLRVLAALPLPWQQRCSSLHEHPHLILEVLLMRKQLESASLILKEFPSLRNNNVIIAYAAKAVSISSPSREPRISVSGPRPKQKTRAGAPTRSSFSSSLSNLQKEARRAFSWTPRNTGEKAAPKDVYRKRKNSGLSPSERVAWEAMTGIQEDRVSSFSADGQERLPSVSISEEWMLTGDTNKDEAVRSSHRYESAPDIILFKALLSLCSDELVSAKGALDLCVNQMKNVLSSHQLPENATVETVGRAYHATETFVQGLFFARSLLRKLAGGSDLSSNPERSRDADDTSSDAGSSSMGSQSTDELSEVLSQAEIWLGRAELLQSLLGSGIAASLNDIADKESSARLRDRLIVDEQYSMAVYTCKKCKIDVFPVWNAWGHALIRMEHYAQARVKFKYVKFIFGLQALQLYKGDPAPVILEIINTIEGGPPVDVAAVRSMYDHLARSAPTILDDSLSADAYLNVLYMPSTFPRSERSRRALESASSNSIYSPDFEDGPRSNLDSLRYLECVNYLQEYARQHLLTFMFRHGHYNDGCMLFFPTNAVPPPPQPSNHGVVTSSSSPQRQDLLATDYGSIDDLCDMCIGYGAMSVLEEVISTRMLSTNLQDVAVNQYTAAALARICTYCETHKHFNYLYQFQVIKKDHVAAGLCCIQLFMNSSSQEEAIKHLEHAKMHFDEGLSARHKAGDSTKLVTKGIRGKSASEKLTEEGLVKFSARISIQVDVVKSFNDSDGPQWKHSFFGNPNDPETFRRRCEIAETLVEKNFDLAFRLIYEFNLPAVDIYAGVAASLAERKKGGQLTEFFRNIKGTIDDDDWDQVLGAAINVYANRHKERPDRLIDMLTSSHRKVLACVVCGRLKSAFQIASRSGSVADVQYVAHQALHANALPVLDMCKQWLAQYM

SEQ ID NO: 8063 - protein, 574 aa, Ricinus communis
MVGFEVGFVPFNPDGWGPPDAAFASAATTTSTLPLNVPFAPFSRSDKLGRIADWTRNINPNANRPNSKQNASDSVFDFTADDSFPAATAAGDDDSTFRLVDGKPPPRPKFGPKWRFNQHRQQLPQRRDEEVEARKREAEKERARRDRLYNMNRSNQNQPRREAAVFKSSVDIQPEWNMLDQIPFSTFSKLSFSVPEPEDLLLCGGLEFYDRSFDRITPKNERRLERFKNRNFFKVTTTDDPVIRRLANEDKATVFATDTILATLMCAPRSVYSWDIVIQRVGNKLFFDKRDGSQLDLLSVHETSQEPLPEAKDDMNSAYSLSVEAAYINQNFSQQVLIRDGNKVSFDEPNPFATEGEEVASVAYRYRRWKLDDDMHLVARCEVQSVVEVNKQRSFLTLNALNEFDPKYSGVDWRQKLETQRGAVLATELKNNANKLAKWTAQALLASADLMKLGYVSRVHPRDHYNHVILAVVGYKPRDFAAQINLNTSNMWGIVKSIVDLCMKLNEGKYVLVKDPSKPQVRIYEVPADAFENDYVEEPLPEEEQVQPPGEDTENAEANGGTVDVEAKDIDAQA

SEQ ID NO: 8064 - protein, 574 aa, Populus trichocarpa
MVDGFEVGAVHFNSEGWGPPDATVTPTTTSTLPLNVPYAPFSRSEKLGRIADFTRILNPGSGEGGGGGRKSAASDSVFDFTADDSFPSGADNDSTFRLVDGKPPPRPKFGPKSRFNQHHRPQLPQRRDEEVEAKKREAEKERARRDRLYYLNRSNQNQQRREAAVFKSSVEIQTEWNMLDKIPFSIFTKLSFSVSEPEDMILCGGLEFYDKSFDRITPKAERRLERFKNRNFFKVTTTDDPVIRRLANEDKATVFATDNILATLMCATRSVYSWDIVVQRVGNKLFFDKRDGSQLDLLSVHETSQEPLPEAEDDINSAYSLSVEAAYINQNFSQQVLFRDGNKVSFDEPNPFANEGEEVASVAYRYRRWKLDDDMYLVARCEVQSVVEVNKQRSFLTLNALNEFDPKYSGVDWRQKLETQRGAVLATELKNNANKLTKWTAQALLANADMMKLGYVSRVHPRDHFNHVILAVVGYKPRDFASQINLNTSNMWGIVKSIVDLCMKLNEGKYVLVKDPSKPQVRIYEVPADAFENDYVEEPLPEEEQAQPPEENAENTEANGVTNDVEDKEIGAQV

SEQ ID NO: 8065 - protein, 557 aa, Glycine max
MGKAFDIGAVPFNAEGWGPPDSTITGSNINLPLNVPFAPFSRSDKLGRIADWTRNFNNPTRSKNPADAVFDFTNDDDDDTFHLVDPKPPPRPKFGPKWRFPQQRQLPQRRDEEVEAKKREQEKERARRDRLYHMNRSNPNQQRREAAVFKSSVDIQPEWNMHDQIPFSTFSKLSFTVPEPEDLLLCGALEYYDRTYDRITPKNERRLERFKNRNFFKVTTTDDPIIRRLANEDKATVFATDTILSTLMCAPRSVYSWDIVVQRVGNKLFFDKRDGSQLDLLSVHETSQEPLPESKDDINSAHSLSVEAAYINQNFSQQVLIRDGNKVTFDEANPFANEGEEVASVAYRYRRWKLDDDMYLVARCEVHSVVDVNKQRSFLTLNALNEFDPKYSGVDWRQKLETQRGAVLATELKNNANKLAKWTAQALLASADTMKLGYVSRIHPRDHFNHVILAVVGYKPRDFAAQINLNTTNMWGIVKSIVDLCMKLNEGKYVLVKDPSKPQVRIYEVPADAFENDYVEEPLPEDEQVQPPSEGAEGGEATTTTNDVEDKQIDGQA

SEQ ID NO: 8066 - protein, 556 aa, Populus trichocarpa
MVGGFEVGAVPFNPDGWGPPDATVTATTTSTLPLNVPFAPFSRSEKLGRIADFTRNLNQGQGGAGGRKNAASDSVFDFTADDSFPSAADNDSSFRLVDGKPPPRPKFGPKWRFNQHNRPQLPQRRDEEVEAKKREAEKERARRDRHYNQNRSNQNQPRREAAVFKSSVEIQPEWNMLDQIPFSTFTKLSFSVPEPEDLILCGGLEFYDKSFDRITPKAERRLERFKNRNFFKVTTTDDPVIRRLANEDKATVFATDNILATLMCATRSVYSWDIVVQRVGNKLFFDKRDGSQLDLLSVHETSQEPLPEAKDDINSAYSLSVEAAYINQNFSQQVLFRDGNKVAFDEPNPRWKLDDDMHLVARCEVQSVVEVNKQRSFLTLNALNEFDPKYSGVDWRQKLETQRGAVLATELKNNANKLAKWTAQALLASADMMKLGYVSRVHPRDHFNHVILAVVGYKPKDFASQINLNTSNMWGIVKSIVDLCMKLNEGKYVLVKDPSKPQVRIYEVPADAFENDYVEEPLPEEEQAQPPEENAENAEANGVTNDVEDKEIDVQA

SEQ ID NO: 8067 - protein, 565 aa, Glycine max
MGKAFDIGAVPFNADGWGPPDNATSGSNNNNLPLNVPFAPFSRSDKLGRIADWTRNFNNPTRSKNPADAVFDFANDDSFPASADDDASFRLVDGKPPPRPKFGPKWRFQQQRQLPQRRDEEVEAKKREQEKERARRDRLYHMNRSNPNQQRREAAVFKSSVDIQPEWNMHDQIPFSTFSKLSFTVPEPEDLLLCGALEYYDRTYDRITPKNERRLERFKNRNFFKVTTTDDPVIRRLANEDKATVFATDTILSTLMCAPRSVYSWDIVVQRVGNKLFFDKRDGSQLDLLSVHETSQEPLPESKDDINSAHSLSVEAAYINQNFSQQVLIRDGNKVTFDEANPFANEGEEVASVAYRYRRWKLDDDMYLVARCEVHSVVDVNKQRSFLTLNALNEFDPKYSGVDWRQKLETQRGAVLATELKNNANKLAKWTAQALLASADTMKLGYVSRIHPRDHFNHVILAVVGYKPRDFAAQINLNTTNMWGIVKSIVDLCMKLNEGKYVLVKDPSKPQVRIYEVPADAFENDYVEEPLPEDEQVQPPAEGAEGGEAAATTNDVEDKQIDGQA

SEQ ID NO: 8068 - protein, 591 aa, Arabidopsis thaliana
MVTEAFEFVAVPFNSDGWGPPDASDVSSSASPTSVAAANLLPNVPFASFSRSDKLGRVADWTRNLSNPSARPNTGSKSDPSAVFDFSAFAIDEGFGLASSGGNPDEDAAFRLVDGKPPPRPKFGPKWRFNPHHNRNQLPQRRDEEVEAKKRDAEKERARRDRLYNNNRNNIHHQRREAAAFKSSVDIQPEWNMLEQIPFSTFSKLSYTVQEPEDLLLCGGLEYYNRLFDRITPKNERRLERFKNRNFFKVTTSDDPVIRRLAKEDKATVFATDAILAALMCAPRSVYSWDIVIQRVGNKLFFDKRDGSQLDLLSVHETSQEPLPESKDDINSAHSLGVEAAYINQNFSQQVLVRDGKKETFDEANPFANEGEEIASVAYRYRRWKLDDNMHLVARCELQSVADLNNQRSFLTLNALNEFDPKYSGVDWRQKLETQRGAVLATELKNNGNKLAKWTAQALLANADMMKIGFVSRVHPRDHFNHVILSVLGYKPKDFAGQINLNTSNMWGIVKSIVDLCMKLSEGKYVLVKDPSKPQVRIYEVPPDAFENDYVEEPLPEDEQVQPTEENTEGAEASVAATKETEEKKADDAQA

SEQ ID NO: 8069 - protein, 591 aa, Arabidopsis thaliana
MVTEAFEFVAVPFNSDGWGPPDASDVSSSASPTSVAAANLLPNVPFASFSRSDKLGRVADWTRNLSNPSARPNTGSKSDPSAVFDFSAFAIDEGFGLASSGGNPDEDAAFRLVDGKPPPRPKFGPKWRFNPHHNRNQLPQRRDEEVEAKKRDAEKERARRDRLYNNNRNNIHHQRREAAAFKSSVDIQPEWNMLEQIPFSTFSKLSYTVQEPEDLLLCGGLEYYNRLFDRITPKNERRLERFKNRNFFKVTTSDDPVIRRLAKEDKATVFATDAILAALMCAPRSVYSWDIIIQRVGNKLFFDKRDGSQLDLLSVHETSQEPLPESKDDINSAHSLGVEAAYINQNFSQQVLVRDGKKETFDEANPFANEGEEIASVAYRYRRWKLDDNMHLVARCELQSVADLNNQRSFLTLNALNEFDPKYSGVDWRQKLETQRGAVLATELKNNGNKLAKWTAQALLANADMMKIGFVSRVHPRDHFNHVILSVLGYKPKDFAGQINLNTSNMWGIVKSIVDLCMKLSEGKYVLVKDPSKPQVRIYEVPPDAFENDYVEEPLPEDEQVQPTEENTEGAEASVAATKETEEKKADDAQA

SEQ ID NO: 8070 - protein, 591 aa, Arabidopsis lyrata subsp. lyrata
MVAEAFEFVAVPFNSDGWGPPDASDVSSSASSTSVAAANLLPNVPFASFSRSDKLGRVADWTRNLSNPSARPPTGSKSDPSAVFDFSAFAIDEGFGLTSSGGNPDEDAAFRLVDGKPPPRPKFGPKWRFNPHHNRNQLPQRRDEEVEAKKRDAEKERARRDRLYNNNRNNIHHQRREAAAFKSSVDIQPEWNMLEQIPFSTFSKLSFTVQEPEDLLLCGGLEYYNRVFDRTTPKNERRLERFKNRNFFKVTTSDDPVIRRLAKEDKATVFATDAILAALMCAPRSVYSWDIVIQRVGNKLFFDKRDGSQLDLLSVHETSQEPLPEAKDDINSAYSLGVEAAYINQNFSQQVLVRDGKKETFDEANPFANEGEEIASVAYRYRRWKLDENMHLVARCELQSVAELNNQRSFLTLNALNEFDPKYSGVDWRQKLETQRGAVLATELKNNGNKLAKWTAQALLANADMMKIGFVSRVHPRDHFNHVILSVLGYKPKDFAGQINLNTSNMWGIVKSIVDLCMKLSEGKYVLVKDPSKPQVRIYEVPPDAFENDYVEEPLPEDEQVQPTEGNAEGAEASVAAAKETEDKKADEIQA

SEQ ID NO: 8071 - protein, 597 aa, Musa acuminata
MGFDVGVVPFNTDGWGPPESPAAPLLLSRNDGESTQPANIPFAPFSRSEKLGRVADWTRNPNFGNNAARSAGGRDAVFDFAVDESSALSGAAADDSSFRLVDGKPPPRPKFGPRWRFQQRPQLPQRRDEEVEARKREAEKERARRDRLYRLNHRSYASAGGHGAAGSHRDAPARKSSVDIQPEWTMLDQIPFSTFSKLSFSVPDPPEDLLVCGALEFYDRSFDRVNPKNERRLERFKSRNFFKVTTSDDPVIRRLAADDKATVFATDAILSALMCAPRSVYSWDIVIQRVGNKLFFDKRDRSQLDLLSVHETSQELLPDAKEDINSAYSLAVEATYINQNFSQQVLVRDGNKVSFDEPNPFASEGEEVASVAYRYRRWKLDEDTHIIARCEVHSVTDVKGQRAFMTLNALNEFDPKFSGVDWRQKLETQRGAVLATELKNNANKLAKWTAQALLAGADLMKLGYVSRVHPRDHFNHVILSVIGYKPKDFATQINLNTSNMWGIVKSIVDLCMKLNEGKYVLVKDPVKPQVRIYEVPADAFENEYVEEPLPEEEQVQPPAEEDATVGATDAAAEAEAEPNTAAGAAEGERDAIIASAV

SEQ ID NO: 8072 - protein, 588 aa, Arabidopsis lyrata subsp. lyrata
MVFEAFEVGTVPFNSDGWGPPDASDTSSTSAAAANLLPNVPFASFSRSEKLGRVADWTRALSNPSARPHTGSKADPSAIFDFSAFAVDEGFGLTNSGGNADEDAVFRLVDGKPPPRPKFGPKWRFNQYHNRNQLPQRRDEEVEAKKREAEKDRARRDRLYNNNRNNIHQQRREAAAFKSSVDIQPEWNMLEQIPFSTFSKLSFTVQEPEDLLLCGGLESYDRSYDRITPKADRRLERFKNRSFKVTTSDDLVIRRLAKEDKATVFATDAILAALMCAPRSVYSWDLVIQRVGNKLFFDKRDGSPLDLLSVHETSQEPLPEAKDDINSAHSLGVEAAYINQNFAQQVLVRNGKRVTFDEPIPNVNEGEENASIAYRYRRWKLDDSMYLVARCELQSTVDLNNQRSFLTLNALNEFDPKYSGVDWRLKLETQRGAVLANELKNNGNKLAKWTAQALLANADMMKIGFVSRVHPRDHYNHVILSVLGYKPKDFAGQINLNTNNMWGIVKSIVDLCMKLSEGKYVLVKDPSKPQVRIYEVPADAFDNDYVEEPLPEDEQVQPSEENADAGAETNGASSTNVAAEDKKSEAEA

SEQ ID NO: 8073 - protein, 333 aa, Phaseolus vulgaris
MDGNPTTTSSSASPPVNFNFSPDNPSPITLTADQVSHCAQALNLLKEKLHAPHTITREFAHLQANRITPSEMRRRCTVALDAVNLSKNRYTDVLPFDSNRVALKSSTDYRPAAQGYINASLVSTSSPGNVSQFVATQGPLPHTYEDFWEMIIQYHCPAIIMLTRLVDNYKMVKCGDYFQAEDGPREVGNISVIGKWVNTTETSLVLRLLEVNHREVEDAPISVLHIQYPEWPDHGVPKDTLAVREILKRLYHLPPNLGPIVVHCSAGIGRTGTYCTIHNTIQRILAGDMSAVDIANTVSVFRAQRIGMVQTQDQYIFCYKAIIDELEDLVSQQ

SEQ ID NO: 8074 - protein, 338 aa, Glycine max
MAGNPATTSSSALSPEKFNFNFSPDNPSRITLTSDQVNHCTQALNILKEKLHAPNVITQEFAHLQANRITPSEMRRRCTVAYDDVNLRKNRYTDVLPFDKNRVVLKSSTDYRPEAQGYINASLVSTSSAGNVSQFIATQGPLQHTYEDFWEMIIQYHCPAIIMLTRLVDNYKMAKCGDYFQAEDRPREVGNISIIGKWENTTETSLVLRHLEVNHREVEDAPLSVLHIQYPEWPDHGVPKDTFAVREILKRLYHLPPNFGPIVVHCSAGIGRTGTYCTIHNTIQRIVAGDMSAVDIAKTIAMFRSQRIGMVQTQDQYIFCYNAIIDELEDLVSQQQSE

SEQ ID NO: 8075 - protein, 338 aa, Glycine max
MAGNSATATATSSALSPENLKFNFSPDNPSRIILTSDQVNHCTQALNLLKEKLHDPHVITQEFAHLQANRITPSEMRRRCTVAYDAVNLSKNRYTDVLPFNKNRVVLKSSTDYRPEAQGYINASLISTSSAGNVSHFIATQGPLPHTCEDFWEMITQYHCPVIIMLTRLVDNYKMVKCVDYFQAEDGPREVGNISIIGKWENTTETSLVLRHLEVNHREVDDAPLSVLHIQYPEWPDHGVPKDTLAVREILKRLYHLPSNLGPIVVHCSAGIGRTGAYCTIHNTIQRILAGDMSAVRIANTIAMFRSQRIGMVQTQDQYIFCYNAIIDELEDLVSQQQ

SEQ ID NO: 8076 - protein, 332 aa, Pisum sativum
MGGSSAPPSSTSSHNNSTFSPDFPSRIPLTSDQIKHCTEALALLKNKLLNPHTVSQKFFHLQSNRITLSETTKKCHVALNSANLSKNRYSDVIPFDKNRVVLKSSSDYRSEALGYINASKISTSSPGIVSEFIATQGPMPHTFEDFWEMMIQYHCPAIVMLTGLVDNYKTVKCGDYFQSEDRPREFGNISLTCKWTKTTKTSLVLRHLEVNRKEVEDTPLSVFHIQYPEWPDHGVPNNTLAVRAIWKRLYHLPPNLGPIVVHCSAGIGRTGTYCTIHNTIQRILAGDMSAIDIANTVSVFRSQRIGMVQTQDQYIFCYEAIIDELEDLVSQQ

SEQ ID NO: 8077 - protein, 68 aa, Glycine max
MENNSRSPREGCMDFAVHSQVIKIKEEIEKIKHPSLQLHMRRALLRDVNRLRSRSPLGFADRERAILT

SEQ ID NO: 8078 - protein, 599 aa, Medicago truncatula
MEWENAVSGGSDSALPIPLPLASESQQPYVSELLSFTLDRLHKEPELLRVDAERIRRQMQEVAVGNYRSFIAAADALLAIRHEVSSIDTHLESMINEIPKLTSGCTEFIESAEQILEKRKMNQTMLANHSTLLDLLEIPQLMDTCVRNGNYDEALDLEAFVGKLSTMHPKLPIIQALAAEVRLTTQSLLSQLLQKLRSNIQLPECLRIIGYLRRIGVFSEYGMRLLFLRCREAWLNGILEDLDQANPYEYLKGMINCHRMHLFDVVNQYRAIFADDTSGSEENYDGGLLFSWAMHQITSHLQTLKVMLPKITEGGSLSNILDQCMYCAMGLGWVGLDFRGLLPPLFEEAVLNLFSKNMSTAVENFQLVLESHRWVPLPAVGFRANSVEESKEDVTPPSYLMEHPPLAVFINGVSAAMNELRPCAPLSLKHVLAQELIKGLQAVSDSLLLYNTTRVLRANESGLFLSLCRAFIEVLYNLVTVFFRVAYPHCATCFGRCYTGGATLITDAKNVYDGIRRLVEASSARELPKPVNNGEASGIAENGEVPKMDNGETPDAKEPDAKESEAIDTESEATNTDETNKNSTSQTGQEVINLEKTDE

SEQ ID NO: 8079 - protein, 580 aa, Glycine max
MESATVSSSESETALPLPLASESQQPYVSELLSFTLDRLHKEPELLRVDADRIRRQMQEVAVGNYRSFIAAADALIAIRQEVSSIDNHLESLINEIPKLTSGCTEFIESAERILEKRKMNQTMLTNHSTLLDLLEIPQLMDTCVRNGNYDEALDLEAFVGKLSTMHPKLPVIQALAADVRLTTQSLLSQLLQKLRSNIQLPECLRIIGYLRRIGVFSEYGMRLLFLRCREAWLTGILEDLDQANPYEYLKGMINCHRMHLFDVVNQYRAIFADDTSGSEENYDGGLLFSWAMHQITSHLQTLKVMLPKITEGGSLSNILDQCMYCAMGLGWVGLDFRGLLPSLFEEAVLNLFSKNMSSAVENFQLVLDSHRWVPLPGVGFSAHTVGDENHEDVTPPSNLMEHPPLAVFINGVSAAMNELRPCAPISLKHVLAQELIKGLQAVSDSLLLYNTTRVLRSNESGLFLSLCWAFIEAAYPHCATCFGRCYLGGATLIMDAKNVYNGISRLLETSSARELPKPVNNVESKSVAENGESPKMENGETPDAKESEAVNSEEVNEEGTEEGPTLQTDREDTNLEKPLE

SEQ ID NO: 8080 - protein, 576 aa, Glycine max
  misc_feature (402)..(402): Xaa can be any naturally occurring amino acid
MESATASSSESEMALPLPLASESQQPYVSELLSFTLDRLHKEPELLRVDADRIRRQMQEVAVGNYRSFIAAADALIAIRQEVSSIDNHLESLINEIPKLTSGCTEFIESAEQILEKRKMNQTMLTNHSTLLDLLEIPQLMDTCVRNGNYDEALDLEAFVGKLSTMHPKLPVIQALAAEVRLTTQSLLSQLLQKLRSNIQLPECLRIIGYLRRIGVFSEYGMRLLFLRCREAWLTGILEDLDQANPYEYLKGMINCHRMHLFDVVNQYRAIFADDTSGSEENYDGGLLFSWAMHQITSHLQTLKVMLPKITEGGSLSNILDQCMYCAMGLGWVGLDFRGLLPSLFEEAVLNLFSKNMSTAVENFQLVLDSHRWVPLPGVGFSAHTVGDENHEDVTPPSNLMEXPPLAVFINGVSAAMNDLRPCAPISLKHVLAQELIKGLWAVSDSLLLYNTTRVLRSNESGLFRSLCRAFIEVAYPHCATCFGRCYPGGATLVMDAKNVYDGISRLLETSSSRELPKPVNNEESKSVAENGELPKMENGETPDAKESEAVIGKDVNEEGPTLQIDQEDTNLEKSVE

SEQ ID NO: 8081 - protein, 571 aa, Vitis vinifera
MDSDAAEDSSPMATLLPLASVSQQPYVSELLSFTLDRLHKEPELLRVDAERIRRQMQEVAVNNYRAFISAADALLAIREEVSSVDKHLESLINEIPKLTSGCTEFIESAEQILEERKMNQTLLANHSTLLDLLEIPQLMDTCVRNGNYDEALDLEAFVCKLSTMHPKLPVIQALAAEVRQTTQSLLHQLLQKLRSNILLPDCLRIIGYLRRIGVFSEFEMRLQFLRCREAWLTGILDDLDQKNAYDYLKGMVNCQRMHLFDVVNQYRAIFADDTSGSEENYDGGLLFSWAMHQITSHLRTLKAMLPKITEGGSLSNILDQCMYCAMGLGWVGLDFRGLLPSLFEEAVLNLFSKNMNTAIENFQLVLDSHRWVPLPAVGFPSGGVGEETREDVTPPSYLMEHPPLAVFVNGVSAAMNELRPCAPISLKHVLAQELINGLRAVSNSLLRYNASRMLRENESLLFLSLCRAFIEVAYPHCATCFGRCYPGGAALIMDAKNLYDGIGNLLAVSASRELPKSVTTTEENSVTVTENGNLPNEENGVMPETEQALNGKVDEEEENDLTSLTEKPADE

SEQ ID NO: 8082 - protein, 560 aa, Vitis vinifera
MATLLPLASVSQQPYVSELLSFTLDRLHKEPELLRVDAERIRRQMQEVAVNNYRAFISAADALLAIREEVSSVDKHLESLINEIPKLTSGCTEFIESAEQILEERKMNQTLLANHSTLLDLLEIPQLMDTCVRNGNYDEALDLEAFVCKLSTMHPKLPVIQALAAEVRQTTQSLLHQLLQKLRSNILLPDCLRIIGYLRRIGVFSEFEMRLQFLRCREAWLTGILDDLDQKNAYDYLKGMVNCQRMHLFDVVNQYRAIFADDTSGSEENYDGGLLFSWAMHQITSHLRTLKAMLPKITEGGSLSNILDQCMYCAMGLGWVGLDFRGLLPSLFEEAVLNLFSKNMNTAIENFQLVLDSHRWVPLPAVGFPSGGVGEETREDVTPPSYLMEHPPLAVFVNGVSAAMNELRPCAPISLKHVLAQELINGLRAVSNSLLRYNASRMLRENESLLFLSLCRAFIEVAYPHCATCFGRCYPGGAALIMDAKNLYDGIGNLLAVSASRELPKSVTTTEENSVTVTENGNLPNEENGVMPETEQALNGKVDEEEENDLTSLTEKPADE

SEQ ID NO: 8083 - protein, 574 aa, Ricinus communis
MEVENGDDTSAMANLIPLASVSQQPYVSELLSFTLDRLHKEPELLRVDAERIQRQMQEVAVGNYRAFIAAADALLAIRQEVSSIDNHLESLITEIPKLTSGCTEFIESAEQILEERKMNQTLLANHSTLLDLLEIPQLMDTCVRNGNYDEALDLEAFVCKLLTMHPKLPVIQALAAEVRQTTQSLLSQLLQKLRSNIQLPECLRIIGYLRRIGVFSEYEMRLQFLRCREAWLTGILEDLDQRNVYEYLKGMINCHRMHLFDVVNQYRAIFADDTSGSEENYDGGLLFSWAMHQITAHLKTLKIMLPKITEGGSLSNILDQCMYCAMGLCWVGLDFRGLLPSLFEEAVLNLFSKNMSTAVENFQLVLDSHRWVPLPAVGFPTNSVSEENQEDVTPPSYLMEHTPLAVFVNGVSAAMNELRPCAPLSLKFVLAQELIKGLKAVSDSLLRYNATRMLRENESGLFLSLCRAFIEVAYPHCATCFGRCYSGGTALIMDAKNLYDGISRLLATSPSRELPRPVNNPEEKSITENGNLPVVENEVSTDVEQPQPQGMNAATDEKEQKSPTIPTDEKQPDA

SEQ ID NO: 8084 - protein, 568 aa, Citrus unshiu
METETGDDATSSSVASLLPLASLSQQPYVSELLSFTLDRLHKEPELLRVDAERIQRQMQEVAVGNYRAFIAAADALLAIREEVSSIDKHLDSLITEIPKLTSGCTEFIESAEEILEKRKMNQMLLANHSTLLDLLEIPQLMDTCVRNGNYDEALDLEAYVCKLSTLHPKLPIIQALAAEVKQTTQSLLSQLLQKLRSNIQLPECLRIIGYLRRIGVFSEYEMRLQFLRCREAWLTGILEDLDQKNAYEYLKGMINCHRMHLFDVVNQYRAIFADDTSGSEENYDGGLLFSWAMHQITAHLKTLKVMLPKITEGVSLSNILDQCMYCAMGLGWVGLDFRGLLPPLFEEAVLKLFSKNMSTAVENFQLVLDSHRWVPLPAVGYPAHSVGEESQEDVTPPSYLMEHPPLAVFINGVSAAMNELRPCAPLSLKHVLAEELIKGLQAVSDSLLRYSTTRMLRENESGLFLSLCRAFIEVAYPHCATCFGRCYPGGAALIMDAKSLYDGLGRLSTHSPSRELPKPVNDADGKTITENGDLPVVENGVNPAAEETEGTNVDEKEQPLQTEEKPEE

SEQ ID NO: 8085 - protein, 575 aa, Populus trichocarpa
MEITENGQDMSSAVTSLLPLASVSQQPYVSELLSFTLDRLHKEPELLRVDAERIQRQMQEVAVVNYRAFIAAADALLAIRQQVSSIDNHLESLITEIPKLTSGCTEFIESAEEILEKRKMNQTLLANHSTLLDLLEIPQLMDTCVRNGNYDEALDLEAFVCKLSTMHPKLPVIQALAAEVRQTTQSLLSQLLQKLRSNIQLPECLRIIGYLRRIGVFSEYEMRLQFLRCREAWLTGILEDLDQRNAYEYLKGMINCHRTHLFDVVNQYRAIFADDTSGSEENYDGGLLFSWAMHQITSHLKTLKIMLPKITEGGSLSNILDSCMYCAVGLNWVGLDFRGLLPPLFEEAVLNLFSKNMNTAVENFQLVLDSHRWVPLPAVGFPSYSIGEEQQEDVTPPSYLMEHPPLAVFINGVSAAMNELRPCAPVSLKHVLAQELIKGLQAVSDSLLRYNATRMLRDNESGLFLSLCRSFIEVAYPHCATCFGRCYPGGAALIMDAKNLYDGVGRLLATSSRELQRPANNTEGKKITENGDQLVVENGVTPEVEPSGVAIADEKDQISPTVQIDEKQGDSVASV

SEQ ID NO: 8086 - protein, 568 aa, Arabidopsis lyrata subsp. lyrata
MATEVGEMSPPEATASLLSLASATQQPYVSELLSFTLDRLHKEPELLRVDAERIQRQMQEVAVGNYRAFITAADALLAIRQEVSSIDKHLESLIGEVPKLTSGCTEFIDSAENILEKRKMNQSLLANHSTLLDLLEIPQLMDTCVRNGNFDEALDLEAFVSKLATMHPKLPVIQALAAEVRQTTQSLLSQLLQKLRSNIQLPECLRIIGYLRRIGVFGEYEMRLQFLRCREAWLTGILEDLDQKNAYEYLKGMINCHRMHLFDVVNQYRAIFADDTSGSEENYDGGLLFSWAMHQITSHLKTLKIMLPKITEGGSLSNILDQCMYCAMGLGWVGLDFRGLLPPLFEEAVLNLFSKNMSTAVENFQLVLDSHRWVPLPSVGFPSSGINEDSKDDVTPPSYLMEHPPLAVFINGVSAALNELRPCAPLSLKNVVAHELIKGLQAVSDSLLRYNTTRMLRLSESNLFLSLCRAFVEVVFPHCATCFGRCYPGGATIVMDAKSPYEGLGRILAASSSQEPSNKSPKVISTDTKDASENGVASQPEEKQAESPNEKEDNSPIPLQTPETTPES

SEQ ID NO: 8087 - protein, 569 aa, Arabidopsis thaliana
MAMEVGEMSQPEATASLLSLASATQQPYVSELLSFTLDRLHKEPELLRVDAERIQRQMQEVAVGNYRAFITAADALLAIRQEVSSIDKHLESLIGEVPKLTSGCTEFIDSAENILEKRKMNQALLANHSTLLDLLEIPQLMDTCVRNGNFDEALDLEAFVSKLATLHPKLPVIQALAAEVRQTTQSLLSQLLQKLRSNIQLPECLRIIGYLRRIGVFGEYEMRLQFLRCREAWLTGILEDLDQKNAYEYLKGMINCHRMHLFDVVNQYRAIFSDDTSGSEENYDGGLLFSWAMHQITSHLKTLKIMLPKITEGGSLSNILDQCMYCAMGLGGVGLDFRGLLPPLFEEAVLNLFSKNMSTAVENFQLVLDSHRWVPLPSVGFPSSGINEDSKDDVTPPSYLMEHPPLAVFINGVSSALNELRPCAPLSLKNVVAHELIKGLQAVSDSLLRYNTTRMLRLSESNLFLSLCRAFVEVVFPHCATCFGRCYPGGATIVMDAKSAYEGLGRILAASSSQEPSNKSPKVISTDTKDASENGVASQPEEKQAENPNAKEEDNSPIPLQTPEITPES

SEQ ID NO: 8088 - protein, 233 aa, Glycine soja
MAFEALNSPTTTAPSFPFDDPTIPWAKRKRSKRCSRDHPSEEEYLALCLIMLARGGTTRRVSTPPPQPTPDPSTKLSYKCSVCNKSFPSYQALGGHKASHRKLAASGGEDQPTTTSSAASSANTASGGRTHECSICHKSFPTGQALGGHKRCHYEGNSNGNNNNSNSSVTAASEGVGSTHTVSHGHHRDFDLNIPAFPDFSTKVGEDEVESPHPVMKKPRLFVIPKIEIPQFQ

SEQ ID NO: 8089 - protein, 233 aa, Glycine max
MALETLNSPTTTAPSFPFDDPTIPWAKRKRSKRCSRDHPSEEEYLALCLIMLARGGTTRRVSTPPPQPTPDPSTKLSYKCSVCNKSFPSYQALGGHKASHRKLAASGGEDQPTTTSSAASSANTASGGRTHECSICHKSFPTGQALGGHKRCHYEGNSNGNNNNSNSSVTAASEGVGSTHTVSHGHHRDFDLNIPAFPDFSTKVGEDEVESPHPVMKKPRPFVIPKIEIPQYQ

SEQ ID NO: 8090 - protein, 240 aa, Glycine max
MALEALNSPTTTAPSFPFDDPTIPWAKRKRSKRSRDHPSEEEYLALCLIMLARGGTTTVNNRHVSPPPLQPQPQPTPDPSTKLSYKCSVCDKSFPSYQALGGHKASHRKLAGAAEDQPPSTTTSSAAATSSASGGKAHECSICHKSFPTGQALGGHKRCHYEGNGNGNNNNSNSVVTVASEGVGSTHTVSHGHHRDFDLNIPAFPDFSTKVGEDEVESPHPVMKKPRLFVIPKIEIPQFQ

SEQ ID NO: 8091 - protein, 215 aa, Glycine max
MALETLNSPTTTAPSFPFDDPTIPWAKRKRSRRCSRDHPSEEEYLALCLIMLARGGTTRRVSTPPPQPTPDPSTKLSYKCSVCNKSFPSYQALGGHKASHRKLAASGGEDQPTTTSSAASSANTASGGRTHECSICHKSFPTGQALGGHKRCHYEGNSNGNNNNSNSSVTAASEGVGSTHTVSHGHHRDFDLTSRLFRIFRPRSEKTRLRALTLS

SEQ ID NO: 8092 - protein, 299 aa, Glycine max
MASELELPPGFRFHPTDEELVLHYLCRKCASQPIAVPIIAEIDLYKYDPWDLPGLATYGEKEWYFFSPRDRKYPNGSRPNRAAGTGYWKATGADKPIGQPKPVGIKKALVFYAGKAPKGDKSNWIMHEYRLADVDRSVRKKNTLRLDDWVLCRIYNKKGTIEKLQPSSDVAHSRNIESSEIEDRKPEILKSGGGCLPPPAPVPAPPQATAKTDYMYFDPSDSIPKLHTDSSCSEQVVSPGFASEVQSEPKWNEWEKSLEFPFNYVDATLNNSFMAQFQGNNQMLSPLQDMFMYWPNKSF

SEQ ID NO: 8093 - protein, 300 aa, Glycine max
MASELQLPPGFRFHPTDQELVLHYLCRKCASQPIAVPIIAEIDLYKYDPWDLPGLASYGEKEWYFFSPRDRKYPNGSRPNRAAGTGYWKATGADKPIGHPKPVGIKKALVFYAGKAPKGDKSNWIMHEYRLADVDRSVRKKNSLRLDDWVLCRIYNKKGTIEKFQPSSDVVVSRKMESSEIEDRKPEILKSGGGCLLPPVPPPQAKAAVKKDYMYFDPSDSIPKLHTDSSCSEHVVSPEFASEVQSEPKWKEWEKSLEFPFNYVDATLNNSNSFTTQFQGNNQMMSPLQDMFMYWPNKPF

SEQ ID NO: 8094 - protein, 291 aa, Cicer arietinum
MASELQLPPGFRFHPTDEELVMHYLCRKCTSQPISVPIIAEIDLYKYDPWDLPGMASYGEKEWYFFSPRDRKYPNGSRPNRAAGSGYWKATGADKPIGHPKPVGIKKALVFYAGKAPKGDKTNWIMHEYRLADVDRSIRRKNSLRLDDWVLCRIYNKKGTIEKQPNSGVINRKTDPSEIEDKKPEILTRGSGLPPHPPPQATAGMRDYMYFDTSDSIPKLHTDSSCSEHVVSPEFASEVQSEPKWNEWEKHLEFPYNYVDTTLNSGFGSQFQSNNQMSPLQDMFMYLPKTF

SEQ ID NO: 8095 - protein, 288 aa, Medicago truncatula
MASELQLPPGFRFHPTDEELVMHYLCRKCTSQPIAVPIIAEIDLYKYDPWDLPGMATYGEKEWYFFSPRDRKYPNGSRPNRAAGSGYWKATGADKPIGHPKPVGIKKALVFYAGKAPKGDKTNWIMHEYRLADVDRSIRKKNSLRLDDWVLCRIYNKKGTIEKQPSNSVVNRKTEHSEIEDRKPEIVTRGGGLPPHPPPQTTAGIRDYMYFDTSDSIPKLHTDSSCSEQVVSPEFASEVQSEPKWNEWDKNLEFPYNYIDATLNTGFGSQFQNTNPLQDMFMYLPKTF

SEQ ID NO: 8096 - protein, 303 aa, Arachis hypogaea
MASELQLPPGFRFHPTDEELVLHYLCRKCTSQPIAVPIIAEIDLYKYDPWDLPGMASYGEKEWYFFSPRDRKYPNGSRPNRAAGTGYWKATGADKPIGQPKPVGIKKALVFYSGKAPKGDKTNWIMHEYRLADVDRSVRKKNKPQAGMTGCWCRIYDKKGSVEKQQPEQRRPVPVVNQRAESSEVEDKKPDIVPRGGGGGVLPPHPPTAQASAGGVTTDYMYFDNSDSVPKLHTDSSCSEQVVSPEFASEVQSEPKWNEWDKNLESAYNYLDATLTNGFGFPFQGNNQMSPLQDMFMNLPKPF

SEQ ID NO: 8097 - protein, 330 aa, Medicago sativa
MERTHFNIISNTNYPSSHQPTLKKKKKKNNSTYSIKKLIEYTRMQGALELPPGFRFHPTDDELVNHYLCRKCASLPIAVPIIKEIDLYKFDPWHLPEMALYGEKEWYFFSPRDRKYPNGSGRPAAGSGYWKATGADKPIGHPKPVGIKKALVFYAGKAPKGDKTNWIMHGYRLADVDRTIRKKNSLRLDDWVLCRIYNKKGTIEKQPSNGVVNRKTEHSEMEDRKPDIVTRGGGLPPHPLPQTTAGIRDYMYFDTSDSIPKLHTDSSCSEHVVSPEFASEVQSEPKWNEWEKNLEFPYNYVDATLNTGFGSQFQNTNPLQDMFMYLPKTF

SEQ ID NO: 8098 - protein, 369 aa, Ricinus communis
MWAIDTHAPPLERRTRVPAAVIEEKTRKKGKKRYRPRFQAPSPQRERKQESESIYSCSRSRISRVEEKGKQVKGKKNDMAAVLELPPGFRFHPTDEELVMHYLCRKCASQQIAVPIIAEIDLYKYDPWDLPGMALYGEKEWYFFSPRDRKYPNGSRPNRAAGSGYWKATGADKPIGQPKPVGIKKALVFYAGKAPKGEKTNWIMHEYRLADVDRSARKKNSLRLDDWVLCRIYNKKGTIEKQGQLSNKKIINYSPSNIIEDKKPEIMAPPPAPSSGTGTANDFVYFESSDSVPKLHTDSSCSEHVVSPEFTCEVQSEPKWKDWGSNVNALDFPFNYMDGSMDSAFASQFQNNNQMSPLQDMFMYLQKPF

SEQ ID NO: 8099 - protein, 291 aa, Corylus heterophylla
MTAELQLPPGFRFHPTDDELVMHYLCRKCASQSIAVPIIAEIDLYKYDPWELPRMALYGEKEWYFFSPRDRKYPNGSRPNRAAGTGYWKATGADKPIGHPKAMGIKKALVFYAGKAPKGEKTNWIMHEYRLADVDRSARKKNSLRLDDWVLCRIYNKKGTTEKQQQGINLQKMSDSEMEDKKPENLTIGGATSAILSGPAATRTAAGDDYVYFDTSDSVPRLHTDSSCSEHVVSPEFTCEVQSEPKCWEKTIDYHFNYMDATLDNGFGAQFQSSNQMSPLQDMFMYMQKPF

SEQ ID NO: 8100 - protein, 299 aa, Gossypium hirsutum
MTASELQLPPGFRFHPTDEELVMHYLCRKCASQSIAVPIIAEIDLYKYDPWDLPDLALYGEEEWYFFSPRDRKYPNGSRPNRAAGSGYWKATGADKPIGQPKPVGIKKALVFYAGKAPKGEKTNWIMHEYRLADVDRSARKKNSLRLDDWVLCRIYNKKGAIEKQSPQGSIGKSSAVTEIEDKKPDIATLGVDTRQLPPPPTGLGNDYVYFDTSESVPRLHTDSSCSEHVVSPEFTCEVQSEPQWKDWGSATNTTTTNALDFPYNYMDATVDNGFPAHFQSNNQLSPLQDMFMYLQKPF

SEQ ID NO: 8101 - protein, 306 aa, Malus x domestica
MERVQTTPIEMSSADLQLPPGFRFHPTDEELVRHYLCRKCASQPISVPIIAEIDLYKYDPWELPGLALYGEKEWYFFSPRDRKYPNGSRPNRAAGSGYWKATGADKPIGHPKPVGIKKALVFYAGKAPRGEKTNWIMHEYRLADVDRSPRKKNSLRLDDWVLCRIYNKKGTVENQQPQQQQEQQRTTSRNASSGSEFEDRKPDNLRCPPPPASVVPSRHVSDYVYFDNSDSVPKLHTDSSCSEQVVSPELACEVQSEPKWKEWEKALEMPYSYMDTTVENGFGAQFQSGNEMSPLQDIFMYLQKPY

SEQ ID NO: 8102 - protein, 337 aa, Glycine max
MASETPKPKPVLPWKTRVSISFLSTLTDYARRSNGTVNRRLMNFLDRKSQPNAKPVNGVSTQDVTVDAKRNLWFRIFNPAAASGGGLPVVIFFHGGGFAFLSPDSFAYDAVCRRFCRRVPAVVVSVNYRLAPEHRYPLQYDDGEDILRFLDENRAVLPENADVSKCFLAGDSAGANLAHNVAVRVAKSGPLREVRVVGLVSIQPWFGGEARTAAEVKFEGAPLVSTARTDWLWKAFLPDGSDRDHGASNVSGPNSEDLSGLNYPDTLVFVGGFDPLQDWQKKYCEWLKKSGKKAQLIEYSTMIHAFYIFPELPESSQLISEVKDFITKRISDLKSNM

SEQ ID NO: 8103 - protein, 338 aa, Glycine max
MASETPKAKAVLPWTTRVSISFLSTLTDFSRRSNGTVNRRLMNFLDRKTQANAKPVKGVSTKDVTVDAKRNLWFRIYNPTAADADDGLPVFIFFHGGAFAFLSPDSFAYDAVCRRFCRRIPAVVVSVNYRLAPEHRYPSQYDDGEDILRFLDENRAVLPDNADLSKCFLAGDSAGANLAHNVAVRIGKSGLQLIRVVGLVSIQPWFGGEERTAAEVKLDGAPLVSMARTDWLWKAFLPEGSDRDHGAANVSGPNSEDLSGLYYPDTLLFVGGFDPLQDWQKKYYEWLKKSGKNAQLIEYPSSIHAFYIFPELPESSQLISQVKDFVTKKISDFQSNVY

SEQ ID NO: 8104 - protein, 343 aa, Medicago truncatula
MSSPNKPKPFLSWKSRISISFISALSDASRRSNGTVNRRFLNFLDRKSSPNAIPVNGVSTKDVIVNAEDNVWFRLFTPTAAVNSAGEDNTDTKTATLPVIVFFHGGGFTYLTPDSFAYDAVCRRFCRKINAVVVSVNYRHTPEHRYPSQYEDGEAVLKYLDENKTVLPENADVSKCFLAGDSAGANLAHHVAVRVCKAGLREIRVIGLVSIQPFFGGEERTEAEIRLEGSPLVSMARTDWMWKAFLPEGSDRDHGAVNVCGPNAEDLSGLDYPDTLVFIGGFDPLNDWQKRYYDWLKKCGKKAELIQYPNMIHAFYIFPDLPESGQLIMQVKDFISKVSNSRL

SEQ ID NO: 8105 - protein, 568 aa, Medicago truncatula
MSISWITMRGILSLKRAVLVRQHSEKLGLGVRLFSTQGASTASTPQPPPPPPPPEKTHFGGLKDEDRIFTNLYGLHDPFLKGAMKRGDWHRTKDLVIKGTDWIVNEMKKSGLRGRGGAGFPSGLKWSFMPKVSDGRPSYLVVNADESEPGTCKDREIMRHDPHKLLEGCLIAGVGMRATAAYIYIRGEYVNERLNLEKARKEAYAAGLLGKNACGSGYDFDVHIHYGAGAYICGEETALLESLEGKQGKPRLKPPFPANAGLYGCPTTVTNVETVAVSPTILRRGPEWFASFGRKNNAGTKLYCVSGHVNKPCTVEEEMSMPLKELIERHCGGVRGGWDNLLAIIPGGSSVPLIPKHVCDDVLMDYDALKAVGSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIKENAQRELLQATGVVTVLMIAKIKIKQCQSFWKDRWLRFLWLYCYFVLLLCHSNYGWIIPENHLGRYKLCYLDLSFGTFSCDLLIISVYCH

SEQ ID NO: 8106 - protein, 482 aa, Glycine max
MRGILSVRTALVQHHSEKLGLGFRVFSTQGASTASTPQPPPPPPPPEKTHFGGLKDEDRIFTNLYGLHDPFLKGAMKRGDWHRTKDLVVKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERKNLEKAREEAYAAGLLGKNACGSGYDFDVHIHYGAGAYICGEETALLESLEGKQGKPRLKPPFPANAGLYGCPTTVTNVETVAVSPTILRRGPEWFASFGRKNNAGTKLFCVSGHVNKPCTVEEEMSIPLKELIERHCGGIRGGWDNLLAVIPGGSSVPLIPKHVCDDILMDYDALKAVGTGLGTAAVIVMDKSTDVVDAIARLSYFYKHESCGQCTPCREGTGWLWTIMERMKVGNAKLEEIDMLQELTKQIEGHTICALGDAAAWPVQGLIKHFRPELERRIREHAERELLQATG

SEQ ID NO: 8107 - protein, 482 aa, Glycine max
MRGILSVRTALVQHRSEKLGLGFRLFSTQGASTASTPQPPPPPPPPEKTHFGGLKDEDRIFTNLYGLHDPFLKGAMKRGDWHRTKDLVLKGTDWIVSEMKKSGLRGRGGAGFPSGLKWSFMPKVSDGRPSYLVVNADESEPGTCKDREIMRHDPHKLLEGCLIAGVGMRASAAYIYIRGEYVNERKNLEKARQEAYAAGLLGKNACGSGYDFDVHIHYGAGAYICGEETALLESLEGKQGKPRLKPPFPANAGLYGCPTTVTNVETVAVSPTILRRGPEWFASFGRKNNAGTKLFCVSGHVNKPCTVEEEMSIPLKELIERHCGGIRGGWDNLLAVIPGGSSVPLIPKHVCDDIFMDYDALKAVGTGLGTAAVIVMDKSTDVVDAIARLSYFYKHESCGQCTPCREGTGWLWTIMERMKVGNAKLEEIDMLQELTKQIEGHTICALGDAAAWPVQGLIKHFRPELERRIREHAERELLQATG

SEQ ID NO: 8108 - protein, 486 aa, Ricinus communis
MAPIRGIFNLQRAALIRRQSDRLAVGIRSFSTEATKSAGSSQPLPPPPPPEKTHFGGLKDEDRIFTNLYGLHDPFLKGAMKRGDWYRTKDLVLKGADWIVNEVKKSGLRGRGGAGFPSGLKWSFMPKVSDGRPSYLVVNADESEPGTCKDREIMRHDPHKLLEGCLIAGVGMRASAAYIYIRGEYVNERINLERARKEAYAAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIKERAERELLEAAA

SEQ ID NO: 8109 - protein, 485 aa, Populus trichocarpa
MAPIRGIFSLQRTALVRQSERLGVGFRSFSTQAPTNAGAPQPPPPPPPPEKTHFGGLKDEDRIFTNVYGLHDPFLKGAMKRGDWYRTKDLVLKGTDWIVNEVKKSGLRGRGGAGFPSGLKWSFMPKTSDGRPSYLVVNADESEPGTCKDREIMRHDPHKLLEGCLIAGVGMRASAAYIYIRGEYVNERINLERARKEAYEAGLLGKNACGSGYDFDVHIHYGAGAYICGEETALLESLEGKQGKPRLKPPFPANSGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVTSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKERAERELLEAAA

SEQ ID NO: 8110 - protein, 487 aa, Solanum tuberosum
MAPIKGLLSLQRTALAQRSSERWGLYGRLFSTQAASTASTPQPTPPPPPPERTHFGGLKDEDRIFTNLYGLHDPYLKGAMKRGDWYRTKDLVIKGSDWIVNEMKKSGLRGRGGAGFPSGLKWSFMPKTTDGRPSYLVVNADESEPGTCKDREIMRHDPHKLLEGCLIAGVGMRAKAAYIYIRGEYVNERKSLQKARQEAYEAGLLGKNACGSGYDFDVYIHFGAGAYICGEETALLESLEGKQGKPRLKPPFPANAGLYGCPTTVTNVETVAVSPTILRRGPEWFASFGRKNNAGTKLFCISGHVNKPCTVEEEMSISLKELIERHCGGVRGGWDNLLAVIPGGSSVPLLPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIREHAERELQQAAAA

SEQ ID NO: 8111 - protein, 504 aa, Zea mays
MAMRRALLRSVDFSPDSKAAVEYFYSFSRAQSACSLNGAGLCPASRSFSTQAATTSSTPQPPPPPPPPEKTHFGGLKDEDRIFTNLYGLHDPFLKGAVKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTPWLWMIMERLKVGDAKLEEIDMLQEVTKQIEGHTICALGDAAAWPVQGLIRHFRPELEKRIRERAERELLAASA

SEQ ID NO: 8112 - protein, 535 aa, Brachypodium distachyon
MLRRAAHRLASRAAATGGAGSVARRTLAAAEVPVQAPADSAFVGIAANKEVEHLNYLSRPQPTRSITCARLYPAGRSFSTQAASTSSTPQPPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARLEAYASGLLGKNACGSGYDFDVHIHFGAGAYICGEETALLESLEGKQGKPRLKPPFPANAGLYGCPTTVTNVETVAVAPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADRELLTAASA

SEQ ID NO: 8113 - protein, 505 aa, Hordeum vulgare subsp. vulgare
MALRWALFRSAEISPGRKAAFEYLHSLSRAQPTRSPSCADLYPAGRSFSTQAATTSSTPQPPPPPPPPEKTHFGDLKDEDRIFTNLYGLHDPFLKGAMKRGDWNRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADRELLMAASA

SEQ ID NO: 8114 - protein, 486 aa, Arabidopsis thaliana
MAPVRGILGLQRAVSIWKESNRLTPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFEVYIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERAERELLQAAA

SEQ ID NO: 8115 - protein, 532 aa, Medicago truncatula
MASSTSLFQSSPFSLNTKTKPYSSLPKSPKPTHFIIKSQQQPHPVTQNNTPIPTPTPTPPTTRRPADENIRDEARRKNVSQHLFSAKYVPFNADPSSTESYSLDEIVYRSQSGDLLDVQHDLTALKKFDGAYWRNLFDSRVGKTTWPYGSGVWSKKEWVLPEIDDDDIVSAFEGNSNLFWAERFGKQFLGMSDLWVKHCGISHTGSFKDLGMTVLVSQVNRLRKMNRPVVGVGCASTGDTSAALSAYCASAGIPSIVFLPANRISIAQLVQPIANGAFVLSIDTDFDGCMQLIREVTAELPIYLANSLNSLRLEGQKTAAIEILQQFDWQVPDWVIVPGGNLGNIYAFYKGFHMCRELGLVDRIPRLVCAQAANANPLYLYFKSGWKEFKAVRAQTTFASAIQIGDPVSIDRAVHALKNCNGIVEEATEEELMDAMAQADSTGMFTCPHTGVALTALFKLRNSGVIKPTDRTVVVSTAHGLKFTQSKIDYHSKGIKDLACQFANPPTQVKADFGSVMDVLSKYLQSKAPKYH

SEQ ID NO: 8116 - protein, 521 aa, Glycine max
MASSSLFQSLPFSLKTTKPYALPKPAANFVIRAQSPLTQNTNAASSASKHRRPADENIRDEARRINAPHDHHLFSAKYVPFNADPSSSTTESYSLDEIVYRSQSGGLLDVQHDMDALKRFDGEYWRNLFDSRVGKTTWPYGSGVWSKKEWVLPEIHDDDIVSAFEGNSNLFWAERFGKQFLGMNDLWVKHCGISHTGSFKDLGMTVLVSQVNRLRKMNRPVVGVGCASTGDTSAALSAYCASAAIPSIVFLPANKISLAQLVQPIANGAFVLSIDTDFDGCMQLIREVTAELPIYLANSLNSLRLEGQKTAAIEILQQFDWQVPDWVIVPGGNLGNIYAFYKGFKMCQELGLVDKIPRLVCAQAANADPLYLYFKSGWKEFKPVKSSTTFASAIQIGDPVSIDRAVHALKSCDGIVEEATEEELMDATAQADSTGMFICPHTGVALTALFKLRNSGLIKATDRTVVVSTAHGLKFTQSKIDYHSKDIKDMACRYANPPMQVKADFGSVMDVLKTYLQSKTH

SEQ ID NO: 8117 - protein, 519 aa, Glycine max
MASSSLFQSLPFSLQTSKPYAPPKPAAHFVVRAQSPLTQNNNSSSKHRRPADENIRDEARRINAPHDHHLFSAKYVPFNADSSSSSSTESYSLDEIVYRSQSGGLLDVQHDMDALKRFDGEYWRNLFDSRVGKTTWPYGSGVWSKKEWVLPEIHDDDIVSAFEGNSNLFWAERFGKQFLGMNDLWVKHCGISHTGSFKDLGMTVLVSQVNRLRKMNRPVVGVGCASTGDTSAALSAYCASAAIPSIVFLPANKISLAQLVQPIANGAFVLSIDTDFDGCMQLIREVTAELPIYLANSLNSLRLEGQKTAAIEILQQFDWQVPDWVIVPGGNLGNIYAFYKGFKMCQELGLVDKIPRLVCAQAANADPLYLYFKSGWKEFKPVKSSTTFASAIQIGDPVSIDRAVHALKSCDGIVEEATEEELMDATAQADSTGMFICPHTGVALTALFKLRNSGVIKATDRTVVVSTAHGLKFTQSKIDYHSKDIKDMACRYANPPMQVKADFGSVMDVLKTYLQSKAH

SEQ ID NO: 8118 - protein, 539 aa, Ricinus communis
MATSSSLFHSSLASSLTHNKHKQFHRNSKLSSTTTTTTRRIVTPISCTSSTLDPSASSNNTPPVTTKHRRPAEENIRDEARRHRSSSSAVNTFSAKYIPFNAPPDSREYYSLDEIVYRSRSGGLLDVQHDMEALKKFDGGYWRDLFDSRVGKTTWPYGSGVWSKKEWVLPEIDPDDIVSAFEGNSNLFWAERFGKQFLGMNDLWVKHCGISHTGSFKDLGMTVLVSQVNRLRKMKKPVVGVGCASTGDTSAALSAYCASAGIPSIVFLPANKISIAQLVQPIANGAFVLSIDTDFDGCMKLIREVTAELPIYLANSLNSLRLEGQKTAAIEILQQFDWEVPDWVIVPGGNLGNIYAFYKGFKMCHELGLVDRIPRLVCAQAANANPLYLYYKSGWKDFKPVKANSTFASAIQIGDPVSIDRAVYALKKCNGIVEEATEEELMDAMAQADSTGMFICPHTGVALTALIKLRNSGIIGPMDRTVVVSTAHGLKFTQSKIDYHSKAIPDMACKYANPPVQVKADFGAVMDVLKTYLGNKAPK

SEQ ID NO: 8119 - protein, 519 aa, Solanum tuberosum
MAASCMLRSSFISPGLPQLHHQSTSKPNNGIHFFTPIKATATNDAISQQKHRRPADENIREEARRHCSSHNFSARYVPFNAGPNSDEWYSLDEIVYRSRSGGLLDVQHDMDALKKFDGQYWRSLFDSRVGKTTWPYGSGVWSKKEWVLPEIDSDDIVSAFEGNSNLFWAERFGKQFLGMTDLWVKHCGISHTGSFKDLGMTVLVSQVNRLRKMHKPVVGVGCASTGDTSAALSAYCASAGIPSIVFLPANKISMAQLVQPIANGAFVLSIDTDFDGCMQLIREVTAELPIYLANSLNSLRLEGQKTAAIEILQQFDWEVPEWVIVPGGNLGNIYAFYKGFQMCKELGLVDRIPRLVCAQAANANPLYLHYKSGWKDFKPVKANTTFASAIQIGDPVSIDRAVFALQQCNGIVEEATEEELMDAMAQADSTGMFICPHTGVALTALFKLRNSGVIAPTDRTVVVSTAHGLKFTQSKIDYHSKEIKDMECRFANPPVEVKADFGSVMDVLKSYLLSQNSKL

SEQ ID NO: 8120 - protein, 522 aa, Vitis vinifera
MVSSTVFQSPRFSFSSATKSTAKPITTTTAAVHFPIRACSSTEAAGSIKTHHRRPADENIRDEARRQSSGNHHGFSAVYVPFNADPSSTESYSLDEIVYRSRSGGLLDVSHDLDALKKYDGQYWRSLFDSRVGKTTWPYGSGVWSKKEWVLPEIDSDDIVSAFEGNSNLFWAERFGKQFLGMNDLWVKHCGISHTGSFKDLGMTVLVSQVNRLRKMNRPVVGVGCASTGDTSAALSAYCAAAGIPSIVFLPANRISIAQLVQPIANGAFVLSLDTDFDGCMQLIREVTAELPIYLANSLNSLRLEGQKTAAIEILQQFDWEVPDWVIVPGGNLGNIYAFYKGFHMCKELGLVDRIPRLVCAQAANANPLYLHYKSGWGEFKPVKANTTFASAIQIGDPVSIDRAVYALKNSDGIVEEATEEELMDATAKADSTGMFICPHTGVALTALFKLRESGVIRPTDRTVVVSTAHGLKFTQSKIDYHSKDIPDIACRFANPPVQVKADFGSVMDVLKKYLLSRDPRC

SEQ ID NO: 8121 - protein, 526 aa, Arabidopsis thaliana
MASSCLFNASVSSLNPKQDPIRRHRSTSLLRHRPVVISCTADGNNIKAPIETAVKPPHRTEDNIRDEARRNRSNAVNPFSAKYVPFNAAPGSTESYSLDEIVYRSRSGGLLDVEHDMEALKRFDGAYWRDLFDSRVGKSTWPYGSGVWSKKEWVLPEIDDDDIVSAFEGNSNLFWAERFGKQFLGMNDLWVKHCGISHTGSFKDLGMTVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQVPDWVIVPGGNLGNIYAFYKGFKMCQELGLVDRIPRMVCAQAANANPLYLHYKSGWKDFKPMTASTTFASAIQIGDPVSIDRAVYALKKCNGIVEEATEEELMDAMAQADSTGMFICPHTGVALTALFKLRNQGVIAPTDRTVVVSTAHGLKFTQSKIDYHSNAIPDMACRFSNPPVDVKADFGAVMDVLKSYLGSNTLTS

SEQ ID NO: 8122 - protein, 525 aa, Arabidopsis thaliana
LSSCLFNASVSSLNPKQDPIRRHRSTSLLRHRPVVISCTADGNNIKAPIETAVKPPHRTEDNIRDEARRNRSNAVNPFSAKYVPFNAAPGSTESYSLDEIVYRSRSGGLLDVEHDMEALKRFDGAYWRDLFDSRVGKSTWPYGSGVWSKKEWVLPEIDDDDIVSAFEGNSNLFWAERFGKQFLGMNDLWVKHCGISHTGSFKDLGMTVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQVPDWVIVPGGNLGNIYAFYKGFKMCQELGLVDRIPRMVCAQAANANPLYLHYKSGWKDFKPMTASTTFASAIQIGDPVSIDRAVYALKKCNGIVEEATEEELMDAMAQADSTGMFICPHTGVALTALFKLRNQGVIAPTDRTVVVSTAHGLKFTQSKIDYHSNAIPDMACRFSNPPVDVKADFGAVMDVLKSYLGSNTLTS

SEQ ID NO: 8123 - protein, 526 aa, Arabidopsis lyrata subsp. lyrata
MASSCLFNASVSSLNPKQDPIRRHRSASLLRHRPVFVSCTADGNNNKAPIETAVKPPHRTEDNIRDEARRNRSTAVNPFSAKYVPFNAAPGSTESYSLDEIVYRSRSGGLLDVEHDMEALKRFDGAYWRDLFDSRVGKSTWPYGSGVWSKKEWVLPEIDDDDIVSAFEGNSNLFWAERFGKQFLGMNDLWVKHCGISHTGSFKDLGMTVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQVPDWVIVPGGNLGNIYAFYKGFKMCHELGLVDRIPRMVCAQAANANPLFLHYKSGWKDFKPMTASTTFASAIQIGDPVSIDRAVYALKKCNGIVEEATEEELMDAMAQADSTGMFICPHTGVALTALFKLRNQGVIAPTDRTVVVSTAHGLKFTQSKIDYHSNAIPDMACRFSNPPVDVKADFGAVMDVLKSYLGSNTLTS

SEQ ID NO: 8124 - protein, 486 aa, Arabidopsis thaliana
  misc_feature (163)..(163): Xaa can be any naturally occurring amino acid
ADGNNIKAPIETAVKPPHRTEDNIRDEARRNRSNAVNPFSAKYVPFNAAPGSTESYSLDEIVYRSRSGGLLDVEHDMEALKRFDGAYWRDLFDSRVGKSTWPYGSGVWSKKEWVLPEIDDDDIVSAFEGNSNLFWAERFGKQFLGMNDLWVKHCGISHTGSFXDLGMTVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQVPDWVIVPGGNLGNIYAFYKGFKMCQELGLVDRIPRMVCAQAANANPLYLHYKSGWKDFKPMTASTTFASAIQIGDPVSIDRAVYALKKCNGIVEEATEEELMDAMAQADSTGMFICPHTGVALTALFKLRNQGVIAPTDRTVVVSTAHGLKFTQSKIDYHSNAIPDMACRFSNPPVDVKADFGAVMDVLKSYLGSNTLTS

SEQ ID NO: 8125 - protein, 667 aa, Glycine max
MRIRNLVAPTLQFQTQSTVTGNLRRRLSPPGVDFAAYGSALQHCSDHRLLRQGKQLHARLILLSVTPDNFLASKLILFYSKSNHAHFARKVFDTTPHRNTFTWNAMLLGYSFNSMFRHALNLFGSFTFSTTPNASPDNFTISCVLKALASSFCSPELAKEVHCLILRRGLYSDIFVLNALITCYCRCDEVWLARHVFDGMSERDIVTWNAMIGGYSQRRLYDECKRLYLEMLNVSAVAPNVVTAVSVMQACGQSMDLAFGMELHRFVKESGIEIDVSLSNAVVAMYAKCGRLDYAREMFEGMREKDEVTYGAIISGYMDYGLVDDAMGVFRGVENPGLNMWNAVISGMVQNKQFEGVFDLVRQMQGSGLSPNAVTLASILPSFSYFSNLRGGKEVHGYAIRRGYEQNVYVSTSIIDAYGKLGCICGARWVFDLSQSRSLIIWTSIISAYAAHGDAGLALGLYAQMLDKGIRPDPVTLTSVLTACAHSGLVDEAWNIFNSMPSKYGIQPLVEHYACMVGVLSRAGKLSEAVQFISEMPIEPSAKVWGPLLHGASVFGDVEIGKFACDHLFEIEPENTGNYIIMANLYAHAGKWEQAGEVRERMKVIGLQKIRGSSWIETSGGLLSFIAKDVSNGRSDEIYALLEGLLGLMREEGCVLQEELDYENVFS

SEQ ID NO: 8126 - protein, 596 aa, Glycine max; identical to SEQ ID NO: 8036

SEQ ID NO: 8127 - protein, 583 aa, Betula pendula
MSSLSVRFLSPPLFSSTPAWPRTGLAATQAVPPVVAEVDAGRLEPRVEEREGYWVLKEKFREGINPQEKLKLEREPMKLFMEGGIEDLAKMSLEEIDKDKISKSDIDVRLKWLGLFHRRKHHYGRFMMRLKLPNGVTTSAQTRYLASVIRKYGKDGCADVTTRQNWQIRGVVLSDVPEILKGLDEVGLTSLQSGMDNVRNPVGNPLAGIDIHEIVATRPYNNLLSQFITANSRGNLAFTNLPRKWNVCVVGSHDLFEHPHINDLAYMPAIKDGRFGFNLLVGGFFSPRRCAEAVPLDAWVSADDIILVCKAILEAYRDLGTRGNRQKTRMMWLIDELGIEGFRSEVVKRMPNQELERAAPEDLIEKQWERRELIGVHPQKQEGLSYVGLHIPVGRVQADDMDELARLADTYGCGELRLTVEQNIIIPNIENSKLEALLGEPLLKDRFSPEPPILMKGLVACTGNQFCGQAIIETKARALKVTEEVQRQVAVTRPVRMHWTGCPNSCGQVQVADIGFMGCMARDENGKPCEGAAVFLGGRIGSDSHLGNLYKKGVPCKNLVPLVVDILVKHFGAVPREREESED

SEQ ID NO: 8128 - protein, 576 aa, Glycine max; identical to SEQ ID NO: 8080
  misc_feature (402)..(402): Xaa can be any naturally occurring amino acid

SEQ ID NO: 8129 - protein, 599 aa, Medicago truncatula; identical to SEQ ID NO: 8078

SEQ ID NO: 8130 - DNA, 447 bp, Glycine max
atggcacaggcttacactaagagttcaaattgtgttggagcaaaataccatcatgaagctaagaagcattctccttattgtgtgggctttgtttgctctcttgagccacgcttatggggaaatccgtttttgccaaaaagaaatgacgttggatgggtcatgtccacttgggacttcaggggaaagctgctttctggaattcctgaatagattgggagcaagtgccatgcctatgaattgctcttgcaaagatgatccttcccataataaacgccaatgcacttgtaatgttgtgtgtaacacatgagacaattttgcctctagagtgcacttcagtccaaattattcataaaataaaaaaacgtgtactgatcttgtaatttctctacatatgttgagaattttaaaagcccatcacctaatgttccagttattatagttaatgat

SEQ ID NO: 8131 - DNA, 2454 bp, Glycine max
atggaagaaacatttgtaccctttgaaggaatcaagaatgatctgagaggaaggttgatgtgctacaagcaagattggtcgggtggaatcaaagcaggtttaaggatttgggcccccaccacatacatattctttgcttccgcaataccagtcatttcattcggggaacaactagaacgagatactgatggtgttctaactgctgttcaaacattggcatccacttcaatatgtggcattatacactcaatccttggaggtcaacctttattgattttaggagtggcagagcctacggtgatcatgtacacgttcatgttcaattttgcgaaagagagaccagagttgggccgggatttgtttctggcatggactggatgggtatgtgtctggactgcactgttgctattcttgtttgccatcttaggggcttgctctataatcaacaggtttacccgtattgcaggagagttgtttggcatgcttattgcaatgctcttcatgcagcaagctatcaaaggactcgtggatgagtttcgcataccagagagacaaaattcaaaatcaatcgagtttataccttcatggaggtttgctaatgggatgtttgctttagtcctttcgtttggccttcttctcactgcattaagaagcagaaaggctagatcatggcgttatggtaccggttggcttcgcagcctaatagctgactatggtgtgcctcttatggtcctagtttggacaggtgtatcctacataccagctggaagtgttccacatggtattccaaggcgtctgtttagcccaaatccatggtcaccgggtgcatatgagaattggactgttattaaggatatggttcatgttcctgttgtgtacataatcggagcatttatcccagcaaccatgattgcagtactttattactttgaccatagtgtggcttcccagcttgcccagcagaaagagttcaatttgagaaagccatcttcttaccattatgacttgctccttttgggatttttgaccttaatgtgtggcctgattggaattcctcctgcaaatggagtcataccacagtctccaatgcacacaaaaagtctggcaactcttaaacatcagttgcttcgtaacaaactggtggtaaccgcacgaaaaagtatgggaaagaatgctagtttaggacagttatatggcaacatgctagaagcctacaatcaaatgcagacccctcttgtttaccaggacccctctgctcgagcacaaggactaagagaacttaaagaatcaaccattcaagcagctaccagtatgggaaacgtggatgccccagtagatgagactatatttgatgttgagaaagaaatagacgacctgcttcctgttgaggtaaaggaacagcgtctcagtaacttgcttcaatcaacaatggtgggaggatgcgttgcggccatgcctttactcaagaagatcccaacctcagtcctttggggttactttgccttcatggccattgaaagtttgccaggaaaccagttttgggaaagaatcctattactcttcactgcaccaagcagaagatacaaggtgcttgaggattaccatgctactttcgtagaaacagttcctttcaagacaatagcaacattcaccattttccaaaccatttatcttcttatatgttttggactaacatgggttcctattgccggggtcatgtttcctatgatgatcatgctcttagttccggttagacagtactttctccccaagtttttcaaaggggtacaccttcaagatttggatgcagcagcatatgaagagcaaacagctctaccattcaaccttgcaacacactcggagtttggagctggtgcttctcaagttggagaaggtgaaatcctagatgaagttattactagaagccgtggagagtttaggcacactagcagtccaaagatcacaagctccaccccaacaccaagaactgatcctaaaagccatttaagcccacgcctctcatttagtgctcgcgtgggtgagttcaaaactgagcagagtccacgatctggtgcaagaggtcccctcagtccaaaggcaggagaagtgagattatcaaatctgggaagaagtccacttaatccagattcaaaacagcaggaccaaaactaataattaaacgtagaagattgcagtcatatgccttagaaggactttataggaggcttatttgttgctacatttccattctagtttgttctttaattttgcttgtcatggttgtaacttgtaaagtcctttcccttgtcccatattcgacagatatgagatatgtaacaaagtgtggcgctttcctatatcaattgtattagtgaatgttactatatttgtgcaaatgtatatcatcatcacaagtttgtttcaataaattgtgactagtttgagtcttgtatt

SEQ ID NO: 8132 - DNA, 2467 bp, Glycine max
atggaagaaacatttgtaccctttgaaggaatcaagaatgatctgagaggaaggttgatgtgctacaagcaagattggacgggtggaatcaaagctggtttaaggatttgggcccccaccacatacatattttttgcttccgcaataccggtcatttcattcggggaacaactagagcgagatactgatggtgttctaactgcagttcaaacattggcatccacttcaatatgtggcattatacactcaatccttggaggtcaacctttgctaattttaggggtggcagaacctactgtgatcatgtacactttcatgttcaattttgcaaaagagagaccagagttgggccgggatttgtttctggcatggactggatgggtatgtgtctggactgcactgttgctattcttgtttgccgtcttaggggcttgctctataatcaacaggtttacccgtattgcaggagagttgtttggcatgctcattgcaatgctcttcatgcagcaagctatcaaaggacttgtggatgagtttcgcataccagagagacaaaatccaaaatcaattgagtttatatcttcatggaggtttgctaatgggatgtttgctttagtcctttcgtttggtcttcttctcactgcattaagaagcagaaaggctaggtcatggcgttatggtactggttggcttcgcagcctaatagctgactatggtgtgccacttatggtcctagtttggacaggtgtgtcctacatgccagctggaagtgttccacatggtataccaaggcgtctcttcagcccaaatccatggtcacccggtgcatatgagaattggactgttattaaggatatggtccatgttcctgttgtgtacataatcggagcatttatcccagcaaccatgattgcagtactttattactttgaccatagtgtggcatcccagcttgcccagcagaaagagttcaatttgagaaagccatcttcttaccattacgacttgcttcttttgggatttttgaccttaatgtgtggccttattggaattcctcctgcaaatggagtcataccacagtctccaatgcacacaaaaagtctggcaactcttaaacatcagttgcttcgtaacaaactggtggtagccgcacgaaaaagtatgggaaagaatgctagtttaggacagttatatggcaacatgcaagaagcttacaatcaaatgcagacgcctcttgtttaccaggactcctctgctcgagcacaaggactaagagatcttaaagaatcaaccattcaagcagctaccagtatgggaaacgtggatgctccagtagatgaaactatatttgatgttgagaaagaaatagacgacctgcttcctgttgaggtaaaggaacaacgtctcagtaacttccttcaatcaataatggtgggaggatgcgttgcggccatgcccttactcaagaagatcccaacctcagtcctttggggctactttgccttcatggccattgaaagtttgccaggaaaccagttttgggaaaggatcctattactcttcactgcaccaagcagaagatacaaggtgcttgaggactaccatgctacttttgtagaaacagttcctttcaagacaatagtaacattcaccatttttcaaaccatttatcttcttatatgttttggactaacatgggttcctattgccggggtcatgtttcctatgatgatcatgcttttagttccggttagacagtactttctccctaagtttttcaaagggatacaccttcaagacttggatgcagcagcatatgaagagcaaacagctctaccattcaacctcgcaacacactcagagtttggagctggtgcttctcaagttggagaaggtgaaatcctagatgaagttattactagaagccgtggcgagtttaggcacactagcagtcccaagatcacaagctccaccccaacaccaagaactgatactaacagccatctaagcccacgcctctcatttagttctcgcatgggtgagttcaaaactgagcagagtcctcggtctggtgcaagaggtcccctcagtccaaaggcaggagaagtgagattatcacatctgggaagaagtcctcttaatccagattcaaaacaacatgaccacaactaataattaaacctagaagattgcagtcgtatgccttagaaggactacttaggaggcttatttgtagctacatttccattctagtttgttccttaattttgcttgtcatggttgtaacttttaaagtcctttcccttgtcccatatacgacagatatgagctatgtaacaaagtgtggcgctttcctatgtcaattgtattagtgaatgtcactatatttgtgctaatgtatatcatcatcacaagtttgtttcaataaattgtgactagtttgagtcttgtattgcttcatatgggt

SEQ ID NO: 8133 - DNA, 2542 bp, Glycine max
atggaagaaacatttgtaccctttgaaggaatcaagaatgatctgagaggaaggttgatgtgctacaagcaagattggacgggtggaatcaaagctggtttaaggatttgggcccccaccacatacatattttttgcttccgcaataccggtcatttcattcggggaacaactagagcgagatactggtactaaatattattctgacttcaatggattcttcttttttcctgagaaaaaaataagttgttttgcatttgcagatggtgttctaactgcagttcaaacattggcatccacttcaatatgtggcattatacactcaatccttggaggtcaacctttgctaattttaggggtggcagaacctactgtgatcatgtacactttcatgttcaattttgcaaaagagagaccagagttgggccgggatttgtttctggcatggactggatgggtatgtgtctggactgcactgttgctattcttgtttgccgtcttaggggcttgctctataatcaacaggtttacccgtattgcaggagagttgtttggcatgctcattgcaatgctcttcatgcagcaagctatcaaaggacttgtggatgagtttcgcataccagagagacaaaatccaaaatcaattgagtttatatcttcatggaggtttgctaatgggatgtttgctttagtcctttcgtttggtcttcttctcactgcattaagaagcagaaaggctaggtcatggcgttatggtactggttggcttcgcagcctaatagctgactatggtgtgccacttatggtcctagtttggacaggtgtgtcctacatgccagctggaagtgttccacatggtataccaaggcgtctcttcagcccaaatccatggtcacccggtgcatatgagaattggactgttattaaggatatggtccatgttcctgttgtgtacataatcggagcatttatcccagcaaccatgattgcagtactttattactttgaccatagtgtggcatcccagcttgcccagcagaaagagttcaatttgagaaagccatcttcttaccattacgacttgcttcttttgggatttttgaccttaatgtgtggccttattggaattcctcctgcaaatggagtcataccacagtctccaatgcacacaaaaagtctggcaactcttaaacatcagttgcttcgtaacaaactggtggtagccgcacgaaaaagtatgggaaagaatgctagtttaggacagttatatggcaacatgcaagaagcttacaatcaaatgcagacgcctcttgtttaccaggactcctctgctcgagcacaaggactaagagatcttaaagaatcaaccattcaagcagctaccagtatgggaaacgtggatgctccagtagatgaaactatatttgatgttgagaaagaaatagacgacctgcttcctgttgaggtaaaggaacaacgtctcagtaacttccttcaatcaataatggtgggaggatgcgttgcggccatgcccttactcaagaagatcccaacctcagtcctttggggctactttgccttcatggccattgaaagtttgccaggaaaccagttttgggaaaggatcctattactcttcactgcaccaagcagaagatacaaggtgcttgaggactaccatgctacttttgtagaaacagttcctttcaagacaatagtaacattcaccatttttcaaaccatttatcttcttatatgttttggactaacatgggttcctattgccggggtcatgtttcctatgatgatcatgcttttagttccggttagacagtactttctccctaagtttttcaaagggatacaccttcaagacttggatgcagcagcatatgaagagcaaacagctctaccattcaacctcgcaacacactcagagtttggagctggtgcttctcaagttggagaaggtgaaatcctagatgaagttattactagaagccgtggcgagtttaggcacactagcagtcccaagatcacaagctccaccccaacaccaagaactgatactaacagccatctaagcccacgcctctcatttagttctcgcatgggtgagttcaaaactgagcagagtcctcggtctggtgcaagaggtcccctcagtccaaaggcaggagaagtgagattatcacatctgggaagaagtcctcttaatccagattcaaaacaacatgaccacaactaataattaaacctagaagattgcagtcgtatgccttagaaggactacttaggaggcttatttgtagctacatttccattctagtttgttccttaattttgcttgtcatggttgtaacttttaaagtcctttcccttgtcccatatacgacagatatgagctatgtaacaaagtgtggcgctttcctatgtcaattgtattagtgaatgtcactatatttgtgctaatgtatatcatcatcacaagtttgtttcaataaattgtgactagtttgagtcttgtattgcttcatatgggt

SEQ ID NO: 8134 - DNA, 2471 bp, Medicago truncatula
tttgttgtgatttgtttggaattatttgtctttccttaaccttctttggtgggaaaaagaaaaaaaatactatggaagaaacatttgtaccttttgaaggtatcaagaatgatctaagaggaaggttaatgtgctacaaacaagattggacaggtggaatcaaagcaggtgtaaggattttggcccccacaacatacatattttttgcttctgcaatacctgtcatttcatttggtgaacaactagagagaaatactgagggtgttctaacagctgttcaaaccttggcatcaacttcaatatgtggcattatacactcaatcattggtggtcaacctttactgattttaggagtggcagaacctactgtgatcatgtacacattcatgttcaattttgctaaagaaagacctgagttgggcagaaacctgtttcttggatgggctggatgggtatgtgtatggactgctttgatactattcttactggccatcttaggagcatgttccatcatcaaccggtttacccgaattgcgggagagttgtttggcatgctcattgcaatgcttttcatgcagcaagctatcaaaggacttgtggatgagtttcgcataccaaagagagaagatacaaaagcaattgagttcttaccttcgtggaggtttgctaatgggatgttcgctttggtcctttcatttggccttctccttactgcattaaaaagcagaaaggctagatcatggcgttatggtagtggttggctccgtagccttatagccgactacggtgttccgcttatggtcctagtttggacaggtgtgtcctacatgccgactgcaagtgttccaaatggtatcccacggcgcctctttagtccaaatccgtggtcacccggtgcctatgacaattggactgttgttaaggatatggttcaagttcctgttgtattcataattggagcatttataccagcaactatgattgcagtgctttattactttgaccacagtgtggcatctcagctttctcagcagaaagagttcaatttgagaaagccatcttcttaccattatgatttgctccttttgggatttttgacattattgtgtggccttattggaattcctcctgcaaatggagtcataccgcagtctccgatgcatacaaagagtctagcaactcttaaacatcagttgcttcgtaacagactcgtgataaccgctcgaaacagtatcagtaagaatgctagtctaggacagttatatggtaatatgcaagaagtataccatcaaatgcagacaccccttatttaccaggacccatctgctcgagcacaaggactaaaagaattaaaagaaacaaccattcaagcagctacaagcatgggaaacgtggacgccccggttgatgagactatatttgacgtcgagaaagaaatagatgacttgcttcctgttgaggtaaaggaacaacgtgtcagtaacttgcttcaatcagtattggttggaggatgtgttgcagccatgcctattctcaagaaaatcccaacttcagtactttggggctactttgcctttatggcaattgaaagtttacctggaaaccagttttgggaaaggatccttttactcttcactgcaccaagcagaagatacaaggtgcttgaagattaccatgctacttttgttgaaacagttcctttcaagacaatagcattattcacaattttccaaaccatttatctatttatatgttttggactaacttgggtacctattgctggagtcatgtttcctttgatgatcatgctcttagttccactaagacaatactttctccccaaatttttcaaaggtgcacaccttcaagacttggatgcggccgagtatgaggagcaaactgctttaccgttcaaccttgcatcacaatctgagtttggagctggtgcttctcatattggagaaggtgagatatttgatgaagttatcacaagaagccgtggtgaatttaggcatactactaacagtccaaagatcagtagctccactccaacaccaagaaatgatcctaaaagccgtctaagcccgcacctctcttttaattctcgtgtgggcgagttcgcgactgagcaaagtcctcggtctggcgtaagaggcaccaacagtccaatgaccaaagaaatgagattgtcaggtaggggaataagtcctctcaaccctgattccaaacaccaagacaagaaataattcaagacttgtgtcttagaatgatgtaggaggcttatttgttgcttcatttccagtttatggttctttaattttgcttggctttttattgtaacttgtaaagtattttcagtatcctatatacaacaggtgtatgcaaccaaaaatatggagcttcctatgtcaaattgtaactgttaatgttactatatttgtgcaaatgtatatcatcatcaagtttgtttc

SEQ ID NO: 8135 - DNA, 2157 bp, Vitis vinifera
atggaggagacttttgtaccatttcgtggaataaagaatgatcttcgaggaagattgatgtgctacaagcaagattgggctggtggattcagagcaggcttccggattttggcccctaccacgtacatattctttgcttctgctatcccggtcatttcatttggtgaacaactggagagaaatactgaaggagttctgactgcagttcagaccttggcatccacagcaatttgtgggattatacactccatcattggaggacaacccctgctgatcttaggagttgcagagcccactgtcatcatgtacacattcatgttcaattttgccaaggagagaccagatttgggccggaagctgtttctagcatggactggatgggtatgtgtgtggactgcattcttgctgttcttactggctatcttaggagcttgctccattatcaataggtttacccgtgtggcaggagaattgtttggtctgctcatcgctatgctcttcatgcagcaagctattaagggaattgtggatgagtttcgcataccaaaacaagaaaatgccaagttaacagagttcataccttcatggagattcgcaaatgggatgtttgctttggttctctcatttggccttctgctcacagcattaagaagccgaaaagcaaggtcatggagatatgggactggttggcttcggagccttatagcagactatggtgtgccccttatggttctaatctggacagcggtttcctacatacctgctggaagcgttccaaaaggaattccacgacgccttgtcagcccaaatccatggtcacctggtgcatacgagaattggactgtcattaaggacatgcttgatgtgccagttctctatatagtcggagcttttattccagcgacgatgatcgcagtgctttactattttgaccatagtgtagcatctcaacttgctcagcagaaagaattcaatttgagaaagccaccatctttccattatgacttgcttcttttagggttcttgaccattatgtgtggtcttattggaatccctccatcaaatggtgtgatcccacaatctccaatgcatacaaaaagtctggctactcttaaacatcagttgcttcgtaaccgtcttgttgcaacagcacgcataagtatgagaaagaactcaagcttaagtcaattgtatggaaatatgcaagaagcttatcagcaaatgcagacccctttgatctaccaggagccctcagctcgacagggactaaaggagttaaaagaatcaacaattcaattggcttcaagcatgggggcaattgatgccccagttgatgagacggtatttgatgttgagaaggagattgatgacctactgcctgtggaggtgaaagaacagcgcctgagcaacttgcttcaagccgcagcagttggtggatgtgttgcagccatgcctatccttaaaatgatcccaacctcagtactttggggctactttgccttcatggccattgaaagtttaccaggtaaccagttttgggaaaggattttattgctcttcaccgcaccaagcagaagatacaaagttctagaggagtatcatgccaccttcgtggaaactgtgcctttcaagagtattgcgacatttacaattttccaaacagcatacttgcttatctgttttgggatcacatgggttccaattgcagggttgttgttccctttgatgatcatgcttttggttcctgtgagacaatactttctgcccaagtttttcaaaggggcacaccttcaagatttagatgcagcagagtatgaagaggcaccagctttacctttcaatcttgcaatggagggagagatgggggctggagcttctttggcagagggtggagagattttagatgaaataattactagaagccgtggtgaaattaggcatatgtgcagtcctaagatcacaagctccactgcaacaccaacaaaagatcccagaaactttcagagtcctcgtctatcagaaaaagcatacagccctcgagtaagcgaactaagaggggagcatagtcctcaatcaagcgggagagggaaatacagtccaaagacaggagaagtgaagccgtctaacttgggaaaaagtccacattcctcaaactaa

SEQ ID NO: 8136 - DNA, 3527 bp, Vitis vinifera
aggagacttttgtaccatttcgtggaataaagaatgatcttcgaggaagattgatgtgctacaagcaagattgggctggtggattcagagcaggcttccggtatatactcactttatctttgctagtcacattctctaatcatctcgtctatgttgttcacttcttatgttgttggctttgtattgacctcatcgcgtgatacttaattgttttcaggattttggcccctaccacgtacatattctttgcttctgctatcccggtcatttcatttggtgaacaactggagagaaatactggtattcaaagcaaactgttaaattagacatcttgagtaatacttcaaaattctgatagacctttatcttttccagacttattgaccttcattttagcatagaaacgattagaaaatgataatatttcttcaccttgatcatgcagaaggagttctgactgcagttcagaccttggcatccacagcaatttgtgggattatacactccatcattggaggacaacccctgctgatcttaggagttgcagagcccactgtcatcatgtacacattcatgttcaattttgccaaggagagaccagatttgggccggaagctgtttctagcatggactggatggtgatctatctcctctcattttcatgataattatatacttagtttatgctcttaatgtatcttccacaatattgattcgaattccttgtgtggacttcagtttcctgtttatagcttataagtacttacctgaaacatttgatgcttttcagggtatgtgtgtggactgcattcttgctgttcttactggctatcttaggagcttgctccattatcaataggtttacccgtgtggcaggagaattgtttggtctgctcatcgctatgctcttcatgcagcaagctattaaggtaagaaatattttgatcatcttcaattctgttctattctttattttcctctgtaggttgttagtgtaaaactacctacttacaccttctcatcccttattcaacttctgcatactgcttgaagatggttctgtgaattacttcaatcatttgtcatatttttcatttgttgttttgtgagttctctctagggaattgtggatgagtttcgcataccaaaacaagaaaatgccaagttaacagagttcataccttcatggagattcgcaaatgggatgtttgctttggttctctcatttggccttctgctcacagcattaagaagccgaaaagcaaggtcatggagatatgggactggtcagtatgtgtcaagtgtttctggtgatctggaaattaactggactaggctttgactaattcacggatcttgttgcttatgaattggcaactttttcttttctgtgaatatgtttaaaatttttaagcttggttttcccaggttggcttcggagccttatagcagactatggtgtgccccttatggttctaatctggacagcggtttcctacatacctgctggaagcgttccaaaaggaattccacgacgccttgtcagcccaaatccatggtcacctggtgcatacgagaattggactgtcattaaggcatgttaataaagtcttctagttccccaagctccttgtatgtctcattagaccatcaaaactgatgatttataattcaaactggcaggacatgcttgatgtgccagttctctatatagtcggagcttttattccagcgacgatgatcgcagtgctttactattttgaccatagtgtagcatctcaacttgctcagcagaaagaattcaatttgagaaagccaccatctttccattatgacttgcttcttttagggttcttggtatgagagcttttactatgtttttcacttgtgacccctactcatttttttagatgtttgaattcccgtttcttgatggcagaccattatgtgtggtcttattggaatccctccatcaaatggtgtgatcccacaatctccaatgcatacaaaaagtctggctactcttaaacatcaggtaatctactgtaaagcccagtggtaaatttagcggctcttctctttagatacttgaacaaagctggttttcttagactaatatcttcccattgtgcagttgcttcgtaaccgtcttgttgcaacagcacgcataagtatgagaaagaactcaagcttaagtcaattgtatggaaatatgcaagaagcttatcagcaaatgcagacccctttgatctaccaggagccctcagctcgagtaagattgtgtcattttttttttcagtttaaatttcaatagaatacagatttgcattcaaatgatttataggctttgtgggctccaaagagtctgactactaataagcaacttgactccaataaaatcatgattttttttcatcaaactgaagatcccctaatcttggtaagactaaactacatgaattccgtgagcagggactaaaggagttaaaagaatcaacaattcaattggcttcaagcatgggggcaattgatgccccagttgatgagacggtatttgatgttgagaaggagattgatgacctactgcctgtggaggtgaaagaacagcgcctgagcaacttgcttcaagccgcagcagttggtggatgtgttgcagccatgcctatccttaaaatgatcccaacctcagtactttggggctactttgccttcatggccattgaaagtttaccaggtaaccagttttgggaaaggattttattgctcttcaccgcaccaagcagaagatacaagtaaaccgcctaatgcccttttctttaacatctttcaagtttcctactctcttccccatgtctaagaaaatcaccttctttcccgcagagttctagaggagtatcatgccaccttcgtggaaactgtgcctttcaagagtattgcgacatttacaattttccaaacagcatacttgcttatctgttttgggatcacatgggttccaattgcagggttgttgttccctttgatgatcatgcttttggttcctgtgagacaatactttctgcccaagtttttcaaaggggcacaccttcaagatttagatgcagcagagtatgaagaggcaccagctttacctttcaatcttgcaatggtatattcttcatcaaatattctaaaatgttttaccacaaatttgggattagtattgattgatttgttccaagcaggagggagagatgggggctggagcttctttggcagagggtggagagattttagatgaaataattactagaagccgtggtgaaattaggcatatgtgcagtcctaagatcacaagctccactgcaacaccaacaaaagatcccagaaactttcagagtcctcgtctatcagaaaaagcatacagccctcgagtaagcgaactaagaggggagcatagtcctcaatcaagcgggagagggaaatacagtccaaagacaggagaagtgaagccgtctaacttgggaaaaagtccacattcctcaaac

SEQ ID NO: 8137 - DNA, 3534 bp, Vitis vinifera
atggaggagacttttgtaccatttcgtggaataaagaatgatcttcgaggaagattgatgtgctacaagcaagattgggctggtggattcagagcaggcttccggtatatactcactttatctttgctagtcacattctctaatcatctcgtctatgttgttcacttcttatgttgttggctttgtattgacctcatcgcgtgatacttaattgttttcaggattttggcccctaccacgtacatattctttgcttctgctatcccggtcatttcatttggtgaacaactggagagaaatactggtattcaaagcaaactgttaaattagacatcttgagtaatacttcaaaattctgatagacctttatcttttccagacttattgaccttcattttagcatagaaacgattagkaaatgataatatttcttcaccttgatcatgcagaaggagttctgactgcagttcagaccttggcatccacagcaatttgtgggattatacactccatcattggaggacaacccctgctgatcttaggagttgcagagcccactgtcatcatgtacacattcatgttcaattttgccaaggagagaccagatttgggccggaagctgtttctagcatggactggatggtgatctatctcctctcattttcatgataattatatacttagtttatgctcttaatgtatcttccacaatattgattcgaattccttgtgtggacttragtttcctgtttatagcttataagtacttacctgaaacatttgatgcttttcagggtatgtgtgtggactgcattcttgctgttcttactggctatcttaggagcttgctccattatcaataggtttacccgtgtggcaggagaattgtttggtctgctcatcgctatgctcttcatgcagcaagctattaaggtaagaaatattttgatcatcttcaattctgttctattctttattttcctctgtaggttgttagtgtaaaactacctacttacaccttctcatcccttattcaacttctgcatactgcttgaagatggttctgtgaattacttcaatcatttgtcatatttttcatttgttgttttgtgagttctctctagggaattgtggatgagtttcgcataccaaaacaagaaaatgccaagttaacagagttcataccttcatggagattcgcaaatgggatgtttgctttggttctctcatttggccttctgctcacagcattaagaagccgaaaagcaaggtcatggagatatgggactggtcagtatgtgtcaagtgtttctggtgatctggaaattaactggactaggctttgactaattcacggatcttgttgcttatgaattggcaactttttcttttctgtgaatatgtttaaaatttttaagcttggttttcccaggttggcttcggagccttatagcagactatggtgtgccccttatggttctaatctggacagcggtttcctacatacctgctggaagcgttccaaaaggaattccacgacgccttgtcagcccaaatccatggtcacctggtgcatacgagaattggactgtcattaaggcatgttaataaagtcttctagttccccaagctccttgtatgtctcattagaccatcaaaactgatgatttataattcaaactggcaggacatgcttgatgtgccagttctctatatagtcggagcttttattccagcgacgatgatrgcagtgctttactattttgaccatagtgtagcatctcaacttgctcagcagaaagaattcaatttgagaaagccaccatctttccattatgacttgcttcttttagggttcttggtatgagagcttttactatgtttttcacttgtgacccctactcatttttttagatgtttgaattcccgtttcttgatggcagaccattatgtgtggtcttattggaatccctccatcaaatggtgtgatcccacaatctccaatgcatacaaaaagtctggctactcttaaacatcaggtaatctactgtaaagcccagtggtaaatttagcggctcttctctttagatacttgaacaaagctggttttcttagactaatatcttcccattgtgcagttgcttcgtaaccgtcttgttgcaacagcacgcataagtatgagaaagaactcaagcttaagtcaattgtatggaaatatgcaagaagcttatcagcaaatgcagacccctttgatctaccaggagccctcagctcgagtaagattgtgtcatttttttttttcagtttaaatttcaatagaatacagatttgcattcaaatgatttataggctttgtgggctccaaagagtctgactactaataagcaacttgactccaataaaatcatgattttttttcatcaaactgaagatcccctaatcttggtaagactaaactacatgaattccgtgagcagggactaaaggagttaaaagaatcaacaattcaattggcttcaagcatgggggcaattgatgccccagttgatgagacggtatttgatgttgagaaggagattgatgacctactgcctgtggaggtgaaagaacagcgcctgagcaacttgcttcaagccgcagcagttggtggatgtgttgcagccatgcctatccttaaaatgatcccaacctcagtactttggggctactttgccttcatggccattgaaagtttaccaggtaaccagttttgggaaaggattttattgctcttcaccgcaccaagcagaagatacaagtaaaccgcctaatgcccttttctttaacatctttcaagtttcctactctcttccccatgtctaagaaaatcaccttctttcccgcagagttctagaggagtatcatgccaccttcgtggaaactgtgcctttcaagagtattgcgacatttacaattttccaaacagcatacttgcttatctgttttgggatcacatgggttccaattgcagggttgttgttccctttgatgatcatgcttttggttcctgtgagacaatactttctgcccaagtttttcaaaggggcacaccttcaagatttagatgcagcagagtatgaagaggcaccagctttacctttcaatcttgcaatggtatattcttcatcaaatattctaaaatgttttaccacaaatttgggattagtattgattgatttgttccaagcaggagggagagatgggggctggagcttctttggcagagggtggagagattttagatgaaataattactagaagccgtggtgaaattaggcatatgtgcagtcctaagatcacaagctccactgcaacaccaacaaaagatcccagaaactttcagagtcctcgtctatcagaaaaagcatacagccctcgagtaagcgaactaagaggggagcatagtcctcaatcaagcgggagagggaaatacagtccaaagacaggagaagrgaygccgtctaacttgggaaayagtccacattcctcaaacta

SEQ ID NO: 8138 - DNA, 2955 bp, Brassica napus
atggaagagactttcgtgccgtttgaaggaatcaagaatgatctcaaaggcagactcatgtgctataagcaagactggaccggaggattcaaggctggattcaggtattattattatattaccaatgaacgaacgaatattccattttgattctacccccagctgaatattgatttgatcttctaattgcgtaggattctggctcccaccacttacatattcttcgcctctgcgattcctgtcatctccttcggtgaacaactcgaaagaagcaccggtaagttgcttcttaaccaataaagtttcgacctttttatcaaatatttgaaatcttgcagatggagttctcacggctgttcagaccttagcatccaccgccatttgcggcatcattcactctattatcggaggtcagccactgcttattctcggtgttgctgagccaactgtaatcatgtatactttcatgtttaactttgcaaaggccagacctgaacttggtcgtaacctcttcttggcttggtctggatggtatgttctttttttttttgtaatttgcttaaaatagtaatcaggtgttgagaacaacactctttgaatgtgtagggtttgtgtttggactgctttgatgctgtttgtgatggctatatgtggagcttgttccatcatcaataggttcactcgtgtagctggggagttgtttggactccttattgctatgctcttcatgcaacaagccatcaaagtagtaaccttttcaccaaacatttccacaatcttggttttcatctctaatgcatgatttgattcatcctaggggctagtggatgagtttcgcattcctgaccgggaaaatcagaaactgaaggagttcttaccttcctggaggtttgctaatgggatgttcgctctggttctctcctttggccttcttcttactggacttagaagcagaaaagccagatcttggcgctacggatctggtatgtgactatctctcatgagctaagattctttagtattcagatgaaacatctaactgactacatttttgcttatcttgagcaggctggctcagaagcttaatagctgactatggtgtaccactcatggtgctagtgtggaccggtgtctcctacattccagcaggagatgttcctaaaggaatcccccggcgactttttagcccaaatccttggtcccctggtgcttatggaaattggaccgtagttaaggttttgttcttttaccttcacgctcaactaagagttaagacttgtaattcctaatgacttgaacatttctcaggagatgcttgatgttccaatcgtccacataattggagcttttgttccagcgtcaatgattgctgtgctttactactttgatcatagcgtagcttcacagcttgcgcagcagaaagagttcaatttgaggaaaccctcttcttaccactacgacttgcttcttcttgggttcctggtaaggatttggacaagaaaagacttgcacatctcaatatttttctcttggggcttactggtcataatcaatgcagacattaatgtgtggtttactcggaatccctccatcaaatggtgtcattcctcaatctccaatgcataccaagagcttggccactcttaaatatcaggtaacgatagctcaccacagtcttatttccgcaagattttcctgagttctgagatcaaccttgtggctatctttgcagttgcttcgtaacagactggttgcaacagcaagaagaagcatcaaaacgaatgcgagtttgggacaactctataacaatatgcaagaagcttatcaccacatgcagacaccattagtctaccagcagcctcaagtaagagagtatctcccttttattttctcaatagaagacagaactaagaatagcttctttccatttgcagggattaaaagaactgaaagaatcaacaatccaatcaactacattaaccggaaacctcaatgctccgattgatgaaactctgttcgatatagagaaagagattgatgatttgttaccagtggaagtcaaagaacagagggtaagcaacttccttcagtctacaatggtgggaggatgcgttgctgctatgcctatccttaaaatgattccaacatcagtcctttggggttattttgccttcatggccatcgaaagcttacctggaaaccagttctgggagagaatcttgcttctattcacagccccaagtcgtcgcttcaagtaaactaaacacccacttttttttttttaatctcattcaaggcctctctctttttgtagctcattggtttctaattttggcagggttcttgaagattaccacgcaacattcgttgaaaccgttccattcaagacaattgcaacgttcactattttccagacgatttatctcttagtctgctttggcctcacatggattccaatagcaggagttatgttccctttaatgatcatgttcttgattcccgtacgacagtacatcctccctagattcttcaaaggtgctcatcttcaagacttagacgcagcagagtatgaagaagctccagctttacccttcaatctcgcagcggtaagccaagaaccacaataactctgtttttatgttactttagcttcttcttctttttttaatacttgattttcagcaggaaacggagattggatcgacaacttcgtatccaggagactcggagattcttgatgaggttattacacggagcagaggagaatttagacacacgagtagtcctaaggtcacaagttcgaattccactccagtcaatagtaggagtttgtctcaagtgtttagtccacgagtgggtgaactcaggttgggtcaaatgagtcctcgagtcgttggaaatagtcctaagccaccgagtactgggaggagtcctttgaaccagggctctcattga

SEQ ID NO: 8139 - DNA, 1720 bp, Glycine max
atgagtagcatgacaagtgggggtgatacccggaagatatccaaaggtcgttggtcatcatcattagatgaaaaagttggagttggaggtaacgtgggaggagaaggtcctctgaagaaaggcccatggactgcagcagaggatgcaattttggtagaatatgtcaaaaagcacggacaaggcaattggaatgcagtacaaaagcattcaggacttgcccgttgtgggaaaagctgccgtctacgatgggcaaatcatttgagaccagatctaaagaaaggtgcatttactgccgaggaagagaaccgaatccttgaactccatgctaagatgggaaacaaatgggctcgaatggctgcagagttgccaggacgtacggataatgagatcaagaactactggaacacaagaatcaaaagaatgcaacgagcaggcttaccaatctaccctgaagaattgtgccaacggatacttaatggcaatcaagaaagtcaaaatgttggcaccatgacaaatgaagcatgccatcatgatgatctgtcacaaacaaacaattttgatataccagatgtagaattcaaaaatttcaaattccgtcatggtctaccacatgtaccatcgatttttgatatgcctgaaagcagcttgtttgatcaaagctctgactcatcccatagttataacttcttgttcccaaccatgcgtcctacaaaacgccctcgggagtcagaaatgctatacgatagttttggcagttgttcaattaatgctgccccactatttgatcagtatggcaattatacgtttgagaaaatttctgaccatcctgggttgtctcttccatgtgatcccgttcttaacaccactgatcagtttcatggtgataaccttaccggcagccatgccgcattaaatggcaatgcctctgcttctgtgcccatatttggggccatgaagttggagctcccttcactccaatatccagaaactcaacatggtagctggggcccgcctatgtccccacttccttcactggagtctgttgatacattgattcagtctcctacacttgagcctattctatcagatcccatttctccacaaagcagtggtttgctagaagcgatagtctacaactcgaaaagcttgaaaggctcaaacaatgatttattattgcaagagacaattgctacagccaatgaagtagctaatatttcaaccttgaatcattcctttcagacagaatgggatgaactaggcgatccaaattcccccttaggtcaatctgctgcttcagtcctgactgactatactcctgtacgaatgtgctctgtggatgggtatcaatcaactgaaaccagtcaggatcatgatgataagcatgaagcacctaccacccagttcccagatagttccagtaagaaaaaaatattgaaacaggtggattacacacagccagatgctttacttgacttgggttggtttgggaataatactaagtatgaaagcgatcaatttgttcagcaagatgctttgggtgcactttttggtgacaattgtcagcatcagccatagcaagtaggtgggtatggatatattgttttggcttagtgtagtgcttgttcaagacataacatcattttattttttgttaactttcttaacactattgtgtccttttttctttttctttctcgttaatctttagaatcgtatgttc

SEQ ID NO: 8140 - DNA, 1720 bp, Glycine max; identical to SEQ ID NO: 8139

SEQ ID NO: 8141 - DNA, 1479 bp, Glycine max
atgagtagtgtgactagtgggggtgataatcgaaaaatatccaaaggtcgtcggtcatcatcattagaggaagaagctggagttggaggtaacataagaggagaaagtcctctgaagaaaggcccatggactgcagcagaggatgcaattttggtagaatatgccaaaaaacacggacaaggcaattggaatgcagtacataaatattcaggacttgcccgttgtgggaaaagctgccgtctacgatgggcaaatcatttgagaccagatctaaaaaaaggtgaatttactgcagaagaagagaatcgaatccttgaactacatgctaagatgggaaacaaatgggctcgaatggctgcagagttgcctggacgtacggataatgagatcaagaactactggaacacaagaatcaaaagaatgcaacgagcaggcttaccaatctaccctgaagaattgtgccaacggatacttaattgcaatcaagaaagtcaaaatattagcatcctgtcaaatgaagcctcccagcatggtgatctgtcacaaacagactttgatataccagacgtggaattcaaaattttcaaatttcgtcatggtctatcacatggacagtcaatatttgatatgcctgaaagtagcttgtttgatcaaagttcagactcatcccatagttataacttgttcccaactatgcgtcctacaaaacgccctcgggagtcagaaatgctatatgatagttttgaaagttgtacaattaatgctgccccactatttgatcagtatgacaattatacttctgaaaaaatttctgaccatcctaggttgtctcttccacgtgatcccgttcttaacaccaatgatcagtttaatggtgataaccttaccggcagccatgccgcattaaatggcaatgcctcttcttctgtgcccatgtttagggccatgaagttggagctcccttcactccaatatcctgaaactcaacatggtagctggggcacgcctacgtccccgcttccttcactcgagtctgttgatacattgattcagtctcctgttgttgagcctattctattagatcccatttctccgcagagcagtggtttgctggaagcgatagtccacaactcgaaaagcttgaaaggctcaaacaatgatttattattacaagaaacaattggtacaaccaatgaagtagctaagagttcaaccttgaatcattcctttcagacaaaatggtatgaactaggggagccaaattccccctttgatcatgatgataagcatgaagcactcaccacccaatttccagacagttccaggaagaaaaaaaatatattgaaacagatggattatacacagccagatgctttacttgacttaggttggtttgggaatagcaccgagtatggaagtgatcaatctgttctgcaagatgctttaagtgcacttcttggtgaagattgtcagcgctag

SEQ ID NO: 8142 - DNA, 1906 bp, Glycine max
ctctctctcttcgaaatcaaaacacactctttcttctctctcgtgaattttagattctttcgctttctcttctatggattcaaagcgattcgatcgcgcgagtcgcaaggttcgggtcgtcaccaggatccgcgggtttgcgggtcccgaggctaattccgaacctgccgcttccagaacggtggagtgggtttcggtgaaccgcgaaaatttggaggatgtcaccatctccttcggagaccaatcttccagtcggtattcggtggactattgctataaggaagatgaagataatgaattgatatattcaagggaggtgaagcctcttgtgtctgcagcttttgatggtcataacagcactgttattgcacatggtgctaggggtagtggaaagacgcacgcaattcagggctctgctgagagaccaggtttggcagtgcttgctatcgctgagtttctttcagtggctgagaaaaatgggaaaaacatagctgtttctttctatgaggttgatcatcaggagcgggccatggatttattaaatccagagaagccaccaattttggtttttgaagatcatggcagaattcagtttaaaggactaactcaggttcttgtgaaatccattgctgaatttcagaatttgtactcctctgcatgttttgcactgaagggagctcccaaaaaaggaggatgtgaacatgttcatagaagccacatgggattaatcgtccatgtcttttcccagaatggaagtcttgtaagcaaagtgaattttgttgacttggcaggttatgaagatgctagaaagaaaagtggtgatggatcctaccttgctgagattaacaaaattaacaagtcaatttatgccttattgaatgtttgtcatgctttgagtacaaatgaaagtcgtgttgcctaccgggaaagcaaaattacacgcatgctgcaggattcgttgagggggactagcaaaattttattggtttcatgcttgaacccatcattttgccaagacactatttacatggttagcttggcatcacggtcatgtcattggattcatcgggcattcttagattccaccaagagaaatgcaagttcagcaaaacaaatggtgaattctcataagaaccagatacccaaaagtgtttcaggaacagcaaagaaattacatgtttcttctaaattacttgataaaaaagttgttgttgctaagaagtctgcaataaaaggaaggaaattgtttgatgaagccagtcactctgttactaaagctgagaaggaaattgctgttgcccaagttactcaagcatcaaagtctttattggacaattcattgttggaaactggaagtgatgtcgtactcaactctggaatggaaaagaagactggaaatcatgttgtactcaactctggaatggaaaagaagaccagaaatcatgttgtactcaactctggaatggaaaagaagaccagaaatcatgttgtactcaactctggagtggaaaaggatgactcattttcaaaagctagagagaacgtgaaacttgatctgatggtgcaaaatgatgattcatcttttaatgctaacattgaagtggaacttaatcccctagcagatcagggtatttcggtggatgaggaggatcatcaaaaggagcatactccttatgctagtaattactctgaagtattggcaaaaatagttcaggaagaccatagcataaacaaggagaacaacaattcaagggcaatcagagatgattcattggctattaattcaccacctatcagttctcagttgcaggatctttctaatagtcttaaaatgctatattcttcaaccccatcatgcatgcagataccaaaaacggaacccattccacttgatattgttgaacca

SEQ ID NO: 8143 - DNA, 2332 bp, Glycine max
cttcgaaatcaaaacactctttatttcctctctctcaatttttagattctttcactttctcttcgatggattcaaagcaattcgatcgcgcgagtcgcaaggttcgggtcgtcgccaggattcgcgggttttcggtgggtcccgaggctaattccgaaccttccgcttcgagagcggtggagtgggtttcggtgaaccgcgaaaatttggatgatgtcaccatttccttcggagatcaatcttccagtcggtatttggtggactattgctataaggaagatgaagataatgaattgatatattcaagggaggtgaagcctcttgtgtctgcagcttttgatggtcataactgcactgttattgcacatggtgctaggggtagtggaaagacgcacataattcagggctctgctgagagaccaggtttggcagtgcttgctatcactgagtttctttcagtgactgagcaaaatgggaaatccatagctgtttctttctatgaggttgatcatcaggagcgacccatggatttattaaatccagagaagccaccaattttggtttttgaagatcgtagcagaattcagtttaaaggactaactcaggttcctgtgaaatccattgaggaatttcagaatttgtactcctctgcatgttttgcactgaagggagctcccaaaaaaggaggctgtgaacgtgttcatagaagccacatgggattaatcgtgcatgtcttttcccataatggaagtcttctcagcaaagtgaattttgttgacttggcatcttatgaagatgctagaaagaaaagtagtgatgtctcctgccttgctgagactaacaaaattaacaagtcaatttatgccttattgaatgtttgtcatgctttgagtacaaatgaaagtcgtgttgcctatcgggaaagcaaaattacacgcatgctgcaggattccttgagggggactagcaaaattttgttaatttcatgcttgaacccatcattttgccaagacactatttacatggttagcttggcatcacgatcgtgtcattggattcatcgggcatctttagattctaccaagataagtgcaagttcagcaaaacaaatggtgaattctcataagaaccagatacctaaaagtgtttcaggaacagcaaagaaattatatggttcttctaaattacttgataaaaaagttgttgttgcaaagaagtctgcgataaaaggaaggaaattgtttgatgaagccagcaactctgctactaaagctgagaaggaagctcaatgcatcagttggtatcaaacgcaggacaattcattgtcagagactggaaatgatgtcatactcaactctggagtggaaaagaacactggaaatcatgttgtaatcaactttggaatggaaaaggatgactcattttcaaaagctagtgagaacgggaaacatatgcaggatgactctatacaggatgattcatctttgaatgctaacattgaagtggaacttaatccccttgctgatgaaggcattttggtggatgaagaggatcatcaaaaggatccttatgctagtaattactctgaagcattgtcaaaaatagttcaggaagaccatagcatgaacaaggagaacaacaattcaagggcaattggagatcattcatcggctactattagttcaccacctatcagttctcagttgcgggatctttctaatagtcttaaaatgctatattcttcaaccccatcatgcatgcagataccagaaaaggagcccattccacttgatattgttgaaccaaaaactcctacaattgaacaaaacatgagcattaacagattggatgcaatgaatgccaaaagtccctgggagacattcagcatgcgaggttctggaatgaagagttctcttgttcaagaatacctcaggtttttaaatacagctaacaaggaggaattaaaaaaattgaagggaattggagagaagagagctaccttcatacttgaactccgagaagaatctccagaacctttcaagagtctggatgatttgaaggatattgggctttcagcaaagcagattaaaggaataatgaagaaggaagtcggagagcttttcagttagttataaatgtattgctggatttatacaagtttccaaggagaatctgtattggcaacccaaagttgcccttgatatgtgtaatattatgagatgttcctggacttgtgtaatattatgagatgttcctggacttgtgtaattttatgagatgtttatttggatgtagaaaatgatatgaagaaggaaaaaacgtatattttgtt

SEQ ID NO: 8144 - DNA, 2009 bp, Glycine max
atggagaaagcgattgcgcgtgaacttgttcaacattttgccattggaacagggttttcagttttcactgttccattaagtttccgagctcaattcagcttccgattcgccgcgcgcaaaacgacttcgtttttggattttggcgtcgcgtcctattcagaagctatatactataagatgagacgaatgaagaaagatattgaagatgaggtgcttcccaatgatatgagtggggcacagttgaatgatgagagttatgaaggaagtgctggcattgttctgaagaaggggccatggacatcaactgaagatgatattttggtggattatgtcaagaagcatggggaggggaactggaatgctgttcagaagcacaccgggctgtttcgttgcggaaaaagttgtcggctgcggtgggccaatcacctaaggccaaatttaaagaaaggggcgtttgccgcagaagaggagcggctgattgctgaacttcatgccaaaatgggaaacaaatgggcacgcatggcagctcatttgcctggtcggacagataatgagataaagaactactggaacacccggatcaaaaggcgtcaacgggctgggttgccactttatcctccagaagtgagtttgcatgctttgcaagagagtcagcatagccaaagcactggtggacttaatggtggcgataaaatgcatcctgatttcttgcagaaaaacagttatgagatacatgatgctatatttgacagtctaaaggataatcagggaatcttaccttatgtgcatgagctttctgatatttctgtttatggcaataagctaaaaggtcttgattcttctcagtattgtagttttgtgccaccaacatcacctaagcgtaagcgtcttaaagagtcaacaataccatttattgattcctgtgctatgaaaaaaaaggatttatatccatttgatcaaattcaagacaataattctgataagattgcacaatcatttggaatgcaagcaccccttgatcctggtctctcctcgcacagttcaatgtgttacagccattcactttcaaatggcaactcctctacttctaagccttatgaggctatgaagttggagctcccttcactccaatatccagaactcgatttaggtagctggggttcatctcctccaccttctttgctcgagtcagttgatgatttccttcagtctcctacagcaattagtacactggagtcagattgttcttctccacaaaatagtggccttctggatgctttactttatcaggcaaagactatgagcagttcaaagaaccattgttctgataagagttcaaattcttctactgcaacccctggtgacagagctgacagctctattttgaatgtgtacgagacagaatgggaagattatgctgaccctgtatctccctttggtgccacttcaatattgaatgagtgcccagctcttagagccaatgcaaattcattgaacggacagctgccagttcagacctttactggcaaccttccgaaattagaatctgttgaccaggtttggactcctaacaatgaaaatctaaccttgtccctgttgaatattactcgtccagacttcttgcttgcttcagattggtatgacctaggttctggacattgcaagaaccaaaccatcacaactgatgctgcaacggcctttcttggagatgatttagccactgacctcaagcatatgactgctggaatttctaaaactatgtttgaaaatccattccagcccctctaaatgtacattcagggcaaaagtaacaaaggggttatttctctgaacgtatgttgaagcctctgtaccggaaatccaaacaagcgccaagtcaagtcaggtgtgttgttgtgcaatggcagtgaataaaatgcacgctgtctgtcggctgttcaatcttcattaagaaaacttctatcagatgtgtgatttgaaactctattactaagtagatttgtgctgat

SEQ ID NO: 8145 - DNA, 1662 bp, Glycine max
atgagacaaatgaagatagatattgaagatgaggtgcttcccaatgatatgagtgggacacaattgaatgatgagagttatgaaggaggtgctggcattgttctgaagaaagggccatggacatcaactgaagatgatattttggtggattatgtcaagaagcatggggaggggaactggaatgctgttcagaagcacaccgggttgttacgttgcggaaaaagttgtcggctgcggtgggctaatcacctaaggccgaatttaaagaaaggggcgtttaccgcagaagaggagcgggtgattgctgaacttcatgccaaaatgggaaacaaatgggcacgcatggcagcgcatttgcctggtcgcacagataatgagataaagaactactggaacacccggatcaaaaggtgtcaaagggctgggttgccactttatcctccagaagtgagtttgcaagctttgcaagagagccagcatagccaaagctctggtggacttaatggtggcgaaaaaatgcatcctgatttcttgcagaaaaacagttttgagatacatgatggtatatttgacagtctgaaggataatcagggaatcttaccttatgtgcacgagctttctgatatttctgtttatggcaatatgctaaaaggtcttgattcttctcagtattgtagttttgtgccaccaacattacctaagtgtaagcgtcttaaagagtcaacaataccatttatcgattcctgtgatatgaaaaaatatgatttatattcatttgatcaaattcgagacaataattctaataagattgcacaatcatttggaatgcaagcaccccttgatcctggtccctcctcgcacagctcaatgtgttacagccattcactttcaaatggcaattcctctacttctaagccttatgaggctgtgaagttggagctcccttcactccaatatccagaactcgatttaggtagctggggttcatcccccccaccttctttgctcgagtcagttgatgatttccttcagtctcctacaccaatcagtacactggagtcagattgttcttctccacaaaatagtggcctgctggatgctttactttatcaggcaaagactatgagcagttcaaagaaccattgttctgacaagagttcaaattcttctactgcaacccctggtgacagagctgacagctctgctttgaatgtgtacgagacagaatgggaagattatgctgatcctgtatctccctttggtgcaacttcaatattgaatgagtgcactggtcttagagccaatatgaattcattgaacgaacagctaccagttcagaccattactggcgaccttccaaatttagagtctgttgaccaggtttggacccctgacagtgaaaatcaaaccttgtccctgttgaataatacttgtccggacttcttgcttacttcagattggtatgacctaggttctgggcatggcaagaaccaggctatcagtactgatgctgcaacggcctttcttggagatgatttagccactgaccataaatatatgactgaaacactcgccaagtcaagtcaggtgtgggggtttggttgttgtgcaacggcagtgaataaaatgcttgctgtatttcagctgttcatccttggttaa

SEQ ID NO: 8146 - DNA, 1479 bp, Glycine max; identical to SEQ ID NO: 8141

SEQ ID NO: 8147 - DNA, 1720 bp, Glycine max; identical to SEQ ID NO: 8139

SEQ ID NO: 8148 - DNA, 957 bp, Glycine max
atgagggtcagagccagtttctttgtgctgttctcattgtcatgccttctttgtgtgttactttcaagtgctcaacaacttccacctgatgctgttgtttcggctcgtttgttagattcccatcttcaagattcggcctttagggcccttttcagtccaataaccggtgtgccctatgatgctcaagtgcccaccaacctttcagggatcaaagtttcagcaatgaggcttaggagtggtagtttgaggacaaggggtgttcttagctacaaagaatttgagatcccaattggggttgttgagaagccctatgtggagaggcttgtgttggtgtaccaaaacttaggtaattggtctgatcaattttaccctttacctggtttttcatatttggctcctgttttgggcctcttggcctatagtggaattaatttgtcagcctcagagttacctgagttggatataagggcttctgagaagccagttttggtcaattttcctcatgtgaggccagcaccattgggggcattggccaaatgtgtgtattttgatttgcatggttctgtgcaatttgacactctattacctgggaatgtgtgttcaacaatgcaacaagggcacttctctatagttgtggaatccaatgcaccatcaccagcgcctagtagtggtggggaatttcaagatgctagtgggaagaacaataagaaaaataacaagttcatgttgaggatattggctccatgtgtggttggtggaattgtgttgttgattattattttgggtctattggttgttttagtgagaagacacacgaaagggacaaggatgcagcaattggaatgtgtagcttatagcaatgaaatcatggatatgacatccattggtgacatcaaagtaccattagcatttgggactcgtacaagaccaatgatagaacatgattactttccttag

SEQ ID NO: 8149 - DNA, 2421 bp, Glycine max
aaaaaaaaaaaatcaaagaagactgtgacttatgatggcaggtcactcattatcaatggaagacgggagcttctcttctccggttccatccattacccacgaagcacccccgaggagtgggcaggcattcttgacaaagcaagacagggaggcataaacgtggtccaaacttacgtgttctggaacattcatgagactgagaaaggcaagtactcaattgagccgcagtatgattacataaagttcatcaagcttattcaaaagaaaggaatgtatgtaaccctcagggttgggcctttcatccaagctgaatggaatcacggaggacttccatattggctaagagaggtccctgaaatcatattccgctctaacaatgaaccctttaagaagcacatgaaaaaatatgtatcaaccgttataaaaacggtgaaagacgcgaacctctttgctccccaaggaggccctatcatcttggcacagattgagaatgagtacaaccatatccaacgtgcttttagagaggaaggagataattatgtccaatgggccgcaaaaatggcagtgtcactggatattggagttccatggatcatgtgcaagcagacagatgctcctgatccagtgattaatgcatgcaatggaaggcactgtggtgataccttttcaggccccaacaaaccttacaagcctgccatatggactgaaaactggactgctcagtatagagtgtttggagatccaccatctcaaagatcagcagaagacattgccttctcagttgctcgcttcttctctaagaatggatctttggtgaactattatatgtaccatggtggaacaaattttggtagaacaagctctgccttcactacaacccgatattacgatgaagcccctcttgatgagtacggtatgcagagagaaccaaaatggagtcacctgagggatgtgcacagggcattgagcctatgcaagagggccctgtttaatggtgcgtctaccgtcacaaaaatgagccaacatcacgaggttatagtttttgagaagccaggaagtaatttatgtgctgctttcatcaccaacaaccacaccaaagtaccaacaaccataagtttcagaggtacggactactatatgccaccacgttccattagcatccttcctgactgcaagactgttgttttcaacactcaatgtattgcttcacaacatagttcaaggaatttcaagcggtcaatggcagcaaacgatcataagtgggaggtgtattctgagaccattccaaccaccaagcaaattccaacccatgaaaagaatcctatagagctttatagcttgcttaaagacaccagcgactatgcatggtacaccaccagcgtagaactacgtccagaagacttgccaaagaagaatgatatacctaccattctccgtattatgagtcttggtcattcattgcttgcctttgtaaatggagaattcattggatcaaatcatggtagccatgaagaaaaaggttttgaattccagaaacctgtaaccttgaaggttggagttaaccaaatagctatcttggcttccactgtgggactccccgacagtggagcatacatggaacacaggttcgctggacccaagtctatattcatccttggtctcaactctggaaaaatggatctcacttctaatggttggggtcatgaggttggtatcaaaggtgagaagcttggcattttcactgaagaaggatcaaagaaagtacaatggaaagaagccaagggacctggaccggctgtctcctggtacaagacaaattttgcaaccccagagggaacggatcctgttgccatcaggatgactggtatggggaagggaatggtttggatcaatggtaaaagcattggtcgtcactggatgagttacctctctcctcttggacagcctactcaatcagagtaccacatcccaagaacttacttcaatccaaaagacaacttgcttgttgtatttgaggaagagatagctaatccagaaaaggttgaaatcctaactgttaacagagatacaatatgcagtttcgtcacagagaatcacccccccaatgtcaagtcatgggcaattaagagcgagaagttccaggctgttgtgaatgatctggtgccatcagcttcactcaaatgtccacaccaaagaaccattaaggctgtggagtttgcaagctttggtgatcctgcgggtgcatgtggagcctttgctttaggcaaatgtaatgcacctgccatcaagcagattgtggagaagcaatgcctcggaaaagcatcttgtttggttccaattgacaaggacgccttcactaagggccaagatgcttgcccaaatgtgacgaaggcacttgcaatccaagtgaggtgtgaatga

SEQ ID NO: 8150 - DNA, 2478 bp, Medicago truncatula
atgtctttaactctcaaacttttttctattaccttattttccatcatcaccattgtttgtgctcaaaatgccgcgcaaactatcacttatgatggtcgctcactccttctcgatggaaaaggagaacttttcttctccggttccatccattatccacgaagcacccctgatatgtggccagatattcttgataaagcaagacgtggaggactaaacttaatccaaacatatgtattttggaatggtcatgaacctgagaaagacaaggtgaatttcgaaggccggtatgatttggtgaaattccttaagcttgtacaagagaaaggaatgtatgttacccttagaattggccctttcatccaagctgaatggaatcacggaggacttccatattggctaagagaggtccctgacatcatattccgttctaacaatgaaccttttaagaaatacatgaaagaatatgtatcaattgttataaatagaatgaaagaagaaaaactctttgctcctcaaggaggccctatcatcttggctcagattgagaatgagtacaaccacatccaacttgcttatgaagctgatggagataattatgttcagtgggctgcaaaaatggcagtttcactatataatggagttccatgggtcatgtgcaagcagaaggatgctcctgatccagttattaatgcatgcaatggaaggcactgtggtgatacctttacaggtccaaacaaaccatacaaacctttcatatggactgaaaactggactgctcagtatagagtatttggagatccaccatctcaaagatctgcagaagacattgccttctcagttgctcgcttcttctctaagcatggatctttagtcaactactatatgtatcacggtggaacaaattttggtagaacaacctcagcctttacaacaacacgttactacgacgaagctcctcttgatgagtttggcctacaaagagaaccaaaatggagtcacctaagggatgcgcacaaggctgtaaacctatgtaagaagtctctactcaatggtgtgcctaccacacaaaaaattagccagtatcatgaggttatagtctatgaaaagaaagaaagtaatttatgtgctgctttcatcactaacaaccacacccaaacagcaaaaacattaagtttcagaggttcagactattttttgccaccacgttccatcagcattcttcctgattgcaagactgtggtcttcaacactcaaaatattgcttcacaacacagttcaagacactttgagaaatcaaagactggaaacgatttcaagtgggaggtgttttctgagcctataccaagtgccaaggaattgccatccaaacaaaaacttcctgcagaactttacagcttgcttaaggacaaaactgattatgggtggtacaccacgagtgtggagttgggtccagaagacataccaaagaagagtgatgtagcacccgttcttcgtattctgagtcttggacattcattgcaggcctttgtaaacggagaatacatcggatccaaacatggtagccatgaagagaaaggttttgaattccagaaacctgtaaactttaaggttggagttaaccagatagctatcttggctaatttagtaggactacctgatagtggagcatacatggaacacagatatgctggacctaagactataaccatcctaggtttgatgtctggaacaattgacctcacttctaatggttggggtcatcaggttggtctccaaggtgagaatgatagcattttcaccgagaagggatcaaagaaagtagaatggaaagatggcaagggaaaaggatcaactatctcctggtacaagacaaattttgatacaccagaaggaacaaacccagttgccatcggaatggaaggtatggcaaaaggaatgatttgggttaatggtgaaagcattggtcgtcactggatgagctacctctctcctcttggaaagcctactcaatcagagtaccacattccaagatctttccttaaaccaaaagacaacttgcttgtaatattcgaagaagaggcaataagtccagacaagattgctatactaactgtcaacagagatacaatatgcagtttcatcacagagaatcaccctcctaatattaggtcatttgcaagtaagaaccaaaaactcgaacgtgtgggggagaatctgactccagaagcttttatcacgtgtccggaccagaaaaaaattacggctgttgagtttgcaagctttggtgatccttcgggtttctgtggaagctttattatgggaaaatgtaatgcaccttcctccaagaagattgttgagcagctatgcttaggaaaaccaacttgttcggttccaatggtcaaagcaactttcaccggtggcaatgatggttgtccagatgttgtgaagacgcttgcaatccaagtgaagtgtggatga

SEQ ID NO: 8151 - DNA, 2544 bp, Medicago truncatula
atgactcccactcacaatctcgccttcctttccatattattagttctcttaccagccattgtcgcagcacatgatcatggtcgtgttgcaggcattaacaatgttacttatgatggtaaatcactctttgtcaatggaagacgcgagctcctcttctccggttccatccattacactcgcagcacccctgatgcgtggccagacattcttgataaggcaagacatggaggtttgaacgttattcaaacttacgtgttttggaacgctcatgagccagagcaaggcaagttcaattttgaaggcaacaatgatttggtgaagttcattaggcttgttcaatcaaaaggaatgtacgtgaccctcagggttggaccgttcatccaagccgaatggaaccacggaggacttccatattggctaagagaggttccagggatcatattccgctctgacaatgaaccctacaagaaatacatgaaagcatacgtgtcaaaaattatccaaatgatgaaagatgagaagctctttgctccccaaggaggccccatcatcttggcacaaattgaaaatgagtacaaccatattcaacttgcttatgaagagaagggagatagttatgttcagtgggccgcaaatatggcagtggccttggacatcggagttccgtggatcatgtgcaagcagaaggatgctcccgatcccgtcatcaatgcatgcaatggaagacattgtggtgataccttctcaggaccaaacaaaccatacaagccttccctatggactgaaaattggaccgctcagtacagagtatttggtgatccagtatcacagagatctgctgaagatattgccttctcagttgcccgattcttctccaaaaatggaaatctggtcaactactatatgtaccatggtggaacaaactttggaagaacaacctctgcctttacaacaacccgttattacgatgaggcacctcttgatgaatacggtatggagaggcagccaaaatggagccaccttagggacgcccacaaggctttgctcctttgcagaaaggctattctcggtggtgttcccactgtccaaaagctcaacgactaccacgaggttagaatctttgagaagcctggaacaagcacatgttctgcttttatcaccaataaccacactaatcaagcagccacaattagtttcagaggttctaactactttttgccagcacattccattagcgtcctcccagattgcaagactgtcgtctacaacacacaaaatgtaatgaaccaacttgtttattataaactaatctcatctcatctcatcatcaagctaattgtttcacaacataataaaaggaacttcgtgaagtctgctgtcgcaaacaacctcaaatgggagctgtttcttgaggcaattccatcatctaagaaacttgaatcaaatcaaaaaattccattagagctttacacattgcttaaagacaccacagattatggatggtacaccaccagctttgagttgggtccagaagacttgccaaagaagagtgcaattcttcgtattatgagtcttggacacacactatccgcatttgttaatggacaatacattggtactgatcatggtacccatgaagaaaaatcttttgaatttgagcaaccagctaacttcaaggttggaaccaactacatttccatcttggctaccactgttggactacctgacagtggagcttatatggagcataggtacgccggacccaagtccatatccatccttggtctcaataaaggaaaacttgaactcactaagaacggttggggtcatcgggttggtctcagaggtgagcaacttaaagttttcaccgaggaaggatcaaagaaggttcaatgggatccagtcacaggagaaacacgtgcactctcctggttgaagacaagatttgccacaccagagggaagaggtccagttgccatcaggatgactggtatgggaaaaggaatgatttgggtgaacggaaaaagcatcggtcgtcactggatgtcattcctctcccctcttggacaacctagtcaagaagagtaccacatcccaagagattacctgaatgcaaaggacaatttgcttgttgtattagaagaggagaagggaagtccagaaaaaatagagataatgattgttgacagagatacaatctgcagttacattacagagaacagtcctgccaatgtcaattcttggggatctaagaacggagaatttcgttctgttggcaaaaattctggaccacaagcttcactgaaatgtcccagcggcaaaaagattgttgctgtcgagtttgcaagctttggtaatcctagtggttactgtggagattttgctcttggaaattgtaacggtggtgctgctaagggtgttgttgagaaggcatgcttggggaaagaagaatgtttggttgaagtgaaccgtgcaaacttcaacggtcagggctgcgcaggttcagtgaatacacttgctatccaagctaagtgttcctactag

SEQ ID NO: 8152 - DNA, 1533 bp, Glycine max
atgagtcaaatgacaaatgaggtcgacaacaatgtgcattatgatgatcagactgggtcacagttaaatgatgatggtaatggagtaggtgttgttctgaagaaagggccatggacagctgctgaagatgctcttctggtgaactatgtccagaagcatggagaggggaactggaatgctgttcagaattactcaggcctgtctcgttgcggaaaaagctgtagactgcgatgggccaatcacctaaggccaaatttaaagaaaggagcatttaccgcagaagaggagcggatgattgctgaactccacgccaaaatgggaaacaaatgggcacgcatggcagcgcacttgcctggtcgtacagataatgaaataaaaaattactggaacacccggatgaagaggcggcgacgggctggcttgccactttatcctcctgaagtacttttgcaagcatttcaagagagaaagcatggccaaggtactggtgaaattagcgatggtgatggagggcatcgtgatttcttgaagaaaaacaattacgagatacatgatgcaatatttgacagtctgaaggaaaatcaaggaatcttaccttttttgcctgaccttcctgctatttctgctaatagctttcttccaaatggtcttggttctcctccatattgtaatttattgccatcaacattgccaaaccatgatcatcttcaagagtcaacaatgtcttttattggttccagtgaattgaacagcaatcgattttatccatttgaccatattaaggataatacttctgataagatttcagaatcatttggattgtattctccccttgatcgtggtgtctcacatggttcaatttgttacagccattcactatcgaatggcaattcctctacttctaagccgacttctgaggctgtgaagtcagagctcccttcactccaaattccagaaaccgaattcggtagttggggtacctctcccccacctccattgaacgagtctcttgatgttttcattcattctcctcaaccacctaatgcactagactcgggttcttcttcaccacttaatagtggcttgcttgatgcattactttatcaagcaaacactcttggttgttcaaagaataattcttctgacaagagttcaaattcttcaattgcaactcctggcgacagagctgagtgttctgctttgaacatgtacgagacagaatgggaggattatgctgaccctttatctccctttggagcaacttcaatcctgaatgagcatcctgttgttagcaccaatggaaactcatgggatgaatgggaactttttcagacctttagtggcaacaatgagagattgcagtcaattgaccaagtttggacccctaagagtgaaaatcaatccatgtctctgttgaatttcactctgccagatgtcttgataacttcagattggcacgagctgtattctgaccacgacagcacgaaccaagccatcatgactgaagctagtgatgatatcagtggacagtaa

SEQ ID NO: 8153 - DNA, 1533 bp, Glycine max
atgagtcaaatgacaaatgagattaactacaatgtgcactgcaatgatcaaactgggtcacagttaaatgatgagggcaatggagtaggtatggttctgaagaaagggccatggacagctgctgaagatgttcttttggtgaactatgtccagaagcatggagaggggaactggaatgctgttcagaagtactcaggcctgtctcgttgtggaaaaagttgtagactgcgatgggccaatcacctaaggccaaatttaaagaaaggagcatttaccgcagaagaggaacggatgattgctgaactccacgccaaaatgggaaacaaatgggcacgcatggcggcgcacttgcatggtcgtacagataacgaaataaaaaattactggaacactcggatgaagaggcggcaacgggctggcttgccactttatcctcccgaggtacttttgcaagcatttcaagagagaaagcatggccaaggtactggtgaaattagtaatggtgatggagggcatcatgatttcttgaagaaaaacaattatgagatacatgatgcaatatttgacagtctgaaggaaaatcaaggaatcttaccttttttgcctgaccttcctgctatttctgctaatagctttctgccaaattgtcttggttctcctccatattgtaattttttgccatcaacattacctaaccatgatcattttcaagagtcaaccatgtcttttattggttccagtgaattgaacagcaatgagttttatccatttgaccgtattaaggataataattctgataagatttcagaatcatttggattgtattctccccttgatcgtggtgcctcctcacatggctcaatttgttacagccattcactatcgaatggcaattcctctacttctaagctgatttctgaggctgcaaagtcagagctcccttcactccaaattccagaaaccgaatttggttgttggggtacctctcccccacctccattgaatgagtctcttgatgttttcattcattctcctcaaccacctaatgcactagactcaggttcttcaccacttaatagtggcttgcttgatgcattactttatcaagcaaatactcttggttgttcaaagaataattcttctgacaagagtttaaattcttcaattgcaactcctggtgacagagctgagagttctgctttgaacatgtatgagacagaatgggaggattatgctgaccctttatctccctttggagcaacttcaatcctgaatgagcatcctgttgttagcaccaatggaaactcatgggatgattgggaactttttcagacctttagtggcaacaatgagagattgcagtcagttgaccaggtttgggcccctaagagtggaaatcaatccatgtctctgttgaatctcactctgccagatgtcttgataacttcagattggcacgaactgtattctgaccacgatagcatgaaccaagctgtcatgactgaagctagtgatgatatcagtggacagtaa

SEQ ID NO: 8154 - DNA, 1533 bp, Glycine max; identical to SEQ ID NO: 8153

SEQ ID NO: 8155 - DNA, 1533 bp, Glycine max; identical to SEQ ID NO: 8152

SEQ ID NO: 8156 - DNA, 1662 bp, Glycine max; identical to SEQ ID NO: 8145

SEQ ID NO: 8157 - DNA, 2009 bp, Glycine max; identical to SEQ ID NO: 8144

SEQ ID NO: 8158 - DNA, 2454 bp, Glycine max; identical to SEQ ID NO: 8131

SEQ ID NO: 8159 - DNA, 2467 bp, Glycine max; identical to SEQ ID NO: 8132

SEQ ID NO: 8160 - DNA, 2542 bp, Glycine max; identical to SEQ ID NO: 8133

SEQ ID NO: 8161 - DNA, 2471 bp, Medicago truncatula; identical to SEQ ID NO: 8134

SEQ ID NO: 8162 - DNA, 2157 bp, Vitis vinifera; identical to SEQ ID NO: 8135

SEQ ID NO: 8163 - DNA, 3527 bp, Vitis vinifera; identical to SEQ ID NO: 8136

SEQ ID NO: 8164 - DNA, 3534 bp, Vitis vinifera; identical to SEQ ID NO: 8137

SEQ ID NO: 8165 - DNA, 2955 bp, Brassica napus; identical to SEQ ID NO: 8138

SEQ ID NO: 8166 - DNA, 2097 bp, Glycine max
atgccctttgcttctgcttccatggcaaaaaggagtgaagagctaggattaagcttaatgaacactgattctgctaaccatgacaggattcctggtggttgccacccgaatgatacaaccgcccctctgcctctggtttcaccatctcctttcccccactggaatttgcatgaaacatctcaacattataacaatgaaccagctggagttaattcaatgattgattcctctcagttcagaagttatcagaatttccagatggaccataattactcacacagagcagaagaacataatttccttccatgcagaccagattctcgttttccatgtccagaaggatacatagggtggccatatcaatatgacaggcacaataatctagcaatcccttccaatgtgaggaatgcttccttcaatctaaataattttgagaagcctgacaatggtgggatgtgtgtgaccccaatttacggttcggctagcaggctacaaatggtcaaccctactggaacagcaatgagtgctaatattggtcagccttcactagatatgaattcgggaatggctctgtgtaatccaaatcaaggttgtgtagaaccattgcttacaataggaaaacatgatgaaagatatatgaccatgggttctggaagtaataacaaagagtccaaatccagtgctgtaacaccaaaattcaatgtgactggtaattctgagagggcatttcttcctccaatcaattcatatcacaatcatctgggtagcagaagttccttaaaccctggttttgacatgaatgacaccttttctgcttttcagaatgacagtggattcatatctgatttagctccttcaggcaatcatgaagctctgtttgattctatacctggtttacggttggggccatcatatgcttttcaatggccagctgctggtgagcaaaaccgttatttagggcagttcaacagggatttaggtcttgcaggtgtgaaagacacaagtatggaatttacagatgtaggtctcacaaatggccttgaaagatgcatggatctaaattcattgccaattgttggcagtcaaactatgccttttgaaagtcgacagagctgggcgaatagacagctagttccctcttcaagtggagtagtaactgataatttgcctactgagatgttacctaaaaataatgataagttctcatcacagtttttttctagtcctcctttagctgtggccactagaagcaccagagggcaagatctttcaagtaatcctggtcaatcacaggcaggtggttctattcagcaatcaaactctcttcttcgaccacaatctacttctgatgtaggaatacaatccggaatgggatatatgactgctcaagtttcaaggccatccaacatgtcatctctaaagagagctgcttcccaaccactgtcatccactgtccagaatcaacacaggaagactctaccaactcagttcatacatccatcaattccaaattggaacagattggctccatcagtcccaaatacatcccgagcaatgtctcccttgatccgcccagcccaatctctcacagcccaagctcctcctcactctgttgttcctccatcattcccgacgacttggactaaatctgttcttcaagccccaaacacaacccgggcaattcatcccaaaatgcacacagctacatttcttgcacctaatgacaagagaatctcttctttccaccacccctcatcccatacttcacctcgtacaaaccaatctaaccatcaaatgttggctcaggctttggctcaccaacgtttgaaggctccaattataccatctgctccccgcattgcttccaattacattaaatttaaagatcaaacagcagaaccaagtggttataaatgccttttgtgcaagagggatctctcctacgcaccagaagggcctatttcccagccacctgttccgcctgctactgctgttctaccatgtggccacacctttcatgattactgtttggagcgaataacccctgatgaccaatccaaatatcctccatgcattccttgtgctcttctcgagtag

SEQ ID NO: 8167 - DNA, 2091 bp, Glycine max
atgccctttgcttctgcttccatggaaaaaaggagtgaagagctaggattaagcttaatgaacactgattctgctaaccatgacaggattcctggtgttcgccaccagaatgatactaccgtccctctgcctctggtttcaccatctcctttcccccactggcatttgcatgagacatcccaatattataacaatgaaccagctggagttaattcaatgattgattcctctcagttcagaagttatcagaatttccagatggaccataattactatcacagagcagaacataatttccttccatgcgaaacagattcttgttttccatgtccagaaggatacatagggtggccgtatcaatatgataggcacaataatctgacaatccctgtcgatgtgagggatgcttccttcaatctaaataattttgagaagcctggcaatggtgggatgtgtgtgaccccaagttatggttcagctagcaggctacaaatggccaaccctagtggagcatcaatgagtgctaatactggtcagccttcactagatatgaatttgggaatggctctgtgtaatccaaataaaggttgtgtagaaccattgcttacaataggaaaacgtgatgaaagatttatgaccactggttctggaagtaataacaaagagtccaaatccagtgctgtaacactaaaattcaatttgactggtaattctgacagggaatttcttcctccagtcaatatatatcacaatcaactgggtagcagaagttccttaaaccctggtttagacatgaatgccaccttttctgcttttcagaatgacagtgaagtcatatctgatttagctcctgcaagcaatcatgaagctctgtttgattctagacctggtttacgtttggggccatcatatgcttttcaatggccagctgctggagaccaaaaccattatttagggcaggtcaaccgggatttaggtcttggaggtgtgaaagacacaagtatggaatttacagctgtaggtcacaaaaatggccttggatgcatggatctaaattcattgccaattgttggcagtctaactatgccttttgaaagtggacagagatgggcgaatagacagttagctccctcttcaagtggaacggtaactgataagttgcctactgagctgttacctaaaaataatgataagttctcattacagcttttttctagtcctcctttagctgtggccagtggaagcacccgagagcaagatctttcaagtaatcatggtcaatcacaggcaggtggttctattcagcaatcaaactctcttcttcgaccacagtctacttctgatgtaggaatacaagctggaaagggatacattactgctcaagtttcaaggccatccaacttgtcatctctaaagagagctgcttcccaaccactgtcatccactatccagaatcaacaaaggaagactctaccaactcagttcatacatccatcaattccaactccttggaccagattggctccatcagtcccaaatacatcccgggcaatgtctcccttggtccgtccagccctgtctctcacaccccaagctcctcactctgttgttcctccatcattccctatgacttggactaaatctgttctacaagccccaaacacaacctgggcaattcctcccagaatgtacacagctccatttctcgcacctaatgacaagagaatctcatcttcccaccacccctcatcccatacttcaccttgtacaaaccaatctaaccatcaagcgttagctcgggctttgactcgccaacgcttgaaggctccaattataccatctgctcccagtattgcttccaattatattaaatttaaagatcaaacagcagaaccaattggttataaatgccttttgtgcaagagggatctctcctacgcaccagaagggcccatttcccagccacccgttccgcctgctactgctgttctaccatgtggccacacctttcatgagtattgtttggagcgaataacccctgatgaccaatccaaatatcctccatgcattccttgtgctcttctcgagtag

SEQ ID NO: 8168 - DNA, 1499 bp, Glycine max
atggaagatgatacaacaatgcctcaagatgatcaaggaaattgtgatggaactagaggcattggggttcttggaagatcttctaagaagtcaaagctgaaaaaggtgccacagaggggacttggtgtggcacagcttgaaaagataagactagaagaacaacaaaagagagatgttgctgcaattttaccatctcctagtgctttatcatcaaccacaccatcccatctgcctctcccagttaagaattttcatgactccaacgtatccccttctacacctcttttaccttgtgagccaccgtctgaatttaggtcccctttgtctctgcaacaacaacaccaccaacaacaacacatggatgttaaagttccaagcactgttccattggcaaacagtggtgattttgaggctggctggcctgttgttcctggacatgggaatgttcccaagtggtggagctccttccagtttgattctgagaagaacaactttggagtggagctgggatcgccgattctgccgagtgtgccttttgaatccagccccatttggcctctgcctaatttggtgcagagaacaccacagtatcagcatcagcatcaaacttcttcaccaatggcaagtgtctcatcaggaactttatcaacatatatgcctcatttcacaatagagcccccttcaaaccaaaacaacaattgcagcagtgtgcctgtgaagtcaatggagaagatggttggtatgaaaaggcaaacgccataccctttctccccggattttcctcatgtccctgctttcaattgtatatcgtccccctttgctgaagtaggaactaatgcaaaaactccgtgcggtaatggaagcggatttaactttggcaattcaacttccagagaagtatcatcatcctgtttagcttccaactctgagccaaagtcaaagaaaagaagagaagagaatgagaatttcaatggagattttctcacgttggctcctccctctcctacttcatatccaccttcaaagtccaaattgtctttaactttccaggcatttcacaaccaaggaaatgtagaagatcaaatccctgccgccccaccagtgttcaggctgttcaatcaacaaaagcaaccattttatggcttcttccttccagaaccaaaggaggaacaaattggagaaacagcagccaggattcagaatggtcatgaagtgggagaaagtgttgatcttaacttgaaactatgaatataacttctaggctagttgtttctcactatgaaacttgcatagtcatctttttatttttatttttatttttactagtggtagatattcctaaatgtgcacatgtagtgttggttgagtatgaaaaggactaaaaatcttggccatgtgagaggtaggagtggaaaatgaaaggagagatgttgatttgtttgttttgagtagcaatgcctatgtgctttaatgaaaagccaaactctagtggctttgcc

SEQ ID NO: 8169 - DNA, 1720 bp, Glycine max; identical to SEQ ID NO: 8139

SEQ ID NO: 8170 - DNA, 1479 bp, Glycine max; identical to SEQ ID NO: 8141

SEQ ID NO: 8171 - DNA, 1533 bp, Glycine max; identical to SEQ ID NO: 8152

SEQ ID NO: 8172 - DNA, 1533 bp, Glycine max; identical to SEQ ID NO: 8153

SEQ ID NO: 8173 - DNA, 2421 bp, Glycine max; identical to SEQ ID NO: 8149

SEQ ID NO: 8174 - DNA, 2478 bp, Medicago truncatula; identical to SEQ ID NO: 8150

SEQ ID NO: 8175 - DNA, 2544 bp, Medicago truncatula; identical to SEQ ID NO: 8151

SEQ ID NO: 8176 - DNA, 2009 bp, Glycine max; identical to SEQ ID NO: 8144

SEQ ID NO: 8177 - DNA, 1662 bp, Glycine max; identical to SEQ ID NO: 8145

SEQ ID NO: 8178 - DNA, 1479 bp, Glycine max; identical to SEQ ID NO: 8141

SEQ ID NO: 8179 - DNA, 1720 bp, Glycine max; identical to SEQ ID NO: 8139

SEQ ID NO: 8180 - DNA, 1662 bp, Glycine max; identical to SEQ ID NO: 8145

SEQ ID NO: 8181 - DNA, 2009 bp, Glycine max; identical to SEQ ID NO: 8144

SEQ ID NO: 8182 - DNA, 1533 bp, Glycine max; identical to SEQ ID NO: 8153

SEQ ID NO: 8183 - DNA, 1533 bp, Glycine max; identical to SEQ ID NO: 8152

SEQ ID NO: 8184 - DNA, 783 bp, Glycine max
ggctaacacgcaaaagtctttggcgggaatggaagagggtgacagtgaggccatttttggtgctcttaatctgaacccgcaactcttctgtaacgaagttctcaacattgtcgacgatgtgctcgacgaagctttcaatttcttctaccaggacgcatccacgaagctcaacatcgaaggcacccaaaggtcccaggatctgaaaaagggtgttgattgcgttcggctgaatgttcaatctgttttggacaaacaacttgctgcttgggagagttacatcctccgtcactgttttgctcttccccaaggttttcgtatgccaaacaccgatgaatcaaatgagaatgccctagatccaggtgctccttttgatccagatatagatgcccagttagattcattgagagaaaaactaattgaggtggggaaggagtctgaaatgcttaatcaagaaatgcaagcattagaaagaaagtctgctgtcaatgtggctggacatatcaatgaagctgtacaattatatgagcaaaattctatgcatgaggtgtttcaggagattgtgacgaccgcctcagaacttggagcaaagatggcaaagctaaactctagcatgattgaagagactgaccaaacaaaaactaaaaggatttacagcacagaaatggatctatctgctataaatcctgctaaaggcctgtcaaacatgaagttagacgatgttgaagaatttgtaagtgttatgaagagtatgtgaacttgtctttttcatcaatctagttggac

SEQ ID NO: 8185 - DNA, 694 bp, Glycine max
ggggcgggaatggaagagggtgacagtgaggccatttttggtgctcttaatctgaacccgcaactcttctgtaacgaagttctcaacattgtcgacgatgtgctcgacgaagctttcaatttcttctaccaggacgcatccacgaagctcaacatcgaaggcacccaaaggtcccaggatctgaaaaagggtgttgattgcgttcggctgaatgttcaatctgttttggacaaacaacttgctgcttgggagagttacatcctccgtcactgttttgctcttccccaaggttttcgtatgccaaacaccgatgaatcaaatgagaatgccctagatccaggtgctccttttgatccagatatagatgcccagttagattcattgagagaaaaactaattgaggtggggaaggagtctgaaatgcttaatcaagaaatgcaagcattagaaagaaagtctgctgtcaatgtggctggacatatcaatgaagctgtacaattatatgagcaaaatcctatgcatgaggtgtttcaggagattgtgacgaccgcctcagaacttggagcaagatggcaaagctaaactctagcatgattgaagagactgaccaaacaaaaactaaaaggatttacagcacagaaatggatctatctgctataatcccgctaaagcctgtcaaacatgaagttagacg

SEQ ID NO: 8186 - DNA, 1572 bp, Glycine max
aaagtgggtttccggcagagatcatatatcttctagggtgtccacctttgaaattcaatctccaattgagcatcacaaaccctagaaaatcgttccagatgaatacaaaatcgctccaaatcctggtgcactcaccggacctcggaatttcccttcaatccacaaccaaccacgaaaccctttccgatctcaaaaactctcttttccctcaatcacaccaatccttctacttcaccttcaatggcaaacccctccccgacaaaacccctctttcccaattcccccctctctccaccctctctctccgctcccgcctccttggcggcggcggagacggcggcgccaccggagccgagtcccgcgactgctacctcaacatgtacgccgacaagaagcccgacaaggtggaccccaatgaacagcgtctctccaagtggcacaattgcgccctctccaacgaacccttgagagagccctgcgtgatcgataaattggggaatatcttcaacaaggaagcgctggtggaagcgttgttggggaagaagcttcccaaggaatttgggcacatcaagggtttgaaggatatgattaatgttcagctttctgcgattcctggagcggatgatggggcaaagtttcagtgccctgttgcggggcttgaattcaacgggaagtataggtttttcgcgctgaggaattgtgggcatgttttgagtgcgaaggctctgagggaggttaagtcttcgtcgtgtttggtttgtcacaaggagtatgctgacgtggataaggttgtgctcaatgggagtgatgaggaggttgcggttttgagggagaggatggaggaggagaaagctaagattagggagaagaagagtaagaaggttaagaataatggtaatgatgacggtgtgagtttggaagggactaggttgagtggtactaagcatggtgttgatggtaagggtgtagagaaagcttcggctaaggtggaacgaaatgggaaggttggtaatggtaatgttggtgtgaatggtggtgctgctgctgctgccaagcgtttcaaggctgttgatctggccccggcgaatgctacaaaggatgtgtatgcttccatcttcacttcgtcgaggaagtctgagtttaaagaaacttatagctgtaggtctcttcctcttggaagaaactgattcaggtgtctggttgtgcattatgatatagactatgtttaagtgagagatatcgtctaagtcgggggctgaaggttcgaacatgtgacattcacattcagggtaattagttttgtttctcatgtatgagtaggtcagcgatgtccatggtccatagagtattgcactagcattaccctttgtagatgaggaatgtaaagaaagcgcttggaagatgatattatagagtgcttatttaagctttatgaaaataatttaggactactataaattctttttagcttatttcaacaagcatcttattgtagtttattgaaataaactatttttaccttattccaataggtttcatgcttaaatatatgttataaattctcatgttata

SEQ ID NO: 8187 - DNA, 1301 bp, Glycine max
gataaaagtataaaaatcactatatgatatcgggttacctcctccaattctcaccgaaatccgtcgtcaaagttggtttccggcagagatcatatatctcctagggtttccagctgaatcgagcatactccctcaatctccaattccacatcacaaaccctagaaaatcttttcagatgaatccaaaatcgctccaaatcctggtgcagtcaccggacctcggaatttcccttcaacccacaaccaaacacgaaaccctttccgatctcaaacactctctctttcctcaatcacaccgatccttctacttcaccttcaatggcaagcccctccccgacaaaacccctctctcgcaattcccccctctctccaccctctccctccgctcccgcctccctggtggtggcggagacggcggtgccacaggcgccgagtcccgtgactgctacctcaacatgtacgccgacaagaagcccgacaaggtggaccccaacgaacagcgcctctccaagtggcacaactgcgccctctccaacgaacccttgagagagccctgcgtgatcgataaattggggaatatcttcaacaaggaatctctggtggaagcgttgttagggaagaagcttcccaaggaatttgggcacatcaagggtttgaaagatatgattaatgttcagctttctgcgattcctggagcggaggatggggcaaagtttcagtgccccattgcagggcttgaatttaacggaaagtataggtttttcgcgctgaggaattgtgggcatgttttgagtgccaaggctctgagggaggttaagtcctcttcgtgtttggtttgtcacaaggagtatgctgacttggataagattgtgctcaatggaagtgatgaggaggttgtaattttgcgggagaggatggaggaggagaagcctaagattagggagaagaagagtaagaaggttaagcataataatggtgatggtggtgtggagaaggcttcggctaaggtggaacgaaatgggaaggttggtaatgttgctttgaatggtaatggtggtggtggtggtgctgctgctgccaagcgtttcaaggctgttgatttggccccggcgaatgctactaaggatgtgtatgcttccattttcacttcctcgaggaagtctgacttcaaagaaacatatagttgtaggtctcttcctcttggaagaaactgattcaggcgtctctactgttttattgttgtccaatgtactgaattttagtttgtgcctttgtggttatataagtgattgacttttcct

SEQ ID NO: 8188 - DNA, 1512 bp, Medicago truncatula
aagatcaaattacgttgagatgttgtaaacgtgagtatttaaaaatctactgggcaaccaaacagacactcaatctccgattttcgtttctctatacaaatacaaaattcacaaaccctagaaaaatcgaaaatgcatcgcaaatcattccaaatccttgttcaatcaccggacctacaaattcaccctaaatccgtcaccggcgacgaaaccctctccgatctaaaacactctatcttccccaattcacaatcatccttctacttcaccctcaacggaaaacctctctccgatgacaccaatttctccacctcccgaatcgcacctctttcaaccctagtccttcaatcacgcctccgtggtggcggtggagatggaggctctacatgtgccgagtcacgtgactgttacctcaagatgtacgcggagaagaaacccgataaggttgatccaaacgagcagaggctatcgaaatggcagaactgtgcgttatcgaatgagcctttacgtgaaccgtgtgtgattgataagcttgggaatattttcaataaggaatcattggtggaagcgttgttggggaagaagctgccgaaagagtttgggtatattaagggtttgaaggatatgattaaaattaagcttgaatctgttcctggtgaggatgatggtgctaagtttcggtgtcccgttgcggggcttgagtttaatggaaagtataagtttttcgctcttaggaattgtgggcatgttttgagtgctaaggctttgaaagaagttaaatcttcggcgtgtttggtttgtcatgaggaatttggtgagggggataagattgtgattaatgggaatgaagaagaggttgaggttttgagggagaggatggaggaggagaaggctaaggttagggagaaaaaaaccaagaaggttaagaataatgatagtgaggctgtcgatggtttgagtttggaagcgtcaaagttgactggtactaagcatggtttgaatgtggagaaggcttcggctaaggtggataagaatgggaaggttgctaatggtaacaaaggtgttaatggtggtgctgctgctgctaagcgtttcaaggcgactgatattgccccggcaaatgcaaccgaggtctatgcttccatctttacttcttctagaaagtctgaatttaaagaaacatattcttgcaggtctctgcctcttgttatcgatgctggacgaatgcagtatggtttggtaaacatatgccaaaaatcagagtggagtggtgcgaatagcttggagtactatagtctagaggataattttgttcacaatataattgacatacggtttaaggctgctaatgggaacaaaagtcttactggcggtgctgctgctaagcgttttaaggcgactgatattgccccggcaaatgctaccgaggtctatgcattgatttttacttctaggaagtctgagtttaaagaaacatgttcgtgcagatctttgcctcttggtagaaattaa

SEQ ID NO: 8189 - DNA, 1552 bp, Glycine max
atgggagagctacaacaccatcaacaacaggcagcagcagcagcagcaccgtcgagagcggcgatgagaggcgtcggcggcggcgagattgtggaggtgcaaggcggccacattgtccgctccaccggacggaaggaccgccacagcaaagtctgcaccgccaaaggccccagagaccgccgcgtgcggctggcggcgcacaccgccatccaattctacgacgtccaggaccgcctgggctacgaccgccccagcaaggcggtcgactggctcatcaagaaagccaaggcggccatcgaccagctcgcggagctcccgccatggaaccccactgccacctcaatgcaacattcaatgaccgctgccttcagtagccgcggcgaaagcaacgctttcgcctcccaccaacaagtggaggataatgaaaatgctaacaacattagcagcagcagcggcaacaaatacaataccggttctgggtttctgcccgcgtctttggacactgacaacattgcggagacaatcaagactttctttcctgtggaagcgacctcgacgtcgtttcagagttacccgccggcgccaccggatttagggcaccaagatctgcggctctcgttgcagtcctttcaggaccctattatgcttcaccaccagcctcatagccaccaccaaccggttctctttgccggaaccgccgccgcggcgctcgacttcgacggcggttccggctggtcagagcacctgcaccagcaccagcaacagaaccaccactcggaggaacagcgattgctctatgctggtggtaacagtggccacggcggtgggtttgtgttcaacacgccggcgccggtgcaggtgccggcgtttggccagtttttttctcagaggggaccccttcagtccagtaacaccccttcgattcgtgcttggatagacccttcggtcgatcaccaccaccaccaccatcactacctatcacagttgatccaccaaggatccgtcgccggtggcggcggattctccggcttccgcattcctgcacgaattcagggtgaagaggaacacgacggcgtgtccgacaagccgtcctctgcttcctctgattctcgccattgatttgaaaaacacacatcaaaaaccccaactttgttctccctcagggtttgtggggttgcattgaagatggttcaattgatggagagaacatgattttggaagatcatgatgaatggattttcaagctacaacgggaattcaagaaaatctgaggtggatattcaggttttccaatccctcggtttgttatgctttttatgttcaacttatgtttttcatgcttaatttaactaggactaggagtattgtgtttcttttgtttcttctgtattggagtgctatgtttcttttgtttcttctgtattggagtgctatgtttccctttgttaagtgattgtgtcttctttgtacttcttcagtttcgagtttcttgtagtgatctgaaaaacatgcaaattcaataaaagagctagtttgctctagttattgtata

SEQ ID NO: 8190 - DNA, 2016 bp, Glycine max
ggaacttttggaagaggcagaagcaagtttcagagtggtggcagttgcacaagcaacaagaagtgcaaagctgggagtgcaaggaatcaacaacccattaggaataagtgcaaagcttcattaaaagctggaagaggaaaatcacaacaggggtctgactctggatcctaacaggaattatcatcatcatcatcttctgcatcaacaacctcatcatcaaaatctgattctaaattcaagaaggcatgtaacaaaccaagaagaccaagaatctcatcctcaccaattccatatccaattccaacaacaaagggaacaacaatcctacacagctttagacacggaactcttaaacccactccaaccaccaaagaaacggtcttgccgcccgcctcttccgccgccaccaccttcctcgcttactttatccgaacatgcaagaaaaatgggagaaccacaacaccctcaccagcaccatcaacaagcagcagcaacaccgtcgagagcggcgatgagaggcggcggcggcggcgagattgtggaggtgcaaggcggccacattgtccgctccaccggacggaaggaccgccacagcaaggtctgcactgccaaaggcccccgagaccgccgcgtgcgcctggcggcgcacaccgccatccagttctacgacgtccaggaccgccttggctacgaccgtcccagcaaggcggtcgactggctcatcaagaaagccaaggcagccatcgaccaactcgcggagctcccgccatggaaccccaccgccacttgccgcggcgagagccccgctttcgccgcggctactagagattcagaacaattctctcacccacaagtagagcagaatgaaaatgctaacaacatcagcagcagcagcatcagcatcaaatacaatagcggttctggttttctgccggcgtccttggacactgacaatattgcggagacaatcaagactttctttccagtggaggcgactacgacgtcgtttcagagttacccgccggcgccaccggatttggggcagcaagatctacggctctcgctacagtcctttcaggaccctattatgcttcatcaccagcctcagagtcaccacgagccggtgctctttgccggaaccgccgccgcggcgctcggcttcgacggcggttacgggtggtcagaacaccagcaccagaaccatcactcggaggaacagcgattgctctatgctggtggcaacagtggccatggcggtgggtttgtgttcaacacgccggcgccggtgccggcgtttggccagtttttttctcagaggggaccccttcagtccagtaacaccccttcgattcgtgcttggatagacccttcggtcgatcaccaccaccatcatcatcactacctctcgcagttgatccaccagggttccgtcgccggaggcagcggattctccagtggattctccggcttccgcattccagcacgaattcagggtgaagaggaacacgacggcgtatcggacaagccgtcctctgcttcctctgattctcgccattgatttgaaaaacacatcaaaaaccccaactttgttcttcctcagggtttgtgggttgcattgaagatgtttaaattgatggagagaacatgcatttggaagattaggatggatgaattttcaagctacaatgggaattcaagagagttgggtttggatttcagatgtgtttattttaatggcctatatatgccgtgggaatgaagaaaatctgaggtggatattcaggttttccaatccctcggtttgttatgctttttatgttttacttacgtttttctgtttaatttaaatagaactaggagtattgtgtttcttttgtttcatctgtattggattgctatgtttccatttgttaagtgattgtgtctactttgtacttcttcagtttcttgtttcttgtagtgatttgaaaaccatgcaaattaaataaaagagctagtttgctctagttattgtat

SEQ ID NO: 8191 - DNA, 1858 bp, Glycine max
gtcctgacaatttcaagttgacgaactgtttggtctgttgttgatttacattaaacattacattacattacctgccgactagtttacgctatcagcaatagcaagtcggtcgctcagacacgcacagatctgatctgatctgatctatctgaagccgaaaacgccgacggtgatgatgaagatggggtgttcacgttgctccttcttcctcttcctcatcctcttagtggcgctcttcccctcgtcgctctccgagatccgcttctccgagatccgaaacgacgatcgccgcatcatccccttcgatcagtttggattcacccacaagggtcgccttgagctcagcgtttccaaaatctcactctccaattccaatttggacctctcgaaggtcggcttctttctctgcaccctcgattcctggcttcatgtcctccagcaactcgaggacggtgagattcggtgcgcccttcaatccgatctggtcaagtccgtctattccttcaattctctaaacggcaaggactctttcagcacgctctacaaagaggaaaccgacgccgatcagtacaacctcgtcttcgccaactgccactggcagcaactcaaggtgacaatggacgttaaatctgccatgtacaacctagaagggaatagcaacgtccgcgattacctctctgcgggcagaaccatccttcctagggtttatttgctcttctcgttggtgtatttcgctctggctgctctctggatcagcgtcctctacaagaagcgccaaaccgccttccgcatccattacttcatgctgggcgtggtcatctttaaggccttgaatctcttgtgcgaggccgaggacaaatcctacatcaagcgcaccggaagcgcccacggttgggatatcgtcttctacattttcagcttcctcaagggcatttcgctcttcactctaattgtcttgattggcactggctggtccttcctcaaacccttccttcaggataaggaaaagaaggttctcatcattgtcatcccccttcaagtcattgccaacattgctcaggtcgttattgacgagagtgggccctttggccatgactgggttacctggaagcagatcttcctccttgttgatgtcgtctgttgttgcgctgtgctcttccccattgtctggtccatcaagaacctccgtgaggccgctaggaccgacggcaaggctgctgttaatttgatgaagcttactctcttccggcactactatgtcgtcgttatctgttacatttacttcaccagggttgtcgtttatgccttggagactattacctcctatcgctattcttggaccagtgttgttgctgctgagttggccacacttgctttctatgtctttactggctacaagttcaagcctgaggctcacaatccttattttgtcatcgatgatgaagaggaagaggctgctgcagaggccttgaagcttgaagatgaatttgaattgtaacttctttcaaaatacaaaattaagcttttttcctagttaggttttgaacaagttggttccatgctcagcaatgctcaggtttcatctcaacagccagtagaaattttcatcttaaatgttatgggtatagtcattattcataaatcattgcgctatattttgtgttctggactcatgccagtttttttaattagtgttataatatcctaaacccttgtgtagtgctatgaacatatattacgtctaagtattgataccgataccttgcaaatattttttgtcatgaatgcttttgttatacttatcttccaacttggaacttctgttgctgcaaagttgcattggaatagtaattagtat

SEQ ID NO: 8192 - DNA, 2030 bp, Glycine max
actggtgtcctggcaatctcaagttgactgactagtttggtgtggtgtctgttgattaacattacattgcctgccgactagtttacggtatcagcaatagcaagtggctcacacacgcacagatctgatctatctgaagctgaaaacgccgacgcccgacggtgatgatgaagatggggtcctcaccttcacgttgctccttcttcctattcctcctcctcctagtggcgctcttcccctcgtcgctctccgagatccggttctccgagatccgaaacgacgatcgctccatcgttcccttcgatcagtttggattcacccacaagggtcgccttgagctcagcgtttccaaaatatcactctccaattccaatttggacctctccaaggtgggattcttcctctgcaccctggattcctggcttcatgtcttccagcaactggaggatggcgagattcggtgcgcccttcaatccgatctggtcaagtccgtctacaccttcaattctctcaacggcaaggactctttcagcacgctctacaaagaagaaaccgacgccgatcagtacaacctcgtctttgccaactgccactcgccgcaactcaaagtgaccatggacgttaaatctgccatgtataatctcgacggaaagagcgacgtccgcgactacctctctgccggcagaaccatccttccgagggtttatttcctcttctcgcttgtgtatttcaccctcgcagctctctggatcagcgtcctctacaagaagcgcttgaccgccttccgcatccattacttcatgctagccgtggttatcttgaaagccctgaatctcttgtgcgaggccgaggacaaatcctacatcaagcgcaccggaagcgcccacggttgggatatcatcttttacattttcagcttcctcaagggcatctcgctcttcactctcattgtcttgattggcactggctggtccttcctcaaacccttccttcaggataaggaaaaaaaggttctcatcgttgtcatcccccttcaagtcattgccaacattgctcaggtcgttattgacgagaatgggccctacggccatgactgggctacctggaaacaggtcttcctccttgttgacgtcgtctgttgctgcgctgtgcttttccccattgtctggtccatcaagaacctccgtgaggccgctaggaccgacggcaaggccgctgttaatttgatgaagcttactctcttcaggcactactatgtcgtcgttatctgttacatttacttcaccagggttgtcgtttatgccttggagactattacctcctatcgttattcttggaccagtgtggttgctgctgagttggccacccttgctttctatttctttactggctacaagttcaagccagaggctcacaatccgtattttgtcatcgatgacgaagaggaagaggctgccgcagaggccttgaagcttgaagatgaatttgaattgtaatttctttcaaaatacaaaattagttgttgaacaagttggtaccatgctcagcaatgctctcaggtttcatctcaacagccagtagaaatttgcatgttacattttatgggtatagtcattattcataaatcattgtgctatattttgtgttctggactcatgccagtttttgcattagtgttataatatcctaaacccttgtgtagtgctctgaacatatattacttctaagtatagatactgataccttgcaaatatttttttgtcatgattacttttattgtacctatcttccaatttggaacttcttttcctgcaaatttgcattggaatttgtttgaccattgatactatatttgttgcaaacattaatccaactattaccactggaattctgaatttgctcagaggtaaaagtgtcatgttagctacacccctgagctagttgtatgtaagaatcagggtcgaggtagtcattgtgcaatttatttatacaatagaaaaatgaaatctcttacccaaaaaaaaaaaaaa

SEQ ID NO: 8193 - DNA, 1254 bp, Cucumis melo subsp. melo
gcggccatggatttattttcctcctccatgtttattctcatcatcttcctcttacccttttcttcttttgccgagattcgtttcaccgagatcagaaatgacaatcgacccatcattcccttcgatgtcttcggtttcagccatggcggtcgtctcgagctcaacgtcacacatctcacactctccgattccaacccagatctcgatctttccaaggtcggatttttcctttgtactcgagaatcatggcttcatgtgatccaacaattggaagaaggtgatatctcttgcgctcttcaatctgaccttgtcaaacccgtttacacctttgattcccttaagaaacaagaccgattcggtgttctttattccgagactgatgctgatcaatacactctcgtttttgctaactgtcttcaacaattcaaggtttctatggatgttcaatccgctatgtacaatcttgaaggcaaaaacgctcgacgtgattatctatctgctgggaaaaccatccttccgaggatttacttcgttttctctttgatttatttctcgcttgctgttgtttggattcatgttctttacaaaaagcgattgacggtttatggtattcatttctttatgcttgctgttgtgatcttgaaggctttgaatcttctctgtgaagctgaggataaatcttatattaagcgtactgggagtgcccatggttgggatgttctgttctacatttttagtttcttaaagggtatcactttgttcactttgatcgtcttgattggcactggttggtctttcttgaaaccttatttgcaggacaaggagaagaaggttttgatgattgtgattccattacaagtggtggctaatattgctcaggttgtgattgatgaaactgggccatttgaacaagaatgggttacatggaaacaggtgttcttgcttgttgatgtgatttgttgctgtgctgttttgttccccattgtttggtcaatcaagaacttgcgcgaagctgcacgaaccgatggaaaagcagctgtgaatttgatgaaattgaccctttttagacagtattacattgtggttatatgctatatctacttcactcgagttgtagtttatgcacttgagacgattacttcgtatcggtatctatggacgagtgtcgtggctggggaattggcaacacttgcattctatgtatttactggttataagttcaagcctgaggctcataatccttattttgtagtt

SEQ ID NO: 8194 - DNA, 1627 bp, Vitis vinifera
ctgatctgagctccccgccctcagatctcccaatggcgatctgctccgcttcatctcgctgcttggctctcatcctcctcaccactctgtcgttctctggttgcttcgcggagatccacacctccgagatccgatccgatggtcaaccgatcatccctctcgatgtgttcggatttacccacaccggccgcctggagctcaacgtctcgcaaatctcgttctctaactctaaccccgatctcgatctctccaaaatcggattcttcctctgcacgcgtgactcatggctacatgttcttcagcagctggaagagtcggatatcacctgcgctctcaagtctgacgtcgtcaagactgtgtattccttcgatcggctcaagggggctacgagctttggtacggtgtatcagatgaacgacgcggatcagtttactcttgtcttcgccaactgccttcagcaggtgcagatctcgatgaacgttcgatccgtgatgtataatcttgaagacaagaacggtcgtcgggattacttgtcggccggaaaagcggtgctgcctagggtttattttctcttttctttgatttatttcggtatggccgctatttggattagggttcttcacaagaagcgcttgacggtgtttcgtattcatttctttatgcttgcggtggtgatattgaaggcgctgaatttactctgtgaggcggaggataaatcgtacattaagagaactggtagtgcacacggttgggatgttttgttttatatattcagttttctgaaggggatttcgcttttcactttgattgttttgatcgggacgggttggtcgttcttgaaaccctacttgcaagataaggagaagacggttttgatgattgtgattccgcttcaagtggttgcgaatattgcacaaattgtgattgatgaatcggggccgtacgggcatgactggttcacatggaagcaggtatttttgcttgttgatatactttgctgctgtgccgtcttgttcccaattgtgtggtcgattaagaatttgcgtgaggcagctaggactgatgggaaggcagctgttaatttgatgaagttgactctgttcagacattattatgttgtgtttatttgctacatatattttacccgggttgtggtgtatgcattggagaccattacctcttatcggtatctctggactagtacagttgctggggagttggcaacgctggctttctatgtgtacaccggttataagttcaagcctgaggctcacaatccgtattttgtgattgatgatgatgaggaagaagcagcagcggagcaactgaagcttgaagatgagtttgaattgtgatatatttctgagtgttgtatgaatggcaatagtaattgcagaatatggtgcagtgaccaattgtgaaggttgaggtagaaacctggggcattccgctgggtttcccagttggacttgactgttgcaggcatggggaatttaaaatgtgctatttttctctttttatgctgatgttctttgtcagttgttcttgagttagcaggataatttcatagattatggtacatgtttgtgaattaaacagtatgtgtaagtaccaatactgaaacttt

SEQ ID NO: 8195 - DNA, 1757 bp, Arabidopsis thaliana
aatttaatttggttggtcacacacaaccgttttcatcggaagaagaacaagttggattgattttgctttggatctcacatctgagatcagattaatctctctgtgaagtcgaagaacgaaaccctagttcccatggatctctcttcacgcttctcatcgatccttatccttctcttgatctccatctccatagcttcggctgagattcgtaaatcagagatccgatccgatgatcgtccaatcatccctttagacgaattcggtttcactcacagcggtcgtcttgagcttgacgcttccaagatctggctttccaacagcaatcccgatctcgatctctccaaagtgggcttctttctctgcactagagacgcttgggttcatgtgatccaacagcttgaagaagaagagatcacgtgcgctctacaatcagatctcgttaagcatgtgttcaccttcaacaatctcaagggaggagataagagcagattctccaccgtattcaccgagaacgatgcggatcagtactctctcgtcttcgctaattgtctccaacaggtcaaaatcagtatggatgttagatccgctatgtataaccttgaaggtaaaaagggaggtcgtgattatctctctgctggaagaactgttcttcctaaggtctatttcttattctctgttatctatttctctctcgccgccacgtggatctacgttctctataagaaacgtctcactgttttcgcaatccatttcttcatgttgggagttgttgtcttgaaagctttgaaccttctttgtgaggctgaggataagtcgtacattaagaaaactggaactgctcatggttgggatgtcttgttctacattttcaatttccttaagggtatcactcttttcactttgatcgtcttgatcggcaccggttggtctttcttgaagccctacttgcaggacaaggaaaagaaggtcttgatgattgtcattcctctccaggttgtcgctaactttgctcaggtggttatcgatgagactggaccgtatggccaagattgggtcacgtggaaacagatctttttgcttgttgatgtcgtctgttgctgtgctgttctgtttcccattgtctggtccatcaaaaacttgcgtgaggcggctaagactgacgggaaggctgctgtgaacctcgttaagttaactctgtttaggcagtactacattgtggttatctgctacatctacttcactcgtgttgttgtgtatgcactggagaccattacctcttacaagtatatgtggactagtgttgttgccagcgagttagccacacttgccttctatctgtttactggctacaagttcaggccagaggtgcataacccgtactttgttgttgacgatgaggaagaagaggctgctgctgaggctctgaagcttgaagacgagtttgaattgtaagtcatcactggaataatcgtgtcacgtgtgagtcagtaaaaagaaacatactttgtttgacaggatgattgagagtaaaccggatcatcagctgcctgctaaaccgccttctcttctttggttttttcctcttgttatctttattagaatgcaatacctgttttgtttttacttgaattgttaggatacttatatagactctatgaatgtcttgtcccccaatgcatagtatgtgtattactggtaacataaaacgcttggtgctgctcgttatacttaatctgagtctctgcttttcatttgat

SEQ ID NO: 8196 - DNA, 1726 bp, Arabidopsis thaliana
aatttaatttggttggtcacacacaaccgttttcatcggaagaagaacaagttggattgattttgctttggatctcacatctgagatcagattaatctctctgtgaagtcgaagaacgaaaccctagttcccatggatctctcttcacgcttctcatcgatccttatccttctcttgatctccatctccatagcttcggctgagattcgtaaatcagagatccgatccgatgatcgaccaatcatccctttagacgaattcggtttcactcacagcggtcgtcttgagcttgacgcttccaagatctggctttccaacagcaatcccgatctcgatctctccaaagttggcttctttctctgcactagagacgcttgggttcatgtgatccaacagcttgaagaagaagagataacttgcgctctacaatcagatctcgttaagcatgtcttcaccttcaacaatctcaagggaggagataagagcaagttctccaccgtgttcaccgagaacgatgcggatcagtactctctcgtcttcgctaattgtctccaacaggtcaaaatcagtatggatgttagatccgctatgtataaccttgaaggtaaaaagggtggtcgtgattatctctctgctggaagaactgttcttcctaaggtctatttcttattctctgttatctatttctctctcgccgccacgtggatctacgttctctataagaaacgtctcactgttttcgcaatccatttcttcatgttgggagttgttgtcttgaaagctttgaaccttctttgtgaggctgaggataagtcgtacattaagaaaactggaactgctcatggttgggatgtcttgttctacattttcaatttccttaacggtatcactcttttcactttgatcgtcttgatcggcaccggttggtctttcttgaagccctacttgcaggacaaggaaaagaaggtcttgatgattgtcattcctctccaggttgtcgctaactttgctcaggtggttatcgatgagactggaccatatggccaagattgggtcacatggaaacagatctttttgcttgttgatgtcgtctgttgctgtgctgttctgtttcccattgtatggtccatcaaaaacttgcgtgaggcggctaagactgacggcaaggctgctgtgaacctggttaagttaactctgtttaggcagtactacattgtggttatctgctacatctactttactcgtgttgttgtgtatgcactggagaccattacctcttacaagtatatgtggactagcgttgttgccagcgagttagccacacttggcttctatctgtttactggctacaagttcaggccagaggtgcataacccttactttgttgttgacgatgaggaagaagaggctgctgctgaggctctgaagcttgaagacgagtttgaattgtaagtcatcactggaataatcgtgtcacgtgtgagtcagtaaaaagaaacatactttgtttgacaggatgattgagagtaaaccggatcatcagctgcctgctaaaccgccttctcttctttggttttttcctcttgttatctttcttagaatgcaatacctgttttgtttttacttgaattgttaggatacttatatagactctatgaatggcttgtcccccaatgcatagtatgtgtattactggtaacataaaacgcttggtgctgctcgttat

SEQ ID NO: 8197 - DNA, 1720 bp, Glycine max; identical to SEQ ID NO: 8139

SEQ ID NO: 8198 - DNA, 1479 bp, Glycine max; identical to SEQ ID NO: 8141

SEQ ID NO: 8199 - DNA, 2030 bp, Glycine max; identical to SEQ ID NO: 8192

SEQ ID NO: 8200 - DNA, 1858 bp, Glycine max; identical to SEQ ID NO: 8191

SEQ ID NO: 8201 - DNA, 2559 bp, Glycine max
cttttccgataagcccggtcattgttcgaatggggaacaacaacaacaatccttcttcttcttctacttcttcttcacaaccactttgagttcaactcacccttgtgcttttcttcttctctctctgtttagtgttttagtctttacctttcgcacacaaaaacacatatacacacttgtctctctctagaaatcacgcaattatcatataccccgatttttctttcactttctttccatttatcacccaccaaactaccaacttaatgtttctttttgctaagagagaagcacaaacaaactgtgctcttgagagttgagacataagaaaagaccatttgggaaattcaacaatctcctgaaatcaggcagcaaaataagtgcctgatgttgagagaatctgcacccttccaataatcaaagggcttatttagagccacatatcatccttgaaaatttcccagccaatttggcgccaaatgttggacctttctacatgactttgcaaccacgttgaaggaagccacaattgtctcatagtttcatcctctggaagggtgagtgagagggtgctgagtctgaaacctagttcagtgttctgcttttgaaactgcaaaaagctaaacaagggcctcctgatttggaccgtgatatatcagagcatgaaaaaggcctttctatcactacccaaccaaagcagtctctgaattatcatcatcatcaatgcaaaggacttagtagacaaccccacacacttgcactcttttttctctctctctctacacaagtgtaacataacatacataacatacataacataaagagagagacaaaaaaagtgtgtgttttgtgcaaggcatgattgtgatatggaggaggaggatgagattcttcaagcacgggcgtgtaagttgccaagaagaagaggcagtgatggggagagcacgaacagcaggttccacagcagcagctggcaccaccacaactcttcgaggatcataagggtgtctcgagcatctggtggcaaagacaggcacagcaaggttatgacttcaaaagggttgagagatagaagggttaggctttctgtgaacactgccattcagttctatgaccttcaagatcgcttgggttatgaccaacctagtaaagctgtggagtggcttatcaaatctgcttctgatgccatttctgaacttccttctttgaacaatttccctgacactccccaaagtgatgatcatgagaagagggaaaacaccgctgatgttgctgttggggtagtagatggtgagaatggcaatggccagaacttgagtttggctaaatctgcttgtagtagcaattctgagactagcaaaggttctggcttgtccctctcaaggtctgatattcgtgtgaaggctagagagagggcaagggagagaacaacaaaggaaaaggagaaagagaaagagaaaaatgatgagtctcatcgtcatcatcacaatgttgttgttgttcctcatcacaaccacaatgtgaacctcgtttcacaaacagcttctttcacggagctactcactggcagtgatcccaacaaagggtgtgatgaggctaataacaacatgatgttcaacaaagcagcaggtagactgcaatggtgttcatcaacaacacctatggactactttctggggctttcctcttctagaacaacgacacacaatcacaatcaccttcatcatcatcaatattcttcttcttcttctagtgggttctcattggcacaaatccaactaggacattctcttcctgaggcaatgaatcatgtttcagcattcaacaacaatgtgagtggtgataaccacaaccactcatcatcagatcctcatctgcagcagcaacacttgtcattgataccggatcatcttatgtcagctgtggttacttcttctgctgcttcttctcatcatcatcatcatcatcagcccagcgggaacgattacaatctgaactccaccatgtcttcgggcctcgctggttacaatagggggacccttcagtccaattctccgtctctgctgcctcactcgcagaggttttcgcctatagacggatccactgtacctttcttcattggagctgcttcttctgctgctgcagttgctgctcctgccatggagaacaacaacaacaacaaccatcaccagcatcagttctcttctgtttttgatggcagccgcttgcaactttactatggccattctgaccagaaggggaaagccaagaactgacttttggattgctccattttcctcctggacttaaagcttgcttttgccaaaagggatgagatggcgttgtcatcaagtgttggtatttcttgttggaatattttaagtcattcaattacattcagtatttggataaatattatattgatctatgcttgcgagatcattgtgtgtttatggagaaatgtaaaagctacttgattcaagatattcttttactttctgcaattattttggtattattgtctatactataaatagagaaaagagctgtccatcagca

SEQ ID NO: 8202 - DNA, 1437 bp, Glycine max
atggaggaggaggatgagattcaagcacagaaggtgagaagaagaagaggcagtgatggagagagcacgaacaggttccacagcagctggcaccaccaccaccaccactcttcgaggatcataagggtgtctcgtgcatctggtggcaaagacaggcacagcaaagtgatgacttcaaaagggttgagagatagaagggttaggctttccgtgaccactgccattcagttctatgaccttcaagatcgcttgggttatgaccaacctagtaaagctgtggaatggcttatcaaatctgcttctgattccatttctgaacttccttctttgaacaatttccctgacacccccaaaagtgatgatcatgagaagagagcaaacactgatgttgctgctggggcagtagatggtgagaattatgaaaatgagaatggcaataacaataaccagagtcagaacatgtctttgtctaaatctggttgtagtagcacttctgagacaagcaaaggttctggcttgtccctctcaaggtctgatattcgtgtgaaggctagagagagggcaagggagagaacaacaaaggaaaaggagaaagagaaaaatgagtctcatcatcatcacagcaatgttgttgttcctcatcatcgtcatcatcatcatcataaccccgtttcacaaacagcttctttcactgagcttctcactggtgggattcccaaagggtgtgatgatgaggagcctaataacatgatgatgttcaacaaagaagctgcagcagcatcatctggtagacagcaatggtgttcatcatcatcagcagcagcagcagcacctatggactactttctggggccttcctcttctagaacaacaacaacaccaccacacaatcaccatcaccatcatcatcaatattcttcttctggtgggttctcattggcacaaatccaactaggacattctcttcctgaggcaatgaatcacaatgtttcagcattcaacaataatgtgagtggtgagaaccaaaaccactcatcatcagatcctcatctgcaacagcagcaacacttctcattcataccggatcatcttatgtcagctgtggttacttcttcttctcatcatcaacctagcgggagcgactacaatctgaacttcaccatgtcttcgggcctcgctggttacaatagggggacccttcagtccaattctccgtctcttttgcctcacttgcagaggttttcgcctctagacggatccactgtacctttcttcattggagctgctccttctgctgcagttgctgctcctgccatggagaacaacaccaccaccaccaacaaccatcaccaccatcagttctcatctggtttcgatggcagccgcttgcaactctactatgggcattctgaccagaaggggaaagccaaaaactga

SEQ ID NO: 8203 - DNA, 1533 bp, Glycine max; identical to SEQ ID NO: 8152

SEQ ID NO: 8204 - DNA, 1533 bp, Glycine max; identical to SEQ ID NO: 8153

SEQ ID NO: 8205 - DNA, 1437 bp, Glycine max; identical to SEQ ID NO: 8202

SEQ ID NO: 8206 - DNA, 2559 bp, Glycine max; identical to SEQ ID NO: 8201

SEQ ID NO: 8207 - DNA, 1924 bp, Glycine max
atggaggaggatgagattcaagcatgtaagttccctagagttggaaatggtaggagtagtgaccaataccaagaggaggaagaagagggtgacctaagaagaaaaggtgttggtggtggtggtggaagtgatgctagcacaaaccacttccaccaaagtagttggcactactcttctagaatcataagggtgtctcgagcatctggtggcaaagacaggcacagcaaagtgatgacctcaaaagggttaagagacagaagggttaggctctctgtgaccacagctattcagttctatgaccttcaagatcgcttgggttacgaccaacctagcaaagctgtggagtggctaatcaaagctgcttcagaagctatctctgagcttccttctctcaacaaccctttccctgatacccctaagcagcctagtgatgagaaaaggcctaccagtggtggtggtcaacaacaacaacaacaaggctttgatgatgcagatggagacacaaattaccaacaaaaccaaagccagaatctttctctctccaagtctgcttgtagcagcacttccgagacaagcaagggctcaggcttgtccctctcaaggtctgagatccgtgtgaaccgtgtgaaggcaagggagagggcaagggagagagcagcaaaagagaaggagaaggagaaagagaaagagagtgattttaacattgcacaccaccatcaccaccacaatgtgaacaacatgtctcacactgcttccttcactgagcttctcactggtgggattgggagcacggtaacagttaaccccaacacaacaacaacaacaacaacaacagcaacaagtcctaatggatcatcggttcatcagatccatgagggtcatgatcatgaggctaatctattcaacaagggaagtcaacaacagcaacagcaacaacatcaccattggtctcaaacagtgacacctatggactacttcagcgcaggcctcttggtaggaccttcatcatctgcaagtactcaacaacaccaatcttcaggacagttccaactgggacatggacatgcacatgcacatgctctttcaatctcaccatttagtggagaaaaccactcggagcaaatgcagcatttttccttcatgccagaccatctcaacaacatgccatcttctgctgcttctgcttctcaacacagcgagggtgacaataacaactacaacctcaacttcagcatctcttcgtcgggccttgctggttacaatagggggacccttcagtccaattctccgtcttcctcgtttttgcctctccttcagaggtttcaacctttagtcgacggatcctccaatctacctttctttataggagctgctcctccttcttctgctcctccaaccatggacaacaacaacagcaacaacagcaacaaccatcaccaccttcagttctcacccatctttgatggccgcttgcaactttgctatggcgatggaacaaggcagcattctgatcacaaggggaagggaaagaactaagttcccccgaggagcaccacttttgttcctggaattgtggtctttgtttttttagtagctgcaagctgtgtacccagcttggtttctgcaaaatggaggataagttgttgtcatcaagtgttggtgtttcttcttggatcattttgagtcattcaattacattgagtacgtatttggatatttattaacttatgcgtgcatagtactatattacggataaatgtataagaatgttgattgaagatattttgattttctacaattgattctgaaattgcctgtaccctttggttgggaagagctgtaggaaactaaataacttcaaatttctacagtgccccctttccgatgacacttttttataaaggaaaattttcttttcataacc

SEQ ID NO: 8208 - DNA, 1599 bp, Glycine max
atggaggaggatgagattcaagcatgtaagttcccaagagttggaaatggtaggagtagtgaccaataccaagaggaggaagaagagggtggtgacctaagacttagaaaaggtgttggtgttggtggtggtggtggaggtggaggaagtgatgctagcacaaaccacttccaccaaagtagttggcaccattcttctagaatcataagggtgtctcgagcatctggtggcaaagacaggcacagcaaagtgatgacctcaaaagggttaagagacagaagggttaggctctctgtgaccacagctattcagttctatgaccttcaagatcgcttgggttacgaccaacctagcaaagctgttgagtggttaatcaaagctgcttcagaagctatctctgagcttccttctctcaacaaccctttccctgatacccctaagcaactaagtgataagaaaaggcctactagtggtggtggtcaacaacaacaacaaatacaacaaggccactttgatgatgctgatggagacacaagttacccccaaaaccaaagccagaacctttctctctccaagtctgcttgcagcagcacttccgagacaagcaagggctcaggcttgtccctctcaaggtctgagattcgtgtgaaccgtgttaaggcaagggagagggctagggagagagctgctaaagaaaaagagaaggagaaggagaaggagaaggagaaggagaaagagagtgaatctagcattgcacatcaccaccatcatcaccatgtgaacaacaacaaccacatgtctcacacagcttccttcactgagcttctcactggtgggattgggagcactgtaacagttaaccccaacaccaccaccaccaccaccacaacaacaacaagtcctaatgggtcatcagttcatcagatccatgatggtcatgatcatgagactaatctattcaacaagggaaggcaacaacaacaacagcatcattggtctcaaacagtgacacctatggactacttcagcacaggcctcttggtaggaccttcttcatcatctgcaagaactcaacaacaccaacaccaatcttcttcagcacatttccaactgggacatgcacatgcccttccaatctctccattcagtggagaaaaccactcagagcagctgcagcatttttccttcatgccagaccacctcaacaacataccagctcatcatgtggttacatcttcttctgcttctcatcaacccaacgggggtgacaacaactacaacctcaacttcagtatctctacatcgacgggccttgctggttacaacaatagggggacccttcagtccaattctccgtcttcctcgtttttgcctcatcacctccagaggtttcaacctttagacggatcgtccaacctacctttctttataggagctgctgctccttcttctgctcctccaaccatggacaacaacaacaataataacagcaacaaccatcaccaccttcagttctcacctgtctttgatggccgcttgcaactctgctatggcgatggaacaaggcattctgaccacaaggggaagggaaagaactaa

SEQ ID NO: 8209 - DNA, 2009 bp, Glycine max; identical to SEQ ID NO: 8144

SEQ ID NO: 8210 - DNA, 1662 bp, Glycine max; identical to SEQ ID NO: 8145

SEQ ID NO: 8211 - DNA, 1479 bp, Glycine max; identical to SEQ ID NO: 8141

SEQ ID NO: 8212 - DNA, 1720 bp, Glycine max; identical to SEQ ID NO: 8139

SEQ ID NO: 8213 - DNA, 2421 bp, Glycine max; identical to SEQ ID NO: 8149

SEQ ID NO: 8214 - DNA, 2478 bp, Medicago truncatula; identical to SEQ ID NO: 8150

SEQ ID NO: 8215 - DNA, 2544 bp, Medicago truncatula; identical to SEQ ID NO: 8151

SEQ ID NO: 8216 - DNA, 1599 bp, Glycine max; identical to SEQ ID NO: 8208

SEQ ID NO: 8217 - DNA, 1924 bp, Glycine max; identical to SEQ ID NO: 8207

SEQ ID NO: 8218 - DNA, 1533 bp, Glycine max; identical to SEQ ID NO: 8153

SEQ ID NO: 8219 - DNA, 1533 bp, Glycine max; identical to SEQ ID NO: 8152

SEQ ID NO: 8220 - DNA, 1662 bp, Glycine max; identical to SEQ ID NO: 8145

SEQ ID NO: 8221 - DNA, 2009 bp, Glycine max; identical to SEQ ID NO: 8144

SEQ ID NO: 8222 - DNA, 1086 bp, Medicago truncatula
atgccattcgggttggtctcggcatggaacaagcgccgaagaagcaagtctcaagatcatacagatccatggatttacaaacctgcacaactttggcaacttgatgataaaacgccacgtcctacaaagaagttgcatggatcatctgtttacacactgagggaaatggaagaggcaacatgttcattcagtgaggaaaatctgcttggaaaaggaggatttggcaaagtctaccgaggcactttgcgatcaggagaggttgtcgcgatcaagaaaatggagcttccagcaataaaagaagcagaaggggaacgtgaatttcgagtcgaagttgacattttgagcagactaagccacccaaatcttgtttctttgataggatactgtgctgatggaaagcatagattcttagtatatgaatatatggttaatgggaacctgcaagatcatttgaatggaattggagaaagaaacatggattggcctcgaagactacaggtggcactgggagctgcaaaaggacttgcttatctccattcaagttctgatgttggaattcctattgttcatagagatttcaaatcgaccaacattctcatagatgccaactttgaagcaaagatatctgatttcgggcttgccaagttaatgccagaaggacaggagacacacgtgactgccagagtcctcggcacatttggttactttgatcccgagtatacatcgacagggaaactcactctccaaagtgatgtttatgcttttggtgtagttcttctggagcttttgaccggacgtcgagctgtagatctcaaccagggtcctaatgatcagaaccttgtactacaggtgaggcacatacttaatgaccgcaagaagctttgtaaggtgattgatccagagatggctcgaagttcttacaccattcagtctatagtcatgtttgctaatctggcatcaagatgcgtacgaactgaaagtaacgagcggccttcaatggcagattgtgtaaaagagatccaaatgattatctatacaaattcaaaaggcttgggaatggttatgcatagcttgagactgatctag

SEQ ID NO: 8223 - DNA, 1086 bp, Medicago truncatula; identical to SEQ ID NO: 8222

SEQ ID NO: 8224 - DNA, 1147 bp, Glycine max
atgccatttggtttggtctcactctcagcctggaacaagcgtcgtagaagcaaatcacaagatcatacagatccctgggtttacaaacctgcacagctttggcaacttgaagatcaaatgccacgacctacaaaaaggctacatggatcatctgtttacacactcaaggagatggaggaggcaacatgttcattcagtgatgagaatctgcttggtaaaggaggatttggcaaagtctaccggggaactttgcggtcaggagaggttgtagcaatcaagaaaatggagttgccagcaattaaagcagcagagggggaacgtgagtttcgtgttgaagttgacatcttgagcagacttgaccacccaaatcttgtttctttgataggctactgtgcggatggaaagcataggttcctagtatatgaatatatgcgtagagggaacctgcaagatcatttgaatggaattggggaaagaaacatggattggcctcgaagactccaagtggcactgggagctgcaaaaggacttgcttatctccattcaagttctgatgttggaattcctattgttcatagggatttcaaatcgaccaatattctcttagacgataactttgaagcaaagatatctgattttgggcttgcgaagttaatgccagaaggacaggagacacatgtgactgccagagtacttggtacctttggctattttgatccagagtatacatcgacagggaaactcactctacagagtgatgtttatgcttttggtgttgttcttttggagcttttgactggacgtcgagctgtagatctaaaccaaggtcccaacgatcaaaaccttgtactacaggtgaggcacatactgaatgaccgcaagaagcttcgtaaggtgatagatccagagatggctcgaaattcttacaccattcagtctatagtcatgtttgccaatctggcatcaagatgtgtccgtactgagagtaatgaaagaccttcaatggcagaatgtataaaagaactcctaatgattatctatacaaattcgaaaggcttgggaatggttatgcatagtttgagaatgatctagtgaaatcacaagtttagacattggaattatgatgatatcttgatgagaataaaaa

SEQ ID NO: 8225 - DNA, 1966 bp, Glycine max
cattatatatgtatgcattaaaatatcagcagttgattttcatataaacaaataaaattactttattatcaaatcctctctatataaattattcctaaccttaccccagattttctggccatgttaactgacaaaacgtatacactggctcttgggacccgcatgaacggtcatggattattattggtgctaaagaaaacgtattcaaatgctgatgatcatatatgctttaatagcaacagcgacggttgcaccataccagagaaagatttggaaacaaggtaacaacagatttagcaatgaagagaacaaatgaaagggccattgcaaccgccactgattttcaaattgcaaacggtaaaacgtaaacaaaatgatcaacatggtgaatggggtggctgtttccatctcactatcaaactaagcatgcccccacccctactaccacatctcaaccataggtgagcaatacctacttttatgagctttctctttgccttaaagcacatatctttgtctctctctcagtgttgttggaaggtgttatgtcaagtattctaatctcgctagcttcacttgctccacacgtaccccaatagaggattcccatgttatcaatatgctttttatatgggaataataactttctcaagcacatgccaactattccaaagtcattacttcaccctctcatcgtatcaaaagagtgttttacttcaaggttcttggcaaaatcacctgtatctctaagtgtgtaatacaattagtcatctctgtccaattgttttctgtttttagaacctagcacttcaattcttaagcagagaacatataagatagagtaatcaatcatgccatttggtttggtctcactctcggcctggaacaagcgccgtagaagcaaatctcaagatcatacagatccctgggtttacaaacctgcacagctttggcaacttgaagatcaaacaccacgacctacaaaaaggctacatggatcatctgtttacacactgaaggagatggaggaggcaacatgttcattcagtgatgagaatctgcttggaaaaggaggatttggcaaagtctatcggggcactttgcggtcaggagaggttgtagcaatcaagaaaatggagttgccagcaattaaagcagctgagggggaacgcgagtttcgagtcgaagttgacatcttgagcagacttgaccacccaaatcttgtttctttgataggctactgtgctgatggaaagcatagattcctagtatatgaatatatgcgtaaagggaacctgcaggatcatttgaatggaattggggaaagaaacatggattggcctcgaagactccaagtggcactgggagctgcaaaaggacttgcttatctccattcaagttctgatgttggaattcctattgttcatagggatttcaaatcgaccaatattctcttagacgataactttgaagcaaagatatctgattttggactcgcgaagttaatgccagaagggcaagagacacatgtgactgccagagtgcttggtacctttggctattttgatcccgagtatacatcgactgggaaactcactctacagagtgatgtttatgcttttggtgttgttcttttggagcttttgactggacgtcgagctgtagatctaaaccaaggtcccaacgatcaaaaccttgtactacaggtgaggcacatactgaatgaccgcaagaagcttcgtaaggtgatagatccagagatggctcgaaattcttataccattcagtctatagtcatgtttgccaatctggcatcaagatgcgttcgtactgagagtaatgaaagaccttcaatcgtagaatgtataaaagaactcctaatgattatctatacaaattcaaaaggcttgggaatggttatgcatagtttgagaatgatctagtgaaatcacaagtttagacattg

SEQ ID NO: 8226 - DNA, 1174 bp, Glycine max
atgccatttggtttggtctcactctcagcctggaacaagcgtcgtagaagcaaatcacaagatcatacagatccctgtattgtttttttccccattcataatggggtttacaaacctgcacagctttggcaacttgaagatcaaatgccacgacctacaaaaaggctacatggatcatctgtttacacactcaaggagatggaggaggcaacatgttcattcagtgatgagaatctgcttggtaaaggaggatttggcaaagtctaccggggaactttgcggtcaggagaggttgtagcaatcaagaaaatggagttgccagcaattaaagcagcagagggggaacgtgagtttcgtgttgaagttgacatcttgagcagacttgaccacccaaatcttgtttctttgataggctactgtgcggatggaaagcataggttcctagtatatgaatatatgcgtagagggaacctgcaagatcatttgaatggaattggggaaagaaacatggattggcctcgaagactccaagtggcactgggagctgcaaaaggacttgcttatctccattcaagttctgatgttggaattcctattgttcatagggatttcaaatcgaccaatattctcttagacgataactttgaagcaaagatatctgattttgggcttgcgaagttaatgccagaaggacaggagacacatgtgactgccagagtacttggtacctttggctattttgatccagagtatacatcgacagggaaactcactctacagagtgatgtttatgcttttggtgttgttcttttggagcttttgactggacgtcgagctgtagatctaaaccaaggtcccaacgatcaaaaccttgtactacaggtgaggcacatactgaatgaccgcaagaagcttcgtaaggtgatagatccagagatggctcgaaattcttacaccattcagtctatagtcatgtttgccaatctggcatcaagatgtgtccgtactgagagtaatgaaagaccttcaatggcagaatgtataaaagaactcctaatgattatctatacaaattcgaaaggcttgggaatggttatgcatagtttgagaatgatctagtgaaatcacaagtttagacattggaattatgatgatatcttgatgagaataaaaa

SEQ ID NO: 8227 - DNA, 1086 bp, Glycine max
atgccatttggtttggtctcagcatggaacaagcgtcgaagaagcatgtctcacgatcattcagacccttggatttataaacctgcagagttttggcaacttgaagatcaaacaccacaacctacaaaaaggaggcatagatcatctgttttcacactcaaggagatggaagaggcaacatgttcattaagtgatgataatctgcttggaaaaggaggatttggcagggtctacagggccactttgaagtcaggagaggttgtagcaataaagaaaatggagctgccagcaattaaagcagcagaaggggagcgcgaattccgcgtagaggttgacatattgagcagacttgaccacccaaatcttgtttctttgataggatactgtgctgatgggaagcatagattcttagtttatgattatatgcataatgggaacctgcaagatcatctgaatggaattggagaaagaaaaatggattggccactgagactcaaagtggcatttggagctgcaaaagggcttgcttatcttcattcaagttcttgtcttggaattcctattgttcatagagatttcaaatccaccaatgttctcttagatgccaattttgaagcaaagatatctgattttgggcttgccaaactaatgccagaaggacaggaaacacatgttactgccagagtacttggcacctttggctattttgaccccgagtatacttcgaccggaaaacttactctacaaagtgatgtttatgcttttggagttgttcttctggagcttttgacaggacgtcgagctgtagatctaaaccagggcccaaatgatcaaaaccttgtactacaggtgagacatttactgaatgatcggaagaagctccttaaggtgatagatccagagatggctcgaaattcttacaccatggaatctatattcacatttgccaatctagcatcacgatgtgtccgtagtgagagcaatgagagaccttcgatggtggattgtgtcaaagaaatccaaatgattatgtacacaaattcaaagggcttgggaatggttatgcataggttgagattggtctaa

SEQ ID NO: 8228 - DNA, 1119 bp, Glycine max
accttgaacaaaacaatacaagatagagtcaccatgccatttggtttggtctcagcttggaacaagcgtcgaagaagcaagtctcaagatcattcagacccttggatttataaacctgcagagttttggcagcttgaagatcaaacaccacaacctacaaaaaggaggcatagatcatctgttttcacactcagggagatggaacaggcaacattttcattcagtgatgataatctgcttggaaaaggaggatttggcagggtctacaggggcactttgaagtcaggagaggttgtagcaatcaagaagatggagctgcctgcaattaaagcagcagagggggagcgcgaattccgagtggaggttgacttattaagcagacttgaccacccaaatcttgtttctttgataggatactgtgctgatgggaagaataggttcctagtatacgaatatatgcataatggtaacctgcaagatcatctgaatggaattggagaaagaaagatggattggcctttaagacttaaagtggcactgggagcagcaaaaggacttgcttatcttcattcaagttcttgtcttggaattcctattgttcatagagatttcaaatccaccaatgttcttctagatgccaaatttgaagcaaagatatctgattttgggcttgccaaactaatgccagaaggacaggagacacatgttactgcaagagtacttggcacctttggctattttgaccctgagtatacatcgactggaaaacttactctacaaagtgatgtttatgcttttggagttgttcttctggagcttttgacaggacgtcgagctgtagatctgaaccagtgcccaaatgatcaaaaccttgtactacaggtgagacacttactgaatgaccaaaagaagctccgtaaggtgatagatccagagatgactcgaaattcttacaccatggagtctatattcatgtttgtcaatctggcgtcacggtgtgttcgtagtgagagtaatgagagaccttcaatggtagattgtgtcaaagaaatccaaacgattttgtacacaaattcaaagggtttggaaatggttatgcatagcttgagattggtctaa

SEQ ID NO: 8229 - DNA, 1077 bp, Medicago truncatula
atgccatttggtttggtctcagcttggaacaaacggcggcgaagcaagtctcgagatcattcagacccttggatttataaacctgcagaggtttggcaacttgaagatcaaacaccacaacctactaaaaggaggcatggatcaaatgttttcacactcaaggagatggaaagtgcaacatattcattcagtgatgataatcttatcggaaaaggaggatttggaagggtctacaagggcactttgaagtcaggagaggttgtagcaataaagaaaatggaaatgcctgcaattgagggagagcgtgaatttcgtgtagaagttgacatattaagcaggctcgaccacccaaatcttgtttctttgatagggtattgtgctgatgggaagcatagattcctagtatatgaatatatgcaaaatggaaacctgcaagatcatttgaatggaatcagggaaagaaaaatggattggcctgaaagactaagagtggcattaggagctgcaaaagggcttgcttatcttcactcaagttcttgtgttggaattcctattgttcatagagatttcaaatccaccaatgttcttttagattccaattttgaagcaaagatatcagatttcgggtttgcaaagctaatgccagaaggacaagagatacatgtaactgccggagtactcggcacatttgggtattttgaccccgagtatacatcgactgggaaactaactctacaaagtgatgtttatgcttatggtgttgttcttctggagcttttgacaggacgtcgcgctgtagatctaaaccagggtccaaatgatcaaaaccttgtactacaggttaggcacttattgaatgacggcaagatgatccgtaagatgattgatgcagagatggctcgaaattcttacaccattgaatcaatatccatgtttgccaatcttgcatcgcgatgtgtccatcctgagagtaacgagagaccttcaatgaaagattgtgtcaaagaaattcaaatgattatctatacaaatacaaaaggcttgggaatggttatgcatagcttaagaatgctctag

SEQ ID NO: 8230 - DNA, 1062 bp, Vitis vinifera
atgccttttgggttggtcacagcatggaataagcgcaggagaagcaagtctcaggatcactctgacccttggatgtataaacctgtggagtactggcagctggatgatcaaaatccatctacaaaaagacggcatgcatcatcagttttcacgctcaaggaaatggaagaggcaacatgctctttcagtgatgagaaattggtgggtaaaggaggatttggccgagtttacagaggtactctgcggtcaggagaggttgtagcaatcaagaaaatggaactgcctccatttaaagaggctgaaggagaacgcgagttcagggtagaagttgatatcttgagcagactcgaccacccaaatctggtttccttgataggctattgtgctgatggaaagcagcggtttctagtttatgaatacatgcacaatgggaacctacaagatcatttaaatggaatccaggacaccaagatggattggcctttgaggctcaaagtggccctgggagcagcaaggggacttgcttatctccattcaagttccaatgttgggattcccattgttcatagagatttcaagtccaccaacattcttttaaattccaactttgacgctaagatatctgattttgggcttgccaagttgatgccggagggccaggatagctatgtgactgccagagtacttggcacttttggctattttgatcctgaatacacatcgacagggaaactcactttacaaagtgatgtttatgcatttggagttgtactacttgagcttttgactggacgacgagcagtggacttgaaccagggacccaatgatcaaaaccttgtactacaggttaggcatatattgaatgataggaagaagttgcgtaaggtgatagatccagaaatgggtcgaagttcatacacagtggagtccatagcaatgtttgcaaacctggcttctagatgtgtccgtacagagagtagtgagagaccctcaatggcagaatgtgtaaaggaactccaactgattttctatacaaatacaaaaggcttgggcatgctctaa

SEQ ID NO: 8231 - DNA, 2268 bp, Vitis vinifera
cttttgggttggtcacagcgtggaataagcgcaggagaagcaagtctcaggatcactctgacccttgtatgtttttcttctcattctcattttcttttgatgagacgaactggggaatggttttcactgtttgaattatgaacactcattttcagggatgtataaacctgtggagtactggcagctggatgatcaaaatccatctacaaaaagacggcatgcatcaacagttttcacgctcaaggaaatggaagaggcaacatgctctttcagtgatgagaaattggtgggtaaaggaggatttggccgagtttacagaggtactctgcggtcaggagaggtatgtttatggaaatcattgtaacgtatacactccctcaaattgaatggggaaaacataagaaagaatagctaacccyttaagcaattcagtttcaatacacatactractgattggcttctctccggaatccyaaggttgtagcaatcaagaaaatggaactgcctccatttaaagaggctgaaggagaacgcgagttcagggtagaagttgatatcttgagcagactygaccacccaaatctggtttccttgataggctattgtgctgatggaaagcagcggtttctagtttatgaatacatgcacaatgggaacctacaagatcatttaaatggttacattttttttcccactcaagaacactctctcatctcaaatttctagctttgaaacttctgactgtgttactggtttctaggaatcsgggacacsaagatggattggcctttgaggctcaaagtggccctgggagcagcaaggggacttgcttatctccattcaagttccaatgttgggattcccattgttcatagagatttcaagtccaccaacattcttttaaattccaactttgacgctaaggtamttagcttgaggytgtaactcgaactttcgtttcagagatgtttatagctcagactccactggctgttttaygcagatatctgattttgggcttgccaagttgatgccggagggccaggatatctatgtgactgccagagtacttggcacttttggctattttgatcctgaatacacatcggtatgttaccaggtttcatcagactctatgtttatatattaatacaatcatctgtatgtcatgaatagagctatgcctccacaaattcaagtaaagcatcttgatggtagttaggtaagtaagatggtggcaagacgggtttggtagatrgtgacrgtagaaagtctgaatatgaatcttgaccatgcttaaagattttccttattcttctttgttaatataatattttagattttmcaacyctttaygtaccatagttgaactcagaaatgaattattcaacaagttctccaaaaagagcttctgtgttgatacaggcactattgggctgattgagaactgttaagggtttaccggtgaatactatgacacacaatatttgtcaaaagattgaaccgtgcccccaattcaatgcacttaaactcatagagctttggatgtagctcagtttggattgatccaaatccagtgtggttattgttttcaaaaagaatgtttgcccagatatttgccaacatctgmctaacatctgttcrgtttctcccatcaytttcttcttttttctactttcttgaccatacactttgcatgtccacygcattcatggttttatgatataaagtgattcagcaggtaggggcagcctttttcttctttaatttatttgaatgacagtaaggaatctaagtattggatgcatctcccttggttacagacagggaaactcactttacaaagtgatgtttatgcatttggagttgtactacttgagcttttgactggacgacgagctgtggacttgaaccagggacccaatgatcaaaaccttgtactacaggtgggaccatttctttacatcccaacacattctgcttctctactcctatggatatagatattrtagttcaaaaaaaaaaaaaraggggactcataaatggtatatgaatgcttgctaatgtttcaggttaggcatatattgaatgataggaagaagttgcgtaaggtgatagatccagaaatgggtcgaagttcatacacagtggagtccatagcaatrtttgcaaacctggcttctagatgtgtccgtacagagagtagtgagagaccctcaatggcagaatgtgtaaaggaactccaactgattttctatacgaataca

SEQ ID NO: 8232 - DNA, 1754 bp, Glycine max
acgtagaagtgaagtctgacaagcaagaagcaagttggtaaaaacgctgcaataatattctattttcaaagggaaacccaaaaactgaagcgcgaggaagctaaaagtagcaacgagggatgagagaacaagaggattggaggattacgacagcgctgttaacgttgttgttggtgtttgtttcttcttttccggcgttgagctacggagttgttcctcctcgtactctgctcaataagctgtctcagggcagttatctcaccactcaggagcaatggttcaatcaaaccctcgatcacttctctccctatgatcaccatcaattccgtcaacgttacttcgagtttctagactatttccggattcctgatggaccaattttcttggtaatcggtggtgaaggtccatgtaatgggataacaaatgactatattggtgtactggcaaagaagtttggagcagctatggttactcttgaacatcgctactatggaaagagttccccatttaattctttggagacagaaaatttgaaatatctttcatccaagcaggcactctttgatttggctgtttttcgtcagtattatcaggattccttaaatgcaaagcttaatagaacaaaaactgaaaacccctggttcgtttttggtggctcatatgctggagcactcagtgcatggttccgtctcaagtttccccatttaacatgtggaagtctggcaagttctgcagttgttcttgctgtttataacttcacagaatatgatcaacagattggtgagtcagcaggtgctgaatgtaaagcagtattacaagaaactactcaactcattgagcacaaacttgcaaccaatggaaaggaactaaaggcatcttttaatgcagatgatctcgaaaaagatggagactttatgtatttaattgctgatgctgctgctgtagcatttcaatatggtaatcctgataaagtatgcaagcctatggttgaagcaaagaatgctggagaggacttggtggatgcttatgccaaatacgtcaaagagtactacattggaacctttggtgttaatgtgcagacttatgaccaggagtacttgaagaaaactgctatcaatgaagacagttctactcgattatggtggtttcaagtttgcactgaagttgcattctttcaggtggctccatcaaatgatagtatacgctcctcagaaattgatgcaaaataccatatggacctttgcaaaaatatctttggagagggcatctttcctgatgttgatgcaactaatttatactacggaggcacaaaaattgctggttcgaaaatagtatttgcaaatggctcacaggatccttggcgtcatgcgtccaaacaaacttcatctcctgatctgccttcctacaccatcacatgtagcaattgtgcccattgtactgattttcgaggatgtcctcaatctcctttggtccttgaaggtaatgagaagaactgctcctcacctgatgcagttcacaaagtaaggcaacagattacagaacatatggacttgtggctatctgagtgccaagaaggcagcagttatatatgatcactagtatgttaacccacgcactgaaatgaataaagtaataaattagtatacactaatttcatccttcatgatcattatatatttaaaaatagatatggaaacatgtgccactttatttatttggggattgttgatggcgagggtggttcgtaaattata

SEQ ID NO: 8233 - DNA, 1684 bp, Glycine max
tttttttttttttttctttaaataaagtggcacatgtttccatatctatttttaaatatataatgatcatgaaggatgaaattagtgtatactaatttattactttattcatttcagtgcgtgggttaacatactagtgatcatatataactgctgccttcttggcactcagatagccacaagtccatatgttctgtaatctgttgccttactttgtgaactgcatcaggtgaggagcagttcttctcattaccttcaaggaccaaaggagattgaggacatcctcgaaaatcagtacaatgggcacaattgctacatgtgatggtgtaggaaggcagatcaggagatgaagtttgtttggacgcatgacgccaaggatcctgtgagccatttgcaaatactattttcgaaccagcaatttttgtgcctccgtagtataaattagttgcatcaacatcaggaaagatgccctctccaaagatatttttgcaaaggtccatatggtattttgcatcaatttctgaggagcgtatactatcatttgatggagccacctgaaagaatgcaacttcagtgcaaacttgaaaccaccataatcgagtagaactgtcttcattgatagcagttttcttcaagtactcctggtcataagtctgcacgttaacaccaaaggttccaatgtagtactctttgacgtatttggcataagcatccaccaagtcctctccagcattctttgcttcaaccataggcttgcatactttatcaggattaccatattgaaatgctacagcagcagcatcagcaattaaatacataaagtctccatctttttcgagatcatctgcattaaaagatgcctttagttcctttccattggttgcaagtttgtgctcaatgagttgagtagtttcttgtaatactgctttacattcagcacctgctgactcaccaatctgttgatcatattctgtgaagttataaacagcaagaacaactgcagaacttgccagacttccacatgttaaatggggaaacttgagacggaaccatgcactgagtgctccagcatatgagccaccaaaaacgaaccaggggttttcaatttttgttctattaagctttgcatttaaggaatcctgataatactgacgaaaaacagccaaatcaaagagtgcctgcttagatgaaagatatttcaaattttctgtctccaaagaattaaatggggaactctttccatagtagcgatgttcaagagtaaccatagctgctccaaacttctttgccagtacaccaatatagtcatttgttatcccattacatggaccttcaccaccgattaccaagaaaattggtccatcaggaatccggaaatagtctagaaactcgaagtaacgttgacggaattgatggtgatcatagggagagaagtgatcgagggtttgattgaaccattgctcctgagtggtgagataactgccctgagacagcttattgagcagagtacgaggaggaacaactccgtagctcaacgccggaaaagaagaaacaaacaccaacaacaacgttaacagcgctgtcgtaatcctccaatcctcctgttctctcatccctcgttgctacttttagcttcctcgcgcttcagtttttgggtttccctttgaaaatagaatattattcc

SEQ ID NO: 8234 - DNA, 1713 bp, Glycine max
aacattccattttcataggaaaagccaaaactgaagctcgaggaagataactacgatgaaacaagaggaatggatgattacgacagcgttgctatcgttgctgtttgtttcatcttttccgccgttgagttacggagttgttcctcctcgtactctgctcaataagctgtcggagggcaaatatctcaacactcaggagctctggttcgaccaaaccctcgatcacttctctccctatgatcaccgacaattccggcaacgttactatgagtttctagactatttccggattcccgatggaccaatttttttggtaataggtggtgaaggtatattgaatggggtagcaaatgactatcttgctgtactggcaaagaagtttggagcagctatggttactcttgaacatcgctactacggaaagagtactccatttaattctttggagacagaaaatttgaaatatctttcgtccaagcaggcactctctgatttggctgtttttcggcagtattatcaggactccataaatgcaaagcttaatagaacaaaaattgaaaacccctggttcatttttggtggttcatattctggagcactcagtgcatggttccgtcttaagtttccccatttaacatgtggaagtctggctagttctgcagttgttcttgctgtttataactacacagaatttgatcagcagattggtgagtcggcaggtcctgaatgtaaagaagcgctgcaagaaactactcaactcattgaacacaaacttgcaaccagtggaaaggaattgaaggcctcttttgatgctgctgatcttgaaatagatggagactttttttatttcttggctgatgctactgctatagcgtttcaatatggaaatccagataaagtatgcaagcctcttgttgaagcaaagaaggctggagaggacttggtggatgcttatgccaaatatgtcaaagagtactacattggaacttttggtactgatgtgcagacatatgatcagaagtacttgaaaagaactgctatgaacgaggacaattctgctcgattatggtggtttcaagtttgcactgaagttgcatactttcaggtggctccctcaaatgacagtattcgctcctcaaaagtggacataaaataccatttggacctttgcaaaaatgtctttggagagggcatctttcctgatgttgatgcaactaatttatactacggaggcactaaaattgctggttcaaaaataatatttacaaatggctcacaagatccttggcgccatgcatccaagcaaacttcatctcctgatatgccttcctacatcgtcaaatgttacaattgtggccactgttctgattatcgaggatgtcctcaattccctttctccattgaaggtaatgagaaaaactgcacctctcctgatgcagttcacaaagtaaggcaaaagatttcagaacatatggacttgtggttatctgaatgcgtcgacacaggcagaagttttatatgattatttacataagatgtgaatgatgtacttttttttctaagttgttaatgatgtactataactccgcatgacttttggtatttctttccttcataagctaattatgacaccgtgaaatatatttagtgacttcgtataaattgaccaaatatagagtagaacctataagactacgggtagggttagaacta

SEQ ID NO: 8235 - DNA, 1674 bp, Glycine max
ggaacattccattttcataggaaaagccaaaactgaagctcgaggaagataactacgatgaaacaagaggaatggatgattacgacagcgttgctatcgttgctgtttgtttcatcttttccgccgttgagttacggagttgttcctcctcgtactctgctcaataagctgtcggagggcaaatatctcaacactcaggagctctggttcgaccaaaccctcgatcacttctctccctatgatcaccgacaattccggcaacgttactatgagtttctagactatttccggattcccgatggaccaatttttttggtaataggtggtgaaggtatattgaatggggtagcaaatgactatcttgctgtactggcaaagaagtttggagcagctatggttactcttgaacatcgctactacggaaagagtactccatttaattctttggagacagaaaatttgaaatatctttcgtccaagcaggcactctctgatttggctgtttttcggcagtattatcaggactccataaatgcaaagcttaatagagcaaaaattgaaaacccctggttcatttttggtggttcatattctggagcactcagtgcatggttccgtcttaagtttccccatttaacatgtggaagtctggctagttctgcagttgttcttgctgtttataactacacagaatttgatcagcagattggtgagtcggcaggtcctgaatgtaaagaagcgctgcaagaaactactcaactcattgaacacaaacttgcaaccagtggaaaggaattgaaggcctcttttgatgctgctgatcttgaaatagatggagactttttttatttcttggctgatgctactgctatagcgtttcaatatggaaatccagataaagtatgcaagcctcttgttgaagcaaagaaggctggagaggacttggtggatgcttatgccaaatatgtcaaagagtactacattggaacttttggtactgatgtgcagacatatgatcagaagtacttgaaaagaactgctatgaacgaggacaattctgctcgattatggtggtttcaagtttgcactgaagttgcatactttcaggtggctccctcaaatgacagtattcgctcctcaaaagtggacataaaataccattttgacctttgcaaaaatgtctttggagagggcatctttcctgatgttgatgcaactaatttatactacggaggcactaaaattgctggttcaaaaataatatttacaaatggctcacaagatccttggcgccatgcatccaagcaaacttcatctcctgatatgccttcctacatcgtcaaatgttacaattgtggccactgttctgattatcgaggatgtcctcaattccctttctccattgaaggtaatgagaaaaactgcacctctcctgatgcagttcacaaagtaaggcaaaagatttcagaacatatggacttgtggttatctgaatgcgtcgacacaggcagaagttttatatgattatttacataagatgtgaatgatgtacttttttttctaagttgttaatgatgtactataactccgcatgacttttggtatttctttccttcataagctaattatgacaccgtgaaatatatttagtgacttcggaaaaaaaaaaaaaaa

SEQ ID NO: 8236 - DNA, 1368 bp, Medicago truncatula
atgaaaccagcttgttcattgggaagattcctcagcactgatgtcatatggttcaatcaaactctcgatcacttttctccatatgatcaccgtcaattccggcaacgttactatgaattcctagactatttccgggctccggatggaccaattttcttggtgataggtggtgaagcaacatgcaatgggatagtaaatgactatattggtgtactggcaaagaagttcggagcagctgtggtttctcttgaacatcgctattatggagaaagtaccccatttgatactttctcgacggaaaatttgaaatatctttcatccaagcaggcactctttgatttggctgtttttcgccagtattatcaggattctttaaatgcaaagctgaatagatcaggagttgaaaatccatggttctttttcggtggctcatattctggagcactcagtgcatggttccgtcttaagtttccccatttaacatgcggaagtcttgccagttctgccgttgttcttgctgttcaagacttcgccgaattcgatcaacagattggtgagtcagctggtcctgagtgtaaagcagtattacaagaaactactcaactcgttgaaacaaagcttgcagacgatggaaaggcactgagatcaatttttaatgcagatgatcttgaaattgatggagacttcttgtactatctggctgatgctgctgttatagcgtttcagtatggaaatccagataagttatgcaagcctttggttgatgcaaagaacgctggcgaggatttggtggatgcatatgccaaatatgtcaaagagtactacgttggaacctttggtatcactccaaaaagttatgaccaggaatatttgaaaaaaactgcaatcaatgaagacagttctactcggttatggtggtttcaagtttgcactgaagttgcgtactttcaggtggctccctcaaatgatagcatacgttcctcaaaaattgacacaaaataccatttggacctttgcaaaaatatctttggagatggtgtctttcctgatgttgatgccactaatttatactatggaggcacaaaagttgctggttcaaaaataatatttacaaatggctcacaggatccatggcgtcatgcttcgaaacaaacttcatcccctgatttgccttcctaccttatcaagtgtaataattgtggccattgtactgatttgcgagggtgtcctcaatctcctttggtcattgaaggcaatgagaagaattgcagttcccctgatgcagttcacaaagtaaggcaaaaggttcaagaagatatggacttgtggctatctgagtgcatcgattcaggaagaagttctatgtga

SEQ ID NO: 8237 - DNA, 1650 bp, Populus trichocarpa
gaccggtcttgatgaacattaacgataacaaaccaagccttaaatattctccatgtttcaaagaaacaacaccaacaacaggaagcaatgacgacgatgaagctagtgtttatttctttgctgctcttgtcaacagcaccttatgcctctctcgctcttagaacgcaggttcacagcttgtctgaaagcagcaacagcaagaattacttgaccactcaagaactctggttcaatcagacccttgatcacttttctccattcgaccatcataagtttccgcaaagatactacgagtttcttgactacttcaggatttctgatggtcccatatttttggaaatttgtggggagtcttcttgtaacgggatagtcaatgactacatcagtgttttggcaaagaagtttggagcagctgtggtttcacttgagcatcgttactatgggagaagtttgccttttaaatcaacaacaacagagaatttgagatttctttcgtctaaacaggcgctattcgacttggctgttttccgtcagtattatcaggaatcattaaacctgaagctcaatagaacaagtgttgaaaatccttggtttgtttttggtggttcatatgctggagcactcagtgcatggtttcgtcttaagtttccacatttaacatgcgggagtcttgcaagttctgcagttgttcttgctattcacaacttcaccgaatttgatcagcagattggtgagtcagctggtgctgaatgtaaagctacactgcaagaaactactcaacttgtcgaagaaaggcttgcgtcaaataaacaagcagtgaaggcattgtttgatgcagctgagctggagattgatggtgacttcctgtattttctggcagatgcagctgttatagcatttcaatacgggaatccggatatagtatgctccactcttgttaaagcaaagaacaatggagatgatttggtggaggcatatgcaaaatatgttaaagagtattatcttggaacttttggctccagcgttcagacatataatcagaagtatttgaaagacacttctcttaataaacatactggtgatcgattgtggtggttccaagtttgcactgaagtagcatattttcaagtggcaccctcaaatgatagtattcgctcttcaaaagtcgacgcaagataccatttggacctttgcaagaacgtctttggagagggtatctatcctgaagttgatgtaacgaatatatattatggaggcaccaatatttcaggttcaaaaattgtttttgcaaatgggtctcaagatccctggcgccatgcgtcgaaacagacctcgtccccggatatgccttcctttttaatctcttgtcacaactgtggtcattgtactgatataagaggttgtccacagactcctttgagccttgaaggtaatgctcggaactgcagctcccctgaagcagttgaaaaggttaggcatcagatcatagaaaagatggacttgtggctctctgagtgtcgtgctggtagttggagctccatgtgatgctatttacagcacaaacacttgttttacttttatttttccaagttttttttttccatatcattgcgatcgcaagtaaacgttgtaagaaaaaaaaaaaaaaaa

SEQ ID NO: 8238 - DNA, 1437 bp, Medicago truncatula
atgatgtcgccgtgtttgttggtgtttctgttcttcatctctacagtgtcggcaacacctcatttgcttcgacgtcgtttgtctgaatctgcaagatatctgactaaggaagaattgtggttcccccaaaccctcgatcactactctccctatgatcaccgcaaattccaacagcgttactatgagttccttgaccattttcggattccagatggaccggtgtttttggtgatctgtggtgaatattcatgcgatgggataagaaatgactatattggtgttctggcaaagaagtttggagcagctgtggtttctcttgagcatcgctattatgggaagagttcgccatttaaatctctggcgacaaaaaatttgagatatctttcatctaagcaggcgctctttgatttggctgtttttcgccagaattaccaggactctttaaatgcaaagcttaatagaacaaatgccgacaatccctggttcgtatttggtgtttcatatcctggagctctcagtgcatggttccgtcttaagtttccgcatttaacatgtggaagtcttgcaagttctgcagttgttcttgctgtttacaacttcacagaatttgatcagcagattggtgagtcagcaggtgttgaatgtaaggcagcattacaagaaaccactcgacttatcgaacgaaaacttgtaactaatggaaaggcattgaaggcttcttttaatgcagctgatcttgaaattgatggtgacttcttgtatttcttggctgatgctgctgttacagcgtttcaatacgggaatcctgatatattatgcaagcctcttgttaaagcgaagaaggacggcgaggatttggtggatgcttatgccaaatttatcaaagagttttaccttggaactgaaggtgaaagtacacaagattataaccaaaacaacttgaagaacgccgctatcactgaaaacagttctggtagactgtggtggtttcaagtttgtactgaggttgcatactttcaggtggctccctcaaatgacagtatacgctcctcaaaagtcgacacaagataccatttggacctttgcaaaaatgtctttggagagggcatatttcctgatgttgatgcaactaatatatattatggaggcacaaaaattgctggttccaaaatagtattcacaaatggctcacaggatccttggcgtcgtgcatcaaaacaaatttcatcacctaatatgccttcctacactatcacttgtcataattgtggccatggaactgacatgcgaggatgccctcaaagtccctttaacattgaaggcaatgagaagaactgcacatcccctgatgctgttcacaaagttagacaaaagatcatagagcatatggatttatggttgtctcagtgtcaggacacgggcaggacttgtatataa

SEQ ID NO: 8239 - DNA, 1602 bp, Medicago truncatula
cgatcatctctctctcaggaaccgcatcaacagtgaccgatgagttcctcagaagaagcatcatctatggaaacaacaacaattgacaaagatcttcatgttacatttgcacagatgatgtatcacttacttccaaatccatatgaatctcaagaaatcaatcacctcactcttgcttactttgttatctcttcccttgacatcctcaactccctccacttggttgagaaagaagctgttgctaattgggttttgtcttttcaagttcaacgtggaacaacaaatgaccctaacaatggacaattctatggatttcatggttccaagacttctcagtttcctccagatgagaatggggtttttcaccataacaacagtcacttggcaagtacttattgtgcccttgccatattgaaaattgttggttacgatttgtcaagtcttgattctgaatcgatgtcgtcttcaatgaagaatcttcaacagcctgatggaagtttcatgcctattcatattgggggagaaacagatcttaggtttgtatattgtgcagctgccatttgtttcatgctggataactggaatggaatggacaaggaaaaagtcaaggattacatattaaattgccagtcttatgatggtgggtttggattagttcctggtgcagaatctcatggtggtgcaacttattgcgctattgcatctctccggctaatgggatacgttgaagacaatgttctctcaagttgtaatttgtcttctttgatagatttgccgttgttgttggactggatcttgcagagacaagggactgatggtggatttcaaggtagacctaataaatctactgatacatgttatgcattttggattggaggcgttttaagaattctcgggggctgcaattttgttgacaataaagctctacgtggatttttgctttcctgtcaatacaagtatggtggtttcagcaaattccctggagactttccagatctataccattcctactatggatttgcagctttcagcctgttggaagaatctggcttgaagtcactttgttctgaacttggaattactaatatggctgcaaatggaattgtgatagaacttgcaattttgaagaggaatacttcgtattattcactaaaaaagtatttcaaaggctctccaatgcaagaaaagaaaaaccagagaaaaactcttcgactttatcaaccattgattcaccaaatgtcctccctccacaatttagtgggaaaaggtattatttcttcgagttcctcggtttcattaagctccacttccaagtattttggtggtttcgcttcatttcaggcagcttcagtttataggaaacaacgcattgacccatcttctggttacaagagcgtcgccggtgtgaacgaggtggtgaaaagagtaagaggagagagtttgcatttttcaccaactcgttcacgccggcgacgtttgggtactttcgattccatcgtggtgggtatgatggaaccaagggtacttaaattagagaagaagaaaacaatgaatgaatttgggttttggtttgatggaaagaagaagaaggtgagggaatga

SEQ ID NO: 8240 - DNA, 1602 bp, Medicago truncatula; identical to SEQ ID NO: 8239

SEQ ID NO: 8241 - DNA, 1368 bp, Medicago truncatula; identical to SEQ ID NO: 8236

SEQ ID NO: 8242 - DNA, 1754 bp, Glycine max; identical to SEQ ID NO: 8232

SEQ ID NO: 8243 - DNA, 762 bp, Glycine max
gaattccgcaattaatcaatatggcttcatgttttccaaatgcatctccatttttggtcatgctcgcaatgtgcctcttaatttccacctctgaagctgaaaaatatgtggttggaggcagtgaaaaatcctggaagtttcctctctcaaaaccagattcactcagccattgggccaactctcaccgatttaaaatcggcgacactctcatatttaaatacgaaaagagaacagagtcagtgcacgaaggtaatgagacggattatgaagggtgcaacacggtggggaaataccacattgtgttcaacggtggcaacaccaaggtgatgcttaccaaacctggattcagacacttcattagtggaaatcagagtcattgccagatggggttaaagctggctgtgcttgtcatatcgtcgaacaaaaccaaaaagaatcttctttccccatctccttcgccttcaccgccaccatcatcgttgctatcaccatcaccttcgccacttccaaataatcaaggtgttactagtagttcaggtgcgggattcatcggggttatgatgtggttgatgttattgctttaaattgagagtattgtgtattcgcaattttgcatgttaatgcctccgtcactaatcactatatatgcaatatatatatttgtggttgtggggttagttattcaggtcaagcatgcattttcgctttcatttttgtaattttttttaaaagtttggacgttttcttttgattgcgcaaaaa

SEQ ID NO: 8244 - DNA, 807 bp, Glycine max
ctctcccatattcaattaatcaatatggcttcatgtttaccaaatgcatctccatttttggtcatgctcgcaatgtgcctcttaatttccacctctgaagctgaaaaatatgtggttggaggcagtgaaaaatcctggaagtttcctctctcaaaaccagattcactcagccattgggccaactctcaccgatttaaaatcggcgacactctcatatttaaatacgaaaagagaacagagtcagtgcacgaaggtaatgagacggattatgaagggtgcaacacggtggggaaataccacattgtgttcaacggtggcaacaccaaggtgatgcttaccaaacctggattcagacacttcattagtggaaatcagagtcattgccagatggggttaaagctggctgtgcttgtcatatcgtcgaacaaaaccaaaaagaatcttctttccccatctccttcgccttcaccgccaccatcatcgttgctatcaccatcaccttcgccacttccaaataatcaaggtgttactagtagttcaggtgcgggattcatcggggttatgatgtggttgatgttattgctttaaattgagagtattgtgtattcgcaattttgcatgttaatcctccgtcactaatcactatatatgcaatatatatatttgtggttgtggggttagttattcaggtcaagcatgcattttcgctttcatttttgtaattttttttaaaagtttggacgttttcttttgattgcgcaattgtgcccttaaactcaatgcccgtcttggtaattttgagattga

SEQ ID NO: 8245 - DNA, 730 bp, Glycine max
ggactactatactgctttgcattgcatatctctctcacacttctctcccatattcaattaatcaatatggcttcatgttttccaaatgcatctccatttttggtcatgctcgcaatgtgcctcttaatttccacctctgaagctgaaaaatatgtggttggaggcagtgaaaaatcctggaagtttcctctctcaaaaccagattcactcagccattgggccaactctcaccgatttaaaatcggcgacactctcatatttaaatacgaaaagagaacagagtcagtgcacgaagtgaatgagacggattatgaagggtgcaacacggtggggaaataccacattgtgttcaacggtggcaacaccaaggtgatgcttaccaaacctggattcagacacttcattagtggaaatcagagtcattgccagatggggttaaagctggctgtgcttgtcatatcgtcgaacaaaaccaaaaagaatcttctttccccatctccttcgccttcaccgccaccatcatcgttgctatcaccatcaccttcgccacttccaaataatcaaggtgttactagtagttcaggtgcgggattcatcggggttatgatgtgggttgatgttattgctttaaattgagagtattgtgtattcgcaattttgcatgttaatgcctccgtcactaatcactatatatgcaatatatatatttgtggttgtggggttagttatt

SEQ ID NO: 8246 - DNA, 863 bp, Glycine max
cttcgcattgcataatattcaatcaaacatggcttcctgtttaccaaataacgcatctccatttttgtttatgctctcaatgtggctcttaatttccatctctgaagctgcaaagtatgtggttggaggcagtgaaacctggaagtttcctctctcaaaaccagattcactcagccactgggccagctctcaccgattcaaaatcggcgacactctcatatttaaatacgatgagagaacagagtcagtgcacgaagtgaatgagacggattatgaacaatgcaacacggtggggaaagaacacgttctgttcaacgatggcaacaccaaggtgatgcttaccaaatctggattcagacacttcattagtggaaatcagagtcattgccaaatggggttaaagctaatggtagttgtcatgtcaaacaacaccaaaaagaaactaattcattcaccatcaccatcaccttcaccatcaccatcaccatcaccttcaccttcaccctcaccttcaccttcattatcatcgccatcaccttcaccacttccaaataatcaaggtgttactcgtagttcaggcgctgaattcattggagttatgatgtggttgggggtgatgatgttattgctttaaattagagagtattgtgtatttacatgttaatttctccataactaatcactatatatgcaatatatatttgtgtggttagttaattaggtcaagcatgcattttcgctttcatttttgtatttttttaagtctggaagattttctattgattgtgcaattgtgcccttaaactccaatgcctactcgttgtaattttgaaattgaataagccatttggatttttaaatgc

SEQ ID NO: 8247 - DNA, 1232 bp, Glycine max
ggaaatagcactcactcacttgcagcgaagaagaaaaaaaataaaaacaccatcagcatcttcactcaccacgaaggttccgttctctgtggatctatatctctagggcacgttacgtggaaggaagctcttcaccgacttcaatcgaagaagatggattacagtgctggttcgagtctgtttccgttgcaccgttgcaaaaccattcacctggtgaggcacgcgcaggggattcacaatgtggagggtgacaaaaactacaaagcctacatgaaccccgattacttcgatgctcatctcactcccttgggatggcaacaggttgacaatttgcgtaagcatgttcgcgactctggccttatcaacaccattgatctagtcattgcatctcctttgatgaggactctacaaacaactgttggggtatttggaggtgagggctacacagataaaacagacgtccttcctcttatggttgcaaatgcaggaaatagctaccgtgctgcaatttcaagtctaaattccccaccaattgttactgttgaactttgtcgtgaacatttgggagttcatccctgtgacagaagaagaagtgttagcgagtatcaatttctttttcccgctgttgatttttcactgttagatagtgatgaggatacctggtggaaggccaatgttagagagacaaaggaagaacttgcagctagggggatgaagttccttaactggttgtggacacgaaaagagaaggagatagcaattgtgacacatagtggattcttgtttcatactctgaatgcctttggaagtgattgccaccccttggtaaagaaagaaatatccaagcactttgctaattgtgaacttcgctccatggtcattgtggatagaggtatgataggattggaacaatcaaccactaactatccaggcaagataccttcagggctggacctccctagtgatgttgcagatgagaagtctgagaaataatggatttggcttcttctacttgtttgtatgtgttcaggaccattcaagcattggttcttctatttgaagttcactattacaaaatctaacatgattatgtcagattatacaaactgtgctgattctgtcttgaaatttatcaattattgtctgcagaaaatatttgttaacaattataaccttgttggaaatcagatgacccatgtgtggcaacacagtcacaaaacacttctgtttgt

SEQ ID NO: 8248 - DNA, 975 bp, Glycine max
atggattgcgttgctggttcgagtttgtttccgttgcatcgttgcaaaaccattcacctggtgaggcacgcgcaggggatccacaatgtggagggtgacaagaactacaatgcctacatcaaccccgattatttcgatgctcatctcactcccttgggatggcaacaggttgacaatttgcgtaagcatgttcgtgactctggccttatcaacaccattgatctcgtcattgcatctcctatgatgaggactctacaaacagctgttggggtatttggaggtgagggttacactgataaaacagacgtgcttcctcttatggtggcaaatgcaggaaatagctaccgtgctgcaatttcaagtctaaattccccaccagttgttgctgttgaactttgtcgtgaacatttgggagttcatccctgtgacagaagaagaagtgttagcgagtatcaatttctttttcctgctgttgatttctcactgttagatagtgatgaggatacctggtggaaggccaatattagagagacaaaggaagaactggcagctagagggctgaagttcctgaactggtatgagttgttgtggacacaaaaagagaaggagatagcaattgtgacacatagtggattcttgtttcatactctaaatgcctttggaagtgattgccatcccttggtaaagaaagaaatatccaagcactttgctaattgtgaacttcgctccatggtcattgtggatagaagtatgataggatccgaactgtcaaccactaactatccaggcaagataccttcagggctggacctccctagtgatgttgcagatgagaaagaagcatgtagcaggaaaaaggaatttgtgcctgtgacagctaagaacactccccttagtcttattgcggttgatccaaagggaataactcttctggtgaaaacggagtccaatgctagttcagctataaattgctga

SEQ ID NO: 8249 - DNA, 876 bp, Medicago truncatula
atggattgcggtgccggcacgtgtttgtttccgttacatcgttgcaaaacgattcaccttgtgagacacgctcaagggatccacaatgtggaaggagacaaaaactacaaagcgtatttgaatcctgattattttgatgcccatcttactcctcttggatgggaacaggttgataatttgcgtaaacatgttcattcctccggattaattaacaagatcgatctcgtcatcgcttctcctttgatgaggaccttgcaaacagctgttggggtatttggtggggagggatacactgatgataaaacggatgtgctgcctcttatggtggcaaatgctggaaatagcttccatggtgcaatttcaagtcataattgcccaccaattgttgctggcgaactttgccgtgaacatttgggagttcatccctgtgacaaaagaagaagtgttagcgagtaccagttcctttttcctgctgttgatttttcactgatagacagtgatgaggatgtttggtggaaggataatgtaagagagacaaaggaggaactggcagctaggggggtggagttcttgaactggttgtggacacgaaaagagaaggagatagcgattgtgacacatagtggattcttgtttcacactctaactacatttggaaatgattgccaccccttggtgaagaaagaaatatccaagcactttgccaattgtgagcttcgctccatggtccttgtggatagaaatatgataggatcagaagcatcaacaactaactatccgggcaagataccttcagggctggacaagcctagtgatgctgtggatgagaatgtcgagaaacagggggtttagttttgctacatgcatgtgtctagt

SEQ ID NO: 8250 - DNA, 1300 bp, Vitis vinifera
aacctcacttctcctacctgctgtagcataagcctcttctcttccgcttcctccaaatccccgtcgccaccacgagctcgcgtctccgctctctgccgttcctctctctccgttgcagatatggacagtggtgcaggtccaagtctgtttccattgcatcgttgcaaaactcttcacctggtgaggcatgcacaagggatccacaatgtagatggagataagaattacaaagcctacttgtctcctgcattttttgatgcacaacttactcacctaggttggcagcaggttgataatctgcgtaaacatgttcatgcatgtgggcttgctaagaggattgaattagttattacatctcctttgttgaggaccatgcagacagctgttggagtatttggtggtgagggctacaaagataggatggatgtgctgccactgatggtggcaaatgcaggggaatgtaaccgatctgcaatttcaagtttggactcccccccattccttgcagtagaactttgtcgcgaacatttgggagttcatccttgtgataagaggagaagcatcagcgactatcagtttcttttccctgccattgatttttcactgatagaaagtgacgaggacatattgtggaaggccaatgttagagaaaccaatgaagaagttgcggctaggggattgaagttcatgaattggttgtggacacggaaagaaaaggaaatagcaattgtcacccatagtggattcttgtttcatacactaaatgcatttggaaatgactgtcaccctctggtgaaaaccgaaatatgcaagcactttgcaaattgtgaactccgatcgatgatcattgtggacagaagtatggcagggtcagattcatcaacaactaattatcccggaaaaattcctcctgggcttgacctccctagtgatattgctgatggaaagcttgaaaacgaagcacgtaattctggattgacatagaaaaagtgcgcctagttcattagccaaactggaatgtggaggtgaatttctataatttgtcaatatcattgttggaagcactgtcttgttgaggctctatttcatactacatatgctgttgtgccttttaatgaggccattttaagacctagttacatgaaaattgtggccctgccaatagtgaaatgcctttgatcatgagattgaacatttaattaaagactgggaaatagttttgggaacatttggaacgttggaatgggaaaaacatatggagcacttactagatgcaagaatatgaattaaaaattcatta

SEQ ID NO: 8251 - DNA, 1106 bp, Arabidopsis thaliana
aatctaatcactttctgcttcttcgcctacttcattcacatcttctttcctcttcctcctttgggttacttcttcgaatctcctgttgtttgcagaaatggagactggtgctggtataggtttgtaccctttgcatcgctgcaaaaccatttacctagtgagacatgctcaggggattcacaatgtggatggggagaagaattataaggcttacatgtctcatgactactttgatgctgagttgacccagcttggctggaaacaggtagatagtttgcgtaagcatgttcattccagtggacttcacaagaagatcgaactggtcatttcgtctccactgatgagaaccttgcaaactgctgttggtgtttttggtggagagggctacacggatatgagtgatgtactacctctaatggtagcaaatgcaggaaatagcagccgtgcagctatatcgagtttaaactgcccaccagttattacagaggagtcctgcagagagcatttgggagtgcatccatgtgatcagaggagaagtatcagcgactatcagtttcttttccctgcagttgacttttcactgatagaaagcgaggaagacaagttatggaaggctgatgttagagaaacgattgaagaacttgcagctagaggaaaaaagttcctgaactggctatggacacggaaagaaaaagagatagctattgtgacacacagtggtttcttgtttcacacattgaatgcactacaaaacgagtgtcatccagatgttaagaaggaaatttgcggccactttgctaattgtgagctacgttcaatggtcatcgtcgatagaagtatgttgggatcggacagttcggtgactgattatccaggaaagattccaaaggggattgatcttccaagtgatgctgttgtagatgataacaacatcaaagttgagtgattctttatgatggacactgcattgtcttcaacttttctatttatctatacacaaacaccttctttgctgtatgcaactctcttattagtattactattgactatcgagttaaagatcttactattgacttactgagttaaagatacgttgctagttgctg

SEQ ID NO: 8252 - DNA, 1193 bp, Populus trichocarpa
gagtgaccgtcactgcgactgtcaaacgctcctcccctctctgctgaaccggtgagcgcttggactgtttttacttggttaagttgcagattatggatagtggtccagatccaagtttgtatccattgcaccgctgcaaaacaattcatgtggtgaggcatgcacaaggattgcataatgtcgagggagaaaagaactacaaagcatacttgaatcctgaatatttagatgctcccctcactcaactaggctggcagcaggttaattatttgcggaagcatgtccatgcatctgggctctccaagagggttgaattagttgttacatccccattgctcaggacattgcaaacagctgttggagtttttggtggggagggctacacggatgggatgaatgcacttccactaatggtggcaaatgttggaaacagtggtcgagaagcaatttcaagtcgtaattcgccaccattcattgccgtagaagattgtcgagaacattttggtgtacatccttgtgacaagagacacaatgtcagcgagtatcaatttctttttcctgcagttgacttttcactgatagaaactgatgaggatgtactgtggaaggccgatgtgagagagacaactgaagaactggctgcaaggggactgaagtttttaaactggctgtggacaaggaaagagaaggagatagccattgttacccatagcgggtttttggttcatacattgcgtgcatttggaactgactgtcatccattggtgaagaaagaaatggacacacgctttgctaattgtgagcttcgatctatggtcattgttgacagaagtatgattggatcagatgtttcaacgactaactatcctggaaagattccttccgggctggatttccctagtgatgttggggaggaggaagcacccaattcaatttaggtgatgaacagattgaaattgatttgagcattctaaattagatgtttggctttcttggaaaactgtggctattgatttgttcacccctgttacctgtaactgggatgcattcccagtcgggagtcatgttatttgaaacatgtaggaaatagacaagactaaggtgcattccggcctggcggggtacagtgaaatcgaaacctgtcaaagcgtttaccaaaagcttttgcagttaaatcaaaaaaaaaaaaaaaa

SEQ ID NO: 8253 - DNA, 1581 bp, Glycine max
atgatcgttaagaagggcttcctcaccaccgtggcgcaaaaatgcaacaccctaacccaactcaagcagctccacgcccacatcctccgatgccgcatcaacgacacgccttacgccctcgccccgcttctctccgtcctagccacctccaacgacgcgtcgttcttctcctacgctcgctccatcttccgccacctcactaaccgcaacaccttcatgcacaacaccatgatccgcggctacctccaatgccggtcacccctccacgccgtgtcctgctacttgtccatgctccaaaacggcgttgccgttaacaactacacgttcccacctttaatcaaagcctgcattgcgcttcttccttcttctccttcgaacattgttggtcgtttggtgcacggtcatgtcgttaagttcggtctccgcaacgacccttacgtggtgagcgcgtttattgagttttactccgtttctcgcgaggtggacaccgcgagagtgttgtttgatgaaacgtcatataaagatgtggttttgggaactgcgatggttgacggttatggcaaaatggggaatgtgaagagtgcaagagaggtgtttgataaaatgcctgagagaaacgctgtgtcgtggagtgccatgatggcggcatattctcgtgtcagtgacttcaaggaagtgctggctttgtttacagagatgcagaacgagggaactgagccaaacgagtctatactcgttacggtacttactgcgtgtgcgcaccttggcgcactcacgcagggactgtgggtgcattcctatgcaagacgattccatcttgagtcgaatccgattctggccacggctttggtggacatgtattcgaaatgtggatgtgtggaatctgctttatctgtttttgattgcattgtcgacaaggacgctggcgcgtggaatgctatgatttcaggcgaggcattgaatggcgatgcagggaaatcgttgcagttgtttcgccaaatggctgcttccaggaccaagccgaacgagactacgtttgtggctgtcctcactgcttgtactcatgcaaagatggttcagcagggcctttggttgtttgaagaaatgagtagcgtgtatggagttgtgccacgaatggagcattatgcatgtgttattgaccttttgtcgagagctgggatggtggaggaggctgagaaatttatggaggagaagatgggtggactcacagctggtgatgctaacgtgtggggtgctcttctgaatgcgtgtagaatacataagaatattcatgttgggaatagggtgtggaaaaagctggttgatatgggggtcactgactgtggtactcatgttcttacttacaatatatatagagaagctgggtgggatgtggaggcaaacaaagttaggagtaggattgaagaagtagggatgaaaaagaagcccggatgcagcataatagaggtggataatgaagttgaagagtttcttgcaggcgatcattctcatccacaagcacaggaaatgtgcaaattgctcgattccattctcaagatggggactttagagcacttctga

SEQ ID NO: 8254 - DNA, 2325 bp, Glycine max
aatgctgatgcatctgaaagaaggaagtccccttaatttgtaaatgctacaggattagctaacaacatgctccaatttccaaagccagaccaggaaagaatgaagaaaagttaagctcagaaactggaactatcacttaccttgattttgcaccaaaatatacccatgaagttgcagttctctattgttgcacttgttctattaggctccacactgtccttctgtggcctgatagtagctgacttgaactctgaccaacatgctctcttggagtttgcttcaagtgtcccacatgccccaaggctcaactggaagaatgactctgcttcaatttgcacctcatgggttggtgtgacatgcaactccaacggcacacgtgtcgtaggcctccatcttccagggatgggattaaccgggaccattccagagaacagcataggaaaactagatgctcttagggtcctgagtcttcattctaatggacttataggaagtcttccttctaatgtactctccattccttcactccaatttgcataccttcagcacaatagcttctctggcctaattccttctccagtgacccctaaactcatgacattggacatttcttttaactccttttctggcaccatcccaccagcttttcagaaccttagaagactcacttggttgtatctccaaaacaattccatatctggggctattcctgacttcaaccttccaagtctcaagcatttgaacttgagctataataacttgaatggctcaattccaaactccataaaggcattcccttacacttcttttgttgggaacgctctcttatgcgggccacctctcaatcattgctctacaatctccccttctccatctccttccactgattacgagccactcactccaccagccacccaaaaccaaaatgctacacaccataaggaaaactttggcctagttactatacttgctctagtcattggggtcattgccttcatctctttaatagttgtagtgttctgtttgaagaagaagaaaaacagcaaaagcagtggcatactgaaaggaaaggcttcttgtgctggaaagactgaggtttcaaagagttttgggagtggagtgcaaggggctgaaaagaacaagctatttttctttgaaggttcctctcacagctttgaccttgaggatttgctgaaggcttcagctgaagttcttggaaaaggaagttatggaacagcatacaaggctgttttggaggagggaacaacagtggtagttaaaaggttgaaggaagttgtggtaggaaagaaggagtttgagcagcagttgcagattgtggggagaattggaaaccaccccaatgtgatgccactaagggcttattactattccaaagatgagaaacttctggtttacaactacatgccaggtggcagcttgtttttcttgttgcatggaaacaggggagcaggaagaagcccactagactgggactccagagtgaaaattttgctaggagctgccaggggaatagctttcatccactcagaggggggtccaaagttctcacatggcaacatcaagtcaaccaatgtgctcataacccaagaactggacggctgcatctccgatgtgggattgccgcctctaatgaacactccagcaaccatgtcaagagccaatggctacagagctccagaagccacagactcaaagaagatcagtcacaagtctgatgtctacggctttggcgtgctgctgcttgaaatgctgacagggaagacccctttgaggtaccctggctatgaagatgtggttgatcttccaaggtgggtgaggtctgttgtgagagaggagtggactgctgaagtgtttgatgaggagcttctgagagggcaatatgttgaagaggagatggtgcagatgcttcagattgcactggcatgtgtggctaaggggtctgataataggcctagaatggatgaagttgttagaatgttggaggagattaagcatcctgagttgaagaaccaccacaggcaatcctctcatgaatctgactctaatgtgcagacaccaacaccatgatcaagtgcatttcttgggagagtaatcaaattttctcttgcctcctcatattgtgttttgcttgcatgccctcaaccaaataagcatgtatcattgtaaaatactattcatgatgatgtttttattcgtgttggccataaaagcttctttttcatgtttcacattatttgttacgttctgagctatgtcacttttggatattcagtcggtggaaataattcaagtattcattttcct

SEQ ID NO: 8255 - DNA, 2368 bp, Glycine max
acttcaagtattgaaagaaagaaagaaaatgcctcgactgatgcatctgaaagaaggaagtcccttcctttctaaatggatcagctaacaacttgctccaatttccaaagctagacaaggaaagaatgaagaacagttaagctcagaatctggaaccatcacttgccttgattttgcaccaaaatatacccatgaaggtgcagttctctattgttgcacttgttctattaggctccacactgtgtctttctggcctaattgtagctgacttgaactctgaccaacaagctctcttggagtttgcttcaagtgtcccacatgccccaaggctcaactggaagaaagattctgtttcaatttgcacctcatgggttggtgtgacatgcaactcaaacggcacacgtgtcgttggccttcaccttccaggaatgggattaatcggtaccattccagagaacagcataggaaaactagatgctcttagggtcctgagtcttcattccaatggccttataggaagtcttccttctaacattctctccattccttcactccaatttgcataccttcagcacaatggcttctctggcattattccttctcctgtgacccctaaactcatggcattggacatttcctttaacaacttttctggcagcattccaccagcttttcagaaccttagaagactcacttggttgtatctccaaaacaattctatatctggagctattcctgacttcaaccttccaagtctcaagcatttgaacttgagcaataataacttgaatggctcaattccaaattccataaagacatttccttacacttcttttgtaggaaattctctcttatgtggtccacctctcaatcattgctctacaatctccccttctccatctcctgccactgattaccagcccctcactccaccaaccacacaaaaccaaaatgctacacaccataagaaaaactttggcctagctactatacttgctctagtcattggggtcattgccttcatctctttaatagttgtagtgatctgtgtgttctgtttgaagaagaagaaaaacagcaaaagcagtggcatactgaaaggaaaggcttcttgtgctgggaagactgaggtttcaaagagttttgggagtggagtgcaaggggctgaaaagaacaagctctttttctttgaaggttcctctcatagctttgaccttgaggatttgctgaaggcttcagctgaagttcttggaaaaggaagctatggaacagcatacaaggctgttttggaggagggaacaacagtggtagttaaaaggttgaaggaagttgtggttggaaagaaggagtttgagcagcagttggagattgtggggagagttggaagccaccccaatgtgatgcccctaagggcttattactactccaaagatgagaaacttctggtttacaactacatgccaggtggcagcttgtttttcttgttgcatggaaacaggggagcaggaagaaccccactagactgggactccagagtgaagattttgctaggagctgccaagggaatagctttcatccactcagaggggggtccaaagttcgcacatggcaacatcaagtcaacaaacgtgctcataaaccaagaactcgacggctgcatctccgacgtgggattgcctcctttaatgaacactccagcaaccatgtcaagagccaatggctacagagctccagaagtcactgactcaaagaagatcactcacaagtccgatgtctacagcttcggggtgctgctgctagaaatgctgacagggaagacccctctgaggtatcctggctatgaggatgtggttgatcttccaaggtgggtgaggtctgttgtcagagaggaatggactgcagaagtgtttgatgaggagcttctgagagggcaatatgttgaagaggagatggttcagatgcttcagattgcattggcatgtgtggctaaggggcctgatcaaaggcctagaatggatcaagttgttagaatgttggaggagattaagcatcctgagttgaagaactaccacaggcaatcctctgagtctgagtctaatgtgcagacaccaacaccatgatcacgatgagatgcatttgatgggagactaataaaattttctctgcagaatggggtttgtcatcattaggctcatattgtgttttgcttgcatgccctcaaccaaataagcatgtttcattgtaaaatactactaatgatgatgtttttttatttgtgttggccataaaaggcttcttttcatgtttcacattattttgttgcgttatgacacttttagctattggctaattgctattcagttggtgg

SEQ ID NO: 8256 - DNA, 1947 bp, Glycine max
atgaagttccaattccatgcagttccatttgttctactaagcttcacagtgtctctctttggcctaattgaggctgacttgaactctgacaaacaagctcttcttgagttcttttccaatgttccgcatgccccaaggctaaactggagtgagtccactccaatttgcacatcttgggctggtgtcacttgcaaccaaaatggaactagtgtcattgaaatccatcttccaggggctggattcaaaggctcgattccagagaacagcctaggaaaacttgattctcttaaaatcctgagccttcattccaatggccttagaggaaaccttccttctgacattctctccattccttcactccaatatgtaaacctgcagcagaataacttctcaggcctaatcccttcctctatctcaccaaaactcatagcattggatatttcctctaacaacttctctggcagtattccaactacctttcagaatcttagtagactcacctggttgtatctccaaaacaattcaatctctggagctatccctgactttaaaaaccttacaagtctcaagtatttgaatttgagctataacaacttgaatggctcaattccaaattccatcaacaattatccatacacttcttttgttggaaactctcacttgtgtggaccacctctcaataactgttctaaagcttccaatccatcttcttctacttcctctctttctccttctcattctcctgtttctcaaccactctctccagcagaaactccacaaaatagaactgctaccacttcaaagagttactttggcctagctactatacttgctctagcaattggaggctgtgcctttatctccctcctagttttgatcatctttgtatgctgtttgaagaggaccaagagtgaaagcagcggcatactgacaggaaaggcaccttgtgctggaaaggctgagatttcaaagggttttgggagtggagtggaagaggctgaaaagaacaagttgttcttctttgaaggttgctcttacagttttgaccttgaagacttgttaaaggcttcagctgaagttcttggaaaggggagctatggaacaacatatagagctgctttggaggatggaacaacagtggtggttaaaaggttaagggaagttctagttggaaagaaagagtttgagcaacagatggaggttgtaggaagaattggaaggcacccgaatgtcatgccccttagagcttattactattccaaagatgagaaacttctagtctatgactacatttccagaggcagcttgttttccttgttgcatggaaacagaggcatgggaagagctccgttagactgggattcaagaatgaagattgcacttggagctgcaaagggaattgcttccattcacactgatcacatggactcaaaacttactcatggcaacatcaagtcttccaatgtgctcataaaccaacaacatgatggctgcatcactgatgtaggactcactcctatgatgagcactcaatcaaccatgtcaagagccaatggctaccgtgctcccgaagtaaccgagtaccggaggatcactcagaagtctgatgtttacagctttggggtgctcctattagaactgctcactggcaaggcgccactaggatatcctggctatgaggacatggttgatcttcctaggtgggtgaggtctgtggttcgtgaggaatggacggctgaagttttcgacgaggaacttcttagagggcagtattttgaagaggagatggtgcagatgcttcagattgcacttgcctgtgtggcaaaggtatcagataataggccaacaatggatgaaactgttaggaacatagaggaaattaggcttcctgaattgaagaaccgtaacacatcatctgaatctgattctaatgtacaaactccatga

SEQ ID NO: 8257 - DNA, 2504 bp, Glycine max
gtgaccaactccaagtgcttagttttaatctctttatttatttcatagtttaatgtcatatgttgcgtgctcaataagtttagtttagccctgttgcacaccatttcatttgatcctcattaaatggcaagtgggaaattttgaacttcataacacttctctcttgttgaactggattaaatatctcctactcgtttttgtgacatgatcttgtttcattctgttctaggcatcctcacactgaatttcatacaaagctaaaccaagcaagaatgaagaacagctaaaggtcagagataggaactaccacttgcctccacttcacaccaaacaagcacctatgaagttccaattccatgcagttccatttgttctactaagcttcacagtgtctctatttggtctgattgaagctgacttgaactctgacagacaagctctccttgagttcttttccaatgttccacatgccccaaggctaaactggagtgattctactccaatttgcacttcttgggctggtgtcacttgcaaccaaaatggaactagtgtcattgaaatccatcttccaggagctggattcaagggctccattccaaagaacagcctaggaaaactagattctcttaaaattcttagccttcactccaatggccttagaggaaaccttccttctgacattctctccattccttcactccaatatgtaaacctgcagcagaataacttctcaggcctaatcccttccactatctcacctaaactcatagcattggatatttcttctaacaacttttctggaagtattccaactacctttcagaatcttagtagactcacctggttgtatctccaaaacaattccatctctggagctatccctgacttaaaaaaccttacaagtcttaagtatttgaatttgagctataacaacttgaatggctcaattccaaattccatcatcaattatccatacacttcttttgttggaaactctcacttgtgcggaccacctctcaataattgttctgcagcctctcctccatcttcttctacttcctctctttctccttctccttctccttctcctgtttatcaaccactctctccagcagcaactccccaaaatagaagtgctaccacttcaaagagctactttggcctagctactatacttgctctagcaattggaggatgtgccttcatctccctcctacttttgattatctttgtatgttgtttgaagaggaacaagagtcaaagcagtggcattctgacaagaaaggcaccttgtgctggaaaggctgagatttcaaagagttttgggagtggagtgcaagaggctgaaaagaacaagttgtttttctttgaaggttgctcttacagctttgaccttgaagacttgttaaaggcttcagctgaagttctgggaaaggggagctatggaacaacatatagggctgctttggaggatggaacaacagtggtggttaaaaggttgagggaagttctagttggaaagaaggagtttgagcagcagatggaggttgtaggaagaattggaaggcaccccaatgtcatgccccttagagcttattactattccaaagatgagaaacttctagtctatgactacatttcaggaggcagcttgttttccttgttgcacggaaacagaggcatgggaagagctccattagactgggattcaagaatgaagattgcactaggagctgcaaagggaattgcttccattcacactgatcacatggactcaaaactcactcatggcaacatcaagtcctccaatgtgctcataacccaacaacatgatggctgcatcactgatgtaggactcactcctatgatgagcactcaatcaaccatgtcaagagccaatggctaccgtgctcctgaagtaaccgagtatcggaggatcactcagaagtctgatgtttacagctttggggtgctccttctagaactgctcactggcaaggccccactgggatatcctggctatgaggacatggttgatcttccaaggtgggtgaggtctgtggttcgcgaggaatggacggctgaagttttcgacgaggaacttcttagagggcaatattttgaagaggagatggtgcagatgcttcagattgcactggcctgtgtggcaaagctggcagataataggccaacaatggatgaaactgttaggaacatacaggaaattaggcttcccgagttgaagaaccctaacacatcatccgagtctgattctaatctacaaactccatgattattttgtatatgtatgcttgccttgccatgatgcacttgttattttctgttcaatgcaaggaataaccttgctttgtctctagaattttaaagttatggtaactctattgtatgtttagatgacaatagtagtttcttattctccaaatgtagtaagaaacgtagtgtcacgtgagtggtcattgaagaagtaaaaattttaaaacctt

SEQ ID NO: 8258 - DNA, 1384 bp, Glycine max
acgcacacatggtgctgccactgtcactcttctcttctcctttctgcttcgccgattctctatttttgcgcgcaatcgattgtatgctttgggccagtcgttaatgataacttgaggtctggatgatgctttctgattggttgtttacatattgtaattcagaatgtggaactttgcatcgaattgcattgctggaactgtgggactgaaaaatgattcaaagcctactcattctgcttcggaatgttctgatgatgaaaactctgttataggcagagaggaagggctggaatgcccaatatgctgggaatctttcaatattgttgaaaatgtgccctatgttttatggtgtggccacaccctttgtaaaaattgtatcctcggactgcagtgggctgttgtgaaatttccaacactgcctgttcaacttcccctttttatctcctgtccatggtgcaaccttctgtctttccgtttagtttaccggggaaaccttaaattccctcgcaaaaactactttcttctttggatggttgagagcatgaatggtgatagagggaaatcgcattcacctttctgtggtgataatcagcaacactcaattaaagataatttaaccatgggaagccaagtaagccatggaaaccttcggagggggctagttcgccatccagagacatcgagttccaaccaatatcatggtaatactggtaatcacctcaatacagaaagatttcatgtttatcttcggaagtcactgatcttctttgtccagttgacggctaagttcccattggtcattatattccttttaattgtcttatatgcaataccagcaagtgcagccattttggccctgtatgtacttgttacaattctgtttgccctcccatcatttctcattttgtacttctcatatcctagtttggattggcttgtgagggaaattatcacttaagattgtgaactagtgtaggctccaactttgcaaacattaagacaacagcttatatcttctactttgtaattatccgacttctcctttagaagctgtcatttatcttcccatatagggtcgttatcaatatatgtatacttgagtcttgattgtagctcaggtcgaacttggctagttggtggatgaaatgtcagtttttggcattagcttcgatgtcaatcagggcagtgggatagggtaatgataaatgcttgtgccctttcctggtggcaagaatttgtttgattaatgccatgttttatttcaattctgattatacttatatttgtaaattgtatataataattgagttgtttgtttggctgtgtgtggaaatactatctgcttaacttgaaataagtgatattccgttctctgtttaagaaa

SEQ ID NO: 8259 - DNA, 1270 bp, Glycine max
ggtttcagtcaaattgaacggaaccaccgtttctctctcacggtgctgccactgtcactcttctctactttctgcttcccagattctctatttttgcgcgtaatcgaatgtggaactttgcatcgaattgcattgctggaactgtgggactaaaaaatgattcaaagcctactcactctgcttcagaatgttctgatgatgagacttctgttataggcagagaggaagggctggaatgcccaatatgctgggaatctttcaatattgttgaaaatgtgccctatgttttatggtgtggccacaccctttgtaaaaattgtatcctcggactgcagtgggctgttgtgaaatttccaacactgcctgttcaacttcccctttttatctcctgcccatggtgcaaccttatgtctttccgtttagtttaccggggaaatcttaaattccctcgcaaaaactactttcttctttggatggttgagagcatgaatggtgatagagggaaatcacattcacctttctgtagcgataatcaacaacactcaattaaagacaatttaaccacgggaagccaagtaagccatggaaaccttcggaggggtcaagtttgccacccagagacattgagttccaacctatatcatggtaatactggtaatcacctcaatacggaaagatttcatgtttatctttggaaatcactgatcttctttgtacagttgacggctaagttcccattggtcattatattcttgttaattgtcttatatgcaataccagcaagtgcagccattttggctctgtatgtacttgttacaattctgtttgccctcccgtcatttctcattttgtacttctcatatcctagtttggattggcttgtcagggaaattatcacttaagattgtgaactagtacaggctccaactttgcaaacattaagacaacagcttatatcttctactttgtaattagccaacttctcctttacaagctgttatttatcttcccatatagggtcgctctcaatctctgtatacttgagtcttgattgtagctcaggtcgaacttggctagttggtggatgtaatgtcagtttttggcattagggttgatgtcaaccagggtggtgggatagggtaatgataaatgcttgtgccatttcccggtggcaagaatttgtttggttaatgccaagttttactttcaatacagattatactgttatgtttgtaaattgtatataatatttgagttgtttgtttggcta

SEQ ID NO: 8260 - DNA, 1667 bp, Medicago truncatula
gagtgatgaaaacgacatcgttttgatatagggtttctgttttgcgatcgaatcgagtggtaccaaccaaatcaatcaacgattctctgctcgtgccactgtcagtccacaatttctccaattttccgcacaatcgaatgtggaacttcgcatcaaattgtattgctggaaatgtagggctgaaaaaggattcgtcaaacccaactcattctgcttcagaatgttctgatgatgagacctctgtcgtaggaagagaggaagggcttgagtgcccagtatgctgggaatctttcaatattgttgaaaatgtgccttatgttttgtggtgtggtcatacactctgtaaaaactgtatcttgggactacaatgggctaccgtgaaatttccaacgctgccggttcaacttccacttttcatctcctgcccttggtgcaaccttctatcatttcgtttagtatatcgaggaaatcttagattccctcgtaagaactactttcttctttggatggttgagggcatgaatggtgaccgagtaaaatcacattcaacttgctgtggggataatcaacaacagtgtgcaagcaaaggtaatttaaccttaggagggcaagtaaaccatggaaatcttcagggggggcaagtccaccctccagatacatcgaactccagtcagcctcgggctaatacccgcaatcacctcgatatggaaagggtgcatatatctcttcgaaagtcattgattttctttgtccagttgacagctaagttcccgttgatcattatatttcttttgattatcttgtatgcagtaccagccagtgcagccattttggctctgtatatacttgttacaattctctttgctctcccgtcatttctcatcttgtacttctcatatccaagtttagactggcttgtcagggaaataattgcctgacatcataagctagtttaagcttttgttccatgatttgccggcttcccctttagtccattacaagctgtgttagttctcttctggcatacagcactgctcaatttaatacagtagtataatcgactcggacttgatttcagctatggtaaagcttggttggttggtactggtaggtacagaatcagtgccattaatagtgttgatgtaaaccaagactgtggactagcgccatgattatgcccatgccgtttttctggaggcaattatttgtctggtttaattccagttttacttgggggagaatcgatcccgatacttggggactacatttatcaatgtcatgttttgtatggtatgggtatttcttttaatacagcttatagttatatgtttgtatctttagaaaaaagagttatatgtttgtaaattgtatataacaattgtgttgtttgtgtgtagcctattttgaagtactttctgcttaattttaagttgtttcctgtgtttggctgctacaaattccagcactctttaggttagatatgtttcatgtatggctgtataatttggtatggatcttgtttgagaaatatgtctcaactgaagcatattatgtatacagaaggcagacatggaaagggtttttgtgttaattcattccatgtgtctgttctttgcggtccaaaatgaactgctcaattatcatgtaacatttacaatatttttttc

SEQ ID NO: 8261 - DNA, 874 bp, Glycine max
ttcacatgttccatagtccaaatgatgcgtgtttcctgactatttctatagtattgtgacttgattcagaatgtggaactttgcatctagtttaattgctggaagtgtgggtctgaaaaatgattctgcaaaaccaactcaccctgcttcagaatgttctgatgatgagacttctatggtaaccagagaggaaaggctggaatgcccaatatgctgggaatcctttaacattgttgaaaatgtgccttatgtcttatggtgtggccacaccctttgtaaaaattgcatccttggattacaatgggctgtggtgaaatttccaacgctgccaattcagcttccgctttttatctcctgcccatggtgcaaccttttgtctctccgtttagtttaccggggaaatctgaaattccctcgcaagaactactttcttctttggatggttgagagcatgaacggtgatagagtgaagtcgcattctactgtttgtggggatcatcaaccagtctggccaataattaaagacagtttaaccaatggaagccaagaaggccatggcatcccttggagagggcaagtttgccatacagagtcttcaagttccaatcaatatcatggcaataccagtaattacctaagtatagaaacactgcatacatcactgcggaagtcgttggttttatttgttcatttgatagcaaagttcccattgatcattatatttcttttgattgtcttatatgccataccagccagtgcagccattttggctctgtatatacttgttaccattctgtttgctctcccatcatttctcatcttgtactttgcatatcctagtttggattggcttgtcagggaaattatcacttga

SEQ ID NO: 8262 - DNA, 1627 bp, Glycine max
aaattgaagggttttccttaactcttctttttcttttgtcttttttgaaagaaaaaaaatccaatctttcattctcattctatcatgatttttgcgtgcaattgtttccaccttccgtaggttcttctatttcctcccctgcttcagcggtttaaacttgttacacctctgtcacgattgatgtggtccagacttgatgctttgatcccatcattaatgaccacagtgaagttcaaatgatgcttgtttcctggccatttctatagttttgtgacgtgattgagaatgtggaactttgcatctagtttaattgctggaagtgtgggtctgaaaaatgattctccaaaaccaactcactctgcttcagaattttctgatgacgagacttccatggttagcagagaggaaaggctagaatgcccaatatgctgggaatcctttaacattgttgaaaatgtgccttatgtcttatggtgtggtcacaccctttgtaaaaattgcatccttggattacaatgggctgtggtgaatttcccaacactgccaattcggcttccactttttatctcctgcccgtggtgcaaccttttgtctctccgtttagtttaccagggaaatctgaaattccctcacaagaactactttcttctatggatggttgagagcatgaacggtgatagagtgaagtcacattctactgtttgcggggatcatcaaccagtgtggccaattatagacagtttaaccaacggaagccaagtaagccatgacagccttcaaggagggcaagtttgccatccagagtcttcaagttccaatcattatcatggtgataccagtaattacctaagtatagaaacactgcatacatctctgcggaagtcattggttttatttgttcacttgacagcaaagttcccattgatcattatatttcttttgattgtcttatatgccataccagtcattgcagccattttggctctgtatatacttgttaccattctgtttgctctcccatcatttctcatcttgtactttgcatatcctagtttggattggcttgtcagggaaattatcacttgagatcaaagctgtatttcttctgctttgcaagcattatgaatgtaactttgcctcaccttgtggccccttcatccagtgtcttctacttcgtaattggtcaacatctccatttgcagctgtatcttttatcttatcatatatagccccagtcaatctcagtacacttcttgaatcttgagctctggttgagcttggctgggtgggaggagggatatcagtttttggcataatctattttgaagaccatcaaggccgtggagtgaacaaggtaatgaataatgattttgccctttcctggtggcaaatggttgttttatcaatatatgaacttcagaagaacaccctgatgtagttatcaagtgggtcaatatcagaaaagcttttttttttcatgggcacatttggatgctcctgttaatactgcctacagtatttttgctaattgtaatttgtaattataattagtagagctattttcctggccatatgtgcaagcactgtactctttatttgattttagtgatcttctcgtggttggcta

SEQ ID NO: 8263 - DNA, 1655 bp, Vitis vinifera
aaagattttaggatgtagtgtatgcatcggagctaagccactgcatctaacagtttctctggccgagaccaggtcctcaagaccatccatccggccctagggaagtgtcttcttatttctatgatatccacagttactgatagtattcagtgtcttcgaagctcagaattatcttggatgctcagatgttaatgacccttacgtgatggaactaacaacagaaagcagagatctggtctgacttcaagggatgctattgactgccacaagagaactgcttcagaacttcaatggttgatcatacttgagcaggcacttgtttagcaagctctttccacattcacaatgtggaattttgcttcaaatgccctctcaggaaccaatggactgaagaatgacctcttaaagccaaatcaagcaccttcagagtgctcagatgatgaaatttccacaaacacaagcagagaagaaggattggaatgtccaatttgttgggaatccttcaacattgttgagaatgtgccctatgttttatggtgtggccataccctctgtaagaattgtgtcctagggctccaatgggctgtcgtgaaattccctacactacccatccagcttcctttcttcatttcttgcccgtggtgcaatctattatccttcaggcttgtttataaggggaatctcacattccctcgcaagaattttttcctcctgtggatggttgagagcatgaatggtgatagggggaagtcacattcttccttttgtgatcatcagccaggctggtcttcaaacagaaatctgatcataggaaatcaaggtagtcatgtaaaccataggcgacctccatatagtcacctcccagaacagtctgagtcgaaccatgatggaggccacctgatcaataggttcctcaatatagaaagactccacttatccgttcgtaagtccttggtgttctttgttcacttgacggctaagttcccattggtaatcatatttcttctgattgttttgtatgcaatacccgccagtgcagccatcttggccctgtacattctgatcactgttctgtttgctctcccatcttttctaatactgtactttgcttatcccagtttggactggttggttagggaaatcattacctgaatcaccctcaatttgtgcttcctgtttcataaactctgtagcatagtggtgtagtgaatccaataatggtgcaatttgacgacttcacttggttttcatggttttctagcttgctatattttcacaccagagagtcatggtccttcagttggaccattttcaattttagaattattctgcacattcttagggcgtgactgctctgatgctagtggaatttgggccacaaaagaagatcttgggatacctctttggttggctaatagtatgttgtttttgtgtattagcagagctccagcaaagagacagttgaacagtggctgtagtgtttgcatcttatcaaacagtgcccttgttttttatggagacttgttatgattttcattcaacattcactattatgtctgtgctgttgtgcttgaccctaatatgtaaattaagtttattcatctccttttcagtttgataagagtaatgcaaaacactagaaagatcttctgcaa

SEQ ID NO: 8264 - DNA, 1317 bp, Vitis vinifera
atgtggaattttgcatccaactgcatagctggaagtgttggactgaagaacaactctccaaaaccaactcaagttgcttctgaatgctcagacgatgaggtttcttcaaatatcagcagagaggaaggtctagagtgtccaatatgctttgaatctttcaacattgttgaaaatgtgccctatgttttatggtgtggccataccctctgtaaaaattgcatccttggactacactgggctgttgtgaaatttcccactctaccaattcaacttcctctcttcatctcttgcccatggtgcaaccttttatccttccgtctcgtttacaagggaagcctcaagttccctcgcaagaactactttcttctctggatgcttgagagcatgaatggtgacagagagaagtctcattcctcgttttctggagatcatcatcaaccagtctggtcatcagacagcaatttagccctggggagtcaagtgaaccacagaatcctcaggagggaacaatttattcaccattctggaccatcaggatcaaaccatgaagatggccatgtaaataactacctcacccttgagagactacattcttctcttcacaagtcactggttttctttgttcagctgacagctaagttcccattggtggtcatacttcttctcattgtcttatatgccatacctgccagtgcagccattctggccttgtacatactcatcacagttctctttgctctgccatcagttctgatgctgtactttgcatatcctagtctggattggctggcaagggaaatcattacttgaatgctcttggttgcttagctcgtaagccctgtgaatacaagtttgttcctccactagaatagcatcagctactacaatttgacgactccactctctcccagggcctgcccccctgaatccttcaatctgtttccagaataattccagcttttagcatatcttgtaactgcgagtttttggaatttgactactggtggaagcaagaagttattttctttgggcatatacatatgggtccctcttgcaagaagttgatttctttgggcatatatgcatacgggtccctcttgcaagaagttaaagcaagtgattatagtcagggaagtgtgattctatggcttgatttacatgaaatctattttgatatctctgtgtgatgtgaatgtgtaaagagtatggttttgtttgccagtgagtttgtttgatatgtatatgaatacacatagttagaccatggattgtgatcaaaattgcatgtttcagagtaattggaagttctttccttaa

SEQ ID NO: 8265 - DNA, 855 bp, Glycine max
atggtagccattgaaaagaaaacccaaagctcactacatcttcgcagaaacagctttcccgccgcagctcaccctcttgtatcacaatttgaggagcaattgcaaagattgaggggttctgaagccacttcttcattgtcatcatcttcagtgtgccacaaacttaatgacatgctggatttgcatgactacactgataagttgcttcaattgccaatcgaacaacaagtcttagcacgagagtgcaacgataaatgtgttgatgacctactagaacagtctcttaggctcttagatatctgtaatacagccaaagagtgccttctgcaatcaaaggagagcatgtgcgacttagtttcagttatccgaagaaagaaaaacaatgaaattggattcacgattgaaggtgcaaaatacttggttgtgagaaagaagatgaagaagcaaattcgaaaggccctggaaaatttgaagcaaaaggacaaaaacacttcaccaatgctcagcttcttgaatgaagcagaagcaatcaccctgagctcattagaacaaatgctactgttcatctctggcccaaaaggacactcaaagcacagcagatggtcagcaatatccaagttgatgcagccaaaaagagtaatgtgtgactctcaagaatcaaacacaaatgaatttgaaaaggtggatgcagctttgcagtctctcatcagtctcaagccttcatctattgagaattttgaaagtcatatggaaaatttggagctgtgcattcaagatctagagataggagttgatcagctctcaagaaaattaattagaaacagggtttcccttcttaacatcttcaaccactaa

SEQ ID NO: 8266 - DNA, 855 bp, Glycine max
atggcagcaattgaaaagaaaacacaaagctctctgcatcttcgcagcaacagcttgccctctgcagctcaccctcttgtatcacaattggaggagcaattgcaaagattgaggggttctgaagccacttcttcattgtcatcatcttcagtgtgcctcaaacttaatgacatgcttgatttgcatgactacactgataagttgcttcaattgccaatggaacaacaagtctcggcacaagagtgcaatgatagatgtgttgatgacctactagaagggtctcttaggctcttagatatctgtagtacaactaaagattgccttctgcaatcaaaggaaagcatgtgcgacttaatgtcagtcatccgaagaaagaaaagcaatgaaactggattcgcggttgaaggtgtgaaatacttggctgcgaggaagaacatgaaaaagcaaattcgaaaggccctggaaaatttgaagcagaaggacaacaacacttcacccatgctcaacttcttaaatgaagcagaagcaatcaccctgtgctcattagaacaattgctactgttcatctcaggcccaaaaagacactcaaagcacagcagatggtcagcaatatccatgttgatgcagcctaaaagagtaatttgtgactctcaagaagcaaacacaaatgaatttgaaaaggtggatgcagctttgcaatctctcatcagccacaggccttcatctattgagaattttcatagtcatatggaaaatttggagttttgcattcaagatctagagataggagttgatcagctctcaagaaaattaattagaaacagagtttcccttctcaacatcttcaaccactaa

SEQ ID NO: 8267 - DNA, 849 bp, Glycine max
atggcacaaacctatggaagaaggcatgagctttccaattacaaacaaaaagataaaaatgccaaccacaggtcaggcattgaaacactctacgcattaccttctacccatctgtttcctaagaagaaaaaatggcagccattgaaaagaaaacacaaagctctctacatcttcgcagcaacagcttgccctcttgtatcacaacttgaggagcaattgcaaagattgaggtgttctgaagccacttcttcattgtcatcatcttcagtgtgccacaaacttaatgacacgttggatttgcatgactacaccgataagttgcttcaattgccaatcgaacaacaagtcttggcacaagagtgcaatgacaaatgtgttgatgacctactagaagggtctcttaggctcttggatatctgtgcaaaatacttggttgtgagaaagaagatgaagaagcaaattcgaaaggtcctggaaaatttgaagcaaaaggacaaaaacacttcaccaatgctcagcttcttgaacgaagcagaagcaatcaccctgagcaatcaccctgagctcattagaacaaatgctactcacagcagatggtcagcaatatccaagttgatgcagccaaaaagagtaatgtgtgactctcaagaatcaaacacaaatgaatttgaaaaggtggatgcagctttgcagtctctcatcagtctcaagccttcatctattgagaattttgaaagtcatatggaaaatttggagctttgcattcaagatctagagataggagttgatcagctctcaagaaaattaattagaaatagggtttcccttcttaacatcttcaacttctaa

SEQ ID NO: 8268 - DNA, 1425 bp, Glycine max
atgaaagacaccattgttctataccctaatcttggtaggggacacctagtttccatggtggagttgggaaaactcatactgacccaccacccttcactttccatcactattctcatcctcactcctcccaccaccccttccaccaccaccaccaccttagcctgcgactctaatgctcaatacatcgccaccgtcaccgccaccactccctccatcacgttccaccgcgttcccctcgccgcactccccttcaacacccccttcctcccccctcacctcctctccctcgaactcacccgccacagcacgcaaaacatcgccgttgcactccaaaccctcgccaaagcttcgaacctcaaagccatcgtcattgacttcatgaacttcaacgaccccaaagccctcactgaaaatctcaacaacaacgtccccacttacttctactacacttctggcgcctccactctcgctttactcctttactaccccaccattcacccaaccctcatagaaaaaaaggatacagaccaacctttgcaaatccaaatccctggattatccacaattacagccgatgattttccaaacgaatgcaaagaccccttgagttacgcttgccaagtcttccttcagatagcggaaaccatgatgggtggtgccgggattatagtaaacacatttgaagccattgaagaagaagccatcagagcgttaagtgaggatgcgacagtaccaccacccttgttttgtgtcggacccgtgatttctgcaccgtatggagaagaagacaaagggtgtctgagttggctaaacttgcaaccgagtcagagcgtcgtgttgctgtgtttcggaagcatgggaaggttctcgagggctcagttgaaggagatagctattgggttggagaagagtgagcaaaggttcttgtgggttgtgagaaccgagttgggtggtgctgatgactcggcggaggaactgagtctggacgagttgctgccagaagggtttttggagaggaccaaggagaagggaatggtggtgagggactgggccccacaggcggcgattctgagtcacgactcggtgggtgggttcgtgactcactgcggttggaactcggtgttggaagcggtgtgtgaaggggtgccgatggtggcgtggcctctctacgcggagcagaagatgaacaggatggttatggtgaaggaaatgaaggtggctttggcggtgaacgagaacaaggatgggttcgtgagttcgactgagttgggggaccgagttagggaactcatggaatcagacaaagggaaagagattcgtcagaggattttcaagatgaaaatgagtgctgcggaagcaatggctgaaggcggaacatcacgtgcttcgttggataagttggctaagctgtggaaacagagttga

SEQ ID NO: 8269 - DNA, 1644 bp, Glycine max
atgaaagacaccattgttctataccctaatcttggtaggggacacctagtttccatggtggagttgggaaaactcatactgacccaccacccttcactttccatcactattctcatcctcactcctcccaccaccccttccaccaccaccaccttagcctgcaactctaatgctcaatacatcgccaccgtcaccgccaccactccctccatcacgttccaccgcgttcccctcgccgcactccccttcaacacccccttcctcccccctcacctcctctccctcgaactcacccgccacagcacgcaaaacatcgccgttgcactccaaaccctcgccaaagcttcgaacctcaaagccatcgtcatggacttcatgaacttcaacgaccccaaagccctcactgaaaatctcaacaacaacgtccccacttacttctactacacttccggcgcctcccctctcgctttactcctttactacccccccattaaccaagtccttatagaaaaaaaggacaaagaccaacctttgcaaatccaaatccctggattacccacaattacagccgatgattttccaaacgaatgcaaagaccctttgagttacgtttgccaagtcttccttcagatagcggaaaccatgatgggtggtgccgggattatagtaaacacatttgaagccattgaagaagaagccatcagagcgttaagtgaggatgcgacagtaccaccacccttgttttgtgtcggacccgtgatttctgcaccgtatggagaagaagacaaagggtgtctgagttggctaaacttgcaaccgagtcagagcgtcgtgttgctgtgtttcggaagcatgggaaggttctcgagggctcagttgaaggagatagctattgggttggagaagagtgagcaaaggttcttgtgggttgtgagaaccgagttgggtggtgctgatgactcggcggaggaactgagtctggacgagttgttgccagaagggtttttggagaggaccaaggagaagggaatggtggtgagggactgggccccacaggcggcgattctgagtcacgactcggtgggtgggttcgtgactcactgcggttggaactcggtgttggaagcggtgtgtgaaggggtgccgatggtggcgtggcctctctacgcggagcagaagatgaacaggatggttatggtgaaggaaatgaaggtggctttggcggtgaaagagaacaaggatgggttcgtgagttcgactgagttgggggaccgagttagggaactcatggaatcagacaaagggaaagagattcgtcagaggattttcaagatgaaaatgagtgctgcggaagcaatggctgaaggcggaacatcacgtgcttcgttggataagttggctaagctgtggaaacagagttgattctcagtttgacattgacttgtcctctaaatattataccatttggtttccaaactttaaacttgtagacttaattttttaagttgaatttgtttcaattagtgatccttgctcatctaaaacatttatgacacctttcatttttatctttttattaaatcaaatatttattatatttataatttttttatcatttttaatctcttatttttctttgtttta

SEQ ID NO: 8270 - DNA, 1539 bp, Glycine max
atgaaagacaccattgttctataccctaatgttctaaggggacacctagtttccatggtggagctaggcaaactcatactaactcaccacccttcactttccatcactatcctcatcctcactccaaccaccacctcttccaccaccagcgtctcctgcaactctaatgctcgatacatcgccaccgtcaccgccacgacccccgccatcacattccaccacgcccccttcgccacactccccccctccactccttccctcccctctcacatcctctccatcgaactcacccgccacagcacgcaaaacctcgccgttgccctccaaaccctcgccaaagcctcgaacctcaaagccctcgtcattgacttcatgaacttcaacgaccccaaagccctcactgaaaatctcaacaacaacgtccccacttacttctacttcgcttcatgcgcgtcctttctctctctactccttcgtttaccaaccattcaccaaaccgttactagagagaaggtcaaagaccaaccgctgcagattcaaatccctggattacccacaatctccaccgacgattttccaaacgaggccaaagacccttcgagtgaaagctaccagtccttgcttcaggtagcggaaaacatgaggtgcagtgttggcattatagcaaacacgtttgaagcccttgaagagaaatccatcagggcgttatgcaaagatgggacgttgccgcctttgttttttatcggaccgttgatctctgcaccgtatgaagaagacaaagggtgcctgagttggctagactcgcaaccgagtcagagcgtcgtgttgctgagtttcggaagcctcggaaggttttctagggctcagttgaaggagatagccattgggttggagaagagtgagcaaaggttcttgtgggttgtgaggtccaggttggatgatgctgactcgatggaggaactgagtctggacgagttgatgccagaagggtttctggagaggaccaaagagaaggggctgataatgagaaactgggccccacaggttcagttactgagtcatgactcggtgggtgggttcgtgactcactgcgggtggaactcggtgttggaagcagtgtgtgaaggggtgccgatggtggcgtggcccctctacgcggagcagaagatgaatagggtgattatggtgaaggaaatgaaggtggctttggaggtgaacgagaacaaagatgggttggtgagtgcaacagagttgggggaccgagtcagggaactgatggactcggtaaagggaaaagagattagacaaagggttttcgagatgaaaaaaagggctgaggaagcaatggctgaaggtggaacctcgtgcgtcacgttagataagttggctatcaagttgtggaaaggaaacatgattgacatctaactgtttgtattaaatttatactgcgtagggactacccttaacatgtctcctctaactagggctcattatcacaaattctgataccatattaaatttatagtagagtatagatat

SEQ ID NO: 8271 - DNA, 1558 bp, Vigna angularis
atgaaagacaccattgttctgtaccctaacattggtaggggtcacctagtgtccatggtggagctaggcaagctcattctatcccaccacccttctctttccatcaccatcctcatcctcaccccatctcccaacgccactttcaccctagccagcaactccaacgcccaatacatcgccgccgtctccgccaccatccccgccatcacctttcacagcgttcccatggcccaactccccctcgacacccattccctaccccctcacctcatctccgtcgatctctcccgacacagcacccacaacgttgcccttgcactccaaagcctcgtcaaaggctccaacattaaagcccttgtcatggacttcttaaacttcagcaaccccaaaactctcactgaaaatctcaccacaaacatccccactttcttctactacacatccgcagcctccagcctcgttgtgctttttcatatgtccaccactctcccgaaacaaatcaaagatgaacagtttctacttcacttcccagggttgcccgctatctccaccgatgactttccaaacgaatccctcgatcctttgaactacactaaccagattttctctcagatagcggaagccatgaagggtagttctgggattataataaacacttgtgaagcgattgaagagaaagccattgcagtgttgaacgacgatgggaccgtgcctccgttgttttgtgtgggccccgtgatttctgcatcatatggggaaaaggacaaaggatgtctgagttggctcgagtcgcaaccgagtcagagcgtggtgttgttgtgtttcggaagcatgggtttgttctcgagggagcagttgaaggagatggctattgggttagagaagagccagcaaaggttcttgtgggtggtgaggaccgagttggaatgtggtgactcggtggaggagaaaccgagtctgaacgagttgttgccagaaggatttttggagaggacgaaggagaaggggttggtggtgcgggactgggccccacagagggagattctgagtcatgactcagtgggggggtttgtgactcactgcgggtggaactcggtgctggaatccgtgtgcgaaggggtgccaatggtggcgtggccattgtacgccgagcagaagctgaatagggtgtttatggttcaggaaatgaaggttgctttggcgttgaaggaggagaaagatgggtcagtgagtgggagtgagttgggggagcgactgaaggaactcatggaatcggacaaggggaaagaaattcgtcagaaggttttcaagatgaaactcagtgctgcagaagcattgggtgaacgtggaacttcacgtgttgcgttgaataagttggctacattatgggaaacgagttatttcactatttaacttcagtttctaagctttatgttccatttggttttcttctcttcctactagttataaatttatgttccatttaacaagttttttcttttccaataataaaaaattctgcagaaaaaccccaaaaaaaaaaaaaaaaaaaaaaaaa

SEQ ID NO: 8272 - DNA, 1425 bp, Glycine max; identical to SEQ ID NO: 8268

SEQ ID NO: 8273 - DNA, 1477 bp, Glycine max
agtctagaagggggaaagaggtgtagagcaagtgtttaggtttctgtgcacagtagagagtttatccaatcaaataaacccaaaccaagccgtctcttcatttccgatagaagccatggataggcttctatcttcttgttcttcttcccttaacaccaatctcaagcccttttctcttctccctcgatttgactccgtcagattcaaccctttctcatcaacgcgctgttccttcacctcaatttcatccaagcatgaaaccccacctccattatcgtcttctcctccaaaaaccctaccacccctttccccctctccactcattcattttcatgcctccgtgcccccatcccaacccctcactccgaataatttccaaaatccaaaggcaataacagctcgaacgtttgcaatactctcttctcttgttttgctcttaatccaaccagcttttgctccggcagcttttgccacgtttcaaaatgctgccaagactggtggccctgctgctgccgcagttggtggaaaactaatccgcactgagcttctaactagtgcttggactggtttctttgctggctgcttgcacacactgtcagggcctgaccaccttgcagctttggctccattgtcaattggccgaacccgaatggagagtgctgctgttggagccctttggggttgtggccatgatgccggtcaagttatctttggcttaatatttttgctcttaaaagatcgacttcacattgaaattatccgaacttggggcacccgagtggttggccttaccctgctagtaattggtgctatgggaattaaggaagcttcagaagtgcctaccccgtgtgttgccttagaaaatggtgaatgtgatgtcagtgtctatgaatcacgcgatagtaatcctgttgtaggaaagaagaagattggttttgctacttttgccactggaatagttcacggactgcaaccagatgcattgatgatggtgttgcctgcccttgctctaccctcacgcttggctggtgctgcatttctcatcatgttcttacttggaactgttgttgcaatggggagctatacggtatttatcggttcatgtagcgaggcactaaaagatagagtacctagaataactgagaaactcacttgggcttcttctcttattgcaatagccctcggatttgccatcatcattagccagttttttgggtttagcctgtattagtaaactttattcagccagggaccttttttatgaacatcgttttggtgtctagaaaaaagtagggacgttagagagaaatttgattgtttggagcaaggtcattatttatgcaagattttgattgtctattatttgactacgtttgtgaatgtatatatcgggtaggttcaattactctactgccaagaactatgttgctgtttcatttgaagatttcgattgattttaccaatattctgtttatgc

SEQ ID NO: 8274 - DNA, 907 bp, Glycine max
atggccgcaataacagcccgaacatttgcaatactctctgctcttgttttgctcttaatccaaccagcttttgctcctgcagcttttgcaacgtttcaaaatgctgccaagaccagtggccctgctgctgcagcagttggtggaaaactaatccgcactgagcttctaagtagtgcttggactggtttctttgccggttgcttgcacacactatcagggcctgaccaccttgcagctttggctccattgtcaattggccgaacccaaatggagagtgctgctgttggagccctttggggttgtggccatgatgccggtcaagttatctttggcttaatatttttgctcttaaaagatcgacttcacattgaaattatccaaacttggggcacccgtgtggttggccttaccctgctagtaattggtgctatgggaattaaggaagcttcagaagtgcctatcctgtgtgttgccttagaaaatggtgaatgtgatgttagcgtctatgaatcacgcgatagtaatcctgttgtaggaaagaagaagattggttttgctacttttgccactggaatagttcatggactggaaccagatgcattgatgatggtgttgcctgcccttgctctaccttcacgcttggctggtgctgcatttctcatcatgttcttactgggaactgttgttgcaatggggagctatacggtatttattggttcatgtagcgaggcactaaaagatagagtacctagaataactgagaaactcacttgggcttcttctcttgttgcaatagccctcggatttgccatcatcactagccagttttttgggtttagcctgtattagtacccacgttattcagccaccaacccatggcccattaattggttaattatacccaaat

SEQ ID NO: 8275 - DNA, 1143 bp, Medicago truncatula
atggataggcttctatcttcttcttcttcttctctcaacaccaacctcaaacccttcactttccttcctcttaaacctcgttttaattctgcaagattcaattttttcccttcaaatcgttcttccttcaagtgggtcgcttcaatttctcgtaacaatgaaaacccatctccatttttgtctgcaacgccccttttcgtcaaaccaaacaattcactttctcatgttgccaattctgataaccctataattgaatctcaacctgtcaataagatcaatgccactgatttcaaaaaaccaaagggattaacagttcagacatttgtaatactctctgctcttgttgtgctcttaattcaaccagtttttgcaccagcagcttttgcaacatttgcaaatgctgccaagaccagtggtcctgccacaactgcagttgggggaaaacttatccgtaccgagctcctaagtagtgcttggactggtttctttgctggttgcttgcacacattatcagggcctgaccaccttgcagctttggctccattgtcaattggccgtactcgaacagagagcgctctcgttggagccctttggggttgtggccatgatgctggtcagttaatctttggcttaatatttttgctcctaaaagatcgacttcacattgaaattatccgaacttggggcacaagagtagtaggtcttaccttgctagtaattggtgctatgggaattaaggaagcttcagaagtttctgccccaattgttgccttagaaaacggtgaaagcagcgtcggcgcctatgaatcactcgataatcctgtagctggaaagaagaagattggttttgctacttttgccactggaatagttcatggactgcaaccagatgcgttgatgatggtgttgcctgctcttgctttgccttctcgtgtatccggtgctgcatttctcatcatgttcttagttggaactgtagttgcaatggggagctatacagtatttataggatcatgtagccaagcactaaaggatagagtgcctagaataaccgagaaactcacttgggcttcttctcttatagcgatagcccttgggtttgccatcatcattagccagttttttgggtttagtttgtattga

SEQ ID NO: 8276 - DNA, 1424 bp, Vitis vinifera
aaatctacaagtgtcttgagagagaggggggagaaaacggagagaagcagaggcaatggagcggttgatttactcgtattctccaatcccctccaaagtccgtctaaagcccttttctcctctctctcctatcccttcacttcctccattcgactcctcaagactctgtttttcttccttctcatgcacccatctcaagcgcctcaacgcctcaacgccccattcttcttttctctgttctttagcgcccttgcttgcatcatcctcgtcttcctcggctttccaggctgagtcacccgacgagtcggtttccccacccagttctctcccacagatcgtagcaggagcttcccagcagcgaaaggcagcaactgctgggacaataacactactctcagctcttaccattctcttaatccacccagttcttgcacaaccagcttttgcaactttccaaactgcagccaagactgggggtccagctgctgctactgtagggggacaactcatccggactgaattactaagtagtgcttggactggtttctttgctggctgcttacacacactatcagggcctgatcaccttgctgctttggctccactctcagttggccgtagccgcatggaaagtgctgcagttggagccctttggggctgtggccatgatgctggtcagatgatctttggcctgctctttctgctgctaaaggaccgcctccacattgaagtcatccgaacttggggcaccagagtggttggatttactctacttgttattggagccatgggaatcagggaggcctcagaagtccctactccatgcgtggccgtggagaatggtgagtgtgatgttggtacctatgaggcgctagaaaaccctacagctaagaaaaagaagattggatttgcaactttcgccacagggatcgtccacggcctgcaacctgatgcactgatgatggtcttgcctgcacttgcattgccttctcgcttggccggtgctgcatttctggtaatgttcttactagggactgtagttgcaatggctagctatactgtattcataggctcatgtagtcaggctctaaaagaaagggtccctagaataactgagaaactcacttgggcttcttcccttatagcaattgctcttggatttgccattctcattagccagtttttcgggtttagcttgtactgattcacatgaccatattcaggtttagcatgttctgagtttcctccagtcctatagaaagatcttgagaaggcccaatgaatttggttactatcaaaaattcatcttcatagcatcgaatatttatgagaatcatcctccttatcattaaaggttgtaatctctgtaattcctttatattcagattgatattcaggttggatgaagtgccccattctacaaa

SEQ ID NO: 8277 - DNA, 1338 bp, Glycine max
gtagatagaagccatcagtcatggataggcttctatcatcgtcttcacccccttcttttacatttctcactcgattcgaatctgcaactgcaagattcaatttctctccgtcaacacgttctcactctcacttgaagcggctctcctcaatttgttgccagcatgcaaatccatctcctttttcctcttccactccctttctcgcttcttccaaccaccccattaattttccatccttttcctcttcttcagatccctccacactcgaatcccattctctcaatcaaatcaaaaccggggctttcccaaaaccaaaggtaataacagctcggacgcttgtaatactttctgctcttgctatgatcttaatccaaccaactattgcaccagcagcttttgcaacctttcaaactgctgccaagactggtggtcctgctgctgcagctgcagttggtagaaaactaatccacacggagctactaagtagtgcttggactggtttcttggctggctgcttacacaccttatcagggcctgaccacctagctgccttggctccattgtcaatcggtcgaacccgaatggagagtgctgctgttggagccctttggggttgtggccatgatgctggtcaagttctttttgggttaatatttctaatcctcaaggatcaactccatattgaaattatccgaacttggggtaccagagtggtgggtcttactctgctaataattggtgctatgggaattagagaagcatcagaagtacatgccccaattgttgctttagaaagtggtgaatgtgatgtcaacgtgtatgaatcgcttgataatccaacagtgggcaaaaagaagataggttttgctacttttgcaacagggatagttcatggcctgcaaccagatgcattgatgatggttttgcctgcccttgctttgccttcgcgtttggctggtgctgcgtttctcatcatgttcttaattggaactgtaattgcaatgggaagttataccgtgtttataggttcgtgtagccaggcactgaaggatagagtacctaggataactgagaaactcacttgggtttcctcccttattgcaatagccctcggatttgctatcattattagccagttttttgggtttagtctgtattaaaacatctttaataagaaaggtactttttttcttatgaacattgttttagtatttagaaaaagtagacgttggacagaaaattggttgtttataggaagtacatcatccagaaaacatgtgaaattgattgttaattatttactttgcattcgaatgtgtataagtatatgtgagttcc

SEQ ID NO: 8278 - DNA, 1315 bp, Glycine max
ttcatttgtgtttttgtagatagaagcccagccatggataggcttctatcatcgccttcacccccttctttcacatttctcactcgattcgaatctgcaactgcaagattcattttcacacgttctcattctcacttgaagcgggtcacctcaatttgttgccagcatgctaatccatctcctttcactccctttctcgcttcttccaaccaccccaatacttttccatccatttcctctccttcagttcgctccacacccgaatcccattctctcaatcaaatcaaaactggggctttccaaaaaccaaaggcaataacagctcggacgcttgtaatactttctgctcttgctatgatcttaatccaaccagctattgcaccagcagcttttgctacctttcaaactgctgccaagaccggtggtcctgctgctgcagttgggcctgaccacctagctgccttggctccattgtcaatcggtcgaacacgaatggagagtgctgctgttggagccctttggggttgtggccatgatgctggtcaggttctttttgggttaatatttcttatcctcaaggatcaactccatattgaaattatccgaacttggggcaccagagtggtgggtcttactctgctaataattggtgctttgggaattaaagaagcttcagaagtacatgccccaattgttgcattagaaagtgatgaatgcaatgtcaacgtgtatgaatcacttgataatccaacagtaggcaaaaagaagataggttttgctacttttgcaacagggatagtccatggcctgcaaccagatgcattgatgatggtgttgcctgcccttgctttgccttcacgtttagctggtgctgcatttctcatcatgttcttaattggaactgtaattgcaatgggaagttatactgtgtttataggctcgtgtagccaggcactgaaggatagagtacctaggataaccgagaaactcacttgggcttcttcccttattgcaatagccctcggattggctatcattattagccagttttttgggtttcatctgtattaagtattaaaacatttttaatcagactttttttggtatttagaaaaagtagagacgttggacagaaatttgggttgtttagaggaagtacaatccaggaaacatgtgaaattgattgttgattatttactttgcacttgaatgtgtgtaggtatatgtaagttccatgattctgcagctgagaacagcgtagctcttttgtctatatttctggaatttattttatatactgttgtctgtcagagtt

SEQ ID NO: 8279 - DNA, 1477 bp, Glycine max; identical to SEQ ID NO: 8273

SEQ ID NO: 8280 - DNA, 1413 bp, Vitis vinifera
ggcgctatggagaggcttatccactcctcttcttccctcctttccaaaccctttctaaaacccgcccattctccccaccgcctctcccgaaacgacgcccttccattccggctttcctttcttaagcgtccttatttcgtccaacttggctcggctttctgtgctctcgagaattcatcctcttcttcttcttcttcttcctttcgccgcctcaaatttcatgctcattgctcgaagaaggggccgtcgttttcttcttcccccgatccagatgtttcgtcgacacccggatctcattttctcaagcgcatagtgggagctgcttcgaatcaacaaaaggtcatcactgctggagcagtactactagtgtcagctctctttgtgctcttagtccacccaattattacttcttcagcatatgctactgggttctctgctgcttctgctgtcaatggaaaaatcgttcgtactgagctgctaagtagtgcttggactggcttctttgctggttgcttacacacactgtcaggaccagaccaccttgctgctttggctccactttctattgggcgcaccagggtggagagtgctctagttggagcactttggggctgtggccatgatgctgggcaattgatttttggtttgctgtttctactactcaaggatcggcttcatatagagattctccgcacatggggcacaagagtggtaggcttcaccttactcgttattggtgccatgggaataagggaagcatcagagtctcctgcaccttgtgttgtcctggaaaatggcgagtgtgatgttagcatgtatgattccctcgaagctccagttgttggaaagaagaaaattgggtttgcaacttttgctaccggcattgttcatggattacaaccagatgccctaatgatcatcttaccagcacttgccttaccttcacgcatagctggtgctgcctttctgggtatgttcttgattggaacggtagttgcaatgggaagttacacggtgtttataggttcatgcagccaggcattaaaagaaagggtccctagagtaaccgagaaactgacttgggcttcttcacttgtagcaattgctcttggacttgccatcattttcagccagttttttgggttcagcctttattgacttatcttatagtcttcgggacaaagccccttacaaagttgcgcaaggaactctccatctccacaagaatcttcatccatcttttctttcttacttggaagttcatatttcatactcaaagaatctcttttaggattttcatggaacacgatgtagctttatatatgatagctcagatagacttgcatatttcttgtgactattgtcccaatcagagtatagttctcttctctctaatttagttgtgagtttggt

SEQ ID NO: 8281 - DNA, 1061 bp, Glycine max
atggtgagacatggttggtcggagatgaactttgatacggagggtgatgatgatgatgaccgttcaaatctaagtacagaacaaagtaattcagttgtcatttcaaacacaggttcaattaggacacaaaaggaagtacctggacatgtgaatgtactactaggacatgatcaaaggaaacaagaattaactgcctcaatttctacagtccaaagggatattaccactcccatcaccaccattccaaacttagttcccaccactcccaccatttcaacatctccattcctgaatcctaattccaaccctgacacggtctctccagcctccacaatcccatttagcactccaaccactgtgaattccccaatgttctcaggtgcaagttggtgtattgcaagtccaactgcctcacagactactctacaagttgcattggactatgcttgtggctttggtggtgctgattgctcagcaattcaacctggtggaagctgttacaacccaaattccatcaggaaccatgcttcttatgcctttaataagtattatcaaaagaatcctgttccaaatagctgcaattttggtggaactgctgtcatcattagcactaacccaagcactggggcatgccaatatccatccactagcactagtacatcagttttgaacacaacaaactcaaacggtgccaacgtttttggttcagtgccagtgcccacaaacccctctccctcctctgctgctgcacctgacacactaaatagctttgcagatatttgtgtcattttgtggataatttcaactttgcaaagaaattatctctaaaatggttgagagttggaagttgctgctctgagcaaatttttttgcccctttaaactttttgagagacacaaaagccaacagctacatgaccatcaacagtacataaatggtagaaacacatggtagaaagaaaaggcaatttaagatgatggacattttgcaaagatatatatatatatatactgtacataccttttttatttaattttctttgtgttgctcacatttttttt

SEQ ID NO: 8282 - DNA, 843 bp, Vitis vinifera
tttcaggcagcaactgctgggacaataacactactctcagctcttaccattctcttaatccacccagttcttgcacaaccagcttttgcaactttccaaactgcagccaagactgggggtccagctgctgctactgtagggggacaactcatccggactgaattactaagtagtgcttggactggtttctttgctggctgcttacacacactatcagggcctgatcaccttgctgctttrgctccactctcagttggccgtagccgcatggaaagtgctgcagttggagccctttggggctgtggccatgatgctggtcagatgatctttggcctgctctttctgctgctaaaggaccgcctccacattgaagtcatccgaacttggggcaccagagtggttggatttactctacttgttattggagccatgggaatcagggaggcctcagaagtccctactccatgcgtggccgtggagaatggtgagtgtgatgttggtacctatgaggcgctagaaaaccctacagctaagaaaaagaagattggatttgcaactttcgccacagggatcgtccacggcctgcaacctgatgcactgatgatggtcttgcctgcacttgcattgccttctcgcttggccggtgctgcatttctggtaatgttcttactagggactgtagttgcaatggctagctatactgtattcataggctcatgtagtcaggctctaaaagaaagggtccctagaataactgagaaactcacttgggcttcttcccttatagcaattgctcttggatttgccattctcattagccagtttttcgggtttagcttgtac

SEQ ID NO: 8283 - DNA, 1744 bp, Glycine max
caaatccttcttcaccttcacaattagaaaaaaaaaaaaacaaaaaatgggcgtttctcgttctcaaaagcctcatgttgtttgtgtgccattcccagcacaaggccacgtgaacccttttatgcaactaagcaaactccttctttgcaccggtttccacataacctttgtgaacaccgagttcaaccacaagcgtttggtgaagtctcttggacaagaatttgtcaagggacaacctcattttcgatttgagaccataccagatgggttgcctccatctgacaaagatgcaacacaaagcattgcagcattgtgtgatgcaactagaaaacattgttatgagccactcaaagagcttgtgaagaagctcaatgcttcacatgaagtgcctttggttacctctatcatctatgatgggctaatgggctttgcagggaaagtggcaagggatttggacatttctgaacaacaattttggacagcctcagcttgtggtttaatgggatacttgcaatttgatgagcttgtcgaaagaggcattattcccttccaagatgaaagtttcactactgatgggtcattggatacaaatctagactggatatctggaatgaaaaatatgcgaatcagagattgtccaagtttcgtgagaactaccactctagatgaaaccagttttatttgctttggtatagaagcaaaaacctgcatgaaatcatcttcaatcataattaacaccatccaagaattggaaagtgaagttctcaatgcccttatggctcagaacccaaatatatataacattggtccacttcaattgttaggaaggcattttcctgataaagacaagggcttcaaggtgagtgggtcaaatctttggaaaaatgactcaaaatgtatccaatggctagaccaatgggaaccttcctcagtcatatatgtgaattatggaagtattactgtgatgtccgaggatcatttgaaagaatttgcttggggactagcaaatagcaatttaccatttttgtggataaaaaggccagatttggtaatgggtgagtccacacaattgccacaagacttcttagatgaggttaaagatagaggatacataacaagttggtgcccccaagagcaagtgctgtctcatccatcagttggggttttcctaactcattgtggctggaattctacactagaaggtataagtgggggtgtccctatgataggttggcctttctttgctgaacaacaaacaaattgcaggtacatatgcacaacttgggggataggaatggatattaaagatgatgtaaaaagggaggaggtgacaacacttgtgaaagaaatgataaccggagaaagggggaaggaaatgagacaaaagtgtctggagtggaaaaagaaagcaatagaagccactgatatgggaggatcatcatataatgatttccatcgattagtgaaggaggttcttcacaatgatgttgtttgagtctttcaatatattgggggtccgaaggtagggtattaggtgtttcaatattggagatcctagtgttgggctgggctatcaaacaaaatattatgaagaaactagcatgacttgatggctgaaaatcaagtctattaaataaagatttgtgtggatgtaattcatcatatattgtattgatttgaagtgtatgtcggtttacaatatacatgtaaactttcaattcgatgtaattgaggttaaattata

SEQ ID NO: 8284 - DNA, 1744 bp, Glycine max
acggccttatccttcacacatattctgtttttttgtgaataaacttgttatttgaacacaacatatatcccataattgatattcagcatccaaaaaaaaaaaatggattcaccacttcatatccaaaagcctcatgttgtatgtgtaccattcccagcacaaggccatgtaaacccctttatgcaactagccaaactccttcattgtgtgggtttccacataacctttgtgaacactgagttcaaccacaaccgttttgttaagtcccatggaccagactttgttaagggtctccctgatttcaaatttgagaccatacccgatggcttgccgccttcggataaggatgcaactcaggatgttccagcactgtgcgattctactaggaaaacttgttatggtccattgaaagagttggtgatgaagttgaactcttcttcccctgaaatgcctccggttagttgcatcattgctgatgggactatgggatttgctggaagagtcgcaagggatttgggcatacaagaggttcaactttggacagcctcagcgtgtggttttgtgggatatttgcaattcgaggaactggtgaaaagaggcattcttccattcaaagatgaaaattttgctattgatggcaccttggataagagtttaaattggatttctgaaatgaaggatattagactcaaagaccttccaagttttatcagaacgaccactttggatgatactatgtttgatttcttgggttctgaggcacgaaacactttgagatcatcttcaatcatcattaacacattccaagacttggatggagaagccattgatgtccttaggatcaagaaccctaacatatataacattggcccacttcacttgattgataggcattttcttgagaaagaaaagggcttcaaggccagtggatcaagtttatggaaaaatgattcaaaatgcttagcatggctagacaaatgggaacctaactcagtcatatatgttaattatggaagtataacggtgatgacagagcatcacttgaaagaatttgcttggggactagcaaatagcaagcaacatttcttatggataatgagaccagatgtagtaatgggtgaatctatatctttgccacaagagttctttgatgagatcaaggacaggggatatataacaagttggtgtgttcaagagaaagtgctttctcatccatcagttggggcctttctaacccattgtggttggaattctacacttgaaagtatatctgcaggtgtgcctatgatttgttggcctttctttgccgagcaacaaacaaattgcaagtatgtatgcacaacttggggaatcggaatggaaattaaccatgatgttaggagagaagagatagcaaagcttgtgaaggaaatgatgatgggagaaaagggaatggaaatgagacaaaaatccttagagtggaagaagaaagcaataagagctactgatgttggaggatcatcttacaatgatttctataagttaataaaggaggtttttcattacagtgttctttaagtccttattttataatcaggtgtattaaggtttattagttatataaaaatacctttcttaagttataatgggatgacaaacatgatgcaattggtttggcctaattactgttagtttaaaatgttttcatttatatttatcatgtcacgtgtactaaaattttaatattgtaactctttgtgtaagc

SEQ ID NO: 8285 - DNA, 1718 bp, Glycine max
atgagctcaaaatttgtgagcaacacccaaaagcctcatgttgtatgtgtaccatttccagcacaaggccatgtaaacccctttatgcaactagccaaactccttcattgtgtgggtttccacataacctttgtgaacactgagttcaaccacaaccgttttgtcaagtcccatggaccagactttgttaagggtctccctgatttcaaatttgagaccatacccgatggcttgccgccttcggataaggatgcaactcaggatgttccagcactgtgcgattctactaggaaaacttgttatggtccattgaaagagttggtgatgaagttgaactcttcttcccctgaaatgcctccggttagttgcatcattgctgatggggttatgggatttgctggaagagtcgcaagggatttgggtatacaagaggttcaactttggacagcctcagcgtgtggttttgtgggatatttgcaattcgaggaactggtgaaaagaggcattcttccattcaaagatgaaaattttgctattgatggcaccttggataagagtttaaattggatttctgaaatgaaggatattagactcaaagaccttccaagttttatcagaacgaccactttggatgatactatgtttgatttcttgggttctgaggcacgaaacactttgagatcatcttcaatcatcattaacacattccaagacttagatggagaagccattgatgtccttaggatcaagaaccctaacatatataacattggcccacttcacttgattgataggcattttcttgagaaagaaaagggcttcaaggctagtggatcaagtttatggaaaaatgattcaaaatgcttagcatggctagacaaatgggaacctaactcagtcatatatgttaattatggaagtataacggtgatgacagagcatcacttgaaagaatttgcttggggactagcaaatagcaagcaacatttcttatggataataaggccagatgtagtaatgggtgaatctatatctttgccacaagagttctttgatgcgatcaaggacaggggatatataacaagttggtgtgttcaagagaaagtgctttctcatccatcagttggggcctttctaacccattgtggttggaattctacacttgaaagtatatctgcaggtgtgcctatgatttgttggcctttctttgccgagcaacaaacaaattgcaagtatgcatgcacaacttggggaatcggaatggaaattaaccatgatgttaggagagaagagatagcaaagcttgtgaaggaaatgatgatgggagaaaagggaatggaaatgaaacaaaaatccttagagtggaagaagaaagcaataagagctactgatgttggaggatcatcttacaatgatttctataagttaataaaggaggtttttcatcacagtgttctttaagtccttattttataatcaggtgtattaaggtttattagttagataaaaatacctttcttaagttataatgggatggtaaggtcataacatgatgcaattggtttggcctaattactattagtttaaaatttttccatttatatttatcatgtcatgtgtactaaaattttaatattgtaactctttatgtaaacatccatgattgttacaaaggatatgatttactttattagttttatatatgatgagtttaagac

SEQ ID NO: 8286 - DNA, 1025 bp, Glycine max
atgtgggcttgggccgttgcagttgcactagccggaattacatgttttggttgcactaatggatttgataaaggcttggaggttgggaccttttttctacttctcccaacactcgcggaactagaaagcctctacttccaattccacgtggcaaaaaggagagactctgattctgagccgcttctagaaccttccattgtccaagaagtttcattccacgacgacaacgaagaagaagaattccttgacgaatttgaatacgatgaagacgacggtgacggtgacgaatactatgaggaagaagaggaatacgaagaggaggctggtgatggcggcgcaggtggcggaatctccctcaccggaacgtggtgggataaaaaagcactagccattgctaaagaggttactctctccttcgatggcgaattgcaaatttatgcttttagaacactggtcaactgcaccatccaagtgcgcattgagaacctttccaaaaagtctggttcccccagcatggaagatattgaagccttctctacaacatatagagcaaagttggatgaagcagaaattgccaaagttgttcccgacaatatatgtttggaggtgtcttctcctggtgttgaaaggatagttcggattccagatgacctagatcgattcaaggaccgacctatgtatgtgaaatatgccattaatgatgatcaaaataatccagctgcagaaggtgatggtgtcttcaagcttgaatcctttgacatggaaacaaaatgttgcacctggggtttagcagatgtgaaagtcaatagacagaaagcagggaaaggaagaccactgaataaaaagcaaagtgaatggcgtttaagcactccctttgattccttacgttttgtacggttgcactctgatatttaaataatttattttccccgaaagttgattagatttccatctttcttctgtttgcgtgtctgtgtatatgtacacgaacataaagaactgcatgaatagataagtagaacaat

SEQ ID NO: 8287 - DNA, 1199 bp, Glycine max
gattcttgtagccgaatatggatttgatcaaggcttggaggttgagtccttctgtaagtgcaattccctcaccattctgtgctgctcccatttgtgtaagaactttctcttttcagttttcaacttctccctacactcgtccaaagcctctagttcctattccacgtggcaaaagtagagactctgattctgagccgcttctagaatcttccatcgtgcaagaagtttcattcgacgacgacgacgaagaagaattccttgacgaatttgaatacgatgaagcagcggatggcgatgaatactatgaggaagaagaggaatacgaagaggaggctggtgtgccttatgcaggtgatggcggcgcaggtggcggaatctccctcgccggaacttggtgggataaaaaagcactagccattgctaaagaggttactctctccttcgatggcgaattgcaaatttatgcttttagaacactggtcaactgcaccattcaagttcgcattgagaacctttccaaaaagtctggttcccccagcctggaagatattgaagccttctctgcaacatatagagcaaaattggatgaagcagaacttgccaaatctgttcctgacaatatatgtttggaggtgtcttctcctggcgttgaaagaatagttcggattccagatgacctagatcgattcaaggaacgaccaatgtatgtgaaatatgccattaatgatgatctaaataatccagctgcagaaggtgatggtgtcttcaggcttgaatcctttgacatggaaacaaaatgttgtacctggggtttagcagatgtaaaagtcaacagacagaaagcagggaaaggaagaccactgaataaaaagcaaagagaatggcgtttaagcaccccctttgattccttacgttttgtacggttgcactctgatatttaaataatttattttcccccaaagtttatgattagatttccatttttcgtctgtatgtgcgtctgtatatgtacatgcatatagactgcatgaatagataattagaacaattagcacatatactgctcatgttctaactagttcgtgtgaaatgtaaagcagaaaacaaattaagagatgcgagtggatcaagagacattggattgtttcagcttaaccaatggtcttgaatttgagttctagacatgttgttcaatgaga

SEQ ID NO: 8288 - DNA, 2235 bp, Glycine max
gtcaagaccgacaactcatgttagtgaattaatttactcactatactaactcctaactccaacttcagctacattctcccggcgtttcgatcgatcttgatcccaattcccatctacacacatatcacaatgctaagtcgtaaacgactcatcgtttcgctctctctcgccactctccttctcttctcctccctttccctcactctctgcgataaaatcccccctcaaaacgacaacaacaacgatgacgacgaagatctcagcttcctcgaggaacccgatgacgccgccgccacttcgcaccacggccattttccagatcccgaccggttcgacgaggacggcgacgacgacggcgacttcggcgacttctcaggcttcgaccactcgacggaggaggcgttcgaggtggatgacaaggacgtcgtcgttttgaaggagcgcaacttcactaccgtcgtcgagaacaaccgcttcatcatggtcgagttctacgccccctggtgcggccactgccaggccctcgcgccggagtacgccgccgccgccaccgagctcaagcccgacggcgtcgttctcgccaaagtcgacgccaccgtcgaaaacgaactggcgaacgagtacgacgttcagggtttccccaccgtcttcttcttcgtcgatggggtccacaagccctacactggccagagaaccaaagacgctatagtgacatggattaagaagaagatagggcctggtgtgtccaacataactacggtggatgatgctgaacgcatattgacagctgaaagcaaagttgttttgggcctccttaactctttagttggtacggagagtgacgaactagctgcagcatcaaagcttgaggatgatgtcaatttttatcaaactgtggtagctgatgtggcgaagcttttccatattgatccgagtgttaaacgccctgctttgatcttgctcaagaaagaggaagagaaattgaaccattttgatggccaatttgtaaaagctgaaatagccgattttgtaacctccaacaagcttcctttggttacaatttttacaagagaaagtgccccggtaatctttgaaagtcaaatcaagaaacagttgttgctgtttgtgacttcaaatgatacagagaagtttgttccagtatttaaagaagcagcaaaaaaattcaaggggaagctgatctttgttcatgtggaattggataatgaagatgtaggaaagcctgttgcagattattttggtatcactgggaatggtcccaaagtacttgcatatacaggaaacgatgatggaagaaaatttttgcttgatgaggagctgactgttgacacaattacggcatttgggaatgatttccttgaagaaaagctaaaacctttcctcaagtctgatccagttcctgaaagtaatgacggtgatgtgaaaatagttgttgggaataactttgatgaaattgttttggatgagtcaaaggatgttttgcttgagatttatgcaccctggtgcggtcactgccaagccctggaaccaacatacaacaagcttgctaaacatcttcgcaacattgagtctattgttatagccaagatggacggaacaacaaatgagcatcccagggccaagtctgatggattccccacccttctcttcttcccagcaggcaacaagagttctgaccctattcctgttgatgtggatcatacagtgaaagccttttataagttcctcaggaaacatgcatcaatcccattccagctccagaaaccaacctcaactgctaaaaccgggagtgagagttcctatgtcaaggagagccaaagcagcagcacggatgtgaaggatgaattatgagacttaaaggacacttctattgataaagagatatgattcagaaattcagacagctgataacggagtgaaaatgtgcatagcaaagaaagtgactcaatgattgggagagaaagccgtatatttttcctcaccctggccaaaagacaactagccaagtaaagggtagtggaaaaataaggtaacctgtgtattagtttcttcaacttttacatgtttgagtatcagaattttggggagactaattttaaaaatggctcgaaattttattttcggtgtcagaatactggttatttttgcccttaggttaagctttagttgataaaaattgttgaataataaataaaaaaatgaactttcattagagaa

SEQ ID NO: 8289 - DNA, 2237 bp, Glycine max
agatcacaatgctaactcgtaaacgactcgtcgtttctctctctctcgccactctccttctcttctcatccctctctctctctctctgcgataaaaccccccctcaaaacgacaacaaaaaaaacaacaacgacgacgacgaagatctcagcttcctcgaggaatccgatgacgctgccaccacttctcaccaaggccattttccagatcccgacgagttcgacgaggacgacggcgacgacgaggacgacttcggcgacttcgctggcttcgaccactcgtcggaggaggcgttcaaggagcccgaggtggacgacaaggacgtcgtcgttttgaaggagcgcaacttcaccaccgtcgtcgagaacaaccgcttcgtcatggtcgagttctacgcgccctggtgcggccactgccaggccctcgcgccggagtacgccgccgccgccaccgagctcaagcccgacggcgtcgttctcgccaaggtcgacgccaccgtcgaaaacgaattggcgaacgagtacgacgttcagggtttccccaccgtcttcttcttcgtcgatggggtccacaagccctacactggccaaagaaccaaagacgctatagtgacatggattaagaagaagataggacctggtgtgtccaacattactacggtggaagaagctgaacgtgtattgaccgcgggaagcaaagttgttttgggcttccttaactctttggttggtgcagagagtgacgaactggctgcagcatcaaagcttgaggatgatgtcaatttttatcaaactgtggtagctgatgtggcgaagcttttccatattgatgcaagtgttaaacgccctgctttgatcttgctcaagaaagaggaggagaaattgaaccattttgatggccaatttgtaaaagctgaaatagctgattttgtaacctccaacaagcttcctttggttacaacttttactagagaaagtgccccggtaatctttgaaagtcaaatcaagaaacaattgttgctgtttgtgacttcaaatgatacagagaagtttgttccagtatttaaagaagcagcaaaaattttcaaggggaagctgatctttgttcatgtggaatcggataatgaagatgtaggaaagcctgttgcagattattttggtatcgcagggaatggtcccaaagtacttgcattcacaggaaatgatgatggaagaaaatttttgcttgatggagaggtgactattgacacaattacggcgtttgggaatgatttccttgaagacaagctaaaacctttcctcaagtcagatccagttcctgaaagcaatgatggtgatgtgaaaatagttgttggtaataactttgatgaaattgtcttggatgagtcaaaggatgttctgcttgagatttatgctccctggtgtggccactgccaagctctggaaccaacatacaacaagcttgctaaacatcttcgcagcattgagtctattgttatagccaagatggacggaacaacaaatgagcatcccagggccaaatctgatggattccccactcttctcttcttcccagcaggaaacaagagttctgaccctattcctgttgatgtggaccgtacagtgaaagacttttataagttcctcaggaaacatgcatcaatcccattccagctccagaaactagcctcaactactaaaaccgccagtgagagttctgatgtcaaggagagccaaagcagcaccaccgaagtgaaggatgaattatgagagataaaggatatttctatttataaagatatatgattcagacagatgataaccgagtgaaaaggtgcttagcaaagaaagtgacacaacgattgggagagaaagccgtctatttttcctcacccttccaaaagacaactagccaagtagagggtagtgaaaaaatgaggtaacctgtgtattagtttcttcaacttttacatgtttgagtattagaattttggttgagactttaattttaaaaatggctcgaaattttattgtatctgcagtcaattttattttcggtgtcagattatttggttatttttgcccttagtaggttaagctagttgataaaaaaattgaactttcattaaagaatgggtttgacatgcaaggcaaattgcatggattgtgttgttatttgcttgtacaaaagttattttaaatatttcacaaactaccgacaaaaaggcatttcataaa

SEQ ID NO: 8290 - DNA, 2185 bp, Medicago truncatula
ctgtcactaactttagtcaaaacccaaacaatctgaacccaaattccatttcagatcacaatgctataccataataaacgactcgtcgttttcctcttcctcaccactctccttctcatttcttcattctctttcactctttcagaaaaaacccaaaacaacgacgacgacgatgaagatctcagcttcctcgaagaaccagaagacaccaccaccacccaccacgaccacgctgatttcccagatcccgataacttcgacgacgacgacgaaggcgatgacggcgacgaattcggcgatttctccggttacgatcctcactccgatgaagacttcaaggaaccagaagtggatgagaaagatgttgtcgttttgattgagcgaaacttcactaccgtaattgaaaacaaccaattcgtgatggttgaattttatgctccgtggtgtggacattgtcaagctttggcgccagagtatgctgcggcggcgacggaattgaagaaagatggtgttgttttggctaaggtggatgcttcggtggaaaatgaattggcttatgagtataatgttcagggttttcctactgtgtactttttcatcgatggagttcataagccttacaatggccaaagaactaaagatgctatagtgacatggatcaagaagaagacaggacctggtgtatacaacataactacattggatgatgctgaacgcatattgacttctgaaactaaagttgttttgggattccttgactccttagttggtgctgaaagtgacgagctagctgcagcatcaaaacttgaggatggtgtcaatttttaccaaaccgtgattcctaatgtggctaagcttttccatattgacccagatgtcaagcgccctgctttggtcttgctcaagaaagaggaggagaaacttaaccattttgatggccaatttgtaaaagcagaaatagccaactttgtatcatccaacaagcttccgttggtcaacatttttacaagggaaagtgctcccgtgatttttgaaagtccaatcaagaaacagttgttgctgtttgtgacttcaaatgatacagcgaagttcatcacagtatttcaagaagcagcaaagcttttcaaggggaagctgatctttgttcatgtggaaatggataatgaagatgttggaaagcctgttgcagattattttggtctttctggaaatactcccaaagtacttgcattcacaggaaatgaggatggcagaaaatttttgcttgatggagaagtgaccattgacaatattaaggcatttggggaagatttccttgcagacaagctaaaaccttttatcaagtcggatccaattcctgaaagtaatgatggtgatgtgaaaatagttgttggcaataacttcgacgaaattgtcttggatgagtcgaaggatgttctacttgaggtttatgctccttggtgtggccattgccaagccttggaaccaacattcaacaagctcgcaaaacatcttcatagcattgaatctattgtagtagccaagatggatggaacaacaaatgagcatcctagggcaaagtctgacgggttccccactcttctcttctaccctgcaggaaaaaagagttctgaccctattactgttgatgtggatcgtacagtcgtggctttttacaagttcctcaagaaacacgcatcaattccattccaactccagaaaccaaccacaacttctaaaaccaatgatagtgggagttctgacatcaaggaaagtcagagtagcatcacagatgcgaaagatgagttatgagagctaaaggaaacttctatttatgaagaggttcgacagatgacaagagtagagtgactagctgctcagcaaagaaaatagcacaatgactgagtgagaaaaatcgtctattttccctaacctgcccaaaagagacagataagaaaatggtagtggaaaaatgatattgatatttacctgtgtattagtttcttcagctttaaatgtttttgtattagaattttgtgagactgagttgaatgaaatagagtccaaagttttactttatcagcggtttgtttatttttttgtattagttattggtactttttttcttaatttaagcttggtagttgataaaactttatttagtaggtaaggtaaataataatcg

SEQ ID NO: 8291 - DNA, 1978 bp, Glycine max
cagcccgcagttgaaagtcaaccaagttctcgtagcacacactcacacactcagatctctcttctctttctgcaattccattgttgttctcttcactctcacaatgcgaatcctcgttgtgctctctctcgccaccctcctcctcttctcctccctctttctcaccctctgcgacgacctcaccgacgacgaggacctcggcttcctcgacgagccctccgccgcgccggagcacggccactaccacgacgatgacgccaatttcggcgacttcgaggaggacccggaggcgtacaagcagcccgaggtggacgagaaggacgtcgtcattttgaaggagaagaacttcaccgacaccgtcaagagcaaccgcttcgtaatggtcgagttctacgcgccctggtgcggccactgccaggccctcgcccccgaatacgccgccgccgcaacggagctcaagggcgaagacgtaattttggcgaaagtggatgccacggaagagaatgaattggcgcagcagtatgatgttcagggtttccctactgtctacttcttcgttgatggcattcacaagccttataatggccaaaggaccaaagatgctataatgacgtggattaagaaaaagatcggacctggtatatacaacttgactacagtggaggatgctcaacgcatcttgaccaacgaaactaaagttgttttgggcttcctcaactctttagttggtcctgagagtgaggagcttgctgctgcttcaagacttgaggatgatgtcaatttttatcaaactgtggatcctgatgtggcaaagcttttccatattgacccagatgttaagcgcccagctttgatcctcgtcaagaaagaggaggaaaaacttaaccactttgatggcaaatttgagaagtcggaaatagcagactttgtcttctccaacaagcttcctttggtaacaatttttacaagagaaagtgccccatcagtcttcgaaaatccaatcaagaaacagttgttgctgtttgcaacttcaaatgattcagagaagttgatccctgcatttaaagaagctgcaaaatctttcaagggaaagttgatctttgtatatgtggaaatggataacgaagatgttggaaagcctgtttcagaatactttggtatcagtgggaatgctccaaaagtacttgggtacactgggaatgatgatggaaaaaaatttgtgcttgatggagaggtgactgctgacaaaattaaggcatttggggacgatttccttgaagacaagctaaaacctttttacaagtcagatccagttcctgaaagtaatgatggtgatgtgaaaatagtagttgggaataattttgatgaaattgtcttggatgagtcaaaggatgttctcctcgagatttatgctccctggtgtggccattgccaagcactggagccaatatacgacaagcttgcaaaacatcttcgtaatattgagtctcttgtaatagccaagatggatggaacaacaaatgagcatcccagggctaagcctgatggatttcccactctcctcttcttcccggcaggaaacaagagttttgaccctattactgttgatacagatcgtacagtggtagccttctacaagttcctcaagaaacatgcatcaatcccattcaagctccagaaaccaacctcaacttctgatgccaaggggagctctgatgccaaagagagccagagtagtgatgtgaaggatgaattatgaggagttaagtgatatatttttatttattgaaactgattcagacagatgatgacatggtgactgagggagaaaataccaagctgcttctctcccctagccaataaaaacaaacgaggagtggggggaaggagacaaatgcgaggcacatatgtattactattaacttaaatttttacaactgggcattttagaattttgggttgagacttcaataaattc

SEQ ID NO: 8292 - DNA, 2102 bp, Glycine max
tgttccgctctcagttgaaagtcaacgaagtctcacagcacactcagatctctcttctctttcttcaattccattgttgtttggttcccttcactctcacaatgcgaatcctcgtcctgctctctctcgccacccttctcctcttctcctccttctctcccaccttctgcgaccacctcgccgacgacgaggacctcagcttcctcgacgagccctccgccgcgccggagcacgaccaccactacggcgccgatgactccaatttcggcgactttgaggacttcgaggaggacgacgcggaggcgtacaagcagcccgaggtggacgagaaggacgtcgtcgttttgaaggagaagaacttcaccgacgccgtcaagaacaaccgcttcgtcatggtcgagttctacgcgccctggtgcggccactgccaggccctcgcgccggagtacgccgccgccgcgacggaactcaagggcgaagacgtaattttggcaaaggtggatgccaccgaggagaatgaattggcgcagcagtacgatgttcagggtttccccactgtccacttcttcgttgatggcattcacaagccttataatggccaaaggaccaaagatgctatagtgacgtggattaggaagaagatcggacctggcatatacaacttgactacagtggaggaggctcaacgcattttgaccaacgaaactaaagttgttttgggcttcctcaactctttagttggtcctgagagtgaggagcttgctgctgcttcaaggcttgaggatgatgtcaatttttatcaaactgtgaatcctgatgtggcaaagcttttccatattgaccaagatgttaagcgtccagcattgatcctcattaagaaagaggaggaaaaacttaaccactttgatggaaaattcgagaagtcagcaatagcggactttgtcttctccaacaagcttcctttggtaacaatttttacaagagaaagtgccccatcagtctttgaaaatccaatcaagaaacagttgttgctgtttgcaacttcaaatgattcagagactttggtcccagcatttaaagaagcagcaaagtctttcaagggaaagttgatctttgtatatgtggaaatggataacgaagatgttggaaagcctgtttcagaatactttggtatcagtgggaatgctccaaaagtacttggatacactgggaatgatgatggaaaaaaatttgtgcttgatggagaggtgactactgacaaaattaaggcatttggggaagatttcgttgaagacaagctaaaacctttttacaagtcagatccagttcctgaaagtaatgatggtgatgtgaaaatagtagttggtaataattttgatgaaattgtcttggatgagtcaaaggatgttctcctcgagatttatgctccctggtgtggccattgccaatcactggagccaatatacaacaagcttgcaaaacatcttcgcaatattgattctcttgtaatagccaagatggatggaacaacaaatgagcatcccagggctaagcctgatggattccccactcttctcttcttcccggcaggaaacaagagttttgaccctattactgttgatacagatcgtacagtggtagccttctacaagttcctcaagaaacatgcatcaatcccattcaagctccagaaaccaacctcaacttctgaatccgattccaaggggagctctgatgccaaagagagccagagtagtgatgtgaaggacgaattatgaggagttaagtgatatatttttatttatagaaactatgattcagacagatgatgacatagtgactgaggtaaaaaataccaagttacttctcacccctggtcaataaaaaacaaacggggagtggggggagagagacaaatgcgaggcacacatgtattactattaacttcaatttgtacaacagtgggtaatttagaattttgattttgggttgagacttcaataaattcccccttaaattccacttttttcctccgcacttgtgtaatactccataaacaaagttgcattgcatgtatcgtagatctacttgatacgcgttaa

SEQ ID NO: 8293 - DNA, 2043 bp, Glycine max
gtcaagaccgacaactcatgttagtgaattaatttactcactatactaactcctaactccaacttcagctacattctcccggcgtttcgatcgatcttgatcccaattcccatctacacacatatcacaatgctaagtcgtaaacgactcatcgtttcgctctctctcgccactctccttctcttctcctccctttccctcactctctgcgataaaatcccccctcaaaacgacaacaacaacgatgacgacgaagatctcagcttcctcgaggaacccgatgacgccgccgccacttcgcaccacggccattttccagatcccgaccggttcgacgaggacggcgacgacgacggcgacttcggcgacttctcaggcttcgaccactcgacggaggaggcgttcgaggtggatgacaaggacgtcgtcgttttgaaggagcgcaacttcactaccgtcgtcgagaacaaccgcttcatcatggtcgagttctacgccccctggtgcggccactgccaggccctcgcgccggagtacgccgccgccgccaccgagctcaagcccgacggcgtcgttctcgccaaagtcgacgccaccgtcgaaaacgaactggcgaacgagtacgacgttcagggtttccccaccgtcttcttcttcgtcgatggggtccacaagccctacactggccagagaaccaaagacgctatagtgacatggattaagaagaagatagggcctggtgtgtccaacataactacggtggatgatgctgaacgcatattgacagctgaaagcaaagttgttttgggcctccttaactctttagttggtacggagagtgacgaactagctgcagcatcaaagcttgaggatgatgtcaatttttatcaaactgtggtagctgatgtggcgaagcttttccatattgatccgagtgttaaacgccctgctttgatcttgctcaagaaagaggaagagaaattgaaccattttgatggccaatttgtaaaagctgaaatagccgattttgtaacctccaacaagcttcctttggttacaatttttacaagagaaagtgccccggtaatctttgaaagtcaaatcaagaaacagttgttgctgtttgtgacttcaaatgatacagagaagtttgttccagtatttaaagaagcagcaaaaaaattcaaggggaagctaaaacctttcctcaagtctgatccagttcctgaaagtaatgacggtgatgtgaaaatagttgttgggaataactttgatgaaattgttttggatgagtcaaaggatgttttgcttgagatttatgcaccctggtgcggtcactgccaagccctggaaccaacatacaacaagcttgctaaacatcttcgcaacattgagtctattgttatagccaagatggacggaacaacaaatgagcatcccagggccaagtctgatggattccccacccttctcttcttcccagcaggcaacaagagttctgaccctattcctgttgatgtggatcatacagtgaaagccttttataagttcctcaggaaacatgcatcaatcccattccagctccagaaaccaacctcaactgctaaaaccgggagtgagagttcctatgtcaaggagagccaaagcagcagcacggatgtgaaggatgaattatgagacttaaaggacacttctattgataaagagatatgattcagaaattcagacagctgataacggagtgaaaatgtgcatagcaaagaaagtgactcaatgattgggagagaaagccgtatatttttcctcaccctggccaaaagacaactagccaagtaaagggtagtggaaaaataaggtaacctgtgtattagtttcttcaacttttacatgtttgagtatcagaattttggggagactaattttaaaaatggctcgaaattttattttcggtgtcagaatactggttatttttgcccttaggttaagctttagttgataaaaattgttgaataataaataaaaaaatgaactttcattagagaa

SEQ ID NO: 8294 - DNA, 1749 bp, Glycine max
attgtctctttcatttttttttctcaacttctctctttctttctctggctcttaaaaatgggcacaccaaacccaactcaaccaaacgatgggccctgacccactccgccggcaatgggaaagcccggagaagaccacctctctctgccctccgccgaggatccgcggcggaatgcggcggcggcgtctggatgcgccgtgggactccgatgcctcgtcgtcttgcttttctcggtcgcggttttcctctccgcactcttctggctacccccgttcgctcacttcgcagatcccaaggatctgtatttaaattcaaagtacaaagatcatgatattgttgcaagcttttatgtgcagaagccagtttctttgctagaagacaacatcttgcagctttctaatgacatttttgaagagataggagctccctctaccaaagtgatcatcttgtctctagatcccttaccacggtcaaacacgacaaaagtggtgtttgcagttgatcctgatggtaaatattcagaaatgtctgcagctgccattagtttgataagagcatcatttaaatacctggttatacgccaatcatatctccagctcactacattcttgtttggtgttccctccgtttttgaggtgctgaaatttaagggagggattactatcattccacaacagagtgtgttccctctgcaaacagtgcaaacattattcaactttactttgaatttctccatttatgaaatacaatcaaattttgatgagctgacaagtcagctaaagtctggactacatttggcaccttatgagaacttgtatgtcatattatcaaattctgaaggttctacagtagttgctcctactgttgtccaatcatctgtcctacttgcagttgggattccaccatcaaaggaaaggctaaagcaactggcacaaaccataatgggacatcattcatggaacctcgggttgaataacactcaatttggtagggctaagcaggttcgactttcatcgatcttgcaacactcccttcatggcagtggtggtagtggctcgccttccccttcccctctgccttatccccatcatcactaccaccatcatcatcaccaccaaagtcaccaccacaacacccatgtatttcctgaaacttcacctgcacctacacctacaactggggaaggtgctactttacacaattttggtgctccagcccctgcaagaagtgtgcctgccccagggagaagttcttatgctcagcctcctaattgtcgatttgcgcatgtaacacctgcagctccccctactactgctccacactatcctgttgcctcaccatgggttggacccccagcacatggctttgattcttcggttcctgctttgagtcctttaccaaatgtagcatttgcacatgctgaaccccctcctaagaatgaagcagctgctgagcatctgaactctcattttcatggaccatcaccatcttcatcttctgcaggttgtgctgggactgtcaaatggacatctttaatgtttttagtacttgtattactagtataaacaagttctgaaagtgagctataaaaggtgggtgagctaggcaaaggctggcttcacatctggagtggatacaagttatcattaagagtgtaaatagttggacgaattctaccgggcgaaagttaaacattttttgcacggtacgaaagtaaatttgggtcgtcagatcatttcagttttaaa

SEQ ID NO: 8295 - DNA, 2017 bp, Glycine max
atgggaaagcccggagaacaccaccttctgccttccggtgtcgccgccgaggatccgcggcggaatgcggcgtctccgccgggatgcgccgtcggattccgatgcctcgtcgtcttgcttttctcggtcgcggttttcctctccgcactcttctggctaccaccgttcgctcacttcgcagatcccaaggatctgcatataaattctaagtacaaagatcatgatattgttgcaagcttttatgtgcagaagccagtttctttgctggaagaaaacatcttgcagctttctaatgacatttttgaagagataggggttctctctaccaaagtggtcatcttatctctggatcccttaccacagtcaaacacgacaaaagtggtgtttgcagttgatcctgatagtaaatattcagaaatgtctgcagctgccattagtttgattagagcatcattcaaatacctggttatacgccaatcatatctccagctctctacatccttgtttggtgttccctctgtttttgaggtgctgaaatttaaaggagggatcactatcattccacaacagagtgtgttccctctgcaaatggtgcagacattattcaactttactttgaatttctccatttatgaaatacaatcaaattttgatgagctgacaagtcagctaaagtctggactacatttggcaccttatgagaacttgtatgtcatcttatcaaattctgaaggttctacagttactgctcctactgttgttcaatcatctgtcctacttgcagttgggattccaccatcaaaggagaggctaaagcaactggcacaaaccataatgggacatcattcatggaaccttgggttgaataacactcaatttggtagggttaagcaggttcgactttcatctatcttgcaacactcccttcatggcaatggtggtaatggttcaccttcccctgcccctcagcctcatccccatccccatcctcaccaccatcaccaccaccaccatcatcatcaccaccatagtcaccaccaccatgcccacgtatttcctgaaacttcacctgcacctgcacctacacctacaactggggaaggttctacttcacacaattttggtgcccctgctgcccctgcaagaagtttgcctgctccatggagaagttcttatgctcaacctcctaattgtcgatttgagcatagaaagagatctccccggaatagtcaaaaacatgctcatctaacacctgcagtttcccctactaatgctccacactatcctgttgcctcaccatgggttggacctccagcacatggctttcattcttcggttcctgctttgagtcctttaccaaatgtagcatttgcacatgctgagccccctcctaagaatgagccatctgctgaacgtcctaactcacattttcaagggccatcaccatcttcatcttgtgcaggttgtgttgggactgtcaaatggacatctttaatgtttttagtacttgtattacttgtataaacaaattctgaaggtgagctacgcaaaggctagcttcacatctgagtggatacaagttgtccgtaagagtgtaaatagttgattgaaaaagatccaagatcaaatgtaccctttaaaaaagggaaaaagaaaaaaaatccagacagtgcatgagtattcaggtcaaagtctacaagtgacaggccttgattatatgcatcactgctgttctgtaacgttagatggaaaaaggaaatgaaaggaagagatttttttttataacaatttcccgtttggttctcatggcttatacttgattttgtatggttcactaagccagctaaagatgttggcctagctagacaagggttattgctttgggcatcagttgaattgctggtacccccagtaaattttgtaaatcccagtgttatcccttcctattataacttcctgagttgaattgctggtacacccagtaaattttgtaaatttcaatattatccctctctta

SEQ ID NO: 8296 - DNA, 1633 bp, Glycine max
atgggaaagcccggagaacaccaccctctgccctcctactccgccgccgaggatcagcggcggaatgcggcgcctccgccgggatgcgccgtcggactccgatgccttgtcgtcatgcttttctcggtcgcggttttcctctccccactcttctggctaccacctttcgctcacttcgcagatcccaaggatctgcatttagattctaagtacaaagatcatgatattgttgcaagcttttatgtgcagaagccagtttcattgctagaagacaacatcttgctactttctaaggacatttttgaagagataggggttccctctaccaaagtggtcatcttgtccctagatcccttaccacggtcaaacacgacaaaagtggtgtttgcagttgatcctgatggtaaatattcagaaatgtctgcagctgccattagtttgataagagcatcatttaaatacctggttatacgccaatcatatctccagctcactacatccttgtttggtgttccctctgtttttgaggtgctgaaatttaaaggagggatcactatcattccacaacagagtgtgttccctctgcaaacggtgcaaacgttattcaactttactttgaatttttccatttatgaaatacaatcaatttttgatgagctgacaagtcagctgaagtctggactacatttggcaccttatgagaacttgtatgtcatcttatcaaattctgaaggttctacagttactgctcctactgttgttcaatcatctgtcctacttgcagttgggattccaccatcaaaggagaggctaaagcaactggcacaaaccataatgggacatcattcatggaaccttgggttgaataacactcaatttggtagggttaagcaggttcgactttcatctatctggcaacactcccttcatggcaatggtggtaatggctcaccttcccctgcccctcagcctcatccccatcctcaccaccatcaccaccaccaccaccaccatcaccatcaccatcaccaccatagtcaccaccaccatgcccacgtatttcctgaaacttcacctgcacctgcacctacacctacacctacaactggggaagattctacttcacacaattttggtgcccctgctgcccctgcgagaagtttgcctgctccatggagaagttcttatgctcaacctcctaattgtcgatttgagcatagaaagagatctccccggaatactcaaaaacatgctcatctaacacctgcagtttcccctactaatgttccacattatcctgttgcctcaccaggagttggacccccagcacatcatggctttcattctttggttcctgctttgagtcctttaccaaatgtagcatttgcacatgctgagccccctcctaagaatgattcatcagctgaacgtcctaaatcacattttcaatggccatcaccgtctttttcttctgcaggttgtgttgggactgtcaaatggacatctttagtgtttttagtagtcgtattacttgtataaacaatttctgaaggtgagctacgcaaaggctagcttcacatctgagtggatacaagttgtcattaagagtgtaaatagttgattaaaaagatcc

SEQ ID NO: 8297 - DNA, 1347 bp, Glycine max
gaagcaaattcatttcattcaattcaatgtaaaaaaacacagtagccacccaatacataaaatttgtttatgctttctacacgcacttcctccttcgtatccgtctcttccccaaccattggaatacattccttaacccaccgcaaatccaaatccaaattcaattcgagctgaacctagggtttgttccttcctattgccttcacggatctcgcattctcctcaaatttccgaaacgggaaaaagaaaatgcacgcgaaatcggcgcagtcgtcgttccgggatcggactcaggaattccacagcatcacagagaggttgaagaagtccggatcagggcccaatgggcccagcagcagcacttcttccaccagatcggaggaacagcgatccgcgatcgccaaccaatcggagttcaatagaagggcctccaaaatcggatacggaattcaccaaacgtctcagaaactcgccaaactcgccaagttggcgaagaggacgtcggtttttgatgaccctactatggaaatccaagagcttacgggggttattaagcaggatattactgctctgaactctgccgttgtggatcttcagtttctgtgtaactctaggaatgagagtgggaatgtttccgccgacaccactagccattcgagcactgtggtcgatgacttgaaaacacggttgatgagcaccaccaaagagtttaaggatgttctcaccatgagaactgagaacatgaaagtgcatgagaatagaagacagttgttttcatcttctgcatctaaggattctgcaaatccttttattcggcaacggccgttggctgcaagggcggctgctagtacttctaatgcccctgctcttccctgggctaatgggtcaccatcttcatctcaggcgtttcctaagaagcaagtggatggggagagtcaaccattgttgcaacaacagcagcagcagcaggaggtagttccattgcaagacagttacatgcaaagcagagctgaagctcttcagaatgttgagtccactattcacgagcttagcaacatttttaatcagcttgcaacacttgtttcccaacaaggagagattgccatcaggattgatgaaaacatggacgatacattggcaaacgtagagggagcacaaggggctttgctgaagtatctgaacagcatatcttctaatcggtggttgatgatcaaaattttctctgtgttaatatttttccttatggttttcttattttttgtggcatagtcatttaggtgacagaaatgaaaacaatgacacgagtgtcggcattctgtatttctttaatatttatttctccaaata

SEQ ID NO: 8298 - DNA, 1325 bp, Glycine max
acactcacatatcctccttcgtatccgtgtcttccccaaccattccttaacccaccgcaaattcaaattcaattcgagctgaacctagggttagtcctattgccttcaccgatctcgaatttcggaaacggtaaaagaaaatgcacgtcaaatcggcgcagtcatcgttccgggatcggacacaggaattccacagcatcacagagaggttgaagaagtccggatcagggcccaatgggcccagtagtagcagcacttcttccagatcggaggaacagcgatccgcgatcgcgaatcaatcggagttcaatagaagggcctccaaaatcggctacgggattcaccaaacgtctcagaagctcgccaaactcgccaaattagcgaaaaggacttcggtttttgatgaccctactatggaaatccaagagcttacgggggttattaagcaggatatcactgctctgaactctgctgttgtggatcttcagttggtgtgtagctctaggaatgagactggaaatgtttctgccgatacctctagccattcgagcacggtggtcgatgacttgaagacacggttgatgagcaccaccaaagagtttaaggatgttttgaccatgagaactgagaatatgaaagtgcatgagaatagaagacagttgttttcgtcttctgcttctaaggattctgcgaatccttttattcggcaacggccgttggctgcaagggcggctgctagtacttctagtgcccctgctcttccctgggctaatgggtcaccatcttcatctcaggcgtttcccaagaagcaagtggatggggagagtcaaccattgttgcaacagcaacagcagcagcaggaggtagttccattgcaagatagttacatgcaaagcagagctgaagcacttcagaatgttgagtccactattcatgagcttagcaacattttcaatcagctagcaacacttgtttcccaacaaggagagattgccatcaggattgatgaaaacatggatgatacattggcaaacgtagagggagcacagggggctttgttgaagtatctgaacagcatatcttctaatcggtggttgatgatcaaaattttctttgtattaatatttttccttatggttttcttattttttgtggcatagtcatttgggtgacagaaatgaaaacaatgacatgagtgtcggcgttctgtatttctttaatatttatttctccaaatatatatattcattcttgcagagttaacttaagaccaagtttgtcaaataaatatacttgttaagaaccgtgttcacgactattatact

SEQ ID NO: 8299 - DNA, 1505 bp, Glycine max
agcagcaaaagacgaagcagttaacatgagtgtgagggtaaaatgtccaaaatccgaatagagcaacaaggtgctgctcttgctttgtgcaacgcaccatttccataactccttacaccacacctcctcctcgtttatccattcccccatctacaacagctaatgcgatccaattccaattagatctagggtttctctttccctcgccggagaacaacaccgattttccggcgctggcttcacggatctcgcatcactgtttgataatacattggcaaaatgtacaccaaatcggcgcagtcatcgtttcgggaccggacacacgaattccagagcattgcggagaggttgaagaagacaggatcagcgccaaatggacaaagcagcagctcatccagatcggaggaacagcgatcggcgattgcaaatcaatcagagttcaacagaagagcttccaagatcggcttggggattcaccaaacgtctcagaagctcgccaagctcgccaagttggcgaaaaggacttcggtttttgatgaccctactatggaaatccaagagcttacgggggttattaagcaagatatcactgctctaaactctgcggttgtggatcttcagttactctgcaactctaggaacgagagtgggaacgcttctaccgacacgactagccattcaaccacggtggttgatgacctgaagacaaggttgatgagcaccactaaagagtttaaggatgttctcaccatgcgaactgagaacttgaaagtgcatgagaatagaaggcagctgttttcggccaatggttctaaggactctgcaaatccttttgtccggcaacggccgttggctacaaggtcggctgctaatacttctaatgcccccgctccaccatgggctaccgggtcatcttcatctcagttgtttcctaagaagcaggtagatggggagagtcaaccattgctgcaacagcagcagcagcagcagcaagaggtagttcccttgcaagacagttacatgcaaagcagagctgaagctcttcagaatgttgagtccaccattcatgagctcagcaacatctttaatcaactagcaactcttgtttcccaacaaggagagattgccatcaggatcgatgaaaatatggatgatacactggcaaatgtagagggggcgcaaggggctttgttgaagtatctgaacagcatatcttctaataggtggctgatgatcaagattttctttgtattaatattttttcttatggttttcttattttttgtggcatagtcattctaatgacagagaaatgaaaacgaggacacatatgacgcccttattactggtgataagccttttgtatttcattaatatttctttctccaaatctatattcattctggcagagtttagcgtaggaccaagtttgtcaaattttatacttgtacgtatcgatacatataacgaggttaagaactatgtgaattgtgtattgtccatcc

SEQ ID NO: 8300 - DNA, 1489 bp, Vitis vinifera
gacgctttttatattttacaaattttattttatttcctcgtttttcaactatcacactcgcattggttggaactcgggatccagatctagagtttcatctgtgcgtttcattcggtttcgagctgaattttgtgaaggaagttcggttttgttcgtggtggtgagatctggcatttttggtggattattcgggcttgatttttaggttggtcgtggaaaatatctgggtctgctcaaaatgcctgtgaaactgcagcaatcatcatttcgagatcggacgccagagtttcttaatgtggcggagaggctgaagaagtcattctcgtcaactcagaatggggcaaatagtgcttcaaaagcagaggaacagcgctttgcagttgcaatgcagtcagagtttaacaaaagagcttcaaagattgggtttggaatacatcaaacatcgcagaagctttcaaagcttgcaaaattggctaaaaggacttcagtttttgatgatcccaccatggaaatccaagagctgactgcagttataaagcaggatattactgctctgaactcagcagtagtagatcttcagcttctcagcaactccagaaatgaaagtgggaatatctccagtgacaccaccagtcattcgaccacagttgttgatgacctgaaaaaccgcttgatgagcgccacaaaggagttcaaagaagttctcactatgcgaacagagaacttgaaggttcatgagaacagaagacagttgttttccactgcttcaaaagattctacaaatccttttgttcgtcaacgtccattggctaccaggtctgctgctagtgcctcagcaagccctcctccatgggctaatggatccccatcttcatcccagttatttcccaggaagcagattgatggagagagtcagccactgatacagcagcagcagcagcagcagcaacagcaacaacagcagttggttccattacaagacagttacatgcagagcagagcggaagctcttcaaaatgtggagtctacaattcatgagttgagcagcatcttcaaccagctggcaacactggtttctcagcaaggcgaacttgctatcagaatcgatgagaacatggatgacacgctggcgaacgtggaaggggcgcaaggggctttgctcaagtatctccacagcatatcatctaataggtggttgatgatcaaaatattctttgtattgatttttttcctcatggttttcctattttttgtggcataattcatggtggaaactgagatataaaaatgaaaatgagagaaaatgagaaatcctattacgggtatacaccaattattcttttgtgcccccttccttccttggagtgagtatttgtgcacgttcaaatgagattattgtgcagtttgccttttgttgtataagcatgtccctgtacttgtaagagctgttcaaaccggtgaaatatcatatttattattttcctcacta

SEQ ID NO: 8301 - DNA, 1590 bp, Glycine max
acaaaatgacgaagcagttaacatgagttcctatccagcgatgtcggggtaaaatgtacaaaatcgaaagaggaacaaggtgcttcgctgctattgctttctgcaatgcaccttttttcatttccataactctttacagttacaccacgcctcctcctcctcctttagccattcccctatccacaacagctattccaattagatctagggtttcctcttcctcactattcaccatccctcgccggagaacaacaccgattttccggcgccggcttcacggatctcgcatcagcgtctgatacattggcaaaatgcacaccaaatcggcgcagtcatcgtttcgggatcggacgcacgaattccagagcattgcggagaggttgaagaaaacagggccagcgccgaatggacaaagcagcagttcatccagatcggaggaacagcgatccgcgattgcaaatcaatcggagttcaatagaagagcttccaagatcggcttcgggattcaccaaacctctcagaaactcgccaagctcgccaagttggctaagaggacttcggttttcgatgaccctaccatggaaattcaagagcttacgggggttattaagcaagacatcactgctctaaactctgcggttgtggatcttcagttactcagcaactctcggaacgagagtgggaacgcttctaccgacacgactagccattcgaccacggtggttgatgacctgaagacacggttgatgagcgccaccaaagagtttaaagatgttctcaccatgcgaactgagaacttgaaagtgcatgagaataggaggcagctgttttcggccactgcttctaaggactctgcgaatccttttgtccggcaacggccgttggctacgaggtcggctgctagtacttctaatgcccccgctgcaccttgggctactgggtcatcttcatctcagttgtttcctaagaagcaggtggatggggagagtcaaccattgctgcaacagcagcagcagcagcaagaggtagttccattgcaagacagttacatgcaaaacagagctgaagctcttcagaatgttgagtccactattcatgagctcagcaacatctttaatcaactagcaactcttgtttctcaacaaggagagattgccatcaggattgatgaaaacatggatgatacattggcaaatgtagagggggcgcaaggggctttgttgaagtatctgaacaacatatcttctaataggtggctgatgatcaagattttctttatattaatattttttcttatggttttcttattttttgtggcatagtcattctaatgacagaaaaatgaaaacgaggacacacatgacgcccttattgctggtgataagcgttttgtatttcattaataatatttctttcttcaaatctatattcatttcgacagagtttagcttaggaccaagtttgtcaaattttatacttgtacgtatcgatacatataacgaggttaagaactatatgaattgcatgttgtccatttatctttctgtgaatgatgatttttatccagtgttaactttctgtaatatttat

SEQ ID NO: 8302 - DNA, 1546 bp, Vitis vinifera
ttggaatcatttcatcttcaaagcaaatcgcaatttccccgaaacactatgcagatccactctgctctcttcaattcataatttgcgtgctagctaagtctttcctctcaaatttacaaatcctaaacactcctccaaccagatctagggttagggtttcagatctcggcattttcactctgatcgccctcgtattgatgcaattgtatacgatttggccttccttttgaaatgtccatgaagtcagcgcagtcgtcttaccgcgatcgaacgcaagagtttctgaacgttgccgagaggctcaagaagtcattctcttcggctgcgccgaatgcggtgaccagtagtggcgcgaagcccgacggaacgcgatcttcgctcgctattcagaaggaattcaaagacagggcttcgcggattggatatgggattcatcagacctcgcagaagctcgccaagctagcgaaattggcaaagaggacatcagtttttgatgatccaacaatggagatccaagaattgacagctgttgtcaagcaggatattactgcactaaatgcagctgtagtggacctacaactcctttgtaactcccaaaatgaaagtggcaacatctcaagcgacacaacctcccattcaacaacagttgtagatgacttaaaaaatcgcttgatgagcgcgacaaaggagttcaaagatgttctcaccatgcgaacagagaatttaaaggttcatgagaacagaaggcagttgttttcttcaactgcttcaaaagagtccacaaatccttttgttcgccagcgtccattggctgcaaaatcaactgctactgcatcatcatcccctcctccttgggccaatgaatcttcatcctcatctcccctctttccaaggaaacagggaaatgtggaatctcaaccattgctgcagcagcagcagcaacaacaacagttggttcctctgcaagacagttacatgcagagccgagctgaagctcttcaaaatgtggagtcaaccattcatgagcttagcaacatcttcacacaactggctactatggtttcacagcaaggagagcttgcaatcaggattgatgagaacatggaggatacactggcaaacgtggaaggagcacagggacaactggtccggtaccttaacagcatatcatccaatcgatggttgatgatcaagatattctttgtattgattgtatttcttatgattttcttattttttgtggcataagaatatttttaaaaaataggaaaataaagggaacaatagagcatttccttttttactttttgcaattgctccttcatagaaaatggggaatgccctccaagaaaaaagtgttatactttatctaagaaaaagaggtcaaattttgatgtgccgatgctcctaattagagaggttgtcatcctattattgaaaaagtgggagccatcatcatcattatcattggtattattatcattgacaaatgaatctgatggtgtaaattctgtttcctgttcaatgacattgtttttgcctcgtt

SEQ ID NO: 8303 - DNA, 1431 bp, Medicago truncatula
gacaaatgtgtatctgatttaaagttttaataaacaatcatgaaagctggatcttccatttccaaatcctaaattcgttacctccttctcccccttcgtaatcgttacccaaacaaagttttcataattttgttatatcctcaatcaatcgaccccaaattccaattctaattagatctagggtttcaatttcctcaaagatgcagttcaaatcatcacaatcatcatttcgagatcgtacacatgaattcctcaccgttgcagagagattgaagaaatcagtttcatctggatcagctccaaacggagccaccaccagtgctccttcttcctctttcccttcttcttccagatccgacgatcctcgatctgccgttgcaattcaatccgagtttaatcgaagagcttccaaaatcggttatggaattcaccaaacttctcagaaactttccaagctcgccaaattggcgaaaaggacttcggtttttgacgatccaacaatggagattcaagaattaacaagtgttattaagcaagatattactgcgcttaactctgcggttgtggatcttcaattaatcagtaattctagaaatgagagtggaaatgtttctaccgacactactagtcattcaactactgtcgtggatgacctaaagacgcgattgatgagcactaccaaggaatttaaagatgttcttaccatgcgaactgagaatttgaaagtgcatgagaatagaagacaattgttttcggcgaatgcttctaaggattctgccaatcctttcatccgtcaacgtcctttagctacaaagtcggctgctagtacttctagtgcccctgcacctccatgggctagtgggaagcaggtggatggagagagtcaaccgttgttgcagcagcagcagcagcaggtagttccattgcaggacagttacatgcaaagcagagctgaagctcttcaaaatgttgagtccactattcatgagctcagcaacatctttaatcaactagcaacacttgtctcccagcaaggggaggttgccataaggattgatgagaacatggatgatacgttggcaaatgtggagggggcacaaggggctttgttgaagtatttaaatagcatatcttctaataggtggctgatgatcaagattttctttgtattgatgtttttcctcatggttttcttattttttgtggcatagtcgttccagagacaaaattgaccaggaggatacacaccattcttactggtgataagccttttgtatcccattaccatttctttctccaaatatatattcgttatgaccatctagctttggaccaactttgtcaaattttatacttgtacgtaatgatgcatataacgaggctaagtactgtgtgcattgcatttgtgatgatgattatattgaatctatc

SEQ ID NO: 8304 - DNA, 3591 bp, Glycine max
agtgaaaatgtctacctcaaggcctagccaatcatccagcaattcaaggagatcaagacatagtgctagaatggctcaggcaactgtagatgcaaaaatccatgcaacttttgaggagtccggtagttcctttgattactccagttcggtgcgcgtctctggtacagctgatggagtcaatcaaccaaggtctgacaaagttacaacagcttacctcagaggcaagatgattcagccttttggttgcttgttggccattgatgagaaaaatcacatgcagacatgtaaggtcattgcatacagtgagaacgagcccgaaatgctgaccatggttagccatgctgtccccagtgttggtgaccaccctgcccttggcattggcactgacataaaaactctattcactgcaccaagtgtttctggattgcagaaggctctaggatgtgcggacgtttcgcttcttaaccccatacttgtccattgcaagacctctgggaagcccttttatgcaattgtccatcgcgtcactggtagtttgattgttgactttgagccagtcaagccttatgaagttcccatgactgcagcaggtgccttgcaatcttacaagcttgctgccaaagcaattacccgattgcaatcattgcctagtgggaacatggaaagactatgtgatactatggttcaggaagtttttgaactcacaggttatgatagggtgatggcttataaatttcatgaggatgatcatggagaggtgattcgtgagataacaaagccctgtcttgagccatatctgggtttgcactatccagccaccgacattccccaggcttcacgctttttatttaggaagaacaaggttcgtatgatagttgactgtcatgcaaaacacgtgagggttcttcaagatgaaaaactccaatttgatttgattttgtgtggttccaccttaagagctcctcatagttgccacgcgcagtacatggctaacatggattcaattgcttccctggttttggcagttgtagtcaatgacaacgaagaagatggggacactgatgctgttcagccacaaaagacggagagactttggggtttggtagtttgccataacactactcccaggtttgttccctttcctctaaggtatgcaagagaatttctgcctcaagtatttgccgaccatgtgcacaaagaaatagagttagaatatcagattattgagaagaatatcctgcaccacccagggcacctcttgtgtatgctgatgcgagatgcacccctaggaattgcatcagagagtcctaatataatggatctagttaaatgtgatggagctgccctcatatacaggaacaaagtatggagattaggagtgacaccaagtgaaccccagataagagagatagctttgtggttgtctgagtaccatatggattccacatcctttagtacagatagcttgtttgatgcagggttcccatcggctctttctctgggtgatgttgtgtgtggaatggcatctgttagagtaactgcaaaagacatggtattttggtttcggtcacacactgctgcagaaatccgatggggtggtgcaaagcatgaggctggagaaaaagatgatagtaggaggatgcatccaagatcatcattcaaggctttccttgaagttgtgaaggcaaggagtttaccttggaaggaatatgaaatggatgctattcattccttgcagataatactgagaaatgcattcaaagaagataccgagagtttggatttaaacgcaaaagcaattaatacaagactaagagatttgaagattgaagggataaacgatttgaagattgaaaggatgcaggaactggaagcagtgacaagtgagatcgttaggttggattacacagcaacagtgcctattttggccgttgatgttgatgggctggtcaatgggtggaacataaaaattgctgagttgacgggtcttccaattggtgaagctactggaaagcatttactcacacttgttgaggattcttcaactgatagagtcaagaagatgcttaacttagcactgctaggtgaagaagagaagaatgtccaatttgagatcaaaactctagggtctaagatggattctggtcctattagtttggtagtaaatcgttgcgcgagcagggatcttcgagataatgttgtcggggtttgttttgtggcccatgatataactgctcagaagaatgtcatggacaaattcatccgtattgaaggtgattacaaggcaattgtacagaaccgcaatccattaatccctcctatatttggcacagatgaatttggctggtgttgtgagtggaatccagctatgatgaagttaactggatggaagcgagaggaggtgatggataaaatgcttttgggagagatttttggcacccagatggctgcttgtcgcctaaagaatcaagaagcttttgttaatttgggcgtcgtacttaataaagccatgactggttcagaaacagagaaggttccttttggtttctttgctcggaatggcaagtatgtagaatgcctgctttctgtgagtaagaaattggacgtagagggcctagttactggggtcttctgcttcttacagctagctagcccagagctccaacaagcattacatattcagcgtctatctgagcaaactgcttcgaagagattgaatgcattaagttacatgaaaaggcagatcaggaatcctttgtgtggaattgtattttcccggaaaatgttggagggtactgacttgggaacagaacagaaacaacttctgcgcactagtgctcagtgccagcagcagcttagtaaaattcttgatgactcagatcttgacaccatcatagatggttacttggatcttgagatggctgagttcaccctgcatgaagttctggttacctcccttagtcaagtcatggaaaaaagtaatggaaagagtatccgaatagtcaatgatgttgcagggcatattatgatggaaactttatatggtgatagtcttaggcttcagcaggtcttggctgactttttacttatttccatcaatttcactccaaatggaggtcaggttgttgtagcaggctctctaaccaaagaacagttaggcaaatctgtccatcttgttaagttagagctcagcataacacatggtgggagtggggtaccagaagtgttactgaatcagatgttcggaaacaatgggctagaatccgaggagggtattagcctactgataagagcaaagctgctgaagctgatgaatggagatgttcgctatctaagggaagcaggcaaatcagcttttatcctctctgctgaacttgctgcagcccataatttgaaagcttaaaagttttggaaaaaagaataaaagatgatgcaacagcaacacaatctgttttctacatcataaagagaacggagctagaaattaatttgcatccaatgtaactctaatttgttcccacgtttctttaactgcttcttgtaacgtacgttgtagatatgtatgattaatcttcttcccattccttgacc

SEQ ID NO: 8305 - DNA, 4586 bp, Glycine max
ctcaggcaactgtagatgcaaaaatccatgcaacttttgaggagtccggtagttcctttgattactccagttcggtgcgtgtctctggtacagctgatggagtcaatcaaccaaggtctgacaaagttacaacagcttacctcaatcacatgcagagaggcaagatgattcagcctttcggttgcttgttggccattgatgagaaaacatgtaaggtcattgcatacagtgagaacgcgcccgaaatgctgaccatggttagccatgctgtccccagtgttggtgaccaccctgcccttggcattggcactgacataaaaactctattcactgcaccaagtgtttctggattgcagaaggctctaggatgtgcggacgtttcgcttcttaaccccatacttgtccattgcaagacctctgggaagcccttttatgcaattgtccatcgcgtcactggtagtttgatcgttgactttgagccagtcaagccttatgaagttcccatgactgcagcaggtgccttgcaatcttacaagcttgctgccaaagcaattacccgattgcaatcattgcctagtgggaacatggaaagactatgtgatactatggttcaggaagtttttgaactcacaggttatgatagggtgatggcttataaatttcatgaggatgatcatggagaggtgattgctgagataacaaagcccggtcttgagccatatctgggtttgcactatccagccaccgacattccccaggcttcacgctttttatttaggaagaacaaggttcgtatgatagttgactgtcatgcaaaacacgtgagggttcttcaagatgaaaaactccaatttgatttgattttgtgtggttccaccttaagagctcctcatagttgccacgcgcagtacatggctaacatggattcaattgcttccctggttttggcagttgtagtcaatgacaacgaagaagatggggacactgatgctgttcagccacaaaagagggagagactttggggtttggtagtttgccataacactactcccaggtttgttccctttcctctaaggtatgcttgtgaatttctggctcaagtatttgccgtccatgtgcacaaagaaatagagttagaatatcagattattgagaagaatatcctgcgcacccaggcactcttgtgtatgctgatgcgagatgcacccctaggaattgtatcagagagtcctaatataatggatctagttaaatgtgatggagctgccctcatatacaggaacaaagtatggagattaggagtgacaccaagtgaaccccagataagagagatagctttgtggttgtctgagtaccatatggattccacaggctttagtacagatagcttgtttgatgcagggttcccatcggctctttctctgggtgatgttgtgtgtggaatggcatctgttagagtaactgcaaaagacatggtattttggtttcggtcacacactgctgcagaaatccgatggggtggtgcaaagcatgaggctggagaaaaagatgatagtaggaggatgcatccaagatcatcattcaaggctttccttgaagttgtgaaggcaaggagtttaccttggaaggaatatgaaatggatgctattcattccttgcagataatactgagaaatgcattcaaagaagataccgagagtttggatttaaacgcaaaagcaattaatacaagactaagtgatttgaagattgaagggataaacgatttgaagattgaaaggatgcaggaactggaagcagtgacaagtgagatcgttaggttgattgacacagcaacagtgcctattttggccgttgatgttgatgggctggtcaatgggtggaacataaaaattgctgagttgacgggtcttccaattggtgaagctactggaaagcatttactcacacttgttgaggattcttcaactgatagagtcaagaagatgcttaacttagcactgctaggtatgtctttttttctttctctatcttatccttctatactcttttcttttctttgttttttcaagccttatcattcataagcaaaagcttaaaaaatgagttagtatgtgcctgtgtcaatctagctgtgagcaactgagcatattatgttccctaaagccacacatgaacattgcattggtgaagaattctgagaagaaaagtatgtcttgttgacagtttcattcaattttgtgcccttacaataacttgggaaggaatggaacaccctaggagttgtgatgtcatttttattttgggggcttggtgagaggaattgatgcaatttatctgacacagtgggcttgtattcttctaacctgctttccatatttcttaattgttgttttgttctgttaattaggtgaagaagagaagaatgtccaatttgagatcaaaacacatgggtctaagatggattctggtcctattagtttggtagtaaatgcttgcgcgagcagggatcttcgagataatgttgtcggggtttgttttgtggcccatgatataactgctcagaagaatgtcatggacaaattcatccgtattgaaggtgattacaaggcaattgtacagaaccgcaatccattaatccctcctatatttggcacagatgaatttggctggtgttgtgagtggaatccagctatgatgaagttaactggatggaagcgagaggaggtgatggataaaatgcttttgggagagatttttggcacccagatggctgcttgtcgcctaaagaatcaagaagcttttgttaatttgggcgtcgtacttaataaagccatgactggttcagaaacagagaaggttccttttggtttctttgctcggaatggcaagtatgtagaatgcctgctttctgtgagtaagaaattggacgtagagggcctagttactggggtcttctgcttcttacagctagctagcccagagctccaacaagcattacatattcagcgtctatctgagcaaactgcttcgaagagattgaatgcattaagttacatgaaaaggcagatcaggaatcctttgtgtggaattgtattttcccggaaaatgttggagggtactgacttgggaacagaacagaaacaacttctgcgcactagtgctcagtgccagcagcagcttagtaaaattcttgatgactcagatcttgacaccatcatagatgggtatgatatctgtgcattttgttctttttcccccttatttacattcatgtggtgtgaagcatttatcagttggaactcctactaaagcataaaagttcctatttgaaacctcattgaaactcatgactagaaagttaacctcattcatgcaactaaactccaaaaacattgactagtatataacccaactgatattgggtgtttactgttatcatgttctgtttttttttttttgctcagcaaaaactgttatcatgttatgtagttctcaaggttcttgttatgtagttttgtcatgttttgtacttttgttagagtttagtgtacctatttagaagtttaaatattagcatctttgaaagaaggcatccaatgtggatgtttatttttcattcacacggtgctttcaaagtcactctgtagtgctagattaatttgtgtaaaaatacagtttcctcatttatttgtcttggaatcttcgataacagttttataatcattttttccccctgtatgttcaacagttacttggatcttgagatggctgagttcaccctgcatgaagttctggttacctcccttagtcaagtcatgacaaaaagtaatggaaagagtatccgaatagtcaatgatgttgcagggcatattatgatggaaactttatatggtgatagtcttaggcttcagcaggtcttggctgactttttacttatttccatcaatttcactccaaatggaggtcaggttgttgtagcaggctctctaaccaaagaacagttaggcaaatctgtccatcttgttaagttagagctcaggtaactcttccatgctcgcattcccactgtgtatgtgatttaaatgcctggcggaaacactgccataaattgttgcatgatcaacacattgttctcttgtgctaggcaaagaaacttgcattgtttatgcggtcttgctaaccattaaggacactgattaaggaatcaacaagtggttgagattatacgttttctaataaaaaacttttcacttttgattccttaaccagtgtcctgattaacattttccttgttttcaaccaaaacataaagaaggaagttacactataaccttgatttacttctaagtgagtgttacttttggtatttatgtagcataacacatggtgggagtggggtaccagaagtgttactgaatcagatgttcggaaacaatgggctagaatccgaggagggtattagcctactgataagcagaaagctgctgaagctgatgaatggagatgttcgctatctaagggaagcaggcaaatcagcttttatcctctctgctgaacttgctgcagcccataatttgaaagct

SEQ ID NO: 8306 - DNA, 3437 bp, Glycine max
agtgaaaatgtctacctcaaggcctagccaatcatccagcaattcaaggagatcaagacatagtgctagaatggctcaggcaactgtagatgcaaaaatccatgcaacttttgaggagtccggtagttcctttgattactccagttcggtgcgcgtctctggtacagctgatggagtcaatcaaccaaggtctgacaaagttacaacagcttacctcaatcgcatgcagagaggcaagatgattcagccttttggttgcttgttggccattgatgagaaaacatgtaaggtcattgcatacagtgagaacgcgcccgaaatgctgaccatggttagccatgctgtccccagtgttggtgaccaccctgcccttggcattggcactgacataaaaactctattcactgcaccaagtgtttctggattgcagaaggctctaggatgtgcggacgtttcgcttcttaaccccatacttgtccattgcaagacctctgggaagcccttttatgcaattgtccatcgcgtcactggtagtttgattgttgactttgagccagtcaagccttatgaagttcccatgactgcagcaggtgccttgcaatcttacaagcttgctgccaaagcaattacccgattgcaatcattgcctagtgggaacatggaaagactatgtgatactatggttcaggaagtttttgaactcacaggttatgatagggtgatggcttataaatttcatgaggatgatcatggagaggtgattgctgagataacaaagcccggtcttgagccatatctgggtttgcactatccagccaccgacattccccaggcttcacgctttttatttaggaagaacaaggttcgtatgatagttgactgtcatgcaaaacacgtgagggctcttcaagatgagaaactccaatttgatttgattttgtgtggttccaccttaagagctcctcatagttgccacgcgcagtacatggctaacatggattcaattgcttccctggttttggcagttgtagtcaatgacaacgaagaagatggggacactgatgctgttcagccacaaaagagggagagactttggggtttggtagtttgccataacactactcccaggtttgttccctttcctctaaggtatgcttgtgaatttctggctcaagtatttgccgtccatgtgcacaaagaaatagagttagaatatcagattattgagaagaatatcctgcgcacccaggcactcttgtgtatgctgatgcgagatgcacccctaggaattgtatcagagagtcctaatataatggatctagttaaatgtgatggagctgccctcatatacaggaacaaagtatggagattaggagtgacaccaagtgaaccccagataagagagatagctttgtggttgtctgagtaccatatggattccacaggctttagtacagatagcttgtttgatgcagggttcccatcggctctttctctgggtgatgttgtgtgtggaatggcatctgttagagtaactgcaaaagacatggtattttggtttcggtcacacactgctgcagaaatccgatggggtggtgcaaagcatgaggctggagaaaaagatgatagtaggaggatgcatccaagatcatcattcaaggctttccttgaagttgtgaaggcaaggagtttaccttggaaggaatatgaaatggatgctattcattccttgcagataatactgagaaatgcattcaaagaagataccgagagtttggatttaaacgcaaaagcaattaatacaagactaagtgatttgaagattgaagggataaacgatttgaagattgaaaggatgcaggaactggaagcagtgacaagtgagatcgttaggttgattgacacagcaacagtgcctattttggccgttgatgttgatgggctggtcaatgggtggaacataaaaattgctgagttgacgggtcttccaattggtgaagctactggaaagcatttactcacacttgttgaggattcttcaactgatagagtcaagaagatgcttaacttagcactgctaggtgaagaagagaagaatgtccaatttgagatcaaaacacatgggtctaagatggattctggtcctattagtttggtagtaaatgcttgcgcgagcagggatcttcgagataatgttgtcggggtttgttttgtggcccatgatataactgctcagaagaatgtcatggacaaattcatccgtattgaaggtgattacaaggcaattgtacagaaccgcaatccattaatccctcctatatttggcacagatgaatttggctggtgttgtgagtggaatccagctatggtgaagttaactggatggaagcgagaggaggtgatggataaaatgcttttgggagagatttttggcacccagatggctgcttgtcgcctaaagaatcaagaagcttttgttaatttgggcgtcgtacttaataaagccatgactagttcagaaacagagaaggttccttttggtttctttgctcggaatggcaagtatgtagaatgcctgctttctgtgagtaagaaattggacgtagagggcctagttactggggtcttctgcttcttacagctagctagcccagagctccaacaagcattacatattcagcgtctatctgagcaaactgcttcgaagagattgaatgcattaagttacatgaaaaggcagatcaggaatcctttgtgtggaattgtattttcccggaaaatgttggagggtactgacttgggaacagaacagaaacaacttctgcgcactagtgctcagtgccagcagcagcttagtaaaattcttgatgactcagatcttgacaccatcatagatggttacttggatcttgagatggctgagttcaccctgcatgaagttctggttacctcccttagtcaagtcatgacaaaaagtaatggaaagagtatccgaatagtcaatgatgttgcagggcatattatgatggaaactttatatggtgatagtcttaggcttcagcaggtcttggctgactttttacttatttccatcaatttcactccaaatggaggtcaggttgttgtagcaggctctctaaccaaagaacagttaggcaaatctgtccatcttgttaagttagagctcagcataacacatggtgggagtggggtaccagaagtgttactgaatcagatgttcggaaacaatgggctagaatccgaggagggtattagcctactgataagcagaaagctgctgaagctgatgaatggagatgttcgctatctaagggaagcaggcaaatcagcttttatcctctctgctgaacttgctgcagcccataatttgaaagcttaaaagttttggaaaaaagaaaaaagatgatgcaaccagc

SEQ ID NO: 8307 - DNA, 3422 bp, Glycine max
gcccttgcagtgaaaatgtctacctcaaggcctagccaatcatccagcaattcaaggagatcaagacatagtgctagaatggctcaggcaactgtagatgcaaaaatccatgcaacttttgaggagtccggtagttcctttgattactccagttcggtgcgcgtctctggtacagctgatggagtcaatcaaccaaggtctgacaaagttacaacagcttacctcaatcacatgcagagaggcaagataattcagccttttggttgcttgttggccattgatgagaaaacatgtaaggtcattgcatacagtgagaacgcgcccgaaatgctgaccatggttagccatgctgtccccagtgttggtgaccaccctgcccttggcattggcactgacataaaaactctattcactgcaccaagtgcttctgcattgcagaaggctctaggatttgcagaggttttgcttcttaaccctgtccttatccattgcaagacctctgggaagcccttttatgcgattatccatcgtgtcactggtagtatgatcattgactttgagccagtcaagccgtatgaagttcccatgactgcagcaggtgccttgcaatcttacaagcttgctgccaaagcaattacccgattgcaatcgttgcctagtgggagcatggaaagactatgtgatactatggttcaagaagtttttgaactcacaggttatgatagggtgatggcttataaatttcacgaggatgatcatggagaggtgattgctgagataacaaagccaggtcttgagccatatctgggtttgcactatccagccaccgatattccccaggcttcacgctttttatttatgaagaacaaggttcgtatgatagttgattgtcatgcaaaacacgtgagggttcttcaagatgaaaaactcccatttgatttgactttgtgtggttccaccttaagagctcctcatagctgccacgcacagtacatggcgaacatggattcaattgcttccctggttatggcagttgtagtcaatgacaatgaagaagatggggacactgatgctattcagccacaaaagaggaagagactttggggattggtagtttgccataacactactcccaggtttgttccctttcctctaaggtatgcttgtgagtttctggctcaagtatttgccatccatgttaacaaagaaatagagttggaatatcagattattgagaagaatatcctgcgcacccagacactcttgtgtgatctggtgatgcgagatgcacccctgggaattgtgtcagagagccccaatataatggatcttgtgaaatgtgatggagctgccctcatatataagaacaaggtatggagattaggagtaacaccaagtgaatcccagataagagagatagctttttggttgtctgagtaccatatggattccacaggcttcagtacagatagcttgtctgatgcagggttcccatcggctccttctctgggtgatgttgtttgtggaatggcagcagttagagtaactgcaaaagacgtagtattttggtttcggtcacacactgctgcagaaatccgatggggtggtgcaaagcatgaagctggagaaaaagatgatggtaggaggatgcatccaagatcatcattcaaggttttccttgatgttgtgaaggcaaggagcttaccatggaaggaatatgaaatagatgctatgcattccttgcagttaatactgagaaatgcattcaaagataccgagagtatggatttaaacacaaaagcaattaatacaagactaagcgatttgaagattgaggggatgcaggaactggaagcagtgacaagtgagattgttaggttgattgaaacagcaacagtgcctattttggcagttgatgttgatgggctggtcaatgggtggaacataaaaattgctgagttgacaggtcttccagttggtgaagctatgggaaagcatttactcacacttgttgaggattcttcaactgatagagtcaagaagatgcttaacttagcactgctaggtgaagaagagaagaatgtccaatttgagatcaaaacacatgggtctaagatggattctggtcctattagtttagtagtaaatgcttgcgcaagcagggatcttcgagataatgttgttggggtttgttttgtggcccatgatataactgctcagaagaatgtcatggacaaatttacgcgtattgaaggtgattacaaggcaattgtacagaaccgcaatccattaatccctcctatatttggcacagatgaatttggctggtgttgtgagtggaatccagctatgacgaagttaactggatggaagcgagaggaggtgatggataaaatgcttttgggagagctttttggcacccatatggctgcttgtcgcctaaagaatcaagaagcttttgttaatttgggtgttgtacttaataaagccatgactggtttggaaacagagaaggttccttttggtttctttgctcggaatggcaagtatgtggaatgcctgctttctgtgagtaagaaattggacgtagagggcctagttactggggtcttctgcttcttacagctagctagcccagagctccaacaagcattacatattcagcgcctatccgagcaaactgccttgaagagattaaatgcattaagttacatgaaaaggcaaatcaggaatcctttgtgtggaattatattttcccggaaaatgttggagggtactgccttgggaacagagcagaaacaacttctacgcactagtgctcagtgccagcagcagcttagtaaaattcttgatgactcagatcttgatagtatcatagatggttacttggatcttgaaatggctgagttcactctgcatgaagttctggttacctcacttagtcaggtcatgacaaaaagtaatggaaagagtatccgaatagtcaatgatgttgcagagcagattgtgatggaaactttatatggtgatagtcttaggcttcagcaggtattggctgactttttacttatttccatcaatttcactccaaatggaggtcaggttgttgtagcaggcactctaaccaaagaacagttaggcaaatccgtccatctcgttaagttagagctcagcataacacatggtgggagtggggtaccagaagcattactgaaccagatgtttggaaacaacgggctagaatccgaggagggtattagcctactgatcagcagaaagctgctgaagctgatgaatggagatgttcgctatctaagggaagcaggcaaatcagcttttatcctctctgctgaacttgcagcagcccataatttgaaaggttaaaagttttggaaaaaagaataaaagatgatgcaaccagc

SEQ ID NO: 8308 - DNA, 3809 bp, Glycine max
ctggtcacactcacagttgtggtgagtttgaagaagagggggttgggttccttggagagacatgggtgttgttgttgctcacacctcttttctttattttaacccttagcttcattgcttccttccttttgttgccactctttccctttcaagtttggggcgaaaatgtctacctcaaggcctagccaatcatccagcaattcggggagatcaagacgtagtgctagggctatggctctggcaactgtagatgcaaaactccatgcaacttttgaggagtctggtagttcctttgactactccagttcggtgcgcatctctggtacagctgatggagtcaatcaaccaaggcatgacaaagttacaacagcttacctccaccacatgcagaaaggcaagatgattcagccttttgggtgcttgttggccttagatgagaaaacatgcaaggtcattgcatacagtgagaacgcacccgaaatgctgaccatggtgagccatgctgtccccagtgttggtgaccaccctgcccttggtattggcactgacataaaaactctattcactgcaccaagtgcttctgcattgcagaaggctctaggatttgcagaggttttgcttcttaaccctgtccttatccattgcaagacctctgggaagcccttttatgcgattatccatcgtgtcactggtagtatgatcattgactttgagccagtcaagccgtatgaagttcccatgactgcagcaggtgccttgcaatcttacaagcttgctgccaaagcaattacccgattgcaatcgttgcctagtgggagcatggaaagactatgtgatactatggttcaagaagtttttgaactcacaggttatgatagggtgatggcttataaatttcacgaggatgatcatggagaggtgattgctgagataacaaagccaggtcttgagccatatctgggtttgcactatccagccaccgatattccccaggcttcacgctttttatttatgaagaacaaggttcgtatgatagttgattgtcatgcaaaacacgtgagggttcttcaagatgaaaaactcccatttgatttgactttgtgtggttccaccttaagagctcctcatagctgccacgcacagtacatggcgaacatggattcaattgcttccctggttatggcagttgtagtcaatgacaatgaagaagatggggacactgatgctattcagccacaaaagaggaagagactttggggattggtagtttgccataacactactcccaggtttgttccctttcctctaaggtatgcttgtgagtttctggctcaagtatttgccatccatgttaacaaagaaatagagttggaatatcagattattgagaagaatatcctgcgcacccagacactcttgtgtgatctggtgatgcgagatgcacccctgggaattgtgtcagagagccccaatataatggatcttgtgaaatgtgatggagctgccctcatatataagaacaaggtatggagattaggagtaacaccaagtgaatcccagataagagagatagctttttggttgtctgagtaccatatggattccacaggcttcagtacagatagcttgtctgatgcagggttcccatcggctctttctctgggtgatgttgtttgtggaatggcagcagttagagtaactgcaaaagacgtagtattttggtttcggtcacacactgctgcagaaatccgatggggtggtgcaaagcatgaagctggagaaaaagatgatggtaggaggatgcatccaagatcatcattcaaggttttccttgatgttgtgaaggcaaggagcttaccatggaaggaatatgaaatagatgctatgcattccttgcagttaatactgagaaatgcattcaaagataccgagagtatggatttaaacacaaaagcaattaatacaagactaagcgatttgaagattgaggggatgcaggaactggaagcagtgacaagtgagattgttaggttgattgaaacagcaacagtgcctattttggcagttgatgttgatgggctggtcaatgggtggaacataaaaattgctgagttgacaggtcttccagttggtgaagctatgggaaagcatttactcacacttgttgaggattcttcaactgatagagtcaagaagatgcttaacttagcactgctaggtgaagaagagaagaatgtccaatttgagatcaaaacacatgggtctaagatggattctggtcctattagtttagtagtaaatgcttgcgcaagcagggatcttcgagataatgttgttggggtttgttttgtggcccatgatataactgctcagaagaatgtcatggacaaatttacgcgtattgaaggtgattacaaggcaattgtacagaaccgcaatccattaatccctcctatatttggcacagatgaatttggctggtgttgtgagtggaatccagctatgacgaagttaactggatggaagcgagaggaggtgatggataaaatgcttttgggagagctttttggcacccatatggctgcttgtcgcctaaagaatcaagaagcttttgttaatttgggtgttgtacttaataaagccatgactggtttggaaacagagaaggttccttttggtttctttgctcggaatggcaagtatgtggaatgcctgctttctgtgagtaagaaattggacgtagagggcctagttactggggtcttctgcttcttacagctagctagcccagagctccaacaagcattacatattcagcgcctatccgagcaaactgccttgaagagattaaatgcattaagttacatgaaaaggcaaatcaggaatcctttgtgtggaattatattttcccggaaaatgttggagggtactgccttgggaacagagcagaaacaacttctacgcactagtgctcagtgccagcagcagcttagtaaaattcttgatgactcagatcttgatagtatcatagatggttacttggatcttgaaatggctgagttcactctgcatgaagttctggttacctcacttagtcaggtcatgacaaaaagtaatggaaagagtatccgaatagtcaatgatgttgcagagcagattgtgatggaaactttatatggtgatagtcttaggcttcagcaggtattggctgactttttacttatttccatcaatttcactccaaatggaggtcaggttgttgtagcaggcactctaaccaaagaacagttaggcaaatccgtccatctcgttaagttagagctcagcataacacatggtgggagtggggtaccagaagcattactgaaccagatgtttggaaacaacgggctagaatccgaggagggtattagcctactgatcagcagaaagctgctgaagctgatgaatggagatgttcgctatctaagggaagcaggcaaatcagcttttatcctctctgctgaacttgcagcagcccataatttgaaaggttaaaagttttggaaaaaagaataaaagatgatgcaaccagcaaaacacaatctgttttgtacatcataaagagaacggagctagaaattaattgcatccaatgtaactctaatttgttcccacgtttcttattaactgcttcttgtaacgtacgttgtagatatgtattaatcttcttcccattccgtggcctgttctttctagagtttttccttatttacttattcctccatcaaacagcaatgatgaatcatttgttgcgaaatgaaacgtag

SEQ ID NO: 8309 - DNA, 3573 bp, Medicago truncatula
atgaaatctaagatggtaagtgaattgagtgatgttagagaaaaaggaaggaaagtcaaggaaaggctccagctgggtgggagacaaacaagggcggtgcttgctgctgctgctgcaggtgcagggtatgtttgtgataaaatgtcgaccacaaggcctagccaatcatccaacaactcagggagatcaagaaatagtgctaggattattgctcagacgacggtagatgcaaaacttcatgcaacttttgaggagtctggtagttcctttgactactcaagttcggtgcgcgtctctggctcagttgatggagagcatcaaccgaggtccaacaaagtaacaacagcttacctcaatacaatacaaagaggcaagcagatccagccttttggttgcttgctagctttagacgagaaaacgtgcaaggttattgcatacagtgagaatgcacccgaaatgctgaccatggtgagtcatgctgtccctagtgtcggtgaccaccctgcccttggcattggaactgacataagaactatcttcaccgcaccgagtgcttctgcgctacagaaggcactgggatttgcggaggtttcgcttcttaaccctatccttgttcattgcaagacttctgggaagccattttatgcgatcattcaccgtgttacaggtagtttgatcattgactttgagccagtgaagccttacgaagttcccatgactgcagcaggcgcattacagtcttacaaacttgctgctaaagcaattacaagattgcaatctttgcctagtggcagcatggaaaggctttgcgatacaatggttcaagaagtttttgaactaacgggttatgacagggtgatggcttataaatttcacgaggatgatcatggggaggtgattgctgaggtaacaaagacaggcctagagccatatctaggattgcactatccggccacagatattccccaggctgcgcgctttttatttatgaagaacaaggtccgtatgatagttgattgtcacgcaaaacatgtgaaggttcttcaagacgaaaaactcccatttgatttgactttgtgtggttcgaccttaagggccccacatagttgccatttgcagtatatggctaacatggattcaattgcttccttggttatggctgtagtagtcaatgacagcgatgaagatggagatagcgctgatgcagttctcccacaaaagaaaaagagactttggggtttggtagtttgtcataacactacaccaaggtttgttccttttcctctaaggtatgcttgtgaatttctggctcaagtatttgccatccatgtgaacaaagaaatagaattagaatttcagattcttgagaagaatatcctgcgcacacagacgctgttgtgcgatatgctgatgcgagatgcacccttaggtattgtatcacaaagccctaatataatggatctagtgaaatgtgatggggctgcactcttgtatagaaacaagttatggatattaggagcgacgccgagtgaacctcagataagagagatagctttatggatgtccgagtaccatacggattcgactggtttgagtacggatagcttgtctgatgcagggtttccaggggctcttaaacttaatgatactgtatgtggaatggcagctgttagaataacttcaaaagacatagttttctggtttaggtcgcacaccgctgcagaaatccgatggggtggtgcaaagcatgaacctggcgaacaggatgatggtaggaagatgcatccaagatcatcatttaaggctttcctcgaagttgtgaaggctaggagcataccatggaaagactttgaaatggatgctattcattcgttacagttaatactgagaaacgcgtccaaagatacagatatgattgatttaaactcaaaggcaatcaatacaagactaaatgatttgaagatcgaagggatgcaggaattagaagcagtgacaagtgagatggttcgattaattgaaacagcaacagtgcctattttggcagtggatgttgatgggatggtcaatggttggaatatcaaaatttccgagttgacaggtcttccggttggcgaagctattggaaaacatttgctcacacttgttgaggattcttcaacggatatagttaagaagatgcttaatctggcactacagggtcaagaagagaagaatgttcaattcgagatcaaaacacacgggtctaagacggattgcggtcctattagtttgatagttaatgcttgtgcaagcagggatcttcatgaaaatgtagtgggagtttgttttgtggcccaagatataactgctcagaagacagtcatggacaaattcacccgaattgaaggagattacaaggcaattgtacagaaccctaatcaattaatccctcctatattcggtacagatgaatttggctggtgttgtgagtggaatgcagctatgataaagataactggatggaagcgagaggaggtgatggataaaatgcttctaggagaggttttcggaactcatatgtcttgctgtcgtctaaagaatcaagaagctttcgttaatttcggcattgtacttaataaagccatgactggtttggaaacagaaaaggttccttttggttttctctctcggaagggaaagtatgtagagtgcctactttctgtgagtaagaaaatagatgcagagggcctagttaccggggtattctgtttcttgcagctagctagcccggagctgcaacaagcattacatattcagcgcctatctgaacaaaccgctctcaagagactgaaagtattaacttatatgagaaggcaaatcaggaatcctttgtcagggattgtgttttccagtaaaatgttggagaatactgagttgggaactgaacaaaaacgaattgtgaacactagttctcagtgccagcgccagctaagcaaaattctcgatgactcggatctagacagcatcattgatgggtacttggatctcgagatggctgaattcactctgcatgaggtactggtgacctctcttagtcaagtcatgaataggagtaacacaaggagtatcagaatagtgaatgatgttgcggagcatatcgcgatggaaaccttgtatggtgatagtcttagacttcagcaggtcttggctgacttcttactgatttccatcaattccacaccaaatggaggtcaggttgttatagcagccactctaactaaagaacagttagggaaatctgtccatcttgttaatttggagctcagcataacacatggtggaaatggggtggcagaagcagtgttaaaccagatgtttggaaataatgggctagaatcagaggagggtattagcctacacatcagtagaaaattgttaaagcttatgaacggcgatgttcgttatttaaaagaagcaggaaaatcatcttttattctatctgttgaacttgcagcagcccaaaagttgagaggttaaagttttggaaaaataataaaagaggacacaacatgaaattgttcaatgtaactctta

SEQ ID NO: 8310 - DNA, 3808 bp, Vitis vinifera
tttctctgagcaattgggtatggcccgtgctcccctttaagggttcagatgagacggtgatcgaggctcccgggtgatggattttaagctatttctattctcaagttggggtttgctcagctgagttgggacttctactttcaagctcttcagctctgggactagtgtcttttgcattctgcaattctaaagaggttggaggaaaaatgtcttcttctagacctactcagtcatccagcacttcaggtcgatcaaaacacagtgctaggattattgctcagaccaccgtggatgcaaagctacatgcggattttgaggagtcaggtagttcatttgactactcaagttcagtgcgttttactccagctggtggagatcaacagcccagatctgacaaagtaacaacagcttacctccatcacatacagaaaggcaaactgatccaaccatttggctctttgttagccctagatgagaaaactttcaaagtcattgcctacagtgaaaatgcccctgaaatgttgacaatggttagtcatgcagtcccaagcgttggtgagcatccagttctgggcattggtactgatgtgaggaccatcttcagtggccccagtgcatctgcactgcacaaggccttaggatttggagaggtttctcttctgaatcccatcttagtccattgcaaaacctcagggaagcccttttatgcaatcatccatagggtcactggtagcttgatcattgactttgaaccggtgaagccttacgaagttcccatgactgctgctggtgccctgcaatcctataagcttgcagccaaagcaatcacgaggttgcagtcgctgcctagtggtagcttggaaaggctttgtgatacaatggttcaagaggtttttgaactcactggttatgacagggtgatggcttataaatttcatgatgacgaccatggggaggttgtctctgagataacaaagccaggccttgagccatatctgggtttacattatcctgccacagatatccctcaggctgcacgtttcttattcatgaagaataaggtccgaatgatctgtgattgtcgtgcaaaacacatacaggttcttcaagatgagaaactcccatttgatttaacattatgtggttcaacactacgggctccacacagttgccatgtacagtatatggagaacatgaattcaattgcttctcttgttatggcagttgttgtcaatgacggggatgaagagggtgaaagctctaattctgggcagccacagaagagaaagaggctttggggtttagtggtttgccatcatacaactccaaggtttgttcccttccctcttcgctatgcctgcgagtttctagctcaagtgtttgccatccatgtcaataaggagttagaattagaaagtcagattcttgagaagaatattctgcgtacacagacactcttgtgtgatatgctgatgcgagatgcgcccttaggcatagtgtcacagagcccaaatgtaatggatcttgtgaaatgtgatggagctgctctactatacaaaaataaagtatggagattgggaataactccaagtgacttccagttgcatgatatctgttcatggctatccgagtaccacatggattcaactggtttaagcacagatagcttgtatgatgcaggatacccaggggctcttgcccttggtgatgcagtttgtgggatggcagctgtgaagataacttcaaaggatactcttttctggttccggtcccacacagctgcagaagtccgatggggtggggcaaagcatgaaccgggtgagaaggatgatggtaggaagatgcacccaagatcatcatttaaagctttccttgaagtcgttaagacgaggagtttaccttggaaggactatgaaatggatgcaatccattctttgcagcttatccttaggaatgctttcaaagattctgaggccatggatgtaaacaccaatgcgatccacacaaagctcaatgacctaaaaattgaaggaatgcaagagctagaagcagtgaccagtgagatggtccgtttgattgaaacagccagtgtgccaatcttggcagttgatgttgatggtctggttaatggatggaatacaaaaatttctgagttgactagtctgcctgtagataaagcaattgggatgcatttgctcacgcttgtggaagattcttcagctgatactgtaaaaaagatgttgcatttggcgttgcagggccaagaggagcaaaatgtccaatttgagatcaaaacgcatgggtctaaaagagactctggccccatcagcttagttgtaaatgcttgtgcaagcagggatctccatgaaaatgttgtgggggtatgttttgtggcccaagatataaccagtcagaagacggtgatggataagttcacccgaattgaaggtgattacaaagcaatagtacagaacccaaacccattgattcccccaatatttggcacagatgaatttggctggtgctctgagtggaatccggcaatggtaaagttatctgggtggaatcgggaagaagttatggataaaatgcttttaggggaagtgtttgggacccatatggcatgctgtcgtctcaagaatcgagaggcttttgttggtttgggaattgtgctcaatagtgttatgactggtcgggaatcagaaaaggtttcctttggtttcttttcaaagagtgggaagtatgtagaatgcctgctttctgtgagcaagaaattggacagagagggtgcagtcactggggtattttgcttcttgcagttagctagccaagagctgcaacaagcacttcatatccagcggttgtcggagcaaactgccttgaagagattgaaagcattagcttatataaaaaggcagatcaagaatcctctttctgggattatcttttctcggaagatgatggaggatactgatttgggagaggaacagcaacagattcttcatactagtgcccagtgccagcgtcaactcagcaagattcttgatgaccatgatcttgatagtattattgaaggttacttggatctggaaatggtcgagtttactctgcgtgaagtattggttgcctccatcagccaggtcatgataaagagtaatggaaagggtattcaaatagttaatgatgcggaagaggggatcatgactgaaacactctatggagatggtcttaggcttcaacaggtgctagctgatttcttgttgatatcagtaaattttacaccaggtggaggccagctttctgttgcagctagtttgatcaaagatcggttgggggaatctgtccatcttgtgcatctggaactcaggataacacatgcaggaaatggggtaccagaacaattgctgaaccagatgtttggaaacaatggagacgcgtctgaggagggcataagtctgcttatcagcaggaaactggtgaagctgatgaatggggatgtccagtatctaagggaagcgggaaaatcgactttcatcatatcaatcgaactagctgctgctagaaagaagccacaggcctaaataactgtgtgaggaagcaagatcacagtctggtttgtacaggcaaaagagaatggagtgtaatgttgttgtactatgccacgcactgtggtaggctttgtttttcttttttaatcttggctttactctgattgtgttgtttcagctttcaagttgtacatattgatgtgccatcgttgataaacatttgttttaaattttaatcactgcacgaccagttcttggat

SEQ ID NO: 8311 - DNA, 1325 bp, Glycine max; identical to SEQ ID NO: 8298

SEQ ID NO: 8312 - DNA, 1347 bp, Glycine max; identical to SEQ ID NO: 8297

SEQ ID NO: 8313 - DNA, 1311 bp, Arabidopsis thaliana
ggcatccattttcgtttgaatctcaacgttttttgcttgattttagcttctgagagagtccagatccaaggaattggaggaagaataatgtcggcaaggcatgggcaatcgtcgtatcgagatcggagtgacgaattcttcaaaattgtggagactctaaggagatcgattgctccggctccggcggcgaataatgtgccgtatggtaataatcggaacgatggtgcgagaagagaggatcttatcaacaaatccgagttcaacaagagagcttctcatattggtttagctattaatcaaacgtcgcagaagctatcgaagcttgcgaaacttgcaaagaggacatcagtgtttgatgatcctactcaggagatacaagagctgacggtagtcatcaagcaagagatctctgctctaaattctgctctggtcgaccttcaattgttccgcagttctcagaatgatgaagggaataactctagagacagggacaaaagtactcactcagcaactgttgttgacgatctaaagtatcgtttgatggatactaccaaagagtttaaggatgttcttaccatgagaaccgagaatatgaaggtccatgaaagtagaaggcaactcttctcttcaaatgcttcaaaagaatcaacaaacccattcgttcgccagcgtcctttggctgctaaggctgctgctagtgaatctgttcctcttccatgggcaaatgggtcttcttcatcttcatctcagttagtcccatggaagccgggagagggagaatcttcaccattgttgcagcagagtcaacaacaacagcaacagcaacagcaacaaatggtcccattgcaagacacatatatgcagggtcgagcagaagctctacacaccgttgaatcaacaatccatgagctaagcagtatcttcacacaactagcaaccatggtttctcaacaaggggaaattgcaatcaggatcgatcaaaacatggaagatacattagcaaatgtggaaggcgcacagagccaactggccaggtatctcaacagtatatcatcaaaccgatggctaatgatgaagattttcttcgtactcattgcatttctcatgattttcctcttcttcgtggcataaacattgagactaaaaattgattttaaagagtttcaacatctagacatggttcttttgtcctatcgtatcttattgacatgtaaagacttaagagaaaaaagggatcttatgctctgttcagattaatggagagatatataatgtcactttcatgtaaaattgctttcaagttttccaaac

SEQ ID NO: 8314 - DNA, 2977 bp, Medicago truncatula
atgtggaaggttccatcatcattggttcttctgctacttcttcagctagcatgttctcttatttgttctgttatagcttccgtgtcttatgactctaaagctatcaccattaatggacaaagtaggatcctcatttctggatccattcattatccaagaagcactcccgagatgtggccagatcttatacagaaagctaaggaaggtggtttggatgtgattcagacttatgttttttggaatggacatgaaccttcacctggcaaatattattttgaggggaactatgatttggtgaagttcataaagttggtgcagcaagctggtctttatgttcatctaaggattggtccttatgtttgtgctgaatggaattttgggggttttcctgtttggttgaagtacattcctggtatcagttttagaactgacaatgaaccatttaagtttcaaatgcaaaaatttactgagaagattgttgatatgatgaaagcagacaggctatttgagtctcagggtggtccaataattatgtcacagattgaaaatgaatatggacctatggagtatgaaattggtgctcctggtaaatcctacaccaaatgggcagcagatatggctgtaggacttggtaccggagttccgtggatcatgtgcaagcaagatgatgctcctgatcctgttattaacacctgcaatggcttctattgtgattatttctctccaaataaggattacaaaccaaagatgtggacagaagcttggactggctggtttacggagtttggaggtccggtacctcaccgaccagctgaagacatggcattttcagttgcaagatttatacagaaaggaggatcatttatcaattattacatgtatcatggaggaacaaattttggtagaacagctggtggtcctttcattgctacaagctatgactatgatgcacctcttgatgaatatggattgctacagcaaccaaaatggggtcatctgaaggatttacacagagcaataaaactctctgagcctgctttaatttctggagatcctactgttacacggatcggaaactatcaagaggctcatgtgtttaaatcgaagtcgggagcttgtgctgcattccttggaaactacaatccaaaagcttttgcaacagtagcttttggaaatatgcattacaacttgcctccttggtctataagcattcttcctgactgcaagaacaccgtttataacactgcaagggttggttctcagagtgcccagatgaagatgactcgtgttcctattcacggtggactatcttggcaagtgttcactgaacaaacagcctctactgatgatagttctttcaccatgactggtctactagagcagttaaatacaacgagagatttaaccgattacttgtggtactccacagatgttgtgattgatcccaatgaaggatttctgagaagtggaaaggatcctgttcttacagtgttatctgcagggcatgctttgcatgttttcatcaatagtcagctgtcaggaactatatatggaagcttagaattccccaagctaacatttagccagaatgtgaagctcatacctggtgtcaacaaaatctctcttctaagtgttgcagttggactcccgaatgttggccctcactttgaaacatggaatgctggtgttcttggcccgattacattaaatggtctcgatgaaggtagaagggacctctcttggcagaaatggtcttacaaggtcggtctccatggtgaagccttgagtcttcattctctcggtggaagttcctcggtcgagtgggttcaggggagtttagtttctcgtatgcagccgttgacttggtacaaaactaccttcgatgccccggacggaattgcaccgtttgctttagacatgggaagtatgggaaaaggacaagtgtggttaaatggacagaatcttggccgttactggcctgcttataaagcgtccgggacctgtgataactgtgactatgcaggaacttataacgagaataaatgtagaagtaactgcggcgaggcttctcaaagatggtaccatgttcctcattcatggctgataccaactggaaatttattggttgtgtttgaagaattgggtggagaccctaatgggatatttttggttagaagggatatagatagtgtatgtgcagatatttatgagtggcagccaaatcttataagttatcagatgcaaacttctggcaaaactaacaaacctgtgagaccaaaagcacatttatcttgtggccctggacagaaaatatcatcgatcaaattcgctagctttggtactccagtagggtcttgtggaaactttcatgaaggaagctgtcatgctcacaagtcttataatacctttgaaaagaattgtgttggacaaaactcgtgcaaggtaactgtgtcacctgaaaattttggaggagatccatgtccaaatgtcttgaagaaactctcggtcgaggccatttgtacctgatcatttcaacctcaggaaaacaaatggaaacaactttccatattgatattttttcccaaaatcaaatgccggagtttcgcctaaaccaaattctaaactacttatagatcaccatgagcattaatttggcttttaccaaggtgaagttgcagaaaacacaacacactatctggttgaaagccggtagagattcctgatatgattgtggaagtgtgtatatacttgtgttctgcttgttatataaggtgaaaggtgaagatgatttgcttagaagcacaatgaggctatatttatcgagtccatgtgctattgattattttaatataatgtggaagccacttgcttcttgtgtatcattattttatcattgtaagctgcattgatagcaacttagttgttttattcttgtaagaaactttacaggatcaatcatagttgttcttgtttcttt

SEQ ID NO: 8315 - DNA, 2977 bp, Medicago truncatula; identical to SEQ ID NO: 8314

SEQ ID NO: 8316 - DNA, 3359 bp, Glycine max
atcttcaaattaaagtcacttacaatatatatataaaaacattgcaaagttgcagccccggttatttttattatttttattccgatcatcattttgcatagagaaaaagcaaggaagaataataagggagagagagtgagaggaagaagggaaaaccaaagacacttcctagttacttccctctgcagccataatagaataaccagcaccaccaaaggtgaatcatggttatttgcttgaagctcataataatgtggaatgtggcactgcttctggttttttctctaattggttctgctaaggcctcagtgtcctatgactcaaaggctatcaccattaatggccagagaaggatcctcatttctggatccattcattacccaaggagcacccctgagatgtggccagatcttattcaaaaggccaaggatggaggtttggatgtgattcagacttatgttttctggaatggacacgaaccttcacctggcaagtattattttgaggggaactatgatctggtgaagttcataaagctggtgcagcaagcaggcctttatgttcatctcaggattggcccttatgtctgtgctgagtggaactttggtggtttccctgtttggctaaagtacattccaggaatcagtttcagaacagacaatgaaccatttaagcatcaaatgcaaaaatttaccacgaagattgttgatttgatgaaagcggagaggttatatgaatctcagggtggtccaataattatgtcccagattgaaaatgaatatggacctatggagtatgaaattggtgctgctggtaaagcttacactaagtgggcagcagaaatggctatgggacttggtactggggttccatgggtcatgtgcaagcaagatgacactcctgatcctcttattaacacttgcaatggcttctattgtgattatttctctccaaataaggcttacaagccaaagatgtggacagaagcttggactggctggtttactgagtttggaggtcctgttcctcatcgaccggctgaagacttggcattttcagttgcaaggtttatacagaaagggggatcatttataaattattacatgtatcatggaggaacaaatttcggtcgaactgctggtggtccctttattgctacaagctatgattatgatgcaccacttgatgaatatggattgctcaggcaaccaaagtggggtcatctgaaggatttacacagagcaataaaactctgtgaaccagctttagtatctggagatcctactgtaacaaagattggaaactatcaagaggctcatgtctttaaatcaaagtcgggagcctgtgctgcattccttgcaaactacaaccccaaatcttatgcaacagtggcatttggaaacatgcattacaacttgcctccttggtctataagcattcttcctgactgcaagaacactgtttataacactgcaagggttggttctcagagtgcccagatgaagatgactcgtgttcctattcatggcggattctcttggctatcattcaatgaagaaacgaccactactgatgatagttccttcaccatgactggcctgttggagcagttaaatactacaagagatttatctgactacttgtggtactccacagatgttgtgcttgatcccaatgaaggatttctgagaaacggaaaggatcctgttcttactgtgttttctgctgggcatgctttgcatgtttttataaatggtcagctatcaggaactgcatatggaagcttagaattccctaaactgacatttaacgagggagtgaagcttagagccggtgttaacaagatctctctactgagtgttgcagttggactcccgaatgttggtcctcattttgaaacatggaatgctggtgttcttggtccaatttcattaagtggtctcaacgaagggagaagggacttgtcttggcagaaatggtcttataaggttggtcttaaaggtgaaatcttgagtcttcactctcttagtggaagttcctcagtggagtggattcagggatctttagtttctcaaaggcagccattgacttggtacaaaacaacatttgacgcgccagctgggactgcaccattggctttagacatggacagcatgggcaaaggtcaagtgtggttaaatggacagaatcttggccgctactggcctgcttataaagcatccggtacctgtgattactgtgactatgctggaacttataacgagaataaatgcagaagtaactgtggcgaggcttcccaaagatggtatcatgttcctcaatcatggcttaagccaacaggaaatttattggttgtgtttgaagagctaggtggagaccccaatggaatctttttggttagaagggatatagatagtgtatgtgctgatatttatgagtggcagccaaatcttataagctatcagatgcaaacttctggcaaagcacctgttagaccaaaagttcatttatcatgtagcccgggacagaaaatctcatcaatcaaatttgctagctttggtactccagcaggttcttgtggaaacttccatgaaggaagctgtcatgctcacaagtcttatgatgcctttgaaaggaattgtgttggacagaactggtgcacagtaacagtgtcacctgaaaattttggaggagatccatgtccaaatgtcttgaagaaactctcagtggaagctatttgttcctgatcattttaacctcagaaaataaatagattaaactctccagattgatttttcccaccactattcatttcaatacagttcttttgggtcaaccaaagtctacacttctgaatctgatcaacacgagcattattattttggctttaccaaggtgaagttgcagaaaacacaacacaccatatggttgaaagcctgtaaagattgctgagatgattgtggatatgtgtatatacttgtgttctgcatgttatacagaggtgaaaggtgatgatttgcttggtgcactatgagacgatactgaattgagtccatgtgctagtgttttagacttaggtgtggaagcctcttgcttcctgtaatattagttttcccttgtaagctgcattcatagtgatttagtttctttcttcctgtaagaaacttctcaagatgataaagatcagattcagtcattttggtttcgttatttcatgcattgtggcttttggtttctagatgttcttgttttagagttctttcgggtttcattagatcatattgattctaccaaggcagataatgctaccatatttttggattgatgataaatattgaaatgaagtggaattaaaggtt

SEQ ID NO: 8317 - DNA, 3232 bp, Glycine max
atcttcaaattaaagtcacttacaaaatagaaaaaaaaaacattgcaaggttgcagccccagttattttattatttttattcccatcatcattttgcaaagagaaaaagtaaggaataataataagggagagagagaacaagagtgagagaaagcagggaaaaccatagacacttcctagctgcttccctctgcaggcataataatagaataagcagcaatcaccaccaaggtgaatcatggttatgtgcttgaagctgaagctcataatgtggaatgtggcactgcttctggctttttctctcattggttctgctaaggcctcagtgtcctatgactctaaggctatcaccattaatggccagagaaggatcctcatttctggatccattcattacccaaggagcacccctgagatgtggccagatcttattcaaaaggccaaggacggaggcttggatgtgattcagacttatgttttctggaatggacacgaaccttcacctggcaagtattattttgaggggaactatgatctggtgaagttcataaagctggtgcagcaagcaggcctttatgttcatctcaggattggtccttatgtctgtgctgagtggaactttggtggtttccctgtttggctaaagtacattccaggaatcagtttcagaacagacaatgaaccatttaaggttcaaatgcaaaaatttaccacgaagattgttgatttgatgaaagcggagaggttatatgaatctcagggaggtccaataattatgtcccagattgaaaatgaatatggacctatggagtatgaaattggtgctgccggtaaagcttacactaagtgggcagcagaaatggctatggaacttggtactggggttccatggatcatgtgcaagcaagatgacactcctgatcctcttattaacacttgcaatggcttctattgtgattatttctctccaaataaggcttacaagccaaagatgtggacagaagcttggactggctggtttaccgagtttggaggtcctgttcctcatcgacctgctgaagacttggcattttcagttgcaaggtttatacagaaagggggatcatttataaattattacatgtatcatggaggaacaaatttcggtcgaactgctggtggtccctttattgctacaagctatgattatgatgcaccacttgatgaatatggattgctcaggcaaccaaagtggggtcatctgaaggatttacacagagcaataaaactctgtgaaccagctttagtatctggagatcctactgtaacaaagattggaaactatcaagaggctcatgtctttaaatcaatgtctggagcctgtgccgcattccttgcaaactacaaccccaaatcttatgcaacagtggcatttggaaacatgcattacaacttgcctccttggtctataagcattcttcctaattgcaagaacaccgtttataacactgctagggttggttctcagagtgcccagatgaagatgactcgtgttcctattcatggtggtctctcttggctatcattcaacgaagaaacaaccacaactgatgatagttccttcacaatgactggcctgttggagcagttaaatacaacaagagatttatctgactacttgtggtactccacagatgttgtgcttgatcccaatgaaggatttctgagaaacggaaaggatcctgttcttactgtgttttctgctgggcatgctttgcatgtttttataaatggtcagctatcaggaactgcatatggaagcttagaattccctaaactaacatttaacgagggagtgaagctcagaaccggtgttaacaagatctctcttctaagtgttgcagttggactcccgaatgttggtcctcattttgaaacatggaatgctggtgttcttggcccgatttcattaagtggtctcaacgaagggagaagggacttgtcttggcagaaatggtcttataaggttggtcttaaaggtgaaaccttgagtcttcactctcttggtggaagttcgtcagtggagtggattcagggatctttagtttctcaaaggcagccattgacttggtacaaaacaacatttgacgcgccagatgggactgcaccattggctttagacatgaacagcatgggcaaaggtcaagtgtggttaaatggacagaatcttggccgctactggcctgcttataaagcatctggtacttgtgattactgtgactatgctggaacttataacgagaataaatgcagaagtaactgtggcgaggcttctcaaagatggtatcacgttcctcaatcatggctaaagccaacaggaaatttattggttgtgtttgaagagctaggtggagacctcaatggaatctctttggttagaagggatatagatagtgtatgtgcagatatttatgagtggcagccaaatcttataagctatcagatgcaaacttctggcaaagcacctgttagaccaaaagttcatttatcttgtagccctggacagaaaatctcatcaatcaaatttgctagctttggtactccagtaggttcttgtggaaacttccatgaaggaagctgccatgctcacatgtcttatgatgcctttgaaaggaattgtgttggacagaacttgtgcacagtagctgtgtcacctgaaaattttggaggagatccatgtccaaatgtcttgaagaaactctcagtggaagctatttgttcctgatcattttaacctcagaaaataaatggattacaagtctcttcagattgatttttcccaccactattcattttaatacagttcttttgggtcaaccaaagtctacacttctgaatctgatcatcacaagcattattatttcggctttaccaaggtgaagttgcagaaaacacaacacaccatatggttgaaagcattgctgagatgattgtggatatgtgtatatacttgtgttctgcttgttatacagaggtgaaaggtgaagatttgattggtgcactatgagacgataccgaatactgattgtgtccatgtgctagtgttttagacttagtgtggaagcctcttgcttcctgtaatattagttttccattgtaagctgcattcataacgatttggtttctttctccctgtaagaaacttctcaagatgataagatcaagcatattaaattcagtcattttggtttcg

SEQ ID NO: 8318 - DNA, 3438 bp, Glycine max
ccttcacataaagtatcttaaatttttaatcccccaaaaaggtcaaaacaaatcaaaagaaaaaaaagaaatatatatcactgtctctcactcttccaatctacaacctcccattttttttccttcctttcacacagtgttttctcttcaatcattctgctaaaagtaggagacttgagcaacagaacataagcatagaataaagtgtgcaaaggccactgctttagtgctttaccaagctgagaaacaacacaacacaacaagggtgttgtttagtattattattgattattattcattgtttgttgttgtcatgagcttcaacaagctcaaagtgtggaatgtgccactactcttggtggtgtttgcatgttcactgcttggtcaagcttcagcttctgtgtcctatgaccataaggctatcatcatcaatggacagagaaggatacttctttctggctccattcactaccccagaagcacccctgagatgtggccagatcttattcagaaggcaaaggaaggaggtttggatgtcattcaaacttatgttttctggaatggacatgaaccttcacctggcaaatattattttggaggaaactatgatctggtgaggttcataaagctagtgcagcaagcaggcctctatgttaacctcagaattggtccttatgtttgtgctgaatggaacttcggaggattccctgtttggctcaagtacattccaggtatcagcttcagaacagacaatggaccatttaagtttcaaatggaaaagtttaccaagaagattgtggatatgatgaaagcagaaaggttatttgagtctcagggcggtccaataattctgtcccagattgaaaatgaatacggacctatggagtatgaaattggtgctcctggtagatcctacactcaatgggcagcacatatggctgtaggacttggcaccggggttccatggatcatgtgcaagcaagatgatgctcctgatcctattattaacacttgcaatggcttctattgtgattatttctctccaaataaggcttacaaaccaaagatgtggacagaggcttggactggctggtttactgagtttggaggtgcagttcctcacagacctgctgaggacttggcattttcaattgcaaggtttatacagaaagggggatcatttgtcaattattatatgtatcatggcggaacaaattttggtcgaactgctggtggcccctttattgctacgagctatgattacgatgcgccccttgatgaatatggattggccagacagccaaagtggggtcatctgaaggatttacatagagcaataaaactctgtgaacctgctttagtatctggagattctactgtacaacggcttggaaactatgaagaggctcatgtttttagatccaagtctggagcttgtgctgcattccttgcgaactataacccacaatcttatgcaacagtggcatttggaaatcagcattacaacttgcctccttggtctataagcattcttcctaactgcaagcacactgtttataacactgcaagggttggttctcagagcacaacaatgaagatgactcgtgttcctattcatggaggactatcttggaaagcgtttaatgaagaaacaaccactactgatgatagttcgttcactgtgactggcttgttggagcagataaatgcaaccagagatttatctgattacttgtggtactccacagatgttgtgatcaattccaatgaaggatttttgaggaatggaaagaatcctgttcttacagttttgtctgctgggcatgctttgcatgtttttatcaacaatcagctgtcaggaactgcatatggaagcttagaggcccccaaactaacctttagcgaaagtgtgaggctcagagctggtgttaacaaaatctctcttctaagtgttgcagttgggcttccgaatgttggtccacattttgaaagatggaatgctggtgttctaggcccaattacattaagtggtctcaatgagggtaggagggacttaacttggcagaagtggtcatacaaggttggtcttaaaggtgaagccttgaatcttcattctcttagtggaagttcctctgttgagtggcttcaggggtttttagtttccagaagacagccattgacttggtacaaaactacctttgatgccccagctggagttgcaccgttggctttagacatgggcagcatgggcaaaggtcaagtgtggataaatgggcaaagcctaggccgctactggcctgcttacaaagcatccggttcttgtggttactgtaactatgctggaacttacaatgagaagaaatgtggaagtaactgtggcgaggcttctcaacgatggtatcatgttcctcactcatggctgaagccaagtggaaatttattggttgtgtttgaggaattgggtggggatccgaacgggatctttttggttagaagggatatagatagtgtatgtgctgacatctatgagtggcagccaaatcttgtaagttatgagatgcaagcttctggcaaagtcagaagtcctgtgagaccaaaagcacatttgtcatgtggacctggacaaaaaatatcatcaatcaagtttgctagctttggcactccagtagggtcttgtggaagctaccgcgaaggaagttgtcatgctcacaagtcatatgatgctttcctaaagaattgtgttggccagagctggtgcacagtgacagtgtctcctgaaatttttggaggagatccttgtccaagagtcatgaagaaactctctgtggaggccatttgcacctgatcattttcaacatctgaaaataagtggaataaagtttccatattgatttattctgcaattgaatacatggtgttttgggtcagctaagtttacacttgtagaccaccactggcattaatttggctttaccaaggtgaaattgcaaatgaatacacaccatgtggttgaaagcctgctgggatgattgttgtggttttatgtgtatatatattggtgttgtggttgttatactgaagtggaggagagggtgaaaaagttacctgatgcacattgagacgacatcgattgagtccatgtgcaaaattggtttttgtttgtgtggaagtctctagcttcctgtgatgtaatgttataatattaccttgtagttgtaaggagaaagcaatttggcgctttcttataagaaaacaacccaatgtaataacataaggtatattaattcaatcatgttttgcttttactttttcttgtttcgagaaagtgtcactaatacattttttctacccttagttgaagtttgattaaaatttacaaaatgattaagtctccattagaaagaagtgagacttaacattattttttaattcaataaa

SEQ ID NO: 8319 - DNA, 3186 bp, Glycine max
aacctccctttttttttcttcctttaacaccgttttttctcttcaatcattctgctaaaaggaggagacttgagcacagaacataagcatagaataaagtgtgcaagggcaactgcttttccaagctgagaaacaaacaacacaacaagggtgttgtttagtattattattcattgtctgttgtcatgagcttccacaagctcataatgtggaatgtgccactactcttggtggtggtggtgtttgcatgctcactgattggtcatgcttcagcttctgtgtcctatgaccataaggctatcaccatcaatggacaaagaaggatactcctttctggctccattcactatcccagaagcacccctgagatgtggccagatcttattcagaaggcaaaggaaggaggtttggatgtcattcaaacttatgttttctggaatggacatgaaccttcacctggcaaatattattttgggggaaactatgatctggtgaggttcataaagctggtgcagcaagcaggcctctatgttaacctcagaattggtccttacgtttgtgctgaatggaactttggaggtttccctgtttggctcaagtacattccaggtatcagcttcagaacagacaatggaccgtttaagtttcaaatggaaaagtttaccaagaagattgtggatatgatgaaagcagaaaggttattcgagtctcagggcggtccaataattctgtcccagattgaaaatgaatatgggcctatggagtatgaaattggtgctcctggtagagcctacactcaatgggcagcacatatggctgtaggacttggcactggggttccatggatcatgtgcaagcaagaagatgctcctgatcctatcattaacacttgcaatggtttctattgtgattatttctctccaaataaggcttacaaaccaaagatgtggacagaagcttggactggctggtttactgagtttggaggtgcagttcctcacagacctgctgaggatttggcattttcaattgcaaggtttatacagaaagggggatcatttgtcaattattatatgtatcatgggggaacaaattttggtcgaactgctggtggtccctttattgctacgagctatgattacgatgcgcctcttgatgaatatggattgcccagacagccaaagtggggtcatctgaaggatttacatagagcaataaaactctgtgaacctgctttagtatctggagatcctactgtacaacagcttggaaactacgaagaggctcatgtttttagatcaaagtctggggcttgtgctgcattccttgcgaactataacccacaatcttatgcaacagtggcatttggaaatcagcgttacaacttgcctccttggtctataagcattcttcctaactgcaagcacactgtttataacactgcaagggttggttctcagagcacaacaatgaagatgactcgtgttcctattcatggaggactatcttggaaagcatttaatgaagagacaaccactactgatgatagttcgttcactgtgactggcctgttggagcagataaatgcaaccagagatttatctgattacttgtggtactccacagatgttgtgatcaattccaatgaaggatttttgaggaatggaaagaatcctgttcttacagttttgtctgctgggcatgctttgcatgtttttatcaacaatcagctgtcaggaactgcatatggaagcttagaggcccccaaactaacctttagtgaaagtgtgaggctcagagctggtgttaacaaaatttctcttctaagtgttgcagttgggcttccgaatgttgggccacattttgaaagatggaatgctggtgttcttggcccaattacattaagtggtctcaatgaggggagaagggacttaacttggcagaagtggtcatacaaggttggtcttaaaggtgaagccttgaatcttcattctcttagtggaagttcctctgttgagtggcttcagggctttttagtttccagaagacagccattgacttggtacaaaactacctttgatgccccagctggagttgcaccattggctttagacatgggcagcatgggcaaaggtcaagtgtggataaatggacaaagtctgggccgctattggcctgcttacaaagcatccggttcttgtggttactgtaactatgctggaacttacaacgagaagaaatgtggaagtaactgtggccaggcttctcaaagatggtatcatgttcctcactcatggctgaagccaactggaaatttattggttgtgtttgaggaattgggtggggatccgaacgggatctttttggttagaagggatatagatagtgtatgtgctgatatctatgagtggcaaccaaatcttgtaagttatgacatgcaagcttctggcaaagtcagaagtcctgtgagaccaaaagcacatttgtcatgtggccctggacaaaaaatctcatcaatcaagtttgctagctttggcactccagtagggtcttgtggaaactaccgcgaaggaagttgtcatgctcacaagtcatatgatgctttccaaaagaattgtgttggccagagctggtgcacagtgacagtgtctcctgaaatttttggaggagatccttgtccaagtgtcatgaagaaactctcagtggaagccatttgcacctgatcattttcaatctccgaaaataagtggaataaagtttccatattgatttattctgcaattgaatacatggtctttgggtcaaagtttacacctgtagaccaccagaggcattaatttggctttaccaaggtgaagttgcaaatgaacacaacacaccatgtggttgaaagcctgctgggatgattgtggatttgtgtgtatatatattggtgttgtgcttgttatactgaggtggaggaggatgaaaagatacctgatgcacattgagacgacatcgattgagtccatgtgcaaattggtttttgtttgtgtggaagtctctagcttcctgtgatgtaatgttataatattaccttgtagtagttgtaaggagaaagcaatttagtgcttttttattataagaaaacaacccaatgtaataacatctggtatattgattcaatcatgttttgcttttacttcc

SEQ ID NO: 8320 - DNA, 3110 bp, Cicer arietinum
attacaaagcaaagagaacattgaagtttttatttttattattattcattgttgttatcatgggcttcaagctcaatgtgttgttgctattggtgttgctttcaagttcattgattggtcattttgaagcctctgtgtcatatgattataaagctatcaccattaatggacaaagaaagattctactttctgggtctattcattaccccaggagtactcctgagatgtggccagatcttatccaaaaggctaaagaaggtggtttggatgtgattcaaacttacgttttctggaatggacatgaaccttcacctggaaaatactattttgaagggaactatgatttggtgaagttcataaggctggtgcagcaagcaggactctatgttcatctaagaattggtccttatgcttgtgctgagtggaactttggaggttttcctgtttggctcaagtacattccaggaatcagcttcagaacagacaatggaccttttaagtttcaaatgcaaaaatttactactaagattgtgaatataatgaaagcagaaagactatatgagtctcagggtggtccaataattttatctcagattgaaaatgaatatggacctatggagtatgaactcggtgctcctggtaaagcctatgctcagtgggcagcacatatggctataggacttggtactggtgttccatgggtcatgtgcaaacaagatgatgctcctgatcctgttattaatacttgcaatggtttctattgtgattatttctctccaaataaggcttacaaaccaaagatgtggacagaagcttggactggctggtttactggatttggaggtacagttcctcatagacctgccgaggacttggcattttcagttgcaaggtttatacagaaaggaggatcatttatcaattattacatgtatcatggtggaacaaattttggaagaactgctggcggcccttttattgccacaagctatgactatgatgcacctcttgatgaatacgggcttcttaggcaaccaaagtggggtcatttgaaggatttacatagagcaataaaactctgcgaaccggctttagtttctgcagatcctaccgtaactcgtcttggaaactatcaagaggctcatgtttttaagtcaaagtctggagcttgtgctgcattccttgcaaactataatccacactcttattcaacagttgcatttgggaatcagcattacaacttacctccttggtctataagcattcttcctaactgcaagcacactgtctataacactgcaaggcttggttcccagagcgcgcaaatgaagatgacacgtgttcctattcatggaggactctcttggaaagcgtttaatgaagagacaaccactactgatgatagttccttcactgtgactggcttgttagaacagataaatgcaactagagatttatctgactatttgtggtactctacagatgttgtgatcaatccggacgaaggatattttaggaatggaaagaatcctgttcttacagtattatctgctggtcatgctttgcatgtttttatcaatggtcagctgtcaggaactgtatatggaagcttggatttccccaaactaacttttagtgagagtgtgaaccttagagctggtgttaacaaaatctcccttctaagtgttgcagttggactgccgaatgttggtccacattttgaaacatggaacgccggtgttcttggtccaattacattgaatggtctcaacgaggggagaagagacttaacatggcagaagtggtcatacaaggttggtcttaaaggtgaagacttgagtcttcattctcttagtggaagttcctctgttgattggcttcaaggatatttagtttctcgaaggcaaccgttgacttggtacaaaactacttttgatgccccggccggagttgcgccgttggctttagacatgaacagcatgggaaaaggtcaagtgtggttaaacggacagagtctcggacgttactggcctgcttataaagcaactggttcttgtgattattgcaattatgcaggaacttacaatgagaaaaaatgtggaactaactgcggcgaggcttctcaacgatggtatcatgttcctcattcttggctgaaaccaacaggaaatttgttggttatgtttgaggaattaggtggtgatccaaatggagtgtttttggttagaagggatatagatagtgtttgtgctgatatttatgagtggcaaccaaatcttgttagttatcagatgcaagcttctggtaaagtaagcagacctgtgagtccaaaagcacatttgtcatgtggtcctggacaaaaaatctcatcaatcaaatttgccagctttggcactccggtagggtcttgcggaaactaccgcgaaggaagttgtcatgctcacaaatcatatgatgcttttcaaaggaattgtgttggtcagagttcatgcaccgtgacggtatctcctgaaatttttggaggtgatccatgtccaaatgtcatgaaaaaactctcagtagaggccatttgcacctgatcattttcaatctcagaaaataaatggaacaaagatttaaaatatatttttccttatgcaattcaatacatggttttttggtccatcaaaatctactacacttctagatcaccagcagcattaaatttggcttttacaaaggtgaagttgcagatgaacacaacacactatttggttgaaaagcctatagagagttgctgtgatgattgtggttatgttatgtgtatatatattggtattgagcttgtgttatatacaaaggtgaaagaagttgaaaagttggttgatgcacattgagatgacaccaattgagtccatgtgcaaattggtttttgcttgtgtggaagtctcttgcttcctgtaatattattcttgttattactataaattgttttcctttgtagatgcatggagagagcaatttagttattttctatttgagagaaactttctaatgtaataagattagacatgttaaattcagtgataatgttattatggtttgaagtccttgtttcttcaaaaaaaaaa

SEQ ID NO: 8321 - DNA, 3311 bp, Populus trichocarpa x Populus deltoides
gagacccactactattcttctactcgtctactcattaactaaaaagctaaacaacagctgctgctaatctacatttgttgtccctaagccaaagcaacagcacccaataaaccaatccagctgttttcttatttctctctttgtgaagaaagaataaagtgtgcgcagagagaaagcaaaaataaagagagagaaagccaaagcaaagaaaggccattgttttgaaagttgtcatctcttcttctcatgctcattgctcaatggctttgaagaagacatcaatgtgcaatagcagtaatgcgttgctggttttattgtttttggtgagttctttggcctgttctgtcactgcctctgtgtcttatgactctaaggccatcaccattaatggccaaagaaggattcttatttctggatccattcactacccaagaagttcccctgagatgtggccagatcttattcagaaggcaaaagaaggaggactggatgttattcagacatatgttttttggaatgggcatgaaccttcaccaggaaagtattattttgaggggaactatgatctggtcaagtttgttaagctggcgaaggaagcaggcctttatgttcatctcaggattggaccttatatctgtgctgagtggaactttgggggtttcccagtttggctcaagtacattccaggcatcaatttcagaacagacaatggccctttcaaggctcaaatgcagaagttcacaacaaagattgttaacatgatgaaagcagaaaggttatttgagactcaaggtggtccaataattctctcccagattgagaatgaatatggacccatggagtatgaaattggttcacctggtaaagcttacaccaaatgggctgcagaaatggctgtaggtctccgtactggtgtcccatgggtcatgtgcaagcaagatgatgccccagatcctattatcaacacctgcaatggtttctactgtgattacttctctccaaacaaagcttacaaaccaaagatgtggactgaagcttggactggctggtttacccaatttggtggcccagttcctcaccgaccggctgaagacatggcattttcggttgcaaggttcatacagaagggggggtcattcataaactattatatgtatcatggagggacaaattttggccgaactgctggtggtcctttcattgcaacaagttacgattatgatgctcctcttgatgaatatggactgttaaggcagcctaaatggggccatttgaaagatttgcatcgggcaattaagctgtgtgaacccgctttagtatctggagatgcaactgtgataccacttggaaattaccaagaggctcatgtattcaattataaggccggaggttgtgcagcattccttgcaaattaccatcagagatcatttgcaaaggtgtcatttaggaatatgcattataacctgcctccatggtccatcagcattcttccagattgcaagaacactgtttacaacactgcaagggttggagctcaaagtgcaaggatgaagatgacccctgttcctatgcatggagggttctcttggcaagcatataatgaagagccgtctgcaagtggtgatagcacattcactatggttgggttgctggagcaaataaatacaactagagatgtttcagactatttgtggtacatgacagacgttcatatcgaccccagcgaaggctttctgaggagtggaaaatatcctgttcttggtgttctatcagctgggcacgctttacatgttttcatcaatggtcaactatcagggaccgcctatggaagtttagacttcccaaagttgacatttactcaaggtgtaaagttgagagctggcgtcaacaaaatttctcttctcagcattgctgttggtctcccgaatgttggcccacactttgagacatggaatgctggtattcttggacctgtgacgttgaatggtctcaatgagggaagaagggacttgtcctggcagaagtggtcttacaagattggtcttcatggggaagcattgggtctccattcaatcagtgggagttcctcggttgagtgggcagagggatctttggtggcccaaagacagccactgtcatggtataaaactactttcaacgctcctgctgggaattcccctttggcattggatatgggcagcatgggaaaaggccagatatggataaatggacaacatgttggacgtcactggcctgcttataaagcatctggaacatgtggggactgtagttatattggaacttataatgaaaagaaatgctcaactaattgtggcgaggcttcccagagatggtatcatgtccctcagtcatggctaaagccaacagggaacttgctggttgtgtttgaagaatggggtggagatccaaatgggatttctttggttagaagagatgtagacagtgtgtgcgctgatatttatgagtggcagccaactttgatgaattatcagatgcaagcatctggtaaagtcaataagccactgaggcctaaagctcatctgtcatgtggccctggacagaaaatcagatcaatcaagtttgccagctttgggacaccagaaggggtttgtggtagctatcgccagggaagctgtcatgccttccactcttatgatgcttttaacaatctttgtgttgggcagaattcatgctcggtgactgtagcacctgaaatgtttgggggagatccttgcctgaatgtcatgaagaaactagcagtagaggccatttgcagctgatgagctacaacggctgaagtaaatgaaataaagaagattctggattttgattttctcaccctccaatacagcatcttcggtatactattttatggttaaattaaaagcttctcaaccaagagcactacaaacatttgttctggcttttccagggtgaagttgtacaaatatacagcacgccatctggtcgatagccatatagattgtgcaaatgattgcagataagcttttttatataggcggagccagtgtttattgttggtgccctgtatatgcagcaaacaagtgaagggagtgggttcggtagaagcacattgagatgaaaaactaaacgagtccatgtgcaaatttggtagtttttagagtatggaaagcctctggtttcctgtgatcttatattttttattcaatgtaaacttcctgggaaccacttcctttgttgctttgttcttgtaagaaagtttctaagttaaagaaatgataccaaacttcccaaaaaaaaaaaaaaaa

SEQ ID NO: 8322 - DNA, 3309 bp, Fragaria x ananassa
caacactgtagtgtggttctacacttctatactctctagtctgaaaaccccaatagcccaaccctgtcattttacctagagagaaaaactgaaaaggcaagcaggacatacccagctgggtttcctttgtccctgtctatcaaagcagaaaaagggtagcatataataaagtggggaagaagaacaaagaaagaatatagcaaaaaggtcattgctttggtgggtttgctaattaaggagggagaagggttgggaaagcttgctgctttggtttgggctgatgttatgggtttgaggcttgtaatgtggaatgtggtggtagcagcagccctggtggtgttgtgttcttgttttgcttctgtgagagcctctgtttcttatgattccaaggccattgtcatcaatggccagaggaggatcctcatttctggatctattcactacccaagaagcacccctgagatgtggccagatcttattcagagagccaaggatggaggcttggatgtgattcagacttatgttttctggaatgggcatgagccttcacctggcaaatactattttgaggacaactatgatctggtcaaatttatcaagctggtacagcaggcgggcctttatgttcatctcaggattggtccttatgtttgtgcagagtggaactttgggggatttccagtttggctgaagtacgttcctggtatccaattcagaacagataatggacctttcaaggatcaaatgcaaagattcacaacaaagattgtaaacatgatgaaagcagaaaggctgttcgagtctcatggcggtccaataattctatcccagattgaaaatgagtatggccccatggaatacgaaattggagcaccgggtaaagcctacactgactgggcagctcaaatggctgttggacttgggactggtgtcccctgggtcatgtgcaaacaagatgatgcccctgatcctgttattaacgcttgcaatggcttctattgtgattacttctctccaaacaaggcttataaaccaaagatgtggactgaagcctggactgggtggtttactgagtttggaggtgcagttccttaccgaccagctgaggatttggcattttcagttgcaaagtttttacaaaagggtggagcattcattaactattatatgtatcatggaggaacaaattttgggcgaactgctggtggtccattcatcgctactagttatgattacgatgctcctctggatgaatacggactgttgaggcaacctaaatggggccatttgaaagatctgcatagagcaataaagctgtgcgaaccagctctagtttctagtgatcccaccgtaacaccacttggaacttatcaggaggctcatgtattcaaatcaaattctggagcttgtgccgcatttcttgcaaactacaatcggaaatcatttgcaaaagttgcatttgggaacatgcattacaacctgcctccatggtctattagcattcttcctgactgcaagaacacagtttataatactgcaaggattggtgcgcaaactgcacgaatgaagatgccccgtgttcctattcatggaggattctcttggcaggcttacaatgacgaaactgccacgtacagtgacacttcatttaccacagccggattgttggagcagataaatatcactagggatgccactgattacttgtggtacatgacagatgttaagattgatcccagtgaggactttttgcgaagtggaaattatcctgtgctcacagtcttatcagctggtcatgctttgcgtgttttcatcaacggtcaacttgcaggaactgcttatggaagtctagaaaccccaaaactaacatttaagcaaggtgtgaatttgagagctggtatcaaccaaattgcccttctcagcattgctgttggtctgccgaacgttgggccacattttgagacatggaatgctggcattcttggcccagtcatcttaaatggtcttaatgagggaaggagggacttgtcatggcaaaaatggtcttataagattggacttaaaggagaagctttgagtcttcattcgctgactggaagttcctcggtagagtggactgaggggtcttttgtggcacaaaggcagcctcttacatggtacaaaacaactttcaatagaccagctggaaattcaccattggctttagatatgggcagcatgggaaaaggtcaagtttggataaatgaccggagtattggccgctattggcctgcttataaagcatctggtacttgtggtgaatgcaactatgccggaacatttagtgagaagaaatgcttaagtaattgtggggaggcttctcagagatggtatcatgttcctcggtcatggctgaacccaacaggcaacttgttggttgtgttagaagagtggggtggcgacccaaatgggatatttttggtcagaagggaagtagatagtgtatgtgctgatatttatgagtggcaaccaaatcttatgagttggcaaatgcaagtctcaggaagggtcaataaacctctaaggcctaaagctcatttgtcatgcggccctggccagaaaatctcatcaataaagtttgctagtttcggaacaccagaaggggtttgtggaagcttccgagagggaggctgtcatgctcacaagtcttataatgcttttgaaaggagttgcattggacagaactcatgctcagtaactgtatcacctgagaattttggaggggatccatgtccaaatgtcatgaagaaactctctgtggaggccatttgcagctaatgattctgagtctcaagtacacgaatgaaggtcataatcttgatttcttcacactgttacacaacacatcaattgcggttaattatcattgggttaagataaaatctgcgcacacaagatcagtgcaaccattcatttttggctttctcctaggtgaagttgtacaaatatacaacacaccacatggttgaaagcctatagagtttgtgatgattgtgggagagtctggatatgtacatactatcatctgaattgatggttccatggaagctacaaaagatgtggaatcaaagcatggtggatcgtaaaggaagcacatcgagatgatactaattttgagtccatgtgcaactgcctagttagtatggaagcatctggtttccaagtaatttaaatttagttcagtttcgagttgggaagcaattgcttcttttgcttcaatgttgtaatttgtaagaaagttttcaatggtaatagcatcaacttgttatc

SEQ ID NO: 8323 - DNA, 3320 bp, Prunus persica
acactaattcacacttactggcaagcaactgcactagtctgaaaaaagcacagctcttaaatctcattttcctttttttttcctctcattttttcctagaaagaaaataaagaaacctctcaggtaaagaaaaaggaagacataaaccagctgggttaccttgtctttctccccattcaccaaaagaagcatataataaagtggcagagaaacaaagaaagaataatagcagcaaaaaggccactgctctggtggtgagctcaagggtggaaagctcaaatttgctagttttttgtgtatggggttgaggcttgtaatgtggaatgtactagtgctcctggtggtgttgtgttcatgggttggttctgcaaaagcctctgtgtcttatgactctaaggctattgtcattaatgggcagaggaggatcctcatttctggatctattcactacccaagaagctcccctgagatgtggccagatcttattcagaaagccaaggaaggaggtttggatgtgattcagacttatgttttctggaatgggcatgaaccttcacctggcaaatattattttgaagacaactatgatctggtcaagtttatcaagttgattcagcaggcaggcttgtatgttcatctcaggattggtccttatgtttgtgctgaatggaacttcgggggatttcctgtatggctcaagtacattcctggtatccaattcagaacagataatgggccttttaaggctcaaatgcaaaggttcacaacaaagattgtaaatatgatgaaagcagaaaggttatttcagtctcaaggcggtccaataattctatcccagattgaaaatgagtatggacccatggagtatgaacttggtgcaccgggcaaagtctacactgactgggcagctcatatggctttgggactaggcactggtgtcccctgggtcatgtgcaaacaagatgatgcccctgatcctattattaacgcatgcaatgggttctactgtgactacttctctccaaacaaggcctacaaaccaaagatgtggactgaagcctggactggatggtatactgagtttggaggtgcagttccttcccgaccagctgaggatttggccttttcagttgcgaggtttatacagaaaggtggatcattcattaattattatatgtaccacggaggaacaaattttggccgaacagctggtggccctttcattgctactagttatgattacgatgctccccttgatgaatatggattattaaggcaacctaaatggggccatctgaaagatctgcatagagcaataaaactatgtgaaccagctctagtttctgcagatcccactgttacaccacttgggacttaccaagaggctcatgtattcaaatcgaagtctggagcatgtgctgcatttcttgcaaattacaatccaagatcatttgcaaaggtggcatttgggaacatgcattacaacctgcctccatggtctattagcattcttcctgactgcaagaacacagtttataacactgcaagggttggtgctcaaagtgcacagatgaagatgccccgtgttcctctgcatggagcattctcttggcaggcttacaatgacgagactgctacttatgctgacacttcatttaccacagccgggttgttggagcagataaataccactagagattcctctgattatctgtggtacctaacagatgttaagattgatcccaatgaggaatttttgagaagcggaaagtatccggtactgacgatcttatcagctggtcatgctttgcgtgttttcatcaatggtcaacttgcaggaacttcatacggaagtttagaatttccaaaacttacatttagtcaaggtgtgaatttgagagctggtataaaccagattgcgcttctaagcattgctgttggcctcccgaatgttggtccacattttgagacttggaatgctggtgttcttggccccgtcatactaaatggtcttaatgagggaaggagggacttgtcatggcagaaatggtcttataaggttgggcttaaaggagaagccttgagtcttcattcactcagtgggagttcctcagttgagtggattcaggggtctttagtcacaagaaggcagcctctgacatggtacaaaacaactttcaatgcaccagctggaaattcaccattggctctagatatgggcagcatgggaaaaggtcaagtatggataaatggcaggagtattggacgctactggcctgcttataaagcatccggtagttgtggtgcctgtaactatgctgggtcatatcatgagaagaaatgcttaagtaactgtggggaggcttcccagagatggtatcatgttcctcgcacatggctaaatccaacaggcaatttgttggttgtcttagaagagtggggtggagatccaaatgggatatttttggtcagaagggaaatagatagcatatgtgctgatatttatgagtggcaaccaaatcttatgagttggcaaatgcaagcctcaggcaaggtcaaaaaacctgtgaggcctaaagcccatttgtcatgtggccctgggcagaaaatatcatcaataaagtttgctagctttggaacgccagaagggggttgtggaagcttccgtgagggaagctgtcatgcgcacaattcatatgatgcttttcaaaggagttgtattgggcagaactcatgctcagtaactgtagcacctgagaatttcggaggtgatccgtgtccaaatgtcatgaagaaactctctgtggaggccatttgcagctagtgattctcagtctctcaagcaaacaaatgaaggtcgtatattgatttctttacacaccaatacagcaatcagttaattatcctggggtatgttaaagtacacacaaggtcagtgcaaccatttggtccattaaattttggctcttccagggtgaagttgtacaaatatacaacacaccacatggttgaaagcctatagagtttgagatgtttgtggagaagctgtatgtatatactatcctccgttttcattggtgccctgcatgctacaaaaatggcggaatcaatgttgggatcgaaagcacatcgagatgatactaattgagtccatgtgcaaatgttgtagttagtatggaagcatctggcttccaagtatttgaaatatttcaattgttatgtatttgagaaagcaatagttccattgctttgttcttgtaagaaagtttccaatggtaataatagaaagttcaattgctttgttaaaaaaaaaaaaaaaa

SEQ ID NO: 8324 - DNA, 2237 bp, Glycine max; identical to SEQ ID NO: 8289

SEQ ID NO: 8325 - DNA, 2235 bp, Glycine max; identical to SEQ ID NO: 8288

SEQ ID NO: 8326 - DNA, 2185 bp, Medicago truncatula; identical to SEQ ID NO: 8290

SEQ ID NO: 8327 - DNA, 2045 bp, Glycine max
agatcacaatgctaactcgtaaacgactcgtcgtttctctctctctcgccactctccttctcttctcatccctctctctctctctctgcgataaaaccccccctcaaaacgacaacaaaaaaaacaacaacgacgacgacgaagatctcagcttcctcgaggaatccgatgacgctgccaccacttctcaccaaggccattttccagatcccgacgagttcgacgaggacgacggcgacgacgaggacgacttcggcgacttcgctggcttcgaccactcgtcggaggaggcgttcaaggagcccgaggtggacgacaaggacgtcgtcgttttgaaggagcgcaacttcaccaccgtcgtcgagaacaaccgcttcgtcatggtcgagttctacgcgccctggtgcggccactgccaggccctcgcgccggagtacgccgccgccgccaccgagctcaagcccgacggcgtcgttctcgccaaggtcgacgccaccgtcgaaaacgaattggcgaacgagtacgacgttcagggtttccccaccgtcttcttcttcgtcgatggggtccacaagccctacactggccaaagaaccaaagacgctatagtgacatggattaagaagaagataggacctggtgtgtccaacattactacggtggaagaagctgaacgtgtattgaccgcgggaagcaaagttgttttgggcttccttaactctttggttggtgcagagagtgacgaactggctgcagcatcaaagcttgaggatgatgtcaatttttatcaaactgtggtagctgatgtggcgaagcttttccatattgatgcaagtgttaaacgccctgctttgatcttgctcaagaaagaggaggagaaattgaaccattttgatggccaatttgtaaaagctgaaatagctgattttgtaacctccaacaagcttcctttggttacaacttttactagagaaagtgccccggtaatctttgaaagtcaaatcaagaaacaattgttgctgtttgtgacttcaaatgatacagagaagtttgttccagtatttaaagaagcagcaaaaattttcaaggggaagctaaaacctttcctcaagtcagatccagttcctgaaagcaatgatggtgatgtgaaaatagttgttggtaataactttgatgaaattgtcttggatgagtcaaaggatgttctgcttgagatttatgctccctggtgtggccactgccaagctctggaaccaacatacaacaagcttgctaaacatcttcgcagcattgagtctattgttatagccaagatggacggaacaacaaatgagcatcccagggccaaatctgatggattccccactcttctcttcttcccagcaggaaacaagagttctgaccctattcctgttgatgtggaccgtacagtgaaagacttttataagttcctcaggaaacatgcatcaatcccattccagctccagaaactagcctcaactactaaaaccgccagtgagagttctgatgtcaaggagagccaaagcagcaccaccgaagtgaaggatgaattatgagagataaaggatatttctatttataaagatatatgattcagacagatgataaccgagtgaaaaggtgcttagcaaagaaagtgacacaacgattgggagagaaagccgtctatttttcctcacccttccaaaagacaactagccaagtagagggtagtgaaaaaatgaggtaacctgtgtattagtttcttcaacttttacatgtttgagtattagaattttggttgagactttaattttaaaaatggctcgaaattttattgtatctgcagtcaattttattttcggtgtcagattatttggttatttttgcccttagtaggttaagctagttgataaaaaaattgaactttcattaaagaatgggtttgacatgcaaggcaaattgcatggattgtgttgttatttgcttgtacaaaagttattttaaatatttcacaaactaccgacaaaaaggcatttcataaa

SEQ ID NO: 8328 - DNA, 1217 bp, Glycine max
  misc_feature (852)..(852): n is a, c, g, or t
gttctgatggtttgaggttggtgagttgccgtcattcgtcaatctgtgtccttgccttactttccatatatagcagttattaattactatcaatctttttaagccagatccctaacccctccctttacgcacttgaaaccatgctttttcataatcaaccgatggagctggttctccttcaaatcctgaggctggcatggctcgctgccacattacccatcatcgtcgcttctattcccactcccaagctcagctgcctccgtgccaccttgttggcttttgctcgtagaggcaaaatcatgcactcctcccaaaaattcactatttctcagaggttcttcttgcacttctacattgtggcttttatatggacaacgttgctacttcttgggacttgggcgtatgcgtacaacatggtgccacttgttgtggagccgttttcttactctaccatcactagcttcttgacaggtggttctactatcaaaactgatacgtataaattgaggcagggatatgtggcttggcaagcggtttttctgcttttgatgatggaagttcaagtcctcagacgactttatgagactagacacgtttttaactatagtccttctgctcgtatgcacgtcattggttatctcactggattgtttttctacgtaggagcaccactatcgctgtgtggcggttgtgcagtagaggtgtttaacttcctagcaaatctagtgaccaagttcattgtcaagggcaagaatcagatgcaagtaacagagttagaattctggcaagttgtaaatcctctcttcaagcttgggtggaagcattggattggtgctgctgttttcttatggngttggattcatcaacaccagtgccataagattcttggttctctacgacattcaagacaggcagatgaatatgtaattcctcatggtgattggtttgaaatcgtctcctctcctcattatctctctgaaattgttatatacgctagttttgtggttgctactggaggatccaacctaacaatctggctactttttgtttttgtggtggcaaatctggcatttgcagctgtggaaactcatagctggtatcgtcagaaatttgaagattatccaagtagtcggtttgctataattccatttattctgtgagattgtgaagcaatgtgtaattatcacaattgatcacctcaaagaacttcattattt

SEQ ID NO: 8329 - DNA, 1298 bp, Glycine max
atggaggtggttctcgttcaaatgctgaggctggcatgggtcgctgccacgttacccatcatcgtcgcttctattcccactcccaagctcaactgcctccgtggcaccttgctgggttttgctcgtagaggcaaaatcatgcactcttcctcccaaaaagtaactatttctcagaggttcttcttgcacttctacgttgtggcttttatatggacaacgttgctacttgttgggacttgggcatatgcgtacagcatggtgccacttgttgtggagccgttttcttactctactatcactagcttcttgactggtggttctactattagaactgatacgcataaattgaggcagggatatgtggcctggcaagcggtttttctgcttttgatgatggaagttcatgtcctcagacgcctttatgagacgatacatgtttttaactatagcccttctgctcgcatgcatgccgttggttatctcactggattgtttttctacgtaggagcaccactatcgctgtgtggtggttgtgcagtagaggtgtttaacttcctagcaaatctagtgactgagttcattgtcaagggcaagaatcagatgcaagtaacagagttagaattctggcaagttgtgaatcctctcttcaagcttgggtggaagcattggattggtgctgctgttttcttatggggttggattcatcaacaccagtgccataagattcttggttctctacgacattcaagacaagcagatgaatatgtaattcctcatggtgattggtttgaaattgtctcctctccacattatctgtctgaaatcgttatatacgctagttttgtggtcgctactggaggatccaacctaacaatctggctgctttttgtttttgtggtggcaaatctgtcatttgcagctgtggaaacacatggctggtatcgtcagaaatttgaagattatccaagtagtcgctttgctataattccatttattctgtgagattgtgaagcaatgtgtaattatcacaattgatcacggcaaagaacttcattatttcccaaggtgtacttgtttagattaagctattttagtttagagaatcttatacttcaaatacctaaacctaaataatatttggctttgtttttggtgtaaaaatccaaacattcagagtcagtcgtgtattatttacccaccaaaataatacctaaaatagttatgattgcattcattatggaaattactgtcgtgtattatttacccaccaaaataatacctaaaatagttatgattgc

SEQ ID NO: 8330 - DNA, 1771 bp, Glycine max
gaagcacactacttattgttgttcattgtgaaatcatcatcatcatgggttgctcagcctcaagaaccatcaccatagtggccaacaacaataaccaagaggatccatctccttctgcttctcttgcttcttcttcttcttccttctcttcctcttctgcttcacacaaatccatcaactctgcttcttcaccagcagcggcaccagttagaagaagaactctttctctcccaatgcctctcgttcatcatcctcccatcaaaaagggtgactcacaccaccttgtctctctcacctccaccacctatggctcccttctccccattgaccaaaaagactcaaactttacccaaaaaaaccaaccccacataaccaaaacctcaaaccaaactgacccagaacactcactctccccggactcagtcatcaacacttgggaactcatggatggcttagatgaagaacaagaacaagaacaagaaattgcaaatgccaagaagcttccttacgcttccattttggacaaaccaagttcatgcaggtacacagcatttgatggttctgcaaggaagaaacttctagattcctttgaatcaatgaaaacttcacaaacagcaatggaaaaggacttaaactcttcttcttctacatctcctgcaccaacaacgaagaagccactttggcagcacttatctgaggaagctttgcttgctaagttggatccaagtgtggcttggagttacagaagagcattatcatcaaggaatctagatagaaacattctatctagagatgttaggtcaatggggtctagccctttgatctttcattcttcttcttcttgttcttcttcttctttttcatttggtaagaataataatattaataatagtttgtgccgtttgtctggcactgaggacagaatagtgctttattgcactagtttgagagggatccgaaagacctatgaggattgttgttcggttaggatgattctgaggggcttcagagttgcggttgatgagagggacatctcaatggattcgtcctataggaaggagttgaaggatttgcttggtggaaaagcagcagtgacattgcctcaggtctttatcagagggaggtatgtggggaatgctgaggaaatgaagcatctgaatgagtctggggaattggcaaggcttttggagggttttcccactcaggatccagggtttgtgtgtgacaactgtggtgatgccaggtttgtgccatgccccaattgcagtggtagcaggaaggtgtttgagcatgaagatggagggttgagaaggtgccctgaatgcaatgagaatggcttgataagatgtccaggttgcggctcatgattcatggaaattagtcatctaaatcaggtataccccgattcacgaggactaatttctctaagtattaagattcattcaagagattgtatggtatctcttaaagcctatggatcggattcctgaccacaaacttaagagatgattggttatctgtcaacagtgttacgcaacattgatcatgttggtcttgtgtttgtttattggggtagaatttgtcattataaatttttgacaactaccaagaatgcacatttcagtttcgtcctttgtttttagttagtactactttcagttgttatttgtttgtgtcagacttttgctttattagcgttcaattacccttgtgaacggcagaaaataaaaactgacaaggttatgcgtaaaaaaaaaaaaaaaaaaaaaaa

SEQ ID NO: 8331 - DNA, 1349 bp, Glycine max
ggaaggaaaaaaaaaaaagaaaaaagtgttcattttttttttatcattaagcaaaggtagtaggcaaggcaagcacactacttattgttgttcattgtgaaatcatcatcatcatgggttgctcagcctcaagaaccatcaccatagtggccaacaacaataaccaagaggatccatctccttctgcttctcttgcttcttcttcttcttccttctcttcctcttctgcttcacacaaatccatcaactctgcttcttcaccagcagcggcaccagttagaagaagaactctttctctcccaatgcctctcgttcatcatcctcccatcaaaaagggtgactcacaccaccttgtctctctcacctccaccacctatggctcccttctccccattgaccaaaaagactcaaactttacccaaaaaaaccaaccccacataaccaaaacctcaaaccaaactgacccagaacactcactctccccggactcagtcatcaacacttgggaactcatggatggcttagatgaagaacaagaacaagaacaagaaattgcaaatgccaagaagcttccttacgcttccattttggacaaaccaagttcatgcaggtacacagcatttgatggttctgcaaggaagaaacttctagattcctttgaatcaatgaaaacttcacaaacagcaatggaaaaggacttaaactcttcttcttctacatctcctgcaccaacaacgaagaagccactttggcagcacttatctgaggaagctttgcttgctaagttggatccaagtgtggcttggagttacagaagagcattatcatcaaggaatctagatagaaacattctatctagagatgttaggtcaatggggtctagcccttttttgtgccgtttgtctggcactgaggacagaatagtgctttattgcactagtttgagagggatccgaaagacctatgaggattgttgttcggttaggatgattctgaggggcttcagagttgcggttgatgagagggacatctcaatggattcgtcctataggaaggagttgaaggatttgcttggtggaaaagcagaagtgacattgcctcaggtctttatcagagggaggtatgtggggaatgctgaggacatgaagcatctgaatgagtctggggcaattgggtttcccactcaggatccaggctttgtgtgtgacaactgtggtgatgccaggtttgtgccatgccccaattgcagtggtagcaggaaggtgtttgagcatgaagatggagggttgagaaggtgccctgaatgcaatgagaatggcttgataagatgtccaggttgcggctcatga

SEQ ID NO: 8332 - DNA, 1712 bp, Glycine max
cattgtgaaatcatcatcatcatgggttgctcagcctcaagaaccatcaccatagtggccaacaacaataaccaattagaggatccatcttctgcttctcttgcttcttctttctcttcctcttctgcctcacacaaatccattaactctacttcttcaccagcagcagcaccagttagaagaagagctctttctctcccaatgcctcttgttcatcaccctcccataaaaaagggtgacacacaccaccttgtctccctcacctccaccacctatggctcccttctcctcattgaccaaaaagacccaaacttgacccaaaaaaaccaaccccgcctcaccaaaacctcaaaccaaactgacccagcacactcactctccccagactcagtcatcaacacttgggaactcatggatggcttagatgaagaagaagaagaagaagaagaagaaattgccaatgccaagaagaagcctccttacacttccattttggacaaaccaagttcatgcaggtacacagcatttgatggttctgcaaggaagaaactgcttgattcctttgaatcactgaaaacttcacagacagcaatggaaaaggaaaactcttcttcttctccagcaccaaccaagaagccactttggcagcacttatccgaggaagctttgcttgctaagttggatccgagtgtggcttggagttacagaagagcattatcatcaaggaatctaggtagaaacaccttatctagagatgtaaggtcaatggggtctagccctttgatatttcattcttcttctttttcatttggtaagaacaatagtttgtgccgtttgtctggcactgaggacagaatagtgctttattgcactagtttgagagggatccgaaagacctatgaggattgttgttcggttaggatgattctgaggggcttcagggttgcggttgatgagagggacatctcaatggactcgtcctataggaaggagttgaaggatgctcttggtggaaaagcagtgacattgccacaggtctttatcagagggaggtatgtggggaatgctgagcaaatgaagcatctgaatgagtctggagaattggcaaggcttttggagggtttccccactcaggatcctgggtttgtgtgtgacaactgtggtgatgccaggtttgtgccatgccccaattgcaatggtagcaggaaggtgtttgagcatgaggaaggagggttgagaaggtgccctgattgcaatgagaatggcttgataagatgtccaggttgctgcccatgattggtggaaattagtcatctgaatcaggtataccccgattcgtgaagagtaatttctagaactactgatatccatttaagagataagtatctcttaaggtatatttttcagtgcccagaaagcctatggatcgaattcctgaccacaagcttaaaaaatgattaattatctgtcaatcatatcacatcatattgataatgatgttcttgtgtttgtttattggagtagaatttgtcattataaattttgacaactaccaagaatgcacatttcagtttcgtcctttgtttttagttagtactactttcagctgttatttgtttatgtcagacttttgctttattagcgtttaattacccttgtgaacagcagaaaataaaaaactgacaaggttatgtatacatgcttaattttct

SEQ ID NO: 8333 - DNA, 1452 bp, Glycine max
gtcacaggaaagacattctgcatactcatgagcacaaacctcaaaatataattgagtgctatggggattcccatacgaagtggaaatataaaaagacaaaatgaagcaatgaggctcaccctagcaacctttgttggagttgtttttggcttctctctaggagtatcatttccaacactggcattgactaggatgaaccttccatccagccttttaccatctattgatctaacttatgttgatgacaattactcgaaaatttcaaccaagtctttgtgggatgcttgggcttcatttaggagggatagaagcatgtacaagaaggttcacaaattaaatgacacaaagatttgggttcctacaaatcctcgaggggctgaaaggcttcccccaaaaattgtcaaatctgaatcagatttctatcttcatcggttatggggcatgccctatcaggacctaagtatcaaaccgaagtatcttgtaacatttactgttgggtcagatcaaaaagacaacattgatgctgcagtaaaaaagttctctgaaaacttcaccatagtgttgtttcactatgatggacgggctagtgattgggaaaagtttgagtggtcaaagcgagcaattcatatcagtgctaggaagcaaactaaatggtggtatgctaaacgctttctgcatcctgacattgtggctccttatgactacatctttatttgggatgaggatcttggtgtggagcattttgatgcagaagagtacttaaaaatggtaaggaaacatggtttggagatctcacagcctggtatagacccaagtagtagttttacatggcagatgacaaggaaaagggatagtggtgaagtccataagaaagctgaggaaagaagtggttggtgttctgatccacatttgccaccatgtgctgcatttgttgagatcatggctcctgtattttccagagatgcatggcgttgtgtgtggcacatgatacagaacgacctagttcatggatggggccttgatttcgttctcagaaaatgtgtggagcctcctcacgagaaaataggagtggttgacactcaatgggttgtccaccaaagtgttccatcacttgggaaccagggccaagcagagaggggaagggcaccgtgggaaggggtgagagagaggtgtaataaagaatggacaatattccaagagcgtatggctgaagctgagagggactattttcaaacaagggaaattcagggggagtctaatgcttatactagtagtggcctagagaatacttgtaaagccaagagtgacaggggtagaggaaagggaaggaaggggaaatggtgtgggaattttttgccaaaacggaaatacatttctgttttggatggggggggtgcagtgaccatgatggatatccctagttggggaaagaaaatggttaaagagttttaa

SEQ ID NO: 8334 - DNA, 1957 bp, Vitis vinifera
gcctttgtagggcatgtcctctctgtcttctctctcctctctgtgtggtggtatggccttcaacttcccttgagtactcagacttatctcaggttctaatgatctgggttcattattgttgttattatattttgttttcaatttctcaaacgtttctctgattccaaggccttttgatttatttgtagtgtggtgttggtctgttgagtggaataagtttttctttggtttctttttgatctttttgctgttgtgttgttgggttgatgatgcaatcgttttcaagctatgaatagtgagtgagctttagtgttggggaagataagaaggttgattatgtggttatgatgtttgttatgatggtgatgagtcttttgaccacggaaagagatcggataaagctaaaaaaataaaggatgcgtacaataaagagagtattgttggctgtgttgtgaacgagagagaacttgattgctttcattcttctttatctttttttcacacatctcatgtgcagggtagatgtaatgtggcttgaatgctgattttgagggttctcctttttgggggtttctgaggtttggggggagtttggtctaaaggggtttcagaaatgccgatgtttcagcattatcagaaggatgggcttgtggggtttgacggtggtggtgatgggcatgttctagatctggacactgccgttaaagatggagttttgggcggcggtggtggtggggtggttggaggtattgctgagaaactggatctgaagaggatgattgaagagcttgacttgtcggaaattccttcagtgtttatttgcccaatctctcttgaaccaatgcaggaccctgtaaccctttgcacaggccaaacctatgagaggtctaacattctcaaatggttcagtttggggcacctcacttgccccacaacgatgcaagagctctgggatgattcggttacgccgaataagaccctttaccatctaatttacagttggttttcacagaagtatttgcttatgaagaagagatcagaagatgtacagggacgggcatcagagcttctggagacgctaaagaaggtgaagggtcaggccagagttcaagctcttaaggagcttcatcaggttgtggcggcccatgctactgcaaggaagacagtggaagaaggtggagttgctctgatttcagctttattgggcccctttacctcccatgctgttggttctgaagtaattgggatacttgttaacttgacacttgattcagaatccaaagcaaatttgatgcaaccagcaaagatctctttaatggtggacctgttaaatgaggggtcgatcgagacaaagatcaactctactcgattgatagaaatgttgatggaggagaaggattttcgttcagaaattgtttctagtcatagtcttttggttggattaatgaggctagtgaaggataagaggcatcccaatggaaacttgcctgggcttactctcctaagaacaatatgcttacataaacaagtcaggaacttgtttgtgagcattggggccattcctcaactggtagaattgttgcctgccttgaatcctgattgcttggaatcagcccttttcatcttggataccttgtcatctctaccagagggaaggttggctttgagggattgtctgaacactataccgaatatggtgaggctattgatgagggtttcggagagctgtactcaatatgctttagcaatcttatggtctgtatgcaaactggctcctgaggaatgttcatcaattgctgtggaggctggtcttgcagcaaagctccttctcgtcatccagagtggttgcaatcctgtcttgaagcaaagatctgcagagctcttgaaactgtgcagtctcaattatacagataccaccttcatttccaagtgtaagcttacaaaaacaatccaatga

SEQ ID NO: 8335 - DNA, 1350 bp, Glycine max
atgccgatgtttcagccttgtcggaaggacatggttactgggtacgagggtggtgccgatggccagattctagatctggacaccgccgtgaaagacggcgttttgggcggcgtggagggcggcgttgtgggaggcggggttggtgagaaggtggatctggggaagatgattgaggagcttgagttatgtgaagtgccgagtgtgttcatttgcccaatctctttggaaccaatgcaagaccctattaccctctgcacaggccaaacctacgagaggtccaacattcttaaatggttcaacttggggcatttcacctgccccaccacgatgcaggagctctgggacgattccgtcactccgaacaccaccctttacaggctcatacacacgtggttctcgcagaagtacttgctcatgaagaagaggtctgaggatgttcagggaagggcttctgaacttctcgagacactgaagaaggtgaagggtcaggctcgggttcaggccctcaaggagattcaccaattagtggcttctcatgccactgcgcgaaaggctgtgattgatgaaggtggagtttctgttgtgtcttctttgcttggtccttttacttcccatgccgttggctctgaggttattggtattcttgtgactttgacccttgattcggaatctaggaagaatctcttgcagcctgctaaggtttccttgatggtggacatcttgaatgagggttccattgagacgaagatcaattgcacccggctgattgaatcgttgattgaggagaaggattttcgatcggaggttatatcgagtcatagtctcttggttgggttgatgaggcttgttaaggataagcggcacagcaatggagtgtgtcctgggttgagtctcctcagaacaatttgtttgcataaggaagttaggaatttgcttgtgagcattggggctgtttctcagttggttgaattgttgtctggcatggagcctgattgtacggaattggccctttgtgttttggatgcgttggcgtcggtccccgaaggtagagtggctttgaaggattgctctaacaccatacccatcatggtgaagctgttgatgaggatctcagaaaactgcactcagtatgctttgtcgattctatggtccgtgtgcaagctttcacctgatgagtgctcgtcgattgcggttgatgcagggcttgctgcgaaactcctgctcgtgattcagagtggttgcaatcctatattgaaacaacagtctgctgagcttttgaagctgtgtagtttaaattattcagatactatctttatttccaagtgcaagcttaccagaaccatccaatga

SEQ ID NO: 8336 - DNA, 1350 bp, Glycine max
atgccgatgtttcagccttgtcggaaggacttggttgccgggtacgagggtggtggcgacggccagattctagatctggacaccgccgtgaaagacggcgttttgggcggcgtggagggcggcgtcctgggaggtggggttggtgagaaggtggatctggggaagatgattgaggagcttgagttatgtgaagtgccgagtgtgttcatttgcccaatctcattggaaccaatgcaagaccctgttaccctctgcacaggccaaacctacgagaggtccaacattcttaaatggttcaacttgggacacttcacctgccccaccacgatgcaggagctctgggatgattccgtcactccaaacaccaccctttacaggctcatacacatgtggttctcgcagaagtacttgctcatgaagaagaggtcagaggatgttcaaggaagggcttctgaacttcttgagacactgaagaaggtgaagagtcaggctcgggttcaggccctcaaggagcttcaccaattagtggcttcccatgccactgcacgcaagactgtcattgatgaaggtggagtttctgttgtatcttctttgcttggtccttttacttcccatgctgttggctctgaggttattggtattcttgtgactttgacacttgattcggaatctaggaagaatctcttgcagcctgccaaggtttccttaatggtggacatcttgaatgagggttccattgagacgaagatcaattgcacgcggttgattgaatcgttgattgaggagaaggattttcgatccgaggttatcttgagccatagcctcttggttgggttgatgaggcttgttaaggataagaggcacaacaatggagtgtgtcctgggctgagtctcctcagaacaatttgtttgcataaggaagttaggaatttgcttgtgagcattggggctgtttctcagttggttgaattgttgtctggcatggagcctgattgtttggaattggccctttgtgttttggatgcgttggcttcggtccctgaaggtagagtggctttgaaggattgctctaacaccatacccatcatggtgaaactgttgatgaggatctcagaaaactgcactcagtatgctttgtcaattctatggtctgtgtgtaagctttcacctgaagagtgctcgtcgattgcggttgatgcagggcttgctgcgaaactcctactcgtgattcagagtggttgcaatcctatattgaaacagcagtctgctgagcttttgaagctgtgtagtttaaattattcagatactatctttctttccaagtgcaagcttaccagaaccatccaatga

SEQ ID NO: 8337 - DNA, 1864 bp, Medicago truncatula
tgtttctcaattatttctcttcaacccactcacccatctttgtttcaactctttgtcaggttttttccttctgccattcatttcacttctttctttcttgtactatcactgtggtcaccactgtttcttctttctttcattgctctcttctctttcaaccaagtttttattatatcttcatgatttgagatttgattgcattattttcctttttgaccataccaaaaaaaagtgatttttttctacagtgaaataacccattctctctctctctctctctctctctctctctctctctcttttcacttttgtcatagactgtaatgtaatgtgatttgatgaccctttgaagagttcttgtcattgaactgatttttgggttgtgggttttttcattcatagctttctaggtctaaaaaagggattttttttttttttttagggaaaaatgcctatgtatcagccttctaaaagggatatggtagttgggtatgagggtggtggtgatggtcagattctagatctggacacagctgttaaagatggggttttgggtggtgttgattgtggtggtattgtaggaactggtgttgttggtgagaaattagatctgagaaaaatgattcaagagcttgagttatgtgaagtaccaagtgttttcatttgtccaatttctcttgaaccaatgcaagaccctgttactctttgcactggacaaacctatgagaggaacaacattctcaaatggtttaatatgggacactttacttgtcctacaactatgcaagagctttgggatgattccatcactccaaacacaacactttataggttgatatatacttggttttctcagaagtatctgttgatgaagaagaggtccgaagatgttcaaggaagagcttctgagcttgtggagacactcaagaaggtgaagggtcaagctagagttcatgctttgaaggagcttcatcaagttgtgtctgttcatgctactgcaaggaagtctgtgattgatggaggtggtgtttctgttttatcttctttacttggtccttttacttcacatgctgttggttctgaagttattggtattcttgttagtttgacacttgattctgaatctaagaagaatcttatgcaacctgctaagatttctttgatggttgatatcttgaatgagggttcaattgagactaaaatcaattgcacgcggttgattgaaacgttaattgaagagaaagattttcgttccgagattatctccagccatagtttattggttggattgatgaggcttgttaaggataagagacatagcaatggaatctgtcctggattaagccttctcagaacagtgtgcttctataaggaagttaagattttgttagttagcattggcgctgtttctcaattagttgaattgttgtctggtatggaccatgattgtttggaattagccctttgtgttttggattcgttatcgtcaatacccgaaggcagggtagctttgaaggaatgtgttaacacaatccctatcatggtgagacttttgatgaggatatcagaaagctgtactcagtatgcattgtcaattttgtggtctgtttgcaagctcgcgcccgaggagtgttcgtcgattgccgttgatgcagggcttgcagctaagctccttcttgtgattcaaagtggttgcaatccaatattgaaacaacaatctgctgagcttttgaaactatgtagtttgaattattcagataccatcttcatttccaagtttatcacaattggggctgagaggttccgttgcccagaagtccttttccatccatctatgatttcaaaatatctattcggaatgtaa

SEQ ID NO: 8338 - DNA, 2298 bp, Arabidopsis thaliana
gaagaaggtaagagagaaacaaacaaacaaaagagagagtacgggtttcttcttcgtcattctcacgaattcgtgaatttatttttgatttcgtcatctgggttttctcaaattctcttccttttttatcttttgagattttctggtattgaaagttcaaacctttgtactgggttcgttgatttttttttggtttccttctcattattcttcatgattcctccttttttctgtttctcgaaatttgtggttataaaattcacattttttttgggagcagttgggtttcaatcatgtgtttatgatgttatattattaacaagagttgaatgaatcttctttttgaccgttgaaaagagaaaaactaaattaaagcaaagaggaaaaagaagaagaagaagattgtgttgttgttgttgttttaacgcttctttctgagataaagacatgcgtttctttttcagctcacattattttcccaaatgttgtgagtttgagaagaaaagtctgtttttttattgagatttttttgtttctatagattctatcgaaatgccgatgtttcagccgttaaagagagatgggttaataggatttgaaggtggtggtgatgggcaagtcttagatctggatactgcagtgaaagatggagttctcggtggtgttaatggtggtggtgttggagttgttgatgagaaattggatctgaagaagatgataaaggagctagatttacaagatataccttctgttttcatttgtcctatctccttagagccgatgcaagatcctgtgactttgtgtactggtcaaacctatgaaaggttaaacattcacaaatggtttaacctaggtcacttgacttgtcctactacaatgcaagagctttgggatgatacggtaactcctaataaaactcttcatcatttgatctatacttggttctctcagaagtatgtgttgatgaagaaacgttctgaggatgttcaaggacgagctattgagattttggggactttgaagaaagctaaaggtcaagctagggttcatgctttgagtgagcttaaacagattgttattgctcatcttatggcgaggaagactgttgttgaagaaggtggtgtctctgtgatctcttctcttttgggtccttttacttctcatgctgttggatctgaggttgttgctattcttgtgagtcttgatcttgattctgattcgaaatccggcttgatgcaaccagctaaggtttctttgattgttgatatgttgaatgatggatctaatgagactaagatcaattgtgctagattgattagaggattggtggaagagaaagggtttagagcagagcttgtttcaagtcatagtttgcttgttgggttaatgagattggttaaggataagagacatagaaatggagtatctcctgcacttcggttgcttaaaccgatttcggttcataaacaagttcgaagcttgatggttagcattggagcagtgcctcaattagttgatatcttaccgtctttagacccggaatgtttggagttagctctgtttgttcttgatgctttgtgtacagacgtggaaggaagagttgctgtcaaagactctgcaaacacaataccttatacagttagggtgctgatgagggtgtctgagaattgcactaactacgcgctgtcgattctttggtctgtctgcaaattagctccagaagaatgttcaccacttgctgttgaggttggtcttgctgcaaagctgttactcgtgatccagagcgggtgtgatgcagcgttgaagcagcggtcagcagagctacttaagctttgtagtctacattattcagacaccatgtttatttccaaatgcaaactcacaaggacaatccaatagcattggcactgattgatcacaggattcagcgggttatccatgaaacggtaaatgtgcattgcattacgaatctgcctttgccctgatgtatatatagatgatgagtttgaagattgagctattggttttggtggtaacaattcaaaggaagaggcaatcagctgatggaaacatggggaagacgaagaaaccgggtggttgagggatcggtatgtaatgttaccatattggttcgttttgcaataagcattgggaattagaaaaaaactgtgtaaagttaccgcctctggctcaaatcaatttcagaagaacaaagaaaaagaagaatttgaagaaaggaaccatattaagttaaacctctctactttgggttcttgtgagaggttgttttgctttttg

SEQ ID NO: 8339 - DNA, 1725 bp, Vitis vinifera
ctgttaaattttcttgctcttccgcaaagtggttcaaaaatgccgatgtaccagccatctggccggagaagagatgggggtgtcatgtatgatgtgggcggcgacggtgggcatgtcttagatctcgaaaccgccgtgaaagatgggattttggggggcggaggtggggttgtttgcggcagcggagtcactgagaaattggatctgaaaaagatgattgaagacctggactccattgatgttccgtctgtgttcatatgcccaatttcgttagagccaatgcaggatcctgtgaccatttgcactggccagacctacgagagatccaacatcgtgaaatggttctctatggggcacttcacttgccccacaacaatgcaagagctttgggacgattccatcacgccaaacaagactctttaccaactaatttatagttggttttcgcagaagtacttggtcatgaagaagagatcagaagatgtgcaaggcagagcattggaagtcttggagacgttaaagaaagttaagggtcaagctaggattcaagccctcaaggaacttcgacaggttgtctcaattcatgcttctgccaagaagacggtggcagacaatggtggtatcggtctgatttcctctctattaggccccttcacttcgcatgcagtagggtcggaagtaattgggattcttgtgaacttgagtctcgattcagaatcaaagtcaaatttgatgcagccagcaaagatatcactaatggtggacatgttgaatgagggatcaatcgagaccaaaatcaattgtacaaaattgatcgaaattttgatggaggggagggattttgaatcggagattgtgccaagcttgagtcttttggttggattgttgaggttggtaaaggataagaggcaccaaaatgggatcttggctggcctcgccctgctcaagacaatttgtttacacgagccagtgcggaactcagtagtgagcataggggctgttcctcaattggttgagctgttgcccaatttgaatcccgcgtgcctggaattagccctttatatcctggaggttctgtcaactcttccacagggaagattggctttgaaggattgcccaaacatgataccaaatgtagtgaaattattgatgagggtttccgagagctgtacccagttggcattggccatcttatcagcagtttgcaagcttgccccagaggaatgtgcttcacttgccgtggaagctggccttgctgcgaagctcctcctcgttattcagagtggttgcaatcctgtattgaagcaaagggctgcagagctcttaaaattgtgtagtctaaattacacggccaccatcttcatatccaagtgtaagcttacaagaacgatacaatgaaaagaccatgggaaatttgttcatacaaactctcatttcccctccggccgtgggggacaaaggtgcaaagagcttgtgggactcaaacagatttcttaacaatgtgaaatggggtttatgaggtactcctgtgtatacttgaggactttgattttgtcatttgatttcacaagaagaagcatcataatgtggagttttcagcttgtttgccgacagggatacagtcgattacatgattgattcatttcacaacagagcatcataaccatactactggggtggagtttggatggggtttgggatgtaagaatacatgaagagggaagg

SEQ ID NO: 8340 - DNA, 1831 bp, Arabidopsis thaliana
agattgtgttgttgttgttgttttaacgcttctttctgagataaagacatgcgtttctttttcagctcacattattttcccaaatgttgtgaatttgagaagaaaagtctgtttttttattgagatttttttgtttctatagattctatcgaaatgccgatgtttcagccgttaaagagagatgggttaataggatttgaaggtggtggtgatgggcaagtcttagatctggatactgcagtgaaagatggagttctcggtggtgttaatggtggtggtgttggagttgttgatgagaaattggatctgaagaagatgataaaggagctagatttacaagatataccttctgttttcatttgtcctatctctttagagccgatgcaagatcctgtgactttgtgtactggtcaaacctatgaaaggttaaacattcacaaatggtttaacctaggtcacttgacttgtcctactacaatgcaagagctttgggatgatacggtaactcctaataaaactcttcatcatttgatctatacttggttctctcagaagtatgtgttgatgaagaaacgttctgaggatgttcaaggacgagctattgagattttggggactttgaagaaagctaaaggtcaagctagggttcatgctttgagtgagcttaaacagattgttgttgctcatcttatggcgaggaagactgttgttgaagaaggtggtgtctctgtgatctcttctcttttgggtccttttacttctcatgctgttggatctgaggttgttgctattcttgtgagtcttgatcttgattctgattcgaaatccggcttgatgcaaccagctaaggtttctttgattgttgatatgttgaatgatggatctaatgagactaagatcaattgtgctagattgattagaggattggtggaagagaaagggtttagagcagagcttgtttcaagtcatagtttgcttgttgggttaatgagattggttaaggataagagacatagaaatggagtatctcctgcacttcggttgcttaaaccgatttcggttcataaacaagttcgaagcttgatggttagcattggagcagtgcctcaattagttgatatcttacagtctttagacccggaatgtttggagttagctctgtttgttcttgatgctttgtgtacagacgtggaaggaagagttgctgtcaaagactctgcaaacacaataccttatacagttagggtgctgatgagggtgtctgagaattgcactaactacgcgctgtcgattctttggtctgtctgcaaattagctccagaagaatgttcaccacttgctgttgaggttggtcttgctgcaaagctgttactcgtgatccagagcgggtgtgatgcagcgttgaagcagcggtcagcggagctacttaagctttgtagtctacattattcagacaccatgtttatttccaaatgcaaactcacaaggacaatccaatagcattggcactgattgatcacaggattcagcgggttatccatgaaacggtaaatgtgcattgcattacgaatctgcctttgccctgatgtatatatagatgatgagtttgaagattgagctattggttttggtggtaacaattcaaaggaagaggcaatcagctgatggaaacatggggaagacgaagaaaccgggtggttgagggatcggtatgtaatgttaccatattggttcgttttgcaataagcattgggaattagaaaaaaactgtgtaaagttaccgcctttggctcaaatcaatttcagaagaacaaagaaaaagaagaatttg

SEQ ID NO: 8341 - DNA, 1984 bp, Arabidopsis thaliana
cgttccctttttttaatttgtctctttgctttaataatttccttctcaccgaaacacacaccacaaccaattctcttctccttcttcctctttcacaaattcgtcatctgggtattcttaaatttctcacaaattcatttacttttttgttctgttccgagatttcaaggttcactatcgattctgaaactcttggaacaatccagattcttggttagcaggtggggaagcattaatcatgtatttatgatacactgctccattattattacgagagagttgaaagtttcctttttgactcgtttttaaaggcaaggaagaagaaagactttgtttttaaaatgccaatgtttcagccttctaagaacggtgggtttgatgggcatatcttagatctacactcggcggttaaagacggtgttcttggcggcggagatgggaaatttctggtggttgttaccgatgagaagaagaaattggatttgaaggagatgatttctgagctggaattacctgaaataccctctgttttcatctgtcctatctctctagagccgatgcaagatccagtgaccttgtgtactggtcaaacctacgagaggtccaacattctcaaatggttcaatatagggcattgtacttgcccaacgacgatgcaagagctttgggatgatttggtcactcctaacaagactcttcaccaattgatctacacttggttttcacagaagtatgttttgatgaagaaacgatctgaagatgtgcaaggacgtgctattgagattctgggtacgttgagaaaggctaaagggaaagcaaaggttcatgctttaagcgagcttaagcaagttgtgatggctcacgctattgctaagaagactgttgttgatgaaggtggagtctttgtgatctcttctcttttaagtccttttacttctcacgctgttggatctgaggctatagctattcttgttaatcttgagcttgactctgattccaaagctggattgatgcaaccagctagggtctcgttgatggttgatatgttgaatgatggttcgattgaaactaagatcaattgtgctagattgattggaaggttggtggaggagaaaggttttagagcagagcttgtttctagtcatagtttgcttgttggattaatgagattggttaaagataggagacgaagaaacggcgtttcgcctgcgttaacgctgctcaaatcggtttctgttcataaacaagttaggaacttgttggttaggattggtgcagttcctcaattggttgatgttttgccatgtttggatgtggagtgtttagagtcagctcttttcgtgttggattcgttatgtttagaaagcgaaggcagaattgctttgaaagattcggttaacacgattccgcataccgttaggttactgatgaaggtatcagagaaatgcacaaactatgcgatatcgattctttggtcagtttgcaaattagcttctgaagaatgttcatctcttgctgttgaagttggtttggctgcaaagcttttgcttgtgatacaaagtggatgtgatccagctttgaagcaacgttcagctgagctattgaagttatgtagtctacattattcagactcaatgtttatctccaaatgtaaactcacaagaactatccaataaaagactgatcaagttttcacctttcgggtcaaaatcacacaacggatctgccccatcttgttgatgtatatagaaatgaagaagctcaaggagtatgagagtaagaaacgagtttcgatgtgttgaattctattttgcaatgttatttgaataataatagttaagtagaagtaaactgtataaatctttttgttgtggttggttcattattcagtagaagaatagattgaagaaaggaatcatttttttggcctcttgtaagttactagctgtttgtgagtcataataattggagaaattattgatct

SEQ ID NO: 8342 - DNA, 1966 bp, Arabidopsis thaliana
gtctctttgctttaataatttccttctcaccgaaacacacaccacaaccaattctcttctccttcttcctctttcacaaattcgtcatctgggtattcttaaatttctcacaaattcatttacttttttgttctgttccgagatttcaaggttcactatcgattctgaaactcttggaacaatccagattcttggttagcaggtggggaagcattaatcatgtatttatgatacactgctccattattattacgagagagttgaaagtttcctttttgactcgtttttaaaggcaaggaagaagaaagactttgttttttaaaatgccaatgtttcagccttctaagaacggtgggtttgatgggcatatcttagatctacactcggcggttaaagacggtgttcttggcggcggagatgggaaatttctggtggttgttaccgatgagaagaagaaattggatttgaaggagatgatttctgagctggaattacctgaaataccctctgttttcatctgtcctatctctctagagccgatgcaagatccagtgaccttgtgtactggtcaaacctacgagaggtccaacattctcaaatggttcaatatagggcattgtacttgcccaacgacgatgcaagagctttgggatgatttggtcactcctaacaagactcttcaccaattgatctacacttggttttcacagaagtatgttttgatgaagaaacgatctgaagatgtgcaaggacgtgctattgagattctgggtacgttgagaaaggctaaagggaaagcaaaggttcatgctttaagcgagcttaagcaagttgtgatggctcacgctattgctaagaagactgttgttgatggaggtggagtctttgtgatctcttctcttttaagtccttttacttctcacgctgttggatctgaggctatagctattcttgttaatcttgagcttgactctgattccaaagctggattgatgcaaccagctagggtctcgttgatggttgatatgttgaatgatggttcgattgaaactaagatcaattgtgctagattgattggaaggttggtggaggagaaaggttttagagcagagcttgtttctagtcatagtttgcttgttggattaatgagattggttaaagataggagacgaagaaacggcgtttcgcctgcgttaacgctgctcaaatcggtttctgttcataaacaagttaggaacttgttggttaggattggtgcagttcctcaattggttgatgttttgccatgtttggatgtggagtgtttagagtcagctcttttcgtgttggattcgttatgtttagaaagcgaaggcagaattgctttgaaagattcggttaacacgattccgcataccgttaggttactgatgaaggtatcagagaaatgcacaaactatgcgatatcgattctttggtcagtttgcaaattagcttctgaagaatgttcatctcttgctgttgaagttggtttggctgcaaagcttttgcttgtgatacaaagtggatgtgatccagctttgaagcaacgttcagctgagctattgaagttatgtagtctacattattcagactcaatgtttatctccaaatgtaaactcacaagaactatccaataaaagactgatcaagttttcacctttcgggtcaaaatcacacaacggatctgccccatcttgttgatgtatatagaaatgaagaagctcaaggagtatgagagtaagaaacgagtttcgatgtgttgaattctattttgcaatgttatttgaataataatagttaagtagaagtaaactgtataaatctttttgttgtggttggttcattattcagtagaagaatagattgaagaaaggaatcatttttttggcctcttgtaagttactagctgtttgtgagtcataataattggagaaattattgatct

SEQ ID NO: 8343 - DNA, 902 bp, Glycine max
ctcaaaaaaaaaaaaaacaactctctcaacaataacatcgatcactaccctcaccaattaattagccattaccaccaccccaattcatgaacgataacatgaccgccatggctgatcaatgcattcatgatccatccatagaaagactcatggatgcaaccatgtcatcatcatcagagggcatgatgatgttgagaccaaccaattcacacaactacacaacaagtggccacaatttaactccaaagggttgtgcattcaaaccaatccgaaggagatctagaacttctaagagcactccaattacccttctcaaagccaacacctccaatttcagggcattggtacaacaattcactgggtgtcctaccacaaccaccatgtcacttgcaatccataagggtcccattaccttaaatttccaacaagatggtaccaaacaacatattcatcacgatcagcatcacacaaaaataacaactagaggagcaatgccaccatttgccaccataagttctaaccaaaaccatgcttctgtgccatttcctaagcaacaattgatgcaagagcagcaaagtggatactttcttccaacttattcgggtaactcatataggccaattagctgcatggatgatggattgatctttgataatgattttagtttgcatgaactaactgtgaatgccatctccaatgatagcgatggtttatttatgtgatcaaaatgtccataaaggattcaattatgtaatacatagtaatatcttaggaaattatatgcatggtaaactagctcctcttcagtcaacagctgtatacgcatgctatcataaagcaataattcatgtttgccccagcctgtaatacgtttaatttattgtaccgattcaatttcttta

SEQ ID NO: 8344 - DNA, 1404 bp, Glycine max
atggccagcagcaagtgttgcatgatctctccacaacaaaaccagaatgcccccacatgttatccttcaccaatgggaatggtctatgcagacatgatggggtctctctctcttgccaccgtttcaaataatgcttcttcatcacaagaaagtaatggttatagttatggttatgcctctggggtggaaaatgcaaggagtacaaggtggagttttcctttcacgagggagtttctttcttcaaactttgaagactgcagtgatgtagtagtaggggctggggacagtaacaacaacattaatgagaaaacaaaccataataatggcaagttcagtgaagaagaaagtaaccctaatgagaacaaccctgccggtggcaaagaggtggatagtgggcactccaaactttgtgcaagagggcattggagacctgctgaagattccaagctcaaggagcttgtggctcttcatggccctcagaattggaacctcatagctgaaaaactagaaggaagatcagggaagagttgtaggctgaggtggttcaaccagttggatccaaggatcaacagaagagcattcagtgaagaagaagaagagaggctaatgcaggcacatagaatttatgggaacaaatgggccatgattgcaaggctttttcctgggagaacagataatgcagtgaagaatcactggcatgttataatggccaggaagtacagggaacaatccagtgcttacaggaggaggagaatgagccaacctgtgtacagaagagtggatcaaaatccaacctttgtttgcagcagcagagataataatgcctcaaccacagaaccagaaccagaatcatcaccttcctattatcccaatctcaatgaccgtggagtagcactcaccaataacatggctagtttcccatccttacatggagtagctgctggtgctggtggagttgttgagtttggctcaaatgtttctccactaaacatgactagaggtagagaagcagtgtcaaacaccacacatgttggcttgtgtgctcaagctcaacaacaagcaccatttgatttcttctctggtggtggaagccatgacatggtgttggagtctatgagccagatgagaagcagggaaaggaccaatgaatcttacaatcatcattgccaattatctggtttctaccctcatcatccccaacaatatttgatggcaatgcaacaacagctagacaacaacaatttttacagtttcttgaattcctcatcatcagcatcaacaacaagaactagggaaccatcatcaccatgtgttgcagaaatcagagataaagtggtgaatagtgaccccccagatggtgttccacccccattttttgacttctttggagtaggagccacatga

SEQ ID NO: 8345 - DNA, 1437 bp, Glycine max
atggaatttgactatggtgttaatttgcagatacccaacaggccaacatcatcatcatcatcaacaacaacaacaacaaaatttaatgcccccacatgttacccttctccaataggagtagtctttgcagatatgatggggtctctctctcttgccacagtttcaaataatgcttcttcatctcaagaaagtaatgtttatggttatggttatggttatgcctctggggtgggaaatgggagcacaaggtggagttttcctttcatgagggagtttctttcttcaaactttgaagactgcagtgatttagtaggggctggggagagtaacaacagtaatgagaaaacaaaccataataatggcaagttcagtgaagaagaaagtaaccctaatgagaaccatgccaatggcaaagaggtggatagtggacactccaaactttgtgcaagagggcactggaggcctgctgaagattccaagctcaaggagcttgtggctctttatggccctcagaattggaacctcatagctgaaaaactagaaggaagatcaggtaagagttgtaggctgaggtggttcaaccagttggatccaaggatcaacagaagagcattcagtgaagaagaagaagagaggctaatgcaggcacatagaatttacggcaacaaatgggccatgatcgcaaggcttttccctgggagaacagataatgcagtgaagaatcactggcatgttataatggccaggaagtacagggaacaatccagtgcttacaggaggaggagaatgagccaatctgtgcacagaagagtggagcaaaatccaacctttgtttgcagcagcagcagagataatgcctcaaccacagaacaagaaccagaaccatcaccttcctattatcccaatctcattcaccatggagtagcactcaccaataacatggctagtttcccacccttccatggagtagctgcgtgtaatggcgtggttgttgagtttggctcaaatggttctccacaaaacatgactagtgggagagaagcaatgccaaacaccacacatgttggcttgtctgctcaagctcaacaacaagcaccatttgatttcttctctggtggtggaagcaatgacatagtgttagagtccataagccatatgagaagcagggaaagaaccaatggatctcacaatcatcattgccaattatctggttgctaccctcattatccccaacaatatttgatggcaatgcaacaacagctagacaacaacaacaatttttacagtttcttgaattcctcaccagcagcatcaacagctagggaaccatcatcatcaccatgtgttgcagaaatcagagataaagtggagaatagtgaccccccagatggtgttccacccccattttttgacttccttggagtaggagccacatga

SEQ ID NO: 8346 - DNA, 2529 bp, Pisum sativum
atgtcccttgaagactccctaagatctctttctcttgattacttaaatcttctcatcaacggacaagccttcagcgacgtcgttttcagcgtcgaaggccgtttagtccacgctcacagatgcatcttagcagcaaggagtctcttcttcagaaaattcttctgtgggccagacccgccttccggactcgacccgtcaggcaaccgagtcaactcatcaacaaggtccggtgttataccggtgaactcagtgggctacgaggttttcttgctgatgcttcagtttctctacagtggtcaagtttctattgttccgcagaaacatgaacctaggcctaattgcggcgaccgtggttgttggcatacgcattgtacctcggccgttgatctcgctcttgatactctctccgccgcgagatactttggggttgaacagcttgcattgctcactcaggtttattctttttttccttttctgttcctattcttatttttgccaataaaaataggagtgttgttagtagtaagaacataacatcaataaaactaaactatcagcatcaacgagttctctttcttcttttgattcttctgcgtctttgtgatttgtgtgaccagtcatatgtttttttgtgggtcttgggaatttcgacaattactggtttttgggaactgggaagagttttttttttaattaattttttttttgaagatgagaacaaacaagaataagaatgagattttggttttggtttaagaatttttgttaattttatataatttttttatctatcccatcgatcagtagattctattatttgatctcatgtcttctcaatgtcagtactgagtaataactgtgtttttgttttattttgctttgtttttgttttgattctaataattttttctcattaattaattctccttgtctaaatctcatcttcttcttcacatgcagttgttgcttcaattctcaccgtaaagacagataaacacttacattaatctcactgtcacattaattccttttgattttcagcttttttattcttcactagattgtttttatttttttttatattatattatttgtgttaatttatgatgtccttgaaatatttcatgtcatcatgtactggaaattagaggaaaagagacatgacagttttctcgatttggtgttcttccactcactagaatgagtttctaaatttagatcataaatcaatctagtcttgtctttcacacatttagctatagtgcacgaaatctttcacaagcacattcactttcctcatttggtctcaaagaaaaagaagtctatttctgtctaaatgaggataacaaattactcactttgttctctttgcttttatgcatagttttcttaattttaaacacaaatctcaaaaaaaaaaaaaattcacttacatgaactataaaattataaaattatagtaatttgtgatgatactgcattatagtttaatttaaaacttctcttattctatgtttttttttgcaacagaaacaacttgctagcatggtggaaaaagcttctattgaagatgtaatgaaagtgctactagcatcaagaaaacaagacatgcatcaactatggacaacatgttctcacctcgtcgcgaaatctggtcttccgccggaagtgctggcgaagcatcttccgatagacatcatagcgaaaatcgaagagcttcgaatgaaatcatccttatcacgccgctccttaatccctcaccaccaccacaaccctcaccatcaccacgatcatctcaccgctgcagcagacctcgaagaccaaaagatccgtcggatgagacgtgccctcgactcctcggacgtggagctagttaaactcatggtaatgggagaaggccttaacctcgacgaagcattagcgttaccttacgcggttgagagttgcagtagagaagtggtgaaagccttgttagaactcggtgcagctgatgtgaatttcccggccggtccaaccggtaaaaccccgcttcacattgctgccgagatggtctcgccggacatggtggccgtgcttctcgaccaccacgctgacccgaatgtaagaacagtcgacggcgttacacctttagacattctgagaaccctaacctcagactttctcttcaaaggcgctgtccctggattaactcacatagaaccaaacaaactaaggctgtgtttggagcttgttcaatttgcagctcttgtcatgtcaagagaagaaggtaacaacaacaataatgctaataacaacaacacaggatcttcagcaacaaacatgtaccctcacaatcatatgaatgaagaacatcatagtcatcacaacaacaacagtaacatggattcaaggttggtgtatcttaaccttggtgctaatactcaaatgagtacttcaaggttggattctggtgatgatgatcataatagtaatcaaagggaagctatgaatccatccatgtatcatcatcatcattctcatgactactaa

SEQ ID NO: 8347 - DNA, 2529 bp, Pisum sativum
atgtcccttgaagactccctaagatctctttctcttgattacttaaatcttctcatcaacggacaagccttcagcgacgtcgttttcagcgtcgaaggccgtttagtccacgctcacagatgcatcttagcagcaaggagtctcttcttcagaaaattcttctgtgggccagacccgccttccggactcgacccgtcaggcaaccgagtcaactcatcaacaaggtccggtgttataccggtgaactcagtgggctacgaggttttcttgctgatgcttcagtttctctacagtggtcaagtttctattgttccgcagaaacatgaacctaggcctaattgcggcgaccgtggttgttggcatacgcattgtacctcggccgttgatctcgctcttgatactctctccgccgcgagatactttggggttgaacagcttgcattgctcactcaggtttattctttttttccttttctgttcctattcttatttttgccaataaaaataggagtgttgttagtagtaagaacataacatcaataaaactaaactatcagcatcaacgagttctctttcttcttttgattcttctgcgtctttgtgatttgtgtgaccagtcatatgtttttttgtgggtcttgggaatttcgacaattactggtttttgggaactgggaagagttttttttttaattaattttttttttgaagatgagaacaaacaagaataagaatgagattttggttttggtttaagaatttttgttaattttatataatttttttatctatcccatcgatcagtagattctattatttgatctcatgtcttctcaatgtcagtactgagtaataactgtgtttttgttttattttgctttgtttttgttttgattctaataattttttctcattaattaattctccttgtctaaatctcatcttcttcttcacatgcagttgttgcttcaattctcaccgtaaagacagataaacacttacattaatctcactgtcacattaattccttttgattttcagcttttttattcttcactagattgtttttatttttttttatattatattatttgtgttaatttatgatgtccttgaaatatttcatgtcatcatgtactggaaattagaggaaaagagacatgacagttttctcgatttggtgttcttccactcactagaatgagtttctaaatttagatcataaatcaatctagtcttgtctttcacacatttagctatagtgcacgaaatctttcacaagcacattcactttcctcatttggtctcaaagaaaaagaagtctatttctgtctaaatgaggataacaaattactcactttgttctctttgcttttatgcatagttttcttaattttaaacacaaatctcaaaaaaaaaaaaaattcacttacatgaactataaaattataaaattatagtaatttgtgatgatactgcattatagtttaatttaaaacttctcttattctatgtttttttttgcaacagaaacaacttgctagcatggtggaaaaagcttctattgaagatgtaatgaaagtgctactagcatcaagaaaacaagacatgcatcaactatggacaacatgttctcacctcgtcgcgaaatctggtcttccgccggaagtgctggcgaagcatcttccgatagacatcatagcgaaaatcgaagagcttcgaatgaaatcatccttatcacgccgctccttaatccctcaccaccaccacaaccctcaccatcaccacgatcatctcaccgctgcagcagacctcgaagaccaaaagatccgtcggatgagacgtgccctcgactcctcggacgtggagctagttaaactcatggtaatgggagaaggccttaacctcgacgaagcattagcgttaccttacgcggttgagagttgcagtagagaagtggtgaaagccttgttagaactcggtgcagctgatgtgaatttcccggccggtccaaccggtaaaaccccgcttcacattgctgccgagatggtctcgccggacatggtggccgtgcttctcgaccaccacgctgacccgaatgtaagaacagtcgacggcgttacacctttagacattctgagaaccctaacctcagactttctcttcaaaggcgctgtccctggattaactcacatagaaccaaacaaactaaggctgtgtttggagcttgttcaatctgcagctcttgtcatgtcaagagaagaaggtaacaacaacaataatgctaataacaacaacacaggatcttcagcaacaaacatgtaccctcacaatcatatgaatgaagaacatcatagtcatcacaacaacaacagtaacatggattcaaggttggtgtatcttaaccttggtgctaatactcaaatgagtacttcaaggttggattctggtgatgatgatcataatagtaatcaaagggaagctatgaatccatccatgtatcatcatcatcattctcatgactactaa

SEQ ID NO: 8348 - DNA, 2804 bp, Medicago truncatula
atgtcccttgaagactcactaagatctctttctttagactacttaaaccttctcatcaacggacaagcgttcagcgacgttgttttcagcgtcgaaggacgtttagtccacgcacacagatgcatcttagcagcaagaagtctattcttcagaaaattcttttgtgggccagacccaccttctggattagacccatcaggaaaccgagtcaacccatccggttcagctaggtctggtgttataccagttaactctgttggatatgaggttttcttgttgatgcttcagtttctgtacagtggacaagtttctattgttcctcagaaacatgaacctaggcctaattgtggtgaccgtggttgttggcatacacattgtacttcagccgttgatcttgctcttgatactcttgcagccgctagatactttggagttgaacagcttgcattactcactcaggtttttattattgtttttgccattaataagtgtagtagagaagagtaaactatcagcatcagcatcatcatcaatcactctttcttctctttttttagttcttctgtgactttgtgatttgtgtgaccagtcgtatgttttttgggtcttgggaatttccacagttactggtttttgggaactgggaagggatatttttatttttattattattttttgttaattaatgggtgaggaatgagaatgagattttggtctaagaatttttgtattaattttttaatgaaataggtaagaaatgagaatgagattttttttttgatctaagaaaatttgtattattattatttttttatctatctcatcgatcaacaatagataaataaagaacttggttggtttgattccattatttgatcttgtgtcttctcttgtcagataagtactgaataactgtatatatatttttttgttttattttgttcctcattaattaattctactgtctaaatctcatcttcctcttcacagttcacactcaattgttacttcaattctcaccgtaaagacagataaacatattcattaatctcaccgtcacattaattaattcctttgattttatatttttgttaatttgtgatgtacttttgaaatatttcatgtcatgtgtgatgtactggaaggaaattagaggaaaagagaaatgacagttttctcgatttggtgttctttcacccactagaatgagtttctaaatttagatcataaatcaatctagtcttgtcttctaacacagtcagctagtgcacgaaatctttctttcccaaatacattcactttcctcatttggtcttaaagaagaaaagggtccatttatgtctaactccctttcatttaccaaatcaggataactaaaccactcactttcttctctttgcttttattcacgttttcttaattttttagttaaaccaaatcccaaaccttttttcccttgcatgaaatgtagttttttatttatttatttatttatataacaatctaaactataggtaaaataattttaaatttgtgtgtacattaatacaactccgtttgaggttgcatcaactatttttcgatgtgtttatgtgacgataacacaatcgcgattaagaccacatgtattatatatgattttatatttaaaacctaattttttggattgaattaagtttgatgatcaaacatttttccaattgtaaatgcattttgtataggacatattttataggaagtatgtaagattgtagagtttgaacaccaaaactcttgattagtactcattgttttgtttttttttgcaacagaaacaactagcgagcatggtggaaaaagcctcgattgaagatgtaatgaaagtgctcctagcatcaagaaaacaagacatgcaccagctatggaccacatgttcccaccttgtagcaaaatcaggtcttcctccagaagtacttgcaaaacatctccctattgatatcatagccaaaatcgaagagcttcgcatcaaaacctccttatcacgccgctccttaatgcctcaccaccatcatcctcaccatcacgaccatctcaccgctgcagccgaccttgaagaccagaaaatccgtcggatgagacgtgccctcgactcctcagacgttgaactagtgaaactcatggtaatgggagaaggcctaaacctcgatgaagcattggcattaccttatgccgttgagaattgcagtagagaagttgtgaaagccttattggaactcggtgcagccgatgttaacttcccggctggtccaaccggtaaaaccccgcttcacattgcagcggagatggtctcaccggatatggtggctgttttgctcgaccaccacgctgacccaaatgtgagaacagttgatggtgttacaccattggacattctaagaaccctaacttcggattttctattcaaaggtgctgtccctggattaactcacattgaaccaaacaaactaaggttgtgtttggaacttgttcaatctgcagctcttgttatgtcgagggaagaaggaaataacaacaatagtaataataataataataatgcaacagcttcttcagcaacaaatatgtatcctcatcataatatgaatgaagatcaccgccatagccacaacaacaataacatggattcaaggttggtgtatcttaaccttggtgctaatactcaaatgagtacttccagaatggattctggtgatgatgataatactcacagggaagctatcaacaactccatgtatcatcatcactctcatggtcatgactactaa

SEQ ID NO: 8349 - DNA, 1645 bp, Medicago truncatula
aacagtaacatcatcataaacacatgaaccaaacctctctctctttcaatccataaaaacatataaccctaaacaaacacaacacaatcatgtcccttgaagactcactaagatctctttctttagactacttaaaccttctcatcaacggacaagcgttcagcgacgttgttttcagcgtcgaaggacgtttagtccacgcacacagatgcatcttagcagcaagaagtctattcttcagaaaattcttttgtgggccagacccaccttctggattagacccatcaggaaaccgagtcaacccatccggttcagctaggtctggtgttataccagttaactctgttggatatgaggttttcttgttgatgcttcagtttctgtacagtggacaagtttctattgttcctcagaaacatgaacctaggcctaattgtggtgaccgtggttgttggcatacacattgtacttcagccgttgatcttgctcttgatactcttgcagccgctagatactttggagttgaacagcttgcattactcactcagaaacaactagcgagcatggtggaaaaagcctcgattgaagatgtaatgaaagtgctcctagcatcaagaaaacaagacatgcaccagctatggaccacatgttcccaccttgtagcaaaatcaggtcttcctccagaagtacttgcaaaacatctccctattgatatcatagccaaaatcgaagagcttcgcatcaaaacctccttatcacgccgctccttaatgcctcaccaccatcatcctcaccatcacgatcatctcaccgctgcagccgaccttgaagaccagaaaatccgtcggatgagacgtgccctcgactcctcagacgttgaactagtgaaactcatggtaatgggagaaggcctaaacctcgatgaagcattggcattaccttatgccgttgagaattgcagtagagaagttgtgaaagccttattggaactcggtgcagccgatgttaacttcccggctggtccaaccggtaaaaccccgcttcacattgcagcggagatggtctcaccggatatggtggctgttttgctcgaccaccacgctgacccaaatgtgagaacagttgatggtgttacaccattggacattctaagaaccctaacttcggattttctattcaaaggtgctgtccctggattaactcacattgaaccaaacaaactaaggttgtgtttggaacttgttcaatctgcagctcttgttatgtcgagggaagaaggaaataacaacaatagtaataataataataatgcaacagcttcttcagcaacaaatatgtatcctcatcataatatgaatgaagatcaccaccatagccacaacaacaataacatggattcaaggttggtgtatcttaaccttggtgctaatactcaaatgagtacttccagaatggattctggtgatgatgataatactcacagggaagctatcaacaactccatgtatcatcatcactctcatggtcatgactactaatcaatctacctttgaatgcctatcaaatactagtcaccatttgaagtgcggtttcataggaggatgggataagagacaaggagaatctaattatcagttcaatttta

SEQ ID NO: 8350 - DNA, 2639 bp, Glycine max
aacgggcaggccttcagcgacgtcactttcagcgtggagggccgtctggtccacgcgcaccgctgcatactcgcggcgaggagtctcttcttcagaaaattcttttgtgggccggacccaccttccggcctcgaccccaccggaccgcgaggagttaactcctcgcgatccggaggggtcatcccagtcaactcggttggctacgaggtctttctcctcatgctccagtttctatacagtggccaagtctccatcgtgcctcagaagcacgaggccaggcccaattgcggcgagcggggatgctggcacacgcattgcacctccgccgtcgatctcgccctcgacaccctcgccgccgctagatacttcggggtcgaacagctcgcattactcactcaggttttccactgttccagtcccgttcgaatgctaatgttttcgtgtttgattttcacataaatataattctcacaagttaattgttattgcttccacctctcaaacctgactccaaacaagtatccttgttgttaccaatagcagtatcatatcatatccctcactctcaactgttttttttttttttttttctttccaccctttgtgttgccagtcatatgtttcatgggtcttgggaattcggacagttactgctgctgggtctgctctcgttttgggaactgggaacgggtgtttctatgtctttataattgtttttaatttttttatctttatttttattcagagggtctgtaatatggatgagaatttttggttctgaatttgtgcttcaatctatcccatcaggagttataccacaagttcgttctattctatgatctcgtgtcaccgctaaactactgcttttgtttgtcagcgactgaatagctgatttcttttactactatttctcttttctctctctctctctctcattaattccactctccataatttctttctccttgactttcacttgttagcttcaattctctcctcaacaaacccacacacgcaataataccactttcaagtttcaaaatgtagctcatgagcttgctacgattgatgagggtatcgaattttgttggctgaattaaagctttgtatactagttgtatttgtttatgttagagttggacatagctgatttcatgtgctgaaaatcataggatatagtttctcgaattggagttcttccaccctcgaagacgaacactgaggaatttctaaatttagatcatgatatagcagtcttgtctagcacacagtaagcgcacgaaaacttttcccaaacatccactttcctcatttgggtttggactcgaaaagagaacaaaccaccgcagaagaatttttaaaaaaaagggtcctttaattctcctacgctgcgtttcccaaccatcccatcccgttccatttgttctcttccgttttgcattcatttattactttcccacaaaattgtcagtattattgccttacatgtaagtgctgtcatcaaacatgtttctttcctatgcaaataaattctttgttggttgagtaggatgcaatatactgttttttatatgtaaataaactctttcttgtttcttgctctcacgcattttgatatttttctttgttagaaacaactggcgagcatggtagagaaggcttcaatagaggatgtaatgaaagtgctgttggcatcaagaaagcaagacatgcagcaactatgggcaacatgttcccacttggtggcaaaatcaggtcttcctccagaggttctagcaaagcacttaccaatagacattgtggcgaaaatcgaagagctccgtctcaaatcctccctggcacgccgctcattggtgccttctcaccaccaccatcaccaccaccaccaccaccacgcggcggcggcactcgacctcgaggaccagaaaatccggcgaatgaggcgcgccctggactcctccgacgttgaactggtgaagctaatgctaatgggagaaggcctaaacctcgacgaggctttggccttaccctacgcagtggagaattgcagcagagaagtggtgaaggccttactggagcttggtgcagccgacgttaactacccgtcgggtcccgccgggaagacgccgctccacattgcggcggagatggtgtcccccgatatggtggcggtgcttcttgaccaccacgcggaccccaacgtcagaactgtcgatggggtcacccctctagacatcctcagaaccctaacctcggatttcctcttcaagggtgctgtccccggattgacccacatcgagcccaacaagctgaggctgtgcttggagcttgttcaatccgcggctctcgtcatgtcgcgagaagatggcaataacgccaacaacaacaacaacaatgctactaataattcagcagcacccatttaccctccaccaatgaacgaggatcacaacaacaacagcagcagcagcagtggcaacaacaacaacaacaacattggtaaccttaacttggattcgaggttggtgtatctcaaccttggtgccaccgcttcaatgagttcaaggttggataatgctgaggacgagagagaagccatgaaccaaaccatgtaccatcatcaccactctcatgactac

SEQ ID NO: 8351 - DNA, 1464 bp, Glycine max
atgtcccttgaagagtcgctaagatctctttctcttgattacctcaacctcctcatcaacgggcaggccttcagcgacgtcactttcagtgtggagggccgcctggtccacgcgcaccgctgcatactcgccgccaggagcctcttcttcaggaaattcttctgtgggccggacgcgccgtgcggcctcgaccctgccggaccgcgaggcgttaactcctcgcgctccggggtaatccccgtcaactcggtgggctatgaggtgtttctcctcatgctccagtttctctacagtggccaggtctccatcgtgccccagaagcacgaggccaggcccaattgcggcgagcgcggctgctggcacacgcattgcacctccgccgtcgatctcgccctcgacaccctcgccgccgctagatactttggcgtcgaaccgctcgcattgctcactcagaaacaactggcgagcatggtagagaaggcttcaatagaggatgtaatgaaagtgctgttggcatcaagaaagcaagacatgcagcaactatgggcaacatgttcccacttggtggcaaaatcaggtctcccaccagaggttctagcaaagcacctcccaatagacatcgtggcgaaaatcgaagagctccgtctcaaatcctcactggcacgccgctcattggttccttctcaccaccaccaccaccatcacccccaccaccacgcggcggcggccctcgacctcgaggaccagaaaatccggcgaatgaggcgcgccctggactcctccgacgtggaactcgtgaagctaatggtaatgggagaaggccttaacttagatgaagcactggccttaccctacgcagtggagaattgcagcagggaagtggtgaaggccttactggagcttggtgcagccgacgttaactacccgtcgggtcccgccgggaagacgccgctccacattgcggcggagatggtgtctcccgacatggtggcggtcctgctggaccaccacgcggacccgaacgttagaacagtcgatggggtcacccctctagacatcctcagaaccctaacctcggattttctctttaagggtgctgtcccgggattgacccacattgagcccaataagctgaggctgtgcttggagcttgttcaatccgcggctctcgtcatgtcgcgggaagaaggaaataatgctaacaacaacaacaatggtcctcatagttcttcatcagcagcgcctatataccctcctccaatgaacgaggatcacaacaacaacaacaacagcagtagcagcagcggcaacaacaacattggtaaccttaacttggattctaggttggtgtatctcaaccttggtgccactgcctcaatgagttcgagactggataacgctgaggacgagagagaagccatgaaccaaaacatgtaccatcatcaccactctcatgacttctag

SEQ ID NO: 8352 - DNA, 1452 bp, Lotus japonicus
atgtcccttgaagactctctaagatctctgtccctagattacctcaacctcctcatcaacggccaagccttcagcgacgtcaccttcagcgtggaaggccgcctagtccacgcccaccgatgcatcctcgctgccaggagcctcttcttccggaaattcttctgcggccccgacccacctcctccttccggcaacctcgactcccccggcggacctcgagtcaactcgccgaggcccggcggagtcatcccggttaactccgtcggctacgaagtcttcctcctcatgctccagttcctctacagtggccaagtctccatcgtgccacagaagcacgagccgagacccaattgcggtgagcgtgcctgctggcacacgcattgcacctccgccgttgatctcgcccttgacactctcgccgccgcgagatacttcggcgttgaacagctcgcattgctcacacagaaacaactagcgagcatggtggagaaggcttcaatagaggatgtaatgaaagtgctgctggcttctagaaaacaagacatgcaccagctctggaccacatgttcccacctcgtagctaaatctggtctccctccagaggttctcgccaagcatcttcccattgacattgttgccaagattgaagagctccgcctcaaatccacccttgcacgccgctctctgatccctcaccaccaccatcaccaccaccaccatggccaccatgacatgggagcagcggcagacctggaggatcagaaaatccgccggatgaggcgggcgcttgactcctcggatgtggagcttgtgaagctcatggtgatgggagaaggccttaaccttgatgaggcgctggccttaccatacgctgtcgagaattgcagcagggaagtggttaaagccctgctggagctcggggcggcggatgtcaactacccatcgggaccgtctgggaagacgccgctccacatcgcggctgagatggtctccccggacatggtggcggtgctgctggaccaccacgccgacccgaatgtccggaccgtggacggcgtcacgcctctggacatcctcagaaccctaacctcagatttcctcttcaaaggtgctgtcccaggattaacccacattgaaccaaacaagcttaggctgtgtttggagcttgttcaatcagcagctcttgttatgtcaagggaagaaggtaatgccaatgcaaacagcagcaacaacaacaatgctccttgttcagcagctactccgatataccctcctatgaatgaggatcacaatagtagtagcagcaatgctaaccttaacttggattccaggttggtgtatctcaacctcggcgcggcccaaatgagcggtgatgatgatagcagccacggcagccaccgggaagccatgaaccaagccatgtaccaccaccaccactcacatgactattag

SEQ ID NO: 8353 - DNA, 1778 bp, Vitis vinifera
aaataacagtacatcgtcaaagagtagagagaaagagatgaaagcaccgagcttttctctatctctctccatctccatccctatctgggcctgtgctttctcatcttaagcttcatcgccttctagcgcatcaaccccacaaccatacacatctttctctctgtctttttcctccatctacatctgcaaatcatcaaccctagccatgacccttgaagactccttaagatctctgtctctggactatctaaacctgctcatcaatggccaagccttcagcgatgtaactttcaatgtggagggtcgattggtacatgcccaccggtgcatcttggcagcgagaagcctctttttcaggaaattcttttgcggaccagacccaccggcggggctggacccggggggttccaggatgggctcggcggcggcggcgttggcgacgtcgcccaggggcgggaattcgcacgtgatacctgtgaattcagtggggtatgaagtgtttttgttggtgttgcagttcttgtacagtggacaagtctctattgtgccccagaagcatgagcccaggcctaattgtggcgagagagggtgttggcacacgcattgcacttcagccgttgatcttgctctcgatactctggctgctgctagatctttcggcgtcgaacagcttgcattgctcactcagaagcaattggcaagcatggtggagaaggcctcgattgaagatgtaatgaaagtactaatagcttcaagaaagcaagacatgcaccagctttggactacctgttcccaccttgttgccaaatctggcctaccaccagaagtcctagccaagcaccttcccatcgatgtggttgccaagatcgaagagcttcgacttaagtcctctcttgctcgccgttccctaatgccccatcaccaccaccaccaagatattggtgctgcggctgatctcgaggaccagaaaattcgtcgaatgagaagagctctcgactcatctgatgtggagctggtcaagcttatggtcatgggtgagggcctcaatctcgatgaagcattagctctacattatgctgttgagaattgtagccgggaagtggttaaagctttgctcgagcttggtgcagccgatgtgaactaccccgctggaccagctgggaaaactccactccacattgcggccgagatggtatcccccgatatggtggcagttcttctggatcaccacgccgacccgaatgtccgaactgtggatggtgtcacacctctcgacgtacttcgaaccctaacttctgatttcctcttcaaaggggctgttccggggctaacacacattgaaccaaataagctaaggctctgccttgagctagttcaatccgcagctctggttctttctcgggaagaaggcagtgcaaacgctccttcttctactacaatttacccaccaatgagcgatgatcatcacagtagcagcagcagcagcaacatggctagcctaaacctggattcaaggttggtttatctcaatctcggtgcgacgggttcgggtcaaatggggtctagaatggatagagaagatgatgttagccacaataaccagagggaagccatgaatcgacatggatcgcaaggtggctgtgacacatcaatgtaccaccactcccatgagtactagctagctcatgaactaaatatttctatattattcatggatggtgaaagacgagcaaaagttcactaaaactcatggagattattggattatatcatcttct

SEQ ID NO: 8354 - DNA, 2278 bp, Vitis vinifera
caatggccaagccttcagcgatgtaactttcaatgtggagggtcgattggtacatgcccaccggtgcatcttggcagcgagaagcctctttttcaggaaattcttttgcggaccagacccaccggcggggctggacccggggggttscaggatgggctcggcggcggcggcgttggcgacgtcgcccaggggcgggaattcgcacgtgatacctgtgaattcagtggggtatgaagtgtttttgttggtgttgcagttcttgtacagtggacaagtctctattgtgccccagaagcatgagcccaggcctaattgtggcgagagagggtgttggcacacgcattgcacttcagccgttgatcttgctctcgatactctggctgctgctagatctttcggcgtcgaacagcttgcattgctcactcaggtttctcttcttttgatccatggctgatcatcgcttgtttgttttctttgtgctctctctctctcttgattactgtgtccaactaagcgtttatgggttttggttatttcaacatataccgggtttggttttgggaagtgggatgggattttcaggtgggtttttgccctttatttttcgaatttcatcttcgtctgacgaagtgggtcggtgggtgccgtgggttcgtttttgggcagcaaattttgttttatttattaacttataattatcttctcccttggaagctgttgtgcttgatcatagagacatagtaccttttcttttctgcaactgcatatctccttttcagtttcttttaaagccttcgttccaacaattgtttcaattttcgtatgtcatgttcatgggttcttattcttcttctttaatcctcttctctcttcttctcttcacttgagatacaaaccagatttgctccctttggccatattttttcttatactttttatgggggtaaggtgttcttgtcgctgttggtgtcacatacaagtctatcttgatttcatgtgccattctgagtctcttaatcgagtttcttttatctttatgctgcatacccaatactttctatatatagttgttcatctctagtcttgtcttccacagtgagcacaccaaatctttcccaaatattcaactttccccatttggtttcagattggaaagaaataaaggaccagttagaagttaatttcgcacaaacaacccacattttttccagtgcaaaaacttccaaaacatcattttggtttgaataattccattcacgaatatttgtttattgctttttacgggttgcagaagcaattggcaagcatggtggagaaggcctcgattgaagatgtaatgaaagtactaatagcttcaagaaagcaagacatgcaccagctttggactacctgttcccaccttgttgccaaatctggcctaccaccagaagtcctagccaagcaccttcccatcgatgtggttgccaagatcgaagagcttcgacttaagtcctctcttgctcgccgttccctaatgccccatcaccaccaccaccaagatattggtgctgcggctgatctcgaggaccagaaaattcgtcgaatgagaagagctctcgactcatctgatgtggagctggtcaagcttatggtcatgggtgagggcctcaatctcgatgaagcattagctctacattatgctgttgagaattgtagccgggaagtggttaaagctttgctcgagcttggtgcagccgatgtgaactaccccgctggaccagctgggaaaactccactccacattgcggccgagatggtatcccccgatatggtggcagttcttctggatcaccacgccgacccgaatgtccgaactgtggatggtgtcacacctctcgacgtacttcgaaccctaacttctgatttcctcttcaaaggggctgttccggggctaacacacattgaaccaaataagctaaggctctgccttgagctagttcaatccgcagctctggttctttctcgggaagaaggcagtgcaaacgctccttcttctactacaatttacccaccaatgagcgatgatcatcacagtagcagcagcagcagcaacatggctagcctaaacctggattcaaggttggtttatctcaatctcggtgcgacgggttcgggtcaaatggggtctagaatggatagagaagatgatgttagccacaataaccagagggaagccatgaatcgacatggatcgcaaggtggctgtgacacatcaatgtaccaccactcccatgagtac

SEQ ID NO: 8355 - DNA, 1349 bp, Glycine max; identical to SEQ ID NO: 8331

SEQ ID NO: 8356 - DNA, 1771 bp, Glycine max; identical to SEQ ID NO: 8330

SEQ ID NO: 8357 - DNA, 1890 bp, Glycine max
ttcatggttagaggtggtggactccaatccatggattcagatccaattgggagcttcttcctccacaagccaattgttctcaactctttcccagctgaagacacaaacaacaagtggaaaaaacttagtctccaccacaacatggatgccacagctagcaataccaaagataacaccatcccctttcaagtcagccttagatgttctccaaacaatcatgatgatgcctcttcaccaccatctctccacaacaacagaaccgagatggacttattctccgacaagaatagtaccaaagatgatgacaacaacaacaacaaggttgatgcttctgcctctctccccgacaatgatcatcattccaccactccacccacgttggaattcaaactaaacactggtggtctaaatcttcttactaccaacactaacagtgaccaatctatggtggatgatgagatatcacccaattcagaagacaaaagagctaagaatgagatggctgttcttcaagctgatcttgaaagaatgaagagggagaatcaaaagttgagggactcgcttgatgaggttaccaccaattacagcgcgcttcagatgcattttatgaatctgatgcaagagcgaaagggagaggaaggtgaagaagaacaagaagaagtgtatggtggagagaagaagcagcaattaggtgagagtggtggtgatgggatattagttccaaggcagtttatggatcttgggttggctgctaataatggtactagcactggtattgaaccctcttcttcatcaggaggaagaagccaagatcgatcaagatcacccaacgtagaagtggcttccaaggaattagggacaaatgatgaagaagagaagaaagagtatggtagagggatagagagagaggatgatagtccctcagggcatgctcataaagttccaaggttcagtcctccaaaggataataatagtgttgaggctgaggctactatgaggaaggcaagagtttctgttagagctcgatcagagacacccatgattgctgatgggtgtcaatggagaaagtatgggcagaaaatggccaaaggaaacccatgtcctagagcttattataggtgtagcatggcatcggcttgcccagttagaaaacaggtacaaaggtgtgctgaagatagaacagtccttatcacaacctatgaaggaaatcacaaccaccctttgcctccaacagccatggcaatggcacaaaccacatcctcagcagcaagaatgctgctttctggatcaatgtcaagtgctgacagcataatgaatgcaaacttcctcacagggacactccttccttgctcttcaagcatggccactatctcagcatctgctccattcccaactgttacattagacctaactcattctccaaaccctctacagttcccaaggcagcagcatccaaaccagttgcagattggtgtccctcagaataattttgcaaactccccggcagcatctttactgcctcagatatttggacaagcactgtataacaaccaatcaaagttttctggcctacaaatgtcatcatcacattatgatgcagacccttcttcacaatttggtaataaccaattaccacctcatcaggttgttccaccacaccttgctgacacagttggtgctgccattgctactgacccgaatttcactgcagcattggcagcagctatcacttccattattggtggtgctccgctacaacacagcaacagtagtaataataataatagtaacagtaacaataaaggcaacatgacagccaacaacagcaacaatggcaatggcaatgtcgccagtagtagcaacaacaactgcaacaacggaaagcaataa

SEQ ID NO: 8358 - DNA, 1845 bp, Glycine max
atgattagacgtggtgggctatccatggattcagatccaattgggagcttcttcctccataagccaattgttctcaactctttctcagctgaagacacaaacaaccacaaccccgagtggaaaaaactcagtcttcacaacaacaacatggatgccacagttaccacaaaagactacaccatccccttccgaatcaaccttagctgttcttctgcagacaatcatgatgatgtctcttcaccaacatctctccgtagcagaaccgagatggacttcttctccaacaagaacagtaccaaagatgatgacaacaacatcgttgctgcggctggttctgcctctctccccgacaatgatcatcattccatctctccacccacgttggatttaaaagtaaacacttgtctgaatcttcttactaccaatgctagtagcgatcaatctatggtggaagatgagatatcacccaattcagaagacaaagaaactaagaaagagatggctgatcttcaaggtgatcttgagagaatcaaaagggagaatcaaaagttgagggacacgcttgatgaggttaacaccaactacaacgcgcttcagatgcactttatgaatatgatgcaggagcggaagggcgaggaaggtgaagatcagcaagaagtgtctgatggcaaggttaaagagaagaagcagggtcagagtggtggtggggtattggtgtcaaggcagtttatggatcttgggttggctagcgctgatattgaaccctcatcttcatcagggggaataagaagtcaagatagatcaggatcacccaacatagatgtggcttccaagggattagggactagtaacaatgatgggaataatagtgttaatgatgaagaagagaaggagtatgatagagggattgagagcgaagatagtccttcagggcatgctgataaagttccaaggttcagtagtccttcaaagaataataatgttgatcaggctgaggctgaggctactatgaggaaggcaagagtttctgttagagctcgatccgaagcacccatgattactgatgggtgtcaatggagaaagtacgggcagaagatggccaaaggaaacccatgtcctagagcttattatagatgtaccatggctgctggttgcccagttagaaaacaggtacaaaggtgtgctgaagaccgaacagtccttatcacaacctatgaaggaaatcacaaccatcctttgcctccaacagcaatggcaatggcacaaaccacatcctcagcagcaagaatgttgctttctggatccatgtcaagtgctgacagcataatgaatgcagacttcctcacaaggacactccttccttgctcttcaagcatggccactatctcagcatctgctccattcccaacagttacattagacctaactcattctccaaaccctctacagttcccaaggcagcagcatccaaaccagttgcaaattggtgtccctcagaattttgcaaactccccatcatctttaatgcctcagatattcggacaagcactttacaaccaatcaaagttttctggcctacaaatgtcatcacatgatacagcagacccttcttcacaatttggttaccaacctcatcaagttccaccacaccttgctgacacagttggtgctgccattgctactgatcccaatttcacttcagcattggcagctgctatcacttccatcattggtggtgctcagcaacaacacagcaacattaataataatagtaacaataatgtcaacatgacagccaacatcaacaatggcaatggcaacagcaatggcaacggaaagcaataa

SEQ ID NO: 8359 - DNA, 775 bp, Glycine max
gcattcccctgcttacatacagagcacttgtcatccaagagaatgaagaagatactagtatcaatcaagttcctgttttgtttttctctgctctgtgttttgttctcttcacttcctttactccttcaatccttgaagccatccctcatgcaattcttcagctacttggttgaaaaaagctacatgttccttttctgcaatggcctccttcttgttttaatagccatcaactctgctccaatcaatgcctcttcaccaccaaccactgaacgtgctgctttttctgttcacatagaagagaatagcagccagttagaatccaaggaaccagacattgcagttgcagcagcaccaattgctgctgaggaaactgaattcccacaagaagaggaaaatgttttggagatagtagaacgagaaaatgtgctatcagatacccaagaagggggaaatgcccttgttaccattgatgaagatgtgcatgacactgaagagttaaataagaaatgtgaagattttattaaaaggatgaaagcaacgttctcttccactaacttggagctaagggctgtcgacagattttattttgataatcgatcatgtctcatgaatctccctttcttttgaattgactttaactaacagggtgtctttgtttccgagttattttgccacccagatttttgcttgcaggaattaaatcctggcctacatggttctgtcagactatgttccatgttctgttctctgttccaatggaaactctttcattcta

SEQ ID NO: 8360 - DNA, 761 bp, Glycine max
tttttttttttttttttttttagaatgaaagagtttccattggaacagagaacagaacatggaacatagtctgacagaaccatgtaggccaggatttaattcctgcaagcaaaaatctgggtggcaaaataactcggaaacaaagacaccctgttagttaaagtcaattcaaaagaaagggagattcatgagacatgatcgattatcaaaataaaatctgtcgacagcccttagctccaagttagtggaagaaaacgttgctttcatccttttaataaaatcttcacatttcttatttaactcttcagtgtcatgcacatcttcatcaatggtaacaagggcattttccccttcttgggtatctgatagcacattttctcgttctactatctccaaaacattttcctcttcttgtgggaattcagtttcctcagcagcaattggcgctgctgcaactgcaatgtctggttccttggattctaactggctgctattctcttctatgtgaacagaaaaagcagcacgttcagtggttggtggtgaagaggcattgattggagcagagttgatggctattaaaacaagaaggaggccattgcagaaaaggaacatgtagcttttttcaaccaagtagctgaagaattgcatgagggatggcttcaaggattgaaggagtaaaggaagtgaagagaacaaaacacagagcagagaaaaacaaaacaggaacttgattgatactagtatcttcttcattctcttgc

SEQ ID NO: 8361 - DNA, 576 bp, Glycine max
atgaagaagatactagtatcaatcaagtttctgctttgtttatctctgctctgtgttttgttcttatcatttcctttactccttcaatccttgaagccatccctcatgcaattcttcagctacatggttgaaaaaagctacatgttccttctctgcaatggcctccttcttgttttaatagccatcaactctgctccaatcaatgcctcttcaccaccaacaactgaacgtgctgctgtagctgttcacatagaagagaaaagtagccagttagaatccaaggaaccagacattgcagttgcagcaccaattgctggtgaggaaactgaatccccacataaagaagaaaagattttggtgagagtagaacaagacaatgtgctatcagatacccaagaagaagaaaatgtccttgtgatcattgatgaagataagcatgacactgaagagttaaataagaaatgtgaagattttattaaaaggatgaaagcaacgttctcttccaataacttggagctaagagctgtcgacagtttttattttgataatcagaaattgccggtggctgttaattaa

SEQ ID NO: 8362 - DNA, 703 bp, Vitis vinifera
gttgtcaaactgcccaaggacctgactatcaaaccaaagtatcttgtaacatttactgttggttgtgatcagaaaaaaaatgttgatgcagcagttaaaaaggttgatttctccccctctcctctctgctactaaatttgtctctcttttgctactaaatatctattgtgcagttctctgaggactttaccatccttctatttcattatgatggtcaaacaactgaatgggatgaatttgagtggtcaaagagggccattcatgtgagcgttcggagacaaacaaaatggtaaggagcttctgcaaaggattatttttgaacagaagtttcactttttctggtaggtttcaataagctatggtctgttttattcttttaacttcattctttgcaattttgtcctaggtggtatgccaaaagatttctgcatcctgacattgtggcgccatatgactatatatttatctgggatgaagatctaggagttgagcattttaatgcagaagagtgagtgttggacataaatatcttttttatggcatttgtgtttcagtctacccaacttatgtcattttccaattccagatatataagactagtgaggaaatatggcttggagatttcacaacctggtttagaacctaataaagggttaacatggcagatgacaaaaagaagaggtgatcgagaagtccacaagta

SEQ ID NO: 8363 - DNA, 1630 bp, Pisum sativum
attgtttcttcattttcaatcttcctcaccttgtttcaacgataaggttttcttttccttttccacttcttctacatttggaatttctccctttccttaccttcataattggatctgcaattttttttaagaatggcgactccggtcgagcctccgaacgggataagagcggacgggaagcattattactccatgtggcaaactctatttgagatcgacactaaatatgttccgattaagccgattggtcgaggggcgtatgggattgtgtgttcttctgttaatagggagacaaatgagaaagttgcgatcaagaagatacagaacgcgtttgagaatcgtgttgacgcgcttagaactttgagggagcttaaacttcttcggcatcttcatcatgagaatgttattgctttgaaagacatcatgatgcctgttcataggactagttttaaggatgtttatctggtttatgaacttatggacactgatttgcatcagattattaaatcttctcaaacattgtctaatgatcactgccaatatttcctctttcagttgcttcggggtttgaaatatctacactcagctaacatccttcatcgcgacttgaaacctggaaatcttttaattaatgcaaattgtgacctgaaaatatgtgattttgggttagcacgcacaaactgcagcaagaaccagttcatgacggagtatgttgtcactcggtggtatagggcaccagaactgctactttgctgtgacaactatgggacatctattgacgtctggtcagtgggatgcatctttgcagagctccttggacgaaaacctattttccctggttcagagtgtctcaaccaactaaagcttattatcaatatccttggtagtcaaagggaggaggatatcgaatttattgataacccaaaagctaagaggtacatcaaatcacttccgtattctcctggaacccccttttcccgactttaccccaatgcacatccgctggcaattgatctactagctaagatgcttgtttttgatcccacaaagaggattagtgttacggaagcacttcaacaccctttcatggcctctctctatgatcctaattgtgatcctcctgccatcattccaattgatcttgacattgatgaggatctaggggaagagatgataagggagttgatgtggagggaaatggttcattaccatcctggatctgctatgggaaatgcagagttgtcgtcttgattttattctcttcagggttctatttttattatgttcccttttgttggttatagtagtgtctaatataatagcttgttttgaataactaggagggctcggtcatcggtgagctcgatatatattctgtttcctctttgttgagaacagagaaaacagctaaaatatggtcatcttgaaaaaacatgaaacactgtttgctgatgatgcatagtagtagtttttaactgctattttgagacattgattttgtcttttgaactctgtattttgcttccctcgtttgagttgtatataatgtttatttcataaactattctgtaaattaagtcccaaaaaaaaaaaaaaaaaaaaaaaaaaaaaaaaaaaaaaaaaaaaaaaa

SEQ ID NO: 8364 - DNA, 1858 bp, Glycine max
acgagtatcacgcaaaaggatggatgatgatgcaagaaagaaacaaagagaagggaaatatcaggagctagtgctaggtgcgagtactggagcaaaacgcgggtgtgtgtgactttcgttggagagagatgcagttccattcagaaactccaaacaaacatccctcgcgacaaccttaggaatctcgatcgccgaaaaaacctatgcagccccgaacacacacactctgcattccaacttgtttaaatcatgcctctcgattcacccttctctctcaataaatcttttggcctatgaaatcagattcttcgccaccgccacagtcataataaagttttatttttccaaataaagggaatggcgactcctgttgagcctcctaacgggatcagaactgaagggaagcattattattccatgtggcaaaccctgtttgagtttgattcaaaatacgtgcccatcaagccaattggccgcggagcatatgggattgtgtgctcttctgtgaatagagagacaaatgagaaggttgccatcaagaagatacagaatgcctttgaaaaccgggttgatgcactgaggactttgcgcgaactcaagcttcttcgccaccttcaccatgagaatgtgattgctttgaaggatatcatgatgcctgttcataggaatagtttcaaggatgtctatctagtttatgaactcatggacacggatttgcatcagattattaagtcttctcaagctttgtctaatgatcactgccagtatttcctctttcagttgctccgtggcttgaaatatcttcactcagctaacatccttcatcgtgacttgaaacctgggaatcttctaattaatgcaaattgtgacctaaaaatatgcgattttgggttagcacgtactaactgcagcaagaaccagttcatgaccgagtatgttgtcactcggtggtatagggcaccagagctcctactctgctgtgacaactatgggacatctattgatgtttggtcagttggatgcatctttgcagagcttcttggccgaaaaccgattttccctggttcagagtgtctcaaccagctgaagttgattatcaatatccttggtagtcagagggaggaggatattgaattcattgataatccaaaggcaaagaagtatatcaaatcacttccttattctcctggaagccccttttcgcgactttatcctaatgcgcatccattagcaattgatcttcttgcaaagatgcttgtttttgatccaaccaagaggattagtgtcactgaagcacttcaacacccttacatggcccctctgtatgatcctaactgtgaccctccagctgtcattccaattgatcttgacattgatgaggatctaggggaagagatgataagggagatgatgtggaaagaaatgcttcattaccatcccgaatctgcgatggagaatgcagggttgtgctaatgatatttacttcttttcacggttatgttcccttttgttggtgccaggatagttctaatatcataacttgcttcaaataattaggagggctttgtcatcagtgagctcattatatgttcctgttttctatttattgaaagcagagagaaacagcaaaatattatcttaaaaaaaattgtgttattgctgatgatgcattatagtctttaactgccatgttgagagattgattttttactgaactctgtattgtagttgcctcgttttgctgtacataaacatgttcctgtgtctttcataaaccattttgtaaattaagtctaatgtttatcaatagtgtgttaatgtttgaactttgaagttattttattttattttttcctgc

SEQ ID NO: 8365 - DNA, 1830 bp, Glycine max
atcacgcaaaaggatggatgatggaagaaacaaagagaagggaaatatcaggaggtgcgagtaccggagccaaacgcgggtgtgtgtgtgtgtgagggagagagagatgcagttccattcagaaactccaaactaaacatccctggcgacaaccttaggaatctcgatcgctgaaaaaacctatgcagccccgaacacactctctgcattccaacttgtttaagtcatgcctttcgattcacccttctctcaataaatttttaatcagattcttggccaccgccacactcataataaagttttgtttttccaaataaagggaatggcgactcctgttgagcctccaaatgggatcagaactgaagggaagcattattattccatgtggcaaaccctgtttgagattgactcaaaatacgttcccatcaagccgattggtcgcggagcatatggaattgtgtgctcttctgtgaatagagagataaatgagaaggttgccatcaagaagatacagaatgcctttgaaaaccgggttgatgccctgaggactttgcgcgaactcaagcttcttcgccaccttcaccatgagaatgtgattgctttgaaggacatcatgatgcctgttcacaggaatagtttcaaggatgtctatctggtttatgaactcatggacacggatttgcatcagattattaagtcttctcaagctttgtctaatgatcactgccagtatttcctctttcagttgctccggggcttgaaatatcttcactccgctaacattcttcatcgtgacttgaaacctgggaatcttctaatcaatgcaaattgtgacctaaaaatatgtgatttcgggctagctcgtactaattgcagcaagaaccagttcatgaccgagtatgttgtcactcggtggtatagggcaccagagctcctactctgctgtgacaactatgggacatctattgatgtttggtcagttggatgtatctttgcagagcttcttggccgaaaaccgattttccctggttcagagtgtctcaaccagctgaagttgattatcaatatccttggtagtcaaagggaggaggatattgaattcattgataacccaaaggcaaagaagtatatcaaatcacttccttattctcctggaacccccctttcgcaactttatcctaatgcgcatccattggcaattgatcttctggcaaagatgcttgttttcgatccaacaaagaggatcagtgtcactcaagcacttcaacacccttacatggcccctctgtatgatcctaactgtgaccctccagccgtcattccaattgatcttgacattgatgaggatctaggggaagagatgataagggacatgatgtggaaagaaatgcttcattaccatcctgaatctgctatggagagtgcagggttgtgctaatgatatttacttcctttcatagttatgttcccttttgttggtgccaggatagttctaatatcataacttgcttcaaataattaggagggctttgtcatcagtgagctccttatatgttctgttttctatttattgaaagcagagagaaacagcaaaaagatgaccatcttaaaaaaaaatgtgttattgctgatgatgcattgtagtctttaaacgccatgttgagagattgattttgtactgaactttgtattgtagttgccttgttttgttgtacataattatgtttctgtgtctttcataaaccattttgtaaattaagtctaatgtttatcaataatgtgttattgtttgaactttgaagtacaattttttccccgtaagcggaacat

SEQ ID NO: 8366 - DNA, 2199 bp, Vitis vinifera
atggcaactccagttgagcctccaaatgggactagatgcgaaggaaaacattattattcaatgtggcagactttgtttgagattgatacaaaatatgtgcccatcaagccaataggtcggggagcatacggtatcgtgtgctcttctgtgaacaaggaaaccaatgagaaagttgcaattaagaagatacataatgcgtttgataaccgtgttgatgcactgagaactttgcgtgagattaaacttcttcggcatcttcgacatgaaaatgtgattgctttaaaagatgtcatgatgcctatacacaggagaagtttcaaggatgtctatctggtttatgaactcatggatacggatttgcaccagattattaagtcctcccaagcgcttactaatgaccactgccaatattttctgttccaggtatcatcttgttagttgttagtcaagtgaagtaatttcagtattttggatggttctaaaaagtgggttatgctctagtattgaatccctattttagaaagcttctttaatttagcaaagttaagtgatataatataaggtttagttaactagccctattatcattttgatatgatttcagtagaaatgaggataatcattaacccctgctttaacatacaactgttgcattttgattatagttattcaaattatttcaataacactagtgaatggttttcatatgaaaaaatgagaaatgaaaggtttgcaggtgaacttttttgtaataaaagttttgcatttgttaaataggattctttttggtcatcttatttatggggacatataacagttccatcttgttgttaagttctaacatggcttatattaagaagcacttcattaggtaaaagggggtgaaaacagaactgtcacccataccaaaatgtgctgagcgaatcaagatttaagatcttctagtcagcttttcctttccttttggttataggtgtcttgtaactcattagctgtaaaaatttccataacccaaaattaatgattcatgacatatgtgtatatatgtatgtatgtctgaatgctttgttttgctttttctctctttcatcaccatcatcatcttcttcttcttcttcttcttttttccagttatgttcttagcctttggtaagtttgtacattgccaacatggttgccaagtgtatatgattcctttctgtattctttagtaataatgaattcttaacatttatacatctgctgtgggtctaattactgtgtagtatccatctgttgttgctggttttttgtttttcctcctcatgttttatttgttgttctcctgtccctatttgtctgcataccattctttgtgaaatgggcatttcaagctatccactgtttgtttctaatttctaaaatatactagcacaccctattgtagtaaaaatgttgaaagatctatcaaccttgaatttgcttaattctctttttattgtggaactaatccaaatgtcctagtgtagttgctccgaggcctgaagtatctccactcagcaaacatcctccaccgagacttgaagcctggaaaccttcttatcaatgcaaactgtgacctaaaaatatgtgattttgggctagctcgaactagcactggcaagggccagttcatgactgagtatgtggtcactcgctggtacagggccccagaactcctcctctgctgtgacaactatggaacctccattgatgtgtggtctgttggatgcatctttgcggagcttctcggccggaaacctatattccctggcacagagtgtcttaaccagctcaaactgatcatcaacatccttgggagccagagggaggctgatattgaattcattgacaaccccaaagcaaggaaatacatcaagtctctcccgttctcaccagggacgcctttttcccgtctttacccaaatgcccatcccatggcaattgatctgctgcagaagatgctaatttttgacccctcaaagaggattggtgtcaccgaagcactccaacaccctttcatgtcctcactgtatgatcccagtaagaaccctccagcacaggtccccattgatctggacatagacgaggatttaggggaagagatgataagggagatgatgtggaaggaaatgctccattatcatcctgaagctgttacaagcaatggggaggcaagtt

SEQ ID NO: 8367 - DNA, 1248 bp, Solanum lycopersicum
gtaagtttgggtataagcagagtataaatttaaaggaatatggcaactccagttgagccaccaaatgggataaggtccccagggaaacattactattctatgtggcaatccctttttgaaattgatactaaatatgtacctattaagcctattgggcgaggggcatatggaattgtttgttcttctgttaacagggaatccaatgagaaggttgcaatcaagaaaataaacaatgcttttgagaatcgtgttgatgctctcaggacattgcgtgaactaaagctccttcgccatctaagacatgaaaatgtgattgctctgaaagatgttatgatgccaatccataggcgaagtttcaaagatgtttatctggtatatgaactaatggatacagatttacatcaaatagtcaaatcctctcaaacactcacgaatgatcattgccagtatttcctattccagttgcttcgaggtctaaagtatctccattcggcgaatattcttcatcgtgacttgaagcccgggaacctgctcatcaacgctaactgtgatctgaaaatatgtgatttcgggcttgcacgtacaagcagtggcaaggaccagtttatgactgagtatgttgttacacgctggtacagggcgccggaacttctcctttgctgtgacaactacggaacatccattgatgtatggtctgttggttgcatttttgcggagctcttagggaggaaacctgtctttccaggtacggaatgcctgaaccaactgaaattgattatcaacatccttggtagccaaagggaagaagatttagaatttatcgacaatccaaaggcaaggaagtacatcaaatcacttccatattctcctggaacaccattttcccgcctctatccccaagctcatccattggcgattgatctcctgcagaggatgcttgtgtttgacccttccaaaagaattagtgttatggaagcacttcaacacccatacatgtctcctttgtatgatccgaacactgatcccccagcgcaggttcctatcaaccttgacatagacgaggacttgggagaagagacgataagggacatgatgtggacggaaatacttcattaccatcctgaagctgccacagctgctatggaagaagttatgtgagctttatgttagagctttttgtaacttatctttttcccctgctttcaataaatatcgagtcttgattcatcgacagtttgagctgcgatg

SEQ ID NO: 8368 - DNA, 757 bp, Glycine max
ctttcaccatcttctccgttcctcatttcgcaaagccacaattgtcaccattcccaaccctaaccctaacccttctcaaacgatggtagtttctctcggtcctgggaaattctacggcaccagcctcccccgacctcggatctacaccgacgtcaagttcaacgaccaccgcgtcgacccacccgttcccgtcaacgacccactcatgtcctgggcccaagaggcccactggtccatgggcggcctcagcttcaagcgcctccgtctccagggcaaaattgaaggcaatgtcgaaaggcttcgctcccagcgcgagaagttccaggctcaaagcccaagcccaagcccaccggcacgcgccgacctccgcagatccaaaagagctgcttcccctctgactccaccggctccggtcatggcgaaacggcgaagatacatggatcttatccaagaggaagaagaggaagaagaagaaggggttgtggttcggaggaccagtgttcggaagagcggcttggtgaagaagcttggggatgattttgacagggttgccctggaaaacgatgagtccaatacggtgtcgtcgttgaagacgactcgtggtcggaaattggttaagaatggtgaacttgggaacaaaacggtggttgaagtagctgaaaaatcaaacaccaaaggaaagaagagtgcaagtgaagccgagaagagccctggggttagaacttcttccagattggctaaacgtgtgtccaattaa

SEQ ID NO: 8369 - DNA, 969 bp, Glycine max
acactttttcgccttctccaatccccatttcgcaaattcacaatcgccaccattcccaaccctaaccctaaccctaaccctaaccctaacccttctcaaacaatggtagtcgccctgggccccgggaaattctacggcaccagccttccccgccctcgcatctacaccgacgtcaagttcaacgaccaccgcgtcgacccacccgttcccgtcaacgacccactcatgtcatgggccgaagaggcccactggtccatgggcggcctcagtttcaagcgcctccgcctccagggcaaaatcgaaggcaacgtcgaaaggctccgctcccagcgcgagaagatccaggcccgaagcccaagcccaccggcccgctccgatcttcgcagatccaaaagagctgcctcccctctgactccaccggctccggtcatgacaaagcgtcgaaggtacatggatctgatccaagaggaagaaaaggaagaggaacaagaggttgtggttcggaggagccgtttagtgaagaagcttggcgatgatttcgacagggttgctctggagaacgatgggtatgatacggtggcgtcgttgaagatgactcgtggtcggaaattggttaagaacggtgaaccggtgaagaagacggtggttgaagtgacagagaaatcaaacaccaaagcaaagaagagtgttgcaagtgaagctgagaagagctctggggctagaacttcttccagattggctaagcgcttcttgtaattagatgttgcataaattgtggttttccttttactttgcgtaagtttcaagatttagggtttgttcaacaattggtactatgcagtaaagagaaatacatgaatgaaagggcagatgacattatatttgcaattgtttcatagttctctgcctaaaattcacggaacaaattggatttttttttataataatttgacttaattacattcataa

SEQ ID NO: 8370 - DNA, 1580 bp, Medicago truncatula
agagcgtgactctcttgttccaaactcacaacacaaagatcttgtttcgtagtgcttctctataaaaccaaaaccccaactacactgaaggttccattcttgattcttctgccggaaaattcatcctccgttcttcaccttcttccacgttccgcctacaacatcatcacccctcagctggggttttctttttctcactcaaaactttttattttttattttttttgttgctcagatcttcatctctttttccggggtttttcttctttaaacaagcatatttgtttcttatacggaagataccttctagttgatgaatggtgaagtgtgaattttgcatatagttttatgagcatacagccagggaagttccgatatagatggggaccgttactcgcagtcctaatggtagaaaacccagtgaaattatgaggcttattgtcacaacttttattggagtagtttttggtttctttctaggagtgtcgtttccaacattgtcattaacaaagttcaatctcccatctggcttgcttccctcgattgacctctcttacattgaagaaagatatacaggtcgtcgcgcttggtcttttataaacaatagtaacagaagagctttgccaaatcgcttatcaaatgacacatcaaagatatgggttccatcaaatccaagaggagcagaaagtttacctcccggcattgttgaagctgagtccgacttttacttgcgtagattgtggggcaaacccagtgaggatttaacgttcaagccaaagtaccttgtgaccttcactgttggctatgaaatgaaaaaaaatattgatgcagccgtgaaaaagttttcagagaacttcacaatccttctatttcattatgatggccgagctaatgaatgggatgagtttgaatggtcaaagaaggctattcatgtgagtgctcgcaaacagactaaatggtggtatgctaagcgatttctgcatcctgacattgtggcaccatatgactatatatttatatgggatgaagacttgggcgttgagcattttaatgccgaagagtacttaaaactggtgaagaagcatggcctggagatttcacagcctggtttagaacccaataaagggttgacatggcaaatgacaaaaagaagaggagataaagaagttcacaaagtgacggaggagaaaccgggatggtgttccgacccccatttacctccttgtgcagcgtttgttgagattatggctccagtattctcgcgagaagcatggcgttgtgtgtggcatatgattcagaatgacttggtccatggatggggacttgattttgccgttagaagatgtgttgagcctgcacatgagaagattggagttgtcgatgctcaatggattgttcaccaaggtgttcccacactaggaaatcagggtaaaacagaaaccgggaaagcaccatggcagggggtgagggagagatgtaggaaggagtggaccatgtttcagagtcggttagcgaatgcagaacatgcatatttcaagtccggcggtggtattgatatgtctaattccactggtcattag

SEQ ID NO: 8371 - DNA, 1953 bp, Glycine max
ttgatttgaaaattcaaatacaatcactaatcacagccattgctctctctctctctctctcattaatttctgtaaagtaaaggttgaagaagagcaagggaactcaaaaaccaaaaccaaaacaaggagtacaaaacagaggaccatgaccctgcatgatgtttaaactctattaagatcttgcttggttgtgcttttgctataaacccaaaccatagagagagggaagaagattccacccttcatttatttcttcatacacgtgtctctgccgctgaaaaattctttcttttctcgctctataacttcattgtttgttttcgatcaacatcatcaaactcctcgcacttgggctgtttttttctcagcttttcaccagaaaaagcttccatttttgctcagatcttcctcttgctcttcctgttcctgggaggatacttgccaattgataaacagtgaagaatagctcctccatatagttttatgaacatacagttacagaagttccaacataaatgggaatcatcactcgcagttctgctggtagaaaaccaagtgaaattatgaggttttttgtgacaacttttattagtatagttttaggattctttataggagtatcagttccaacattgtcaataacaaagttgaatctcccatctggcctgcttccctccattgatctttcttacatcgaagacagatatacaggtcgccaggcttggtcttttatgaataatggtaacaaaagaagttcatcgcaggttcaattatcaaatgatacatcaaagatttgggttccatcaaatccaagaggtgcagaaagattacctcccggcattgttgaagctgagtcggactattatttgcgtagactgtggggtaagcccagtgaggatctaacgtccaggccaaattaccttgtaaccttcactgttggctatgatcagaaaaataatattgatgcagctgtgaaaaagttttcagggaacttcactattctgctatttcattatgatggccgaactactgaatgggatgagtttgaatggtcaaagcaggctattcatgtgagtgttcacaaacagaccaaatggtggtatgccaagcggtttctgcatcctgacattgtggcaccatatgactatatattcatatgggatgaagacctgggtgttgagcattttaatgcagaagagtacataaaacttgtgaggaagcatggcttggagatttcacagcctggcttggagcctaatagagggttgacatggcaaatgacaaaaagaagaggtgatcaggaagttcacaaagtgacagaggagaaaccaggatggtgttctgaccctcatttgcctccttgtgcagcgtttgttgagattatggctccagtgttctcgcgagatgcatggcgctgtgtgtggcatatgattcagaatgacttggtccatgggtggggtcttgattttgctcttagaaaatgtgttgagcctgcacatgagaagattggagttgttgattctcagtggattgttcaccaaggtattccctcactagggaatcagggtgaatctcaaacagggaaagcgccatggcagggggtgagggagcggtgtagaaaggagtggaccatgttccagagtcggttggcaaatgctgaatacgcgtatcacaactccattggaattgatacatctaattccactgctcattaggtgacttcggcctaagttgacttgtaaacatattgttactacccttagccttacgcgtagaattttcccttaaaaaaaaaaatatattcctatgtaacgttacgtacatgcaatgcaatcacaatatagagtcctagctagggaccaaacatcatttcgatgtagaaattgctgtacttaacagtgagtaaatctagtgaagagaattattattgctgctaacgaaggtgcttatagg

SEQ ID NO: 8372 - DNA, 1995 bp, Glycine max
gaaaatttctttctctgctttgctcgctctataactttcgactttattttcgatcaacatcatcaaactcctcgcatttggggttttttttttcctcagctattcaccagaaaaaaagcttccatttttgctcagatcttcctcttgctcctcccgttcctgttcctgggtttttattactttaatttgacaagcatatctgtttcttatactgaggatacttgccaattgataaacagtgaagaatagctcctccatatagttttatgaacatacagttgcagaagttccaacataaatggtgatcatcactcgcagttctgctggtagaaaaccaagtgaaattatgaagtttttcttgacaacttttattggtatagttttcggattctttataggagtatcaattccaacattgtcaataacaaagttgaatctcccatctggcctgcttccctccattgatctttcttacattgaagacagatatgcaggtcgccaggcttggtcttttatgaataatggtaacaaaagaagttcatcgcaagttcaattatcaagtgatacatcaaagatttgggttccctcaaatccaagaggtgcagaaagattacctcctggcattgttgaagccgagtcagacttttatttgcgtagattgtggggcaagcccagtgaggatctaacgtccaggccaaattaccttgtaaccttcactgttggctatgatcagaaaaataatattgatgcagctgtgaaaaagttttcagggaacttcactatcctgctatttcattatgatggccgaactactgaatgggatgagtttgaatggtcaaagcaggctattcatgtcagtgttcacaaacagaccaaatggtggtatgccaagcggtttctgcatcctgacattgtggcaccatatgactatatattcatatgggatgaagacctgggtgttgagcattttaatgcggaagagtacataaaactggtgaggaagcatgggttggagatttcacagcctggcttagagcctaataaagggttgacatggcaaatgacaaaaagaagaggtgatcaggaagttcacaaagtgacagaggaaaaaccaggatggtgttctgaccctcatttgcctccttgtgcagcgtttgttgagattatggctccagtgttctcaagagatgcatggcgctgtgtgtggcatatgattcagaatgacttggtccacgggtggggtcttgattttgctcttagaagatgtgttgagcctgcccatgagaagattggagttgttgattctcagtggattgttcaccaaggtcttccctcactagggaatcagggtgaatctcaaacagggaaatcacggtggcagggggtgagggagcggtgtagaaaggagtggaccatgttccagagtcggttggcaaatgccgaaaacgcgtattacaagtccatgggaactgatacatctaattccacagctcattagggtgactaaggccaaagttgacttgtacacagatatcattactacccttacgcgtagaattttcccttgaagaaaaatatatattcctatgtaacgttacgtacatgcaatgcaatcacaatagagtcctagctggggaccaaacaatcatttcgatgtagaattttgcagtactgaacagtgagtaaatcaagtgaagagaattattattgctgctaatgaaagtgcttataggaaatggaaatgctagtgtatcctaaaattggaggctgacaacgaagttcattagggtatgtatgtttggaatggagaaaacgaaatgtcataattatcatacccttgggaggaggagaaaggactattactataatagtgttacaatttcttattgttttgttctactagtcagatactggaataaaactttaaaagttgattttatcataaactgtttaaataagtaggattgtctttagtgaacaatatcagtgttatag

SEQ ID NO: 8373 - DNA, 1766 bp, Glycine max
aaagcaaaacaaatctgtattttggctactaaccgaaacctaagatagaagattccataggacaatttgtgtccgctgctaaatctccttcttttcacctttgtttttctcctcgaagaactcagatcactaccaccagcaacttccccgagtgttgtttttcactttctcttctcaaaacccactctctctgccagatcttgcttcctgttgttccagggactgttttcttataacaagtatctttgcttctaataaggagcgtacatgccactggctgactagtgaagaagaacagctcttgtgtatagtttatgagcattcaattagaaaagcttggatattatggggatcagttctcgaagttcttccaacagaaaaccaagtgatagtatgaggcttattgtgacaacttttgttggaatagtttttggcttctttataggagtatcatttccagcattgactacaaagttgaatctcccatccagcctgcttcctgccattgatatttcttacattcaagagaaatatgctggtggcaatgcaccgtcttttgtgaagaataataacagcatctcatcaaagcatcggttaataaacgatacattcaagatatgggttccatcaaatccaagaggtgcagaaagattacctcctgagattattgaagctgagacagacttttatttgcgtagattgtggggtcagcccagtgaggatttaacatcaaagccaaagtaccttgtgactttcactgttggttataatcagagatataatattgatgcaaatgtgaaaaagttctcagagaactttacaatagttctatttcattatgatggccacacaactgaatgggatgagtttgagtggtcaaagcgggcaattcatgtgagtgttcgcaaacagaccaaatggtggtatgccaagcggtttctgcatcctgacattgtggcaccatatgactatatttttatatgggatgaagacctgggtgttgaacattttaatgcagaggaatacttaaaactggtgaagaagcacgggttggagatttcacagcctggtttggaacctaataaaggattgacatggcaaatgacaaagagaagaggtgatcgtgaagttcacaaagaaacagaggagaaaccaggatggtgcgctgacccccatctgcctccttgtgcagcatttgttgagattatggctccagtgttttcacgagatgcatggcgttgtgtctggcatatgattcagaatgatttggtccatggctggggccttgattttgctcttagaaaatgtgttgagcctgcccacgagaaaattggagttgttgattctcagtggattattcatcaaagtgttccctcactagggaatcagggagaatcacaacctgggaaagcgccatggcatggggtgagggagaggtgtaaaagggagtggacaatgttccagagtcggttggcaaatgcagaagacgcatattacagggccgtgggaggggatatgtttaattcgactactccttagtgaggacaaccactgaagttgatttgtacacagccatcaccattattgagttcgattttgcatgatatataattttttttttggtttcaaagtttgtggcactataattgagagtcctagctaaggaccaaacaacagttcaatgggggattccagtgctgatagagaattagataatatataggtaaataaaacttactgtgtaagtagtttatttgattataata

SEQ ID NO: 8374 - DNA, 1490 bp, Glycine max
atgggaatcggttctcgaagttctaccaatagaaaaccaagtgatagtatgaggcttattatgacaacttttgttggaatagtttttggcttctttataggagtatcatttccagcattgactacaaagttgaatctcccatccagcttgcttcccgccattgatatttcttacattcaagagaaatatgcaggtggcaatgcaccgtcttttgtgaagaataataacagcatctcatcaaagcatcaattaataaatgatacattgaagatatgggttccatcaaatccaagaggtgcagaaagattacctcctgagattattgaagctgagacggacttatatttgcgtagattgtggggtcagcccagtgaggatttaacatcaaagccaaagtaccttgtgactttcactgttggttatagtcagagatataatattgatgcaaacgtgaaaaagttctcagagaactttacaatagttctatttcattatgatggcaaaacaactgaatggggtgagtttgagtggtcaaagcgggcaattcatgtgagtgtccgcaaacagaccaaatggtggtatgccaagcggtttctgcatcctgacattgtggcaccatatgactatatttttatatgggatgaagacctgggtgttgaacattttaatgcagaagaatacttaaaactggtgaagaagcatgggttggagatttcacagcctggtttggaacctaataaaggattgacatggcaaatgacaaagagaagaggtgatcgtgaagttcacaaagaaacagaggagaaaccaggatggtgcagtgacccccatctgcctccttgtgcagcatttgttgagattatggctccagtgttttcacgagatgcatggcattgtgtgtggcatatgattcagaatgatttggtccatggctggggccttgattttgctcttagaaaatgtgttgagcctgcccatgagaaaattggagttgttgattctcagtggattattcatcaaagtgttccctcactagggaatcagggagaatcacaatctgggaaagcgccatggcaaggggtgagggagagatgtaaaagggagtggacaatgttccagagtcggttggcaaatgcagaagacgcatattacaaggccgtgggagttgatatgtttaactcgactactccttagtggggacaacgacggaagtttgacttgtacacagccatcaccatagttcgattttgcatgatgtattattttattttattttgttacttaagtttgtgacactagttactttcacttttgagagtcctagctaaggacaaaacaacagttcaatgtgggattccagtgctgatagagaattagataatatataggtaaataaaacttactgtgtaagtagtgtattgattataatattcttttaggaccttgcaggaatatgaatgcaatgccaggtataaacaatttgaatgtga

SEQ ID NO: 8375 - DNA, 1793 bp, Vitis vinifera
atggtagttggaagcatgtcacattccactactgtgaaccttgaagtgttcgccggatcttggtcgtcttcttcgccctttgttcaacgtgattttcctgctgggtatgttttgagttcatttggttgctgggaaaatgcaggaaaagggaaggaggagatcatgaatccttttgaattagcaggtctttctatctatattgcagcttctcttgttttgaagatagagacagaagattgtaaatacaatgagaaatgttggacgcagtttcctcttcttggttgcagtgtaattgttagaaaaccaaatgagactatgaggcttattgtaacaatttctgttggagttgtttttggctttctaataggaatatcttttccaactttgtcaataactaagctgaatctcccatccagccttcttcccaacgttgatatcgcttacattcgggacaaaagttcaggcttttcaacccaagcactgttggatgctttgtcttctgcaaagtacaacagaacacaagctcaaaatttaaatggcacctcaaagatttgggccccttcaaatcctcggggtgcagaaagactaccaccaggcattgttgcagctgagtcagacttctacctccgtagattgtggggtaaacctagtgaggacctgactatcaaaccaaagtatcttgtaacatttactgttggttatgatcagaaaaaaaatgtcgatgcagcagttaaaaagttctctgaggactttaccatccttctatttcattatgatggtcgaacaactgaatgggatgaatttgagtggtcaaagagggccattcatgtgagcgttcggagacaaacaaaatggtggtatgccaaaaggtttctgcatcctgacattgtggcgccatatgactatatatttatctgggatgaagatctaggagttgagcattttaatgcagaagaatatataagactagtgaggaaatatggcttggagatttcacaacctggtttagaacctaataaagggttaacatggcagatgacaaagagaagaggtgatcgtgaagtccacaaagaaacagaggagaaaccgggctggtgccctaacccacatttgcctccctgtgcagcgtttgttgagatcatggctcctgtattttctagagatgcatggcggtgtgtgtggcatatgcttcagaatgacctggtacatggttggggtcttgactttgctctcagaagatgtgtagagcctgcccatgagaaaattggagtcgtagattctcaatggatcgttcatcaaactgttccctcgcttgggaaccaggggcaagcggagaatgggaaggcaccatggcaaggggtgagggagaggtgtaaaaaagagtggaccatgtttcgagttcgcatgaccaatgccgaaaaagcatattacaaggagatgggaattaatcctaccaattccacagctgactaggggatgaccctcacagaagctgacctgtatacaatcataattaccactgttcttagggttttttattttattttattttatttaataatagcaatcattttttagtatcccagaggttactgatgagagtgctttgatcttccatgctgctagaagtgaatgggtacccgggtggcaggtgaaagagaaaaaaggtcaattattcgtttctatcatcgtctattcatttttgttctctctttcacacattgatatgtagacattaaatgggcaagaaagttcctccttcatgggccattatagatgaaatatgaatcaaa

SEQ ID NO: 8376 - DNA, 828 bp, Glycine max
gggagggttttcgcttgagctctgcgagatcttgagtcgccgatttgaaaagatgagtaagcttcagagtgatgctttgcgtgaagccatctcaggaatcatggccgattccaaggagaagaatcgcaaatttgtggagaccatcgaactccaaatcggtttgaagaactacgatccacagaaggacaagcgtttcagtggctccgtcaagttgccccacatccctcgccccaagatgaaaatttgcatgcttggtgatgctcagcatgttgaagaggcagagaagataggactggactggatggatgtagaagccttgaaaaagctaaacaaaaataagaagttggtgaagaagctagctaaaaaataccatgcttttttagcatctgaagcagtcattaagcagattcctcgtcttttgggtcctggtctcaacaaagcaggaaagttccctacacttgttactcaccaggaaactcttgagtcaaaggttaatgagtctaaggccatggttaaatttcaacttaagaaagtgctctgcatgggagtagctgtgggcaatgttagtatggaggaaaagcaaatcttccaaaatgttcaactgagtgttaacttccttgtctctttgttgaaaaagaactggcaaaatgttaggtgcttgtatctgaagagtacaatggggaaatgttaccgtgtcttttgaggaatttctttttttatttcggtgaaattgtgatcgcgcatgatatgttgattaatcttaatagctagatacaaattatcatcttgttacagttttgtgggatggatttttatgttaaagtgttt

SEQ ID NO: 8377 - DNA, 1053 bp, Glycine max
agggttttggctcgaggtattttttctaccccgaacatctgctgttgggttttatccctccattgctttgcactgccgccgataacaattttctgtatcgtgtattttttttttctttgttcacagctctgcgagatcttcattcgccgattttaaaagatgagtaagcttcagagtgatgctttgcgtgaagccatttcaggaatcatggccgattccaaggagaagaatcgcaaatttgtggagaccatcgaactccaaatcgggttgaaaaactacgatccacagaaggacaagcgtttcagtggctctgtcaagctgccccacatccctcgccccaagatgaaaatttgcatgcttggtgatgctcagcatgttgaagaggcggagaagataggactggactggatggatgtggaagccctgaagaagctaaacaaaaataagaagttggtgaagaaactagctaaaaagtaccatgcctttttagcttctgaagcagtcattaagcagattcctcgtcttttgggtcctggtctcaacaaggcaggaaagttccctacacttgttactcaccaggaaactcttgagtcaaaggttaacgagtccaaggccatggttaaatttcaacttaagaaggtgctctgcatgggagtagctgtggggaatgttagtatggaggaaaagcaaatcttccaaaatgttcaactgagtgttaatttccttgtctctttgttgaaaaagaactggcaaaatgtcaggtgcttgtatctgaagagtacaatggggaaatcttaccgtgtcttttgaggaattttttttttaatccggtgaatttgtgatcgcgcttgatacattgattatcttaatagctagatacaaactatcatcttgttacagttttgttggctggatttttatgttagtgtttcgtgttcgtgttcatgttcaaacatttgataatgatatgcgctgtttttggtgctgcttttgtttttactcatgaatgcgtgttctattttggcctcaatttaaagatcctgtacgtagcgt

SEQ ID NO: 8378 - DNA, 925 bp, Glycine max
agctagggtttcagctgtctgctgttagatctgtacccgcctagccattgatttggaaaagtccaacttcaaggatgagtaagcttcagagtgatgctctaagagaagctatctcaggaatcatggctgattccaaggaaaagaacaggaaatttgtggagaccattgaactccaaattgggttgaaaaattatgatccccagaaggacaagcgtttcagtggctctgttaagttgcctcatattcctcgccccaagatgaagatttgtatgcttggagatgcccagcacgttgaggaggctgagaagataggattggactacatggatgttgaggccttgaagaagcttaacaaaaacaaaaagttggtgaaaaaactagccaaaaaatatcatgcctttttagcctctgaagcagtcatcaagcagattcctcgtctcttgggacctggtctcaacaaggcagggaagttccctacacttgtgactcaccaagaatctctcgagtcaaaggttaatgagaccaaggccatggtcaagttccagcttaagaaggttctctgcatgggagtagctgtggggaatgttagcatggaggaaaagcaaatcttccaaaatgtacaactgagtgttaacttccttgtctctttgctgaaaaagaattggcagaacgttcgctgcctatatctgaagagtaccatggggaaatcgtaccgtgtcttttgagtagtggttcttaaaattcagtgaatttctgattgcacttaatatattgtcatgataggttggacagaatttttcatcgttctacagttttgttggatgagtattttttggctagtatttcttgttattgacatttatgtttcaagtgctttgcaacatcggataattttagtggtgctaagtttaagtactcgtgtttt

SEQ ID NO: 8379 - DNA, 886 bp, Glycine max
ggagctagggtttcagtggtgttagatctgtacctgcctagccattgatttggaaaagtccaagcttcaaagatgagtaagcttcagagtgatgctcttagagaagctatctcaggaatcatgactgattccaaggaaaagaacaggaaatttgtggagaccattgaactccaaattgggctgaaaaactatgatccccagaaggacaagcgttttagtggctctgttaagttgcctcacattcctcgccccaagatgaagatttgtatgcttggagatgcccaacacgttgaagaggctgagaagataggattggactacatggatgtcgaggccttgaagaagcttaacaaaaacaagaaattggtgaaaaaactagccaaaaaatatcatgcctttttggcctctgaagcagtcatcaagcagattcctcgtctcttgggacctggtctcaacaaggcagggaagttccctacgcttgtgactcaccaagaatctctcgagtcaaaggttaatgagaccaaggccatggtgaagttccagcttaagaaggtgctttgcatgggagtagccgtggggaatgttagcatggaggaaaagcaaatcttccaaaatgtacaactgagtgttaacttccttgtctctttgttgaaaaagaattggcagaacgttcgctgcctgtatctgaagagtaccatggggaaatcgtaccgtgtcttttgagttgttcttaaattcagtgaatttctgatcgcacctaatatattgtctttcgataggtttgacagaatttttcatcgttctacagttttgttggatgagtattttttgggtagtatttgtttgttatttggcatttatgtttcagtgcttttcgacatcggat

SEQ ID NO: 8380 - DNA, 1026 bp, Medicago truncatula
gcattgctctcatttctttcgtgcggcttcatcctcttcctccctccactctaaggtataagatccaattgctgcaagactctgattcaagatgagtaagcttcagagtgaagctgtgagagaagctattacaggaatcatggctgattccaaggaaaaaaaccgaaaatttgttgagactattgaactccagattggtcttaagaactacgacccacaaaaggataaacgtttcagtggttctgtcaaattgcctcacattcctcgacctaagatgaagatttgcatgcttggagatgctcagcatgttgaggaggctgagaaaataggattggaatcgatggatgttgaagctttgaagaagctaaacaaaaacaagaaactggtgaagaaattggcaaagaagtaccatgcctttttagcttctgaagctgttattaagcagattccccgtcttttgggtcctggtctcaacaaggcaggaaagttccctacacttgtttcccaccaagaatctctcgaggctaaggttaatgagactaaggctatggtcaagttccagcttaagaaagtgctgtgcatgggagtagctgttggcaatgtcagtatggatgagaaacaaatcttccaaaatgtacaactgagtgttaacttcctcgtgtccttgttgaaaaagaattggcaaaatgttaggtgcttgtatctgaaaagttcgatgggcaaatcttaccgtgtcttttaaacggtctttacatccaatgtttttgaaattgagcttaatattttggttactgtaatagctgagacagcaggtttcccttttctacagttttgtttgatgagattttgttgtcagtattgtgttcttgaagattatgtcagaagtgctaattttattccgcatggtttatttcttcagctttttgccctcttctttcatgtatattttttatgcaaagttgctcccatagtctttgtagaataattttattgttatgcatttcatcagatatctcgtctatgtct

SEQ ID NO: 8381 - DNA, 651 bp, Medicago truncatula
atgagtaagcttcagagtgatgctgtgagagaagctattacaggaatcatgggtgattccaaagaaaaaaaccgtaaatttgtggagactattgaactccagattggtttgaaaaactatgatcctcaaaaggataagcgtttcagtggttctgttaaattgcctcacattccgagaccaaagatgaaaatttgcatgcttggtgatgcccaacatgttgaggaggctgagaaaataggattggaatcgatggatgttgaagctttgaagaagctaaacaaaaataagaaactggtgaagaaattagcaaagaagtaccatgcctttttagcttctgaagctgttatcaagcagattcctcgtcttttgggtcctggtctcaacaaggcaggtaagttccctacacttgtttcccaccaagaatctcttgaggccaaggttaatgagactaaggctatggtcaaattccagcttaagaaagtgttgtgcatgggagtagctgttggcaatgtcagtatggatgaaaagcaaatattccaaaatgtacaactcagtgttaacttccttgtgtccttgttgaaaaagaactggcaaaatgttaggtgcttgtatctgaagagctccatgggcaaatcttaccgagtcttttaa

SEQ ID NO: 8382 - DNA, 931 bp, Medicago truncatula
tctgccgctagggttttgtttctctgctcctaccattttgctttgtagcagaagccaccgattcaaccaaaatgagtaagcttcaaagtgaggcagtgagagaagcaatctcaggaatcatggctgattccaaagagaagaatcgcaagtttgttgagaccattgaacttcaaattggtctcaagaactacgacccgcaaaaagataagcgtttcagtggctccgtcaagttgcctcatatccctcgtcctaagatgaagctttgtatgctcggagatgcccaacacgttgaagaggcagagaagataggtttggaatcaatggatgttgaagccttgaagaagctcaacaaaaataagaagttggtgaaaaagctagccaagaagtaccatgctttcttagcttctgaggcagtcattaagcagattcctcgtcttttgggtcctggtctcaacaaggcagggaagttcccaacacttgtctctcaccaagaatctctcgagggaaaggtcaatgagacaaaagctatggtgaaatttcagcttaagaaggtgctctgtatgggagtagctgtgggtaatgttagcatggatgaaaagcaaatctttcaaaatgttcaactcagtgttaacttccttgtctccttgttgaaaaagaactggcagaatgttcggtgcttgtatctgaagagttcaatgggaaaatcttaccgtgtcttttaagggaacttatttcctatcttttttcaatatttaagtcagtcatctccttcaatacatttgtccgaatagcttgatagaaacttcgtcttgttacaattttgctggattatttattgttaaattgttgtttttatgtttgaatatttgataatgttagtcgtgctactttttgtgcttctcatttcctgatgattgttattttttgtgct

SEQ ID NO: 8383 - DNA, 809 bp, Glycine max
ggaattgtacccggataggcggctaagaataataatctgagacgaccaacctcagcctcttaccatgagtaagctacaaagtgatgcactgagagaggcaatttcccaggtggtgagtaattcaaaggagaaaaatcgtaaattcaccgagactattgagctgcaaattggattgaagaactatgatcctcagaaagataagcgtttcagtggttctgttaagcttccgcatattcctcgccctaagatgaaaatctgcatgctcggtgatgctcagcacgttgaagaggcggaaaaaattgggctggactacatggatgtggaagcactgaagaaactcaataaaaacaaaaaacttgtgaagaagcttgccaagaaatatcatgtttttctagcttctgaagcagtcatcaagcaaattcctcgtcttttggggcctggtttaaataaggcaggtaaatttccaacattagtgactcatcaggagtccttggagtcaaaagttaatgaaacaaaggcaatggtgaagtttcaacttaagaaagttctttgtatgggtgttgccgttggaaattgcacaatggaggagaaacagatattccagaatgtacaactcagtgtcaatttccttgtttcattattgaagaaaaactggcaaaacgtgaggtgcttatacctgaagagtactatggggagcgcaatccgcgtattttaaattcatatatatcttccatttaaatataatcatgggcgaagcctcttatgttatggacatgtaagcgaggcattattggtgactgtcgatgcct

SEQ ID NO: 8384 - DNA, 905 bp, Zea mays
gctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggtcctttgcatgggtgtcgccgtcggcaacttggcgatggaggagaagcagatccagcagaacatccagatgagcgtcaacttccttgtttcccttctgaagaagaactggcagaatgtgagatgcctgtacgtcaagagcaccatggggaagccatacagggtgttctaagtatgctcttttgtgaagtctgctaggttctggcaccgaggttttattgaattaaactcttgttaagagtatgtttttggacgatcctatatttcgtcctggcgctactatgtttcagaatggtggtactactataagtatcctggcgctctaagtattgcttgaaaggatcaatataaaaaaaaaaaaaaaaaa

SEQ ID NO: 8385 - DNA, 903 bp, Zea mays
ctctcgctccgttgctcgcctcgggtcaaaccctaagcagggagttgatttatccgctgcagccatgagtaagttgcagtctgattctgtcaaggatgccatctcccagattgttggggatgccaaggagaagaataggaagttcactgagactgtggaacttcagattggtctgaagaattatgatccacagaaggacaagcgtttcagtggctctgttaagttgccctatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggcagaatgtgagatgcctctacgtcaagagcaccatggggaagccatacagggtgttctaagtatgctcttttgtgaagtctgctaggttctggcaccgaggttttattgaattaaactcttgttaaggatatgtttttggacgatcctatatttcgtcctggcgctactatgtttcagaatggtggtactactataagtatcctggcgctctaagtattgcttgaaaggatcaaaaaaaaaaaaaaaa

SEQ ID NO: 8386 - DNA, 1771 bp, Glycine max; identical to SEQ ID NO: 8330

SEQ ID NO: 8387 - DNA, 1701 bp, Glycine max
atgaagatagtgagttacaacgtgaacggtctgaggcagcgcatagcgcagttcgggtctctccggaatctgctaaattcattcgacgccgacatcgtttgttttcaggagacggaactgcggaggcaggaagtcacagcggatttggtcatggccggcggatacgaatcgttcttttcctgcacccgcacctcccagaagggtcgaactggctattccggtgttattacattttgtcgtgtgaagtctgcatttttgagtaatgaagtggtgttgcagctggcagaaaaggaagggtttactggtcttttgggaaactttcaaactagcaacaataaattgccattcttgatgggagatctttaggaatttacaaaagatgagcttctaagtcttgatagtgaggggcgatgcataatcacagatcacactcactttgttcttttcaatgtgtatgggtcccaagctggaggtgatgacacagaaaggattcagtttaagcaaattttttacaggatattacagaaaagatgggggtccctcttgcatcaaggaaggagaatatttgttgttgttgatctcaatattgcgccatttgcaattgatcgatgtgatataggacctgattttgaaaaaaacgagtgagtttaatggttcaaatcaatgttaattgaaaattggggccaattttctgatgtcttcagagcaaaacatcctgatagaagggaagcctacaccagttggtcacaaaatacaggtgctgaagtatttaacttcggaagtagaattgatcatattctgttttctggttcatgctaacatgaattggacctgcaatgccatagttttataagatgccttgtcaaggaatgtgatattctgacacagtataaacggtgtaaaccagaaagcacactgaggtggaagggagggcgtagcgttaaactggaaggatctgatcatgctccagtttttatgtctttacatgaaattcctgatgtctctctgcacagtactcctcccttatctgctagatatgttcccatggttcatggcatacagcaaactctagctacaaaacatttgtcagtgttgatgaaaagacaagtttctaaaaaaatgaaatcatttgagatggcacaagaagacattgcaatggatagtacttgtgagagaaaagaaccagtgaacagagctgaaaaagctaaaagtagtcaatggtcccagctctcacttcggtcatttttccagaaaagtgcaaatcttgacaatggtagttctgtaaaagtagtcaatgactcatgtactgattactcaaataatcaggcagaaccctctcaaccaagccctcgtttacaggaaactccaacagtatttgctcatagtagcagtcccaagaaatatgggttggatactgatacatgtgatcaggatttagctggaccaaatggtagttccacaaaagaagaaatgagtaatgtggcttcactagagtggcaacgaatacaacagttgatgcagaacagtatacctatttgcaagggctataaggaaccttgtattgctcgggtggtgaagaaacaaggacctaattttggccgcagattctatgtttgtgcccacgctgagggccctgcatctaatcttgaagcaaactgcggttactttaaatgggcttcttcaaagtccaagaataaataa

SEQ ID NO: 8388 - DNA, 2395 bp, Glycine max
aagggaacgggaataattacaactacaagctaatgctatgacaagaacacgttgaaggagacgaggagaggagggttcttccaagttgcaaggagcgaagaatagaatgaagatagtgagttacaacgtgaacggtctgagacagcgcatagcgcagttcgggtctctccggaacctgctaaattcattcgacgccgacatcatttgttttcaggagacgaaactgcggaggcaggaagtcacagcggatttggtcatggctgacggatacgaatcgttcttttcatgcacccgcacctcccagaagggccgaaccggctattccggtgtcattacattttgtcgtgtaaagtctgcattttcgagtaatgaagtggtgttgccgctggcagcagaggaagggtttactggtcttttgggaaactctcaaactagcaacgacaaattgccattcttgatggaagatcttgaggaattttcaaaagatgagcttctaagtcttgatagtgaggggcgctgcataatcacagatcacactcactttgttcttttcaatttgtatgggccccgagctggaggtgatgacacagaaaggattcagtttaaacaaaaattttacaggatattacagaaaagatgggagtctctcctgcatcaaggaaggagaatatttgttgttggtgatctcaatattgcaccatttgcaattgatcgatgtgatgccggacctgattttgaaaataacgagtttagaaaatggttcaaatcaatgttaattgaaaatgggggtcgattttctgatgtcttcagagcaaaacatcctgatagaagggaagcatacacctgttggtcacaaaatacaggtgctgaagtatttaactttgggagtagaattgaccatattctatttgctggttcatgcttacatgaattggatgacctgcaatgccatagttttataagatgccatgtcaaggaatgtgatattctgacacagtataaacggtgtaagccagaaagcacactgaggtggaagggagggcatagcgttaaactggaaggatctgatcatgctccagttttaatgtctttacatgaaattcctgatgtctctctgcacagtactccttccttatctgctagatatgttcccatggttcacggcatacagcaaactctagtgtcagtgttgatgaaaagacaagtttctgaactaatgaaatcatgtgagatggcacaagaagacattgcaatggatggtacttgtgagagagaagaaccagtgaacagagctggttcatccacaagaagtccaaatgaatgtcattttcctccaagccaggattttgaagttagtagcattttgaaaccaaacaaactttctggaggttcttctcaggagtctgtttctaaatcaggaagtgaaaataaaaaatcaacaaccaggcaatgtaacagatccaacaaaaaagctagaaatggtcaatggtcccagctctcacttcggtcattttttcagaaaagtacaaatcttgacaaaggtagttccataaaagaagtagtcaatgactcatgtactgattactcaaataataatcaggcagaaccctctcaaccaagccctcgtttacaggaaattccaacagtatgtgctcataatggcagtcccaagcaatatgagttggatactgatacatgtgatccggatttagctggaccaaatggtagttccacaaaagaagaaaaaagtaatgtggcttcactagagtggcaacgaataaaacagttgatgcagaacagtatacctatttgcaagggccataaggaaccttgtattgctcgggtggtgaagaaacaaggacctaattttggccgcagattctatgtttgtgcccgtgctgagggccctgcatctaatccggaagcaaactgcggttacttcaaatgggcttcttcaaagtctaggaataaataatgggagagaatgacattttaatcaaagaatgattaatttgccctcctcatccaagtttctttcataatgacaatatggagctgaaataccagttttgaatggttattagcattactaacttccccaaaggagctggcctctcatagtctttacccacccttttgacaaatatccttgtagcttcctgctacaattatgaatttttttgtttggcacattcagttgttgccatcatatatgtaaaagaggagtgctagcaacacacaattttttattggtcaacgtttattaaaaattataaaatggtgagtgaggtttattaaataagtggaaccctcataattttatgattttcaacaaattttgacagtaaaaagtgtgttaaaaggtgtgctaacatttctctatgtaaaatagtag

SEQ ID NO: 8389 - DNA, 1892 bp, Medicago truncatula
gtttatcttgggacggagagtggccggagtactgagtgaatgattcgaaaatgaagatagtgagttacaacgtgaacgggttgagacaacgcataactcagttcggttctcttcggaatcttcttaattcattcgacgctgacattctttgctttcaggagacaaaacttagtaggcaagatgttacagcggatttggttatggttgatggatacgaatctttcttttcttgtaccagaacttcccaaaaaggccgaaccggttattctggtgttattacattttgtcgtgtaaggtctgctttttccagtaacgaagcagcattgcctttggcagctgaggaaggattcactggcctattgtgtagctctcaaactagtgaaggcaagttgccattctttatggaagaagatcttgaggatttttcaaaagatgagcttctcaatgttgatagtgaagggcgatgtgttgtcactgatcatggtcattttgttcttttcaatatttatgggcctcgagctggaggcgatgacacagagaggattcagtttaaaaaaactttttacaggatactgcagaaaagattggagtctctactgcatcaaggaaggagaatatttgttgtaggtgatcttaatattgcgccatttgcagttgatcggtgtgatgcaggacctgattttgaaaaaaatgagtttagaagatggttcagatcaatgttaatcgaaaatggaggtcgcttttctgatgttttccgagccaagcatcctgataaaatggatgcatacacatgttggtcgcaaagttcaggtgctgaagtgtttaactatgggagtagaattgaccatattctatgtgctggttcatgcttacataaatcagatgacctgcaatcccatagttttataggatgccatgttaaggaatgtgaaattctgactcagtacaaacggttcaaacctgaaagcacactgagttcccacaggtggaagggaggacaaagcattaaacttgaaggatccgatcatgctccagtttgtgcgactttaatgggaattcctgaggtctctctgcatagtactccctccttatcttctagatatgttcccatggttcatggcgtacagcaaagtctagtgtcattgttgatgaaaagacgagtttctgaatcgtgcaagatggcaaacggagacattctaacggttagtacttgtgagagaatagaagaaccagtcgacaaaattggttcgtcaacctgtgaatgcgatttgtttccaaaccaggattcagaaggtagcattttgaaaccaaatgaactttcggcgggttcttctcaggagtctgtttctaaatcaggaagtgtatatgaaaaatcaataactcagaaatgcaatgaatccaagaaaaaagctagaaatagtcaatcgtcccaactctccattagatcattttttcagaaaagcacaagtcttgacaatggtgtcaaggactcttgtattagttactctaataatgaggcagaaccctcacaacccaactctcaattacttgaaacttgtacaattattgatcatagtagcaatcctggtcaagatgaaataaatgctgatgtttgtggtcaggatttagctgaaataaataatagttctagaaaggaagaaaagagtaatgtagcttcacaagagtggcaaagaatacaaaaattgatgcagaacagtatacctctttgcaagggacataaggaaccttgtattgctcgagtggtaaagaaacaaggagctaattttggtcgcagattctatacttgtgctcgtgctgagggccctgcatctaatcctgaagcaaactgtggctactttaaatgggctacttcaaagtctaagaataaataa

SEQ ID NO: 8390 - DNA, 1830 bp, Glycine max; identical to SEQ ID NO: 8365

SEQ ID NO: 8391 - DNA, 1630 bp, Pisum sativum; identical to SEQ ID NO: 8363

SEQ ID NO: 8392 - DNA, 1932 bp, Gossypium hirsutum
atgatcggatggcgatgagataacgaatctttctcttcttactcttatgagtagatcccatccaacctcatcgttgacacaaaataattacattccaaagtttttcctttttctttctgaatgttcggcaccgtgaaagtttctgtttcgagcttggcttgatactttacggcgtcgggatcattcaaaatccaaccttgacgttgtttaaattagggtttcatcgaagcgaatggagctttagttttcccttttgtttctgagaaatttgaagtgaatcaggacgtggattagccagcagtatcagatgtgaagctcctgtatcgcgggaaattttgaagctcagttcttttggaataaattagactcaataagaaaatttaccaaaaacaggaaaatggcaactccagttaagcctcctaacggtattcattaccaaggaaaacattactattcgatgtggcaaacgacgttcgaaatcgacaccaaatatgtgccgatcaagcctattggaagaggggcgtatgggatcgtttgctcttctgtgaatcgcgaaaccaatgaaaaagttgccattaaaaagataaacaacgcctttgagaaccgtgttgatgctctcagaactttgcgtgaattgaagcttctcaggcatcttagacatgagaatgtgattgcttcgaaagatgtcatgatgccgactcataggagaagcttcaaggatgtttatctggtttacgaacttatggataccgatttgcatcaaatcattaagtcttctcaagtgcttaccaatgatcactgtcagtatttcctcttccagttgctccgaggcctgaaatatcttcactcagcaaatattcttcacagagatctgaagcctggaaaccttcttatcaatgcaaattgtgaccttaaaatttgtgactttggactggcacgcactagcaatgccaagggtcaattcatgacagagtatgttgtcactcgttggtacagggcccctgagcttctcctctgctgtgacaactatggaacgtctattgatgtttggtctgttggatgcatctttgcggagcttcttggccggaaacccatcttccctggtacagaatgtctcaatcaacttaagctgatcatcaacatccttggcagccagaaggaggaggatcttgaatttatagataaccctaaggcaaggaaatacatcaaatcacttccatattcccttggaagccccttttcccatctttatccgaatgcccatcctttggcaattgatttgttgcaaaagatgcttgtttttgacccttcaaaaaggattagtgtaactgaagcactccaacacccttacatggcaccattgtatgatccgaacagcaacccttcagcccaggtgccactcgatcttgacatagatgaggatttaggggaagagatgatcagagagaagatgtggaaggaaatgcttcattaccatcccgaagctgctacagccaatggcggggtgtgcctctaatcattttccacttcatggttcaggaatcaagccaaacgatgttgtcttaccactgaagagcctggtattgtgtttttttcttggtgatattagatgctatatttatgtcttcgcaactcctgttatgtttctaataatgttggagagacatacgagatatgttgttgtatctagagcttaagctttgtttagtgctggagctttgtactgtagaagctctgtttcctttacaaacctgtgtataaggctactgttgtatgtgtcttaagtcgtttaactccgagagcttgtgtttgtacgtgtaaattactaagcttagacatcgagaactactattatgagcagtgtaatatttatggaaggaaaacctgtttgcttgttggcagttgaatttaaaaaaaaaaaaaaaaaaaaaa

SEQ ID NO: 8393 - DNA, 2210 bp, Glycine max
atgggaagcaactttctctctccaccagctaagcgctccgcacccgacccgtatccgtttcatccaaacggaccttcaaagcgctccaggcaatccaagcctccgcctccgctgtccgtgccgcccggccacgtggccttccgcctcctctgcaacgcctcccgaatcggcggcgtaatcggcaagtccggctccgtcatcaaaactctccagcaatccacgggcgccaagatccgaatcgaggatgcgccacaggagttgccggaccgcatcatcctggtaattgctgacgccgcactcagcggcaagattctgctgagaaacgaagaggtcattgaggtgtcgaaggcgcaggaagcgctgctgaaggtgttcgataggatccttcgaagtggcggcggagaccgaagcgtcgacgttggggacagggtgatgtcttgccggctcgtggcggacgcggcgcaggccggctctgtcatcggcaagggagggaaggtggtggagaggatcaagaaggaaaccgggtgtaaaattagggtattaactgatgatttgccactttgtgcctccgcttccgatgaaatcattgagatagaaggcagagtgtcatccgtaaagaaggcacttgttgcggtctcccaacgtcttcaagattgtcatcctgttgatagaacaaagatgatggggagcaaaccttatgaaatagttcagtatgaagctttagatgcacttcctcgtgcaacttcaactgcagctccacgtgtgactttaactgcagctccgcgtgggactttaactgctgtacaacatgagactgtagatcatcttttgctgaggagctctgcactgtctactttatccagttcctctaacagctatgccaccagaattcattcactgccaacagaagttaatagagtctcatccttggaaccaaaagcacttaagcaggaagtcaccttcagaatactttgttcaaatgatagagttggaggagttattggaaagggaggcaatattgttagagctcttcagagtgagacaggggctacaataagtattggtcctgcagtagctgagtgcgaggatcgattaattactattgctgcttcagagaatcctgagtcaagatattcccctgcacaaaaggctgctgtgcttgttttctccaggtccattgaggttggttttgagaaggggctagactctggattaaataaggggtcaattgttactgtacgtcttgtagtcccatcaagccaagttggttgtttgataggaaaaggtggagtaatagtttcagaaatgcgaaaggcaactggggctaacataagaataattgggactgatcaggtgccaaaatgtgcatcagataatgatcaagtcgtacagatatcaggagagttttcaagtgtgcaagatgcattatataatgcaatgggtagactgcgagataatctttttgtcagcacacagaatagtgctggaacaaggagcctttcttctctacgagttgataccagtccctatgggagacagcaggatgttgttcctcttggaagtcaactgcccccagccacttctcatagtctgagtagacatacttttgctcaaggcattgatcatcttggtctttctagaaatttagatcatccttcttcaccagggttatggactagaaatttagaccgtccttcttcaccagggttatggactagaaatttagatcgtccttcttcaccggggttatggactagaaatttagatcatcgtccttcttcaccagggttatgggcgccaccaacagtggctgggataaattccagaggcattaatgattttagtttgggattgacatctcgaaaaggcggcttagaacttgtgagtggaagtaaatctgctatcgtgactaatacgattgtagaaattgtggttcctgatgatactattgactgtgtatacggggaaaatggtagcaatttggctcgtctaagacagatatcgggtgccaatgttgttgtccatgagcctcgtcccggaacaagtgacaggattattgtcatatccggtacaccagatgaaacccaagcagcgcagagcctcctccaagcatttattcttagtggctcatgacatatctcctttccaattgcccattatttagttttgttcactgtattgtttttctgttttcctttttctctccaccc

SEQ ID NO: 8394 - DNA, 2459 bp, Glycine max
gcgcgcacgaggcccttcttctcggcgcattttagcataagaattcagaattctattacactgtttcttttactcttcctttttggtagcttcacacaattccgaattcccacagagagagagagagagagagagaattatgggaagcaactttctctctccgccagctaagcgctccgcactcgacccgaatccgtttcctccaaacggaccttcaaagcgctccaggcaatccaagcctccgccgccgctctccgtgccgcccggccacgtagccttccgcctcctctgcaacgcctcccgaatcggcggcgttatcggcaagtctggctccgtcatcaaaactctccagcaatccaccggcgccaagatccgaatcgaggacgcgccgcaggagtcgccggaccgagtcatcctggtgattgccgacgccgcactcagctgcaaggttctgctgagaaacgaagaagtcgttgaggtgtcgaaggcgcaggaggcgctgctgaaggtgttcgataggatcctcgaagtggcagcggagatggaaggagtcgacgttggggacagggtaatgtcttgccggctggtggcggactcggcgcaggctggctccgtcatcggcaagggcgggaaggtggtggagaggatcaagaaggaaaccggatgtaaaattagggtattaactgatgatttgccactttgtgcctccgcttccgatgaaatgatcgagatagaaggcagagtgtcatctgtaaagaaggcacttgttgcggtctcccaacggcttcaagattgtccctctgttaatagaataaagatgatgggaaacaaaccttatgaaatagttcagtatgaaactttagatgcacttcctcgtgagattttaactgcagctccacgtgggactttaactgtagtaccacatgagactgtagatcatcttttgcttaggagctctgcactttctactttatccagttcctctaacagctatgccaccagagttcattcactgtcagcagaagttaatagagtctcatccttggaaccaaaagcacttcagcaggaagtctccttcagaatactttgttcaaatgatagagttggaggagttattggaaagggaggcaatattgttagagctcttcagagtgagacaggggctacaataagtattggtcctttggtagctgagtgcgaggatcgattaattactattgctgcttcagagaatcctgagtcaagatattcaccagcacaaaaggctgctgtgcttgttttctccaggtccattgaggttggttttgagaaggagctagactctggattaaataaggggtcaactgttactgtgcgtcttgtagttccatcaagccaagttggttgtttgataggaaaaggtggagtaatagtatcagaaattcgaaaggcaactggggccaacataagaataattgggactgatcaggtgccaaaatgcgcatcagataatgatcaagtcgtacagatatcaggagagttttcaagtgtgcaagatgccttgtataatgctactggtagactgcgagataatctttttgtcagcacacagaatagtgctggaacaaggagcctttcttctctacgagttgataccagtccctatgggatacagcaggattttgttcctcatggaagccaactgcctgcaaccacttctcactgtctgagtagacatacttttgctcagggcattgatcatcttggtctttctagaaatttagatcatccttcgtcaccagggttatggactagaaatttagacctggctgggataaattcaagaagcattaatgattttagtttgggattgacatctcgaaaaggcggcttagaacttgtgagtggaagtaaatctgctatcgtgactaatacgacagtcgaaattgtggttcctgatgatactattgactgtgtatacggggaaaatggtcgcaatttggttcgtctgagacagatatcgggtgccaaggttgttatccatgaacctcgtcccggaacaagtgacaggattattgtcatatccggtacaccagatgaaacccaagcagcgcagagccttctccaagcatttattcttagtggctcatgacatatcccctctctccaatggccccattatttagtttgttcgcttcctttttctctccacctgaaatcatgtaatatccagccttgtattattcccaaacagtcatccgtggttagtggcgtaagtgtagttatttaaaatcaataacttgattcattagtgcataacaaagtatcgttaagcctttcattaaaaaaaaaaagaaaactctcgggttgttgacctggtttccttttaagatctgacctaggtagtatccctactattcaattactgatatagtttagttcggataatttaaatgaactcccgatgactatctcccata

SEQ ID NO: 8395 - DNA, 2301 bp, Medicago truncatula
atgggaagcaactttctatcaccgccagcgaaacgctccatcaccggattacccgacccgaatccatttccaaacggatcttccaagcgcgctaaaccttccaaacctcctcaacaaccactccccatacctgccggacacgtcgcattccgtctcctctgcaattcctcccgcatcggcggcgtcatcggaaaatccggcaccgtaatcaagaatctccagttgaccaccggtgctaagatccgaatcgaggattctcccaatgagtcacctgaccgagttatcatggtcatcggagccagtaatatcgacggaaaagttatggtgagaagccacagcggtgatggtgaggcaattgaggtgtcgaaagcgcaggaagcgttgcttagagtgtttgataggattttggaagttgcggcggagatggaagggattgagcttggagataggacggtgtcatgccggcttgtggcagattcggcgcaggctgggtcggtgatcgggaagggagggaaggttgtggagaagataaaaaaagacaccggatgtaaaatttgggtttgtaaggataatttgccagcttgcatttcatctcctgatgaagtgattgagatagaaggcagtgtgtcatccgtaaaaaaggcacttgttgcagtctctcgcaatcttcaagatcgccatcatgctgatagaacaaagatgacgggacaaaattctcatgaagtgattcatcatgaagctttagttggagttcctcgtgagactttaatgtcagttccacgcgagacttttattggagctccacgtgagactttaactgcagtgccatgcgagacattaacggatttgcatgtggatcatcttttacaaaggcgctctgcactatctattctacctagtagctctaacagctatgccactggagttcattcattgtcagcagaagttaatagagtctcatccctggaaccaaaagcgcatcagcaagaaatcaccttcaaaattatttgttccaatgatagaattggaggtgttattggaaagggcggcaacataattagagctcttcaaagtgagacaggggccactgtaagtgttggtccttcagtagctgaatgtgaggatcgattaattactattaccgcctccgagagtcccgagtcaagatattcaccagcacaaaaggctactgtgcttgttttctccaggtctgttgaggctggtattgagaaagggatagattctggattaaatacggggtcatctgtgactgcacaacttgtagtctcatctaaccaagtcggttgtttgttaggaaaaggcggagtaatagtgtcagaaatgaggaaggcaacaggggctagcataagaatagttggaactgataaggtttctaaatgtgcatcagataatgatcaagttgtacagatttcaggagagttttcaaacgtgcaagatgcattatataatgcaactggtagactgcgagataatctttttggtggcacactgaagagtgctggaacaaggagcctttcctctgtacaatctgataccagtccctatggaagactaagagatgttcctctgggaagccaatcctctttacgagctgataccaatgcatttgtaagactgagagatgttccccttgtaggccaatcctctttacaagctgatacgagtccctatgtaagattgagagatgtttctcttggaggccaatcctctttacaatctgataccagtccctatgggagactgagagatattccacttggaggccaatcctctttacaatctgataccagtccctatgggaaactgagagatattccacttggaggccaatcagctgtgggaatttctcatagtctgagtaggcacactttttctcaaggcattgaccatttttctcttggtagaaattacgaccgtccttcttccccaggcttatggacaccaccgagagttactgggatgaattcaggaagcattaatgaagctagttggggatcaacatctcgaaaaggcggcctagaacttgtcagtggaagtaaatctgctattgtgactaatacaactatagaaattgtggttcctgaggatactctataccttgtgtatggggaaaatggtagcaatctggctcgtctgagacagatttcgggtgctaaggttgttatccatgaacctcgtcctggaacaagcgacaggactatcgtcttatctggttcacctgatgaaacccaagctgcgcagagccttctccaagcatttatccttaatggttcatcatga

SEQ ID NO: 8396 - DNA, 761 bp, Glycine max; identical to SEQ ID NO: 8360

SEQ ID NO: 8397 - DNA, 775 bp, Glycine max; identical to SEQ ID NO: 8359

SEQ ID NO: 8398 - DNA, 743 bp, Medicago truncatula
cacagttttctagcaaataatagtagagaaacatggctctgggaagaggcagtgcattggttctactagtctgcttttttgttcttaactctgagttggctcatgctgctacctacactgttggaggtcctggaggttggacctttaacactgttggatggcctaatggaaaacgctttagggctggtgatacccttgtgttcaactatagtccatcagctcacaatgtggtggcggtgaacaaaggagggtatgatagttgcaagactccaagaggagcaaaagtgtataggtcaggaaaggatcagatcaggcttgctaggggacaaaactacttcatttgcaactttgtgggtcactgcgagtccggaatgaaaattgccatcaatgctgcttaaattttactatattaaagtctaatatacctaataatttagggttcaacttatatatgtgtgtgtttttcaattttcatacctcttgttgtacctgttctttatgtacttcttgaatcatgtagaagttttattatccttaaattaaataagtggataggtgggtgtgaagtgttaagtgttccatgtatgctgctatatgttagtcatcatggatctagtagtaacaaataatttgtgtaatatgatttctgggtctctcaggatgttatgtagcgaaccaattgtttgaagggaactacaattgatttaaatttaccattgttattattcttgtggtggttgaag

SEQ ID NO: 8399 - DNA, 730 bp, Medicago truncatula
ttttttttttttttttttttgaatcaattgtagttcccttcaaacaattggttcgctacataacatcctgagagacccagaaatcatattacacaaattatttgttactactagatccatgatgactaacatatagcagcatacatggaacacttaacacttcacacccacctatccacttatttaatttaaggataataaaacttctacatgattcaagaagtacataaagaacaggtacaacaagaggtatgaaaattgaaaaacacacacatatataagttgaaccctaaattattaggtatattagactttaatatagcaaaatttaagcagcattgatggcaattttcattccggactcgcagtgacccacaaagttgcaaatgaagtagttttgtcccctagcaagcctgatctgatcctttcctgacctatacacttttgctcctcttggagtcttgcaactatcataccctcctttgttcaccgccaccacattgtgagctgatggactatagttgaacacaagggtatcaccagccctaaagcgttttccattaggccatccaacagtgttaaaggtccaacctccaggacctccaacagtgtaggtagcagcatgagccaactcagagttaagaacaaaaaagcagactagtagaaccaatgcactggctcttcccagagccatgtttctctactattatttgctagaaaactgtgaaag

SEQ ID NO: 8400 - DNA, 625 bp, Glycine max
ggactcacctccaaaacatatctccttctttacttagttcaactcaacccaaggagataattaatatggctctgggaagaggcagtgcagtggttctactactttgcttcttggtgcttcagtctgagatggctcgtgctgccacttatagagttggagattctaggggttggacctttaacaccgttacctggccccaaggaaaacgctttagggcaggtgacacacttgcgttcaattatagtcctggggctcacaatgtggtggcggtgagcaaggctgggtatgatagctgcaagacaccaagaggagccaaagtgtatcggtcagggaaggatcagatcagacttgctaggggacaaaactacttcatctgcaattacgttggtcactgcgagtctgggatgaaaattgccatcaacgctgcatgactttcttctctactcatacgcatctattctaacgcaaactgcacccctttagtgggaatcaacttgtctcctttaaataaatggatagatataggacgtgtgtgttatttaagaaaaagggtagctatgtgtgctctcctatgtatgtaacttattatctattgatgattcagaataaatgtcggcagtatatc

SEQ ID NO: 8401 - DNA, 542 bp, Glycine max
ctcaaggagatggctctgggaagaggcagtgcagtggttctactactttgcttcttgctgcttcactctcagatggctcgtgctgccacctacacagttggagattctgggggttggacctttaacactgttgcctggcccaaaggaaagctctttcgggctggtgacacacttgctttcaattatagccctgggactcacaatgtggtggccgtgaacaaggctggatatgatagctgcaagactccaagaggagccaaagtgtataagtcagggacggatcagatcagacttgccaagggacagaactacttcatctgcaattatgttggtcactgcgagtctgggatgaaaattgccatcaacgctgcctgagtttaataatatggttaactacccatacatattgtattgtaatgcaaattgcaccctttagtgggaagttagctcctttaaataatgttaagaaaaaaagtagctatgtgtgctcttctataaatgtcacttatctataaagaataaatgtcggcagtcggtgatcc

SEQ ID NO: 8402 - DNA, 708 bp, Cicer arietinum
agctcattattccaaattcaattacatccatatcccaaaatttccttttacaaatttctagcaattacatccatatggctttgggaagaggcagtgcattggttgttctactagtttgctttttggtgattcactctgagttggctcaggctgccatctacactgttggaggtgctggtggttggacctttaacactattgcctggcctaatgggaaaaactttaaagctggtgatacacttgtattcaactatagtccgggtgcacacaatgtggtggcagtgagcaaagcagggtatggtagctgcaagactccaagaggagccaaagtgtatcggtcaggaaaagatcagataaggcttgctagaggacaaaactatttcatctgcaattatgttggtcactgcgagtctggaatgaaaattgccatcaatgctgtttgatttttattattataataataatattgtgtgcttttatctatgtgctttcatcatacctcttgtacctgttctaatttatacacttcgtgaatcatgtagaagttttcaataaatggaaaggtgggtgtgaattgtggtgtgtaccatttatgttagtaaatgttattcatcatgggtgtagtaagttgtaacaatacttttgtgtaatacggcccaattgttttgagagaacggcatatgacttgaaaaaaaaaaaaaaaaaaaa

SEQ ID NO: 8403 - DNA, 803 bp, Glycine max
ggaacacaaccaaaattcgctacttgttaagggctgcactataccagaatgtctcagggaagaggcagtgcatctttgcctattgtggtcactgtggtttcactactgtgccttttggaacgtgctaacgcagcaacttactccgttggaggacctgggggatggaccttcaacactaatgcttggcccaatggaaaaagattcagagctggtgatatcctaatcttcaactatgactcaacgacccacaatgtggttgctgtggacagaagtggatacaacagctgcaagacaccagggggtgctaaagtgttcagttcagggaaggaccaaatcaaactagcaagagggcagaactacttcatatgtaactaccctggtcactgcgaatctgggatgaaagttgccattaatgcgctgtgatatactagtagtgctcaatacttcttgaaatgaagtaactgttaagttaatggtcaattaactagcattagtaaatgttagtgtgtgatattgtatgtagtcttttttttatatgaagctgttatatatattaattactatagtttgtgaagcaagtgggagtgagctggcttggtagatcaattgttcctgtatttggtatgtgttgtgtggtgggagtatgataatggtccattagtcacgggctcttcttattagacattggatctgcatattttgaaattattcaagtctgagccaattatctgtatctagtgtctcggtgtcacagtgtgtggttgtattactgaatttgttgccttcataagttaaatttctaa

SEQ ID NO: 8404 - DNA, 859 bp, Glycine max
  misc_feature (124)..(125): n is a, c, g, or t
acaatcaatcccattattaaagggataagccttcaaccttgcaacacaacactacaacctaaggtctgcactacgagaatgtctcagggaagaggcagtgcatctttacctattgtggtcactnnggtttcactactgtgccttttggttcttttggaacgtgctgatgcagcaacttacaccgttggaggacctgggggatggaccttcaacactaatgcttggcccaaaggaaaaagattcagagctggtgatatcctaatcttcaattatgattcaacgacccacaatgtggttgctgtggacagaagtggatacaacagctgcaaaacgccagggggtgctaaagtgttcagttcagggaaggaccaaatcaaactagcaagagggcagaactacttcatatgcaactaccctggtcactgcgaatctgggatgaaagttgccattaatgcagtgtgatggtgcttaatacttcttgagttgaagtgaaaattaagttaatggtcaattagctagcattagtaaatgttagtgtgtgctcatgtatgtactttttttatatgaagctgttatatatatttattaatcactatagttttgtgaagcaaagtgggagtgagctggcttggtagatcaattgttcctatgtttggtatgtgttgtgtagtgggagtataaaaatggtccattagtcacgggctcttcttattagacattggatctacatattttgaagttattgaaagtctcagagccaattatctgtatctgtgtgtcggtgtcacagtgtatggttctattactgattttgtttgcttcaataaattaaatttcctacattgctccacttactaaa

SEQ ID NO: 8405 - DNA, 1833 bp, Medicago truncatula
atggaaaaccaaccatcaccacttccaccaaaaacatacaaactaacagcaacttcaatctcttactccaaaaacctacaaacaaacaacaccatcattgcaccatttctcttcttcaaacattgtacaccaacccccccaaactacatcctcaaagatgtttccctcacagcatacccttctgagattcttgccattgttggtccaagtggtgcaggaaaatcaactcttctagacattctttcagctagaagattacccttaagtggtacactttctcttaactcttcacctatcactaacccttctacattcagaaaactctctgcttatgttcctcaacatgatgcatgtcttcctatgttaactgtttctgaaacttttgctttttctgcttctcttcttaagcctaaaaccattgatattgctgctattgtttcttctcttttaaacgagcttagactcactcatttggctaatacaaggcttaatcatggtttatctggtggtgaacgtagaagggtctctattggacttagtcttcttcatgatcctgctgttttgctacttgatgaacctacttctggtcttgatagttcctctgctttcaaagtcatgcaaactcttaaatcaacttgtgtttcatataacagaactattgttctttccattcaccaaccaagtttcaagattctctcttgtattgatagaatcttacttctttcaaaaggaactgttgttcatcatggaagcttagcttcacttcaatcattcttgctttcaaaagggttcactgttccacatcagcttaatgcattggaatatgcaatggaaatattaaaccaattgaatgagattgaaccaatgattacacccccaagtttacctgagtcaccagagaattctgaatcttcaatagcttgtacttctgcatctgacaatattggaagaactaaaggtaaaagcagagagatcagatacaagagttcaaggattcatgaaatttgtacactttttagaagattttggaagatcatataccgaacaaaacaactactgttgacaaacacagcagaagcattacttgttggtcttgttttaggaacaatttacataaacattgggtttgataaagaagggattgagaaaaggtttggtctttttgcattcactctaacattcctcttatcttccacaactgaaacacttccaatctttatcaatgagagaccaatcttgttaagagaaacatcaagtggtgtttataggctatcatcttatcttatagcaaatacacttgttttcttgccatatttgctagtagttgctgttatctactctattccagtttactttttagtgggtctttgtagttcttggctatcttttgcttactttgttttggttatttgggtcatagttcttatggcaaactcatttgttctgttcttgagttctttagcaccaaactacattgctggaacttcactcatgacagtgctacttgcagcattttttctgttctctggatactttatatctaaggattgtttacctaagtattggctcttcatgcacttcttttctatgtacaaatatgctcttgatgcacttcttatcaatgagtattcttgcttagctacaaggtgcatgatatggtttcaagagaatgatcaagaatgcatgatcactggtggtgacgtgttgcagaagagagggctccatgagggacagagatggaccaatgtgtactttttgattgggttctttgttttttaccgtgtgctttgtttcttggttttacttagaagggtttcaagatccaaaacttga

SEQ ID NO: 8406 - DNA, 2007 bp, Glycine max
atcaccaccacttctcaaactcactccaacactaattctcccatccatggaagacccctcagaatccccaccaccccttaaaacctacaaactaacagccacatcaatctcctacaccaaatccaccaccaccaaaccctcattctcttcacttttcttcaccgcatgcaccaacaccccaccaacctacatcctcaaagacatctccctgaccgccctcccctcccaaatcctggccgtggtgggccccagcggcgccggaaaatccaccctcctcgacatcctcgccgcccgcaccctcccctcccacggcaccctcctcctcaactccgcccctctcgtcccctccaccttccgcaagctctcctcctatgtcccccaacacgaccactgcctccccctcctcaccgtctccgaaaccttcctcttcgccgcaaagctcctcaaacccaaaacctccaacctcgccgccaccgtctcctccctcctctccgaactccgactcacgcacctttccaacactcgcctcgcgcatggcctctccggcggagaacgcagaagggtctccattggcctcagcctcctccacgatcccgcggtgctactcctcgacgaacccacttcggggctcgacagcacttcagccttcaaagtaatgcgaattctaaagcaaacgtgcaccactcgcaacagaaccatcattctctccattcaccaacccagcttcaagatcctcgcttgcattgataggatcttgctgctctccaaaggaaccgtggttcatcatggtagcgttgccaccttgcacgcgttcttgcactccagtggcttcactgttcctcaccaactcaacgcgctggaatatgctatggagattttgagccagttgaatgaggtgaagcctgttactcccccgagtattcctgaatcgcctcaaagttcaatttcaacgagttccgtttctgagggtggagctaggagtagtagagagatcatcaggtatagaagctctagggttcatgagattttcactctttatagcaggttttggaagattatctacagaactagacaacttcttttgcccaacacagctgaagcacttctcgtggggcttgtgttgggaactatttatatcaatatagggtttgataaagaagggattgagaaaaggtttggtctctttgccttcctctccgtttttctcttatcctccacaactgaaacccttcctattttcatcaacgagagacttatcttgttgagagaaacttcgagtggggtttagaggctttcgtcttatctcattgcaaacacgcttgttttcttgccctacttgttcgttattgctgttatatattctattccagtttatttcttggtgggtctttgtgcttcgtggctttcttttgcttactttgttttggtcatttgggtcattgttctcatggcaaactcgttcgctctcttcttgagctctcttgcaccgaactacattgctgggacttcgctcctaacggtgcttctcgcagcgttttttctcttctctgggtattttatctccaaggaaagcttgcccaagtactggctcttcatgcatttcttctctatgtataaatacgctcttgatgcccttctcatcaacgagtactcgtgtttggtgtcacggtgtttgatatggtaccaagagaatgaacagtgcatggtgactggtggtgacgtgttgcagaagagagggctcaaggagagtgaaaggtggaccaacgtgtacttcttgctcgggttctttctgctgtatcgtgtgctttgcttcttggttttggctagaagggtttcaagatcgaaaacttaatagacaccgagaaattatatatggtgataaaacgctgataactttaagcgttgtagtattttagctttcatatattttttttctatcatcctattgcatgtatgaactcgttttgttttatttgatttctatataaagtatataatgtgaaatac

SEQ ID NO: 8407 - DNA, 1929 bp, Glycine max
  misc_feature (244)..(257): n is a, c, g, or t
atggaagacccctcagattccccaccaccaccaccaccaccaccaccacaaacacccctaaaaacctacaaactaagcgccacctcaatctcctacaccaaatccaccaccaaaccctcatttacttctctcttcttcaccccatgcaccaccaccccaccaacctacatcctcaaagacatctccctcaccgccctcccctcccaaatcctggccgtggtgggccccatcggcgccggaaaannnnnnnnnnnnnncggcactctcctcctcaactccgctcctctcgtcccctccaccttccgcaaactctcctcctacgtcccccaacacgaccactgcctccctctcctcaccgtctccgaaaccttcctcttcgccgcaaagctcctaaaacccaaaacctcaaacctcgccgccatcgtctcctccctcctctccgaactccgactcacgcacctatccaacacgcgcctcgcgcgtggcctctccggcggagaacgcagaagggtctccattggcctctgtctcctccacgatcccgctgtattactcctcgacgaacctacttcggggctcgacagtacttcggccttcaaagtcatgcgaattctaaagcaaacgtgcgtctctcgcaacagaaccattattctctccatccaccaacccagcttcaagattctcgcttgcattgataggatcttgttgctctcaaaaggacaagttgttcatcatggaagtgttgccacgttgcaagcgttcttgcactccaatggcttcactgtccctcatcaactcaacgcgttggaatatgctatggagattttgagccagttgaatgaggctaagcctgttactccaccgagtattcctgaatcgcctgagagatcaagttcagtgatttcggtttctgatggtggagttaggagtagtagagagatcataaggtataaaagctctagggttcatgaaattttcactctctatagcaggttttggaagattatctacagaactagacaacttcttttgaccaacaccgcagaagcacttctcgtgggtcttgtgttgggaactatttatatcaatatagggtttgataaggaagggattgagaaaaggtttggtctttttgccttcactctcacgtttctattgtcctccacaacggaaacccttcctattttcatcaacgagagaccgatcttgctgagagaaacttcgagtggggtttataggctctcgtcttatctcattgcaaacacgcttgttttcttgccctacttgttcgttgttgctgttatatactctatccccgtttattttttagtgggtctctgtgcttcgtggctttcttttgcttactttgttttggtcatttgggtcattgttctgatggcaaactcgttcgttctcttcttgagctctcttgctccgaactacattgctggaacttcgcttctaacggtgcttctcgcagcgttttttctcttctctgggtattttatctccaaggaaagcttgccaaagtactggctcttcatgcattttttctctatgtataaatacgctcttgatgctcttctcatcaacgagtactcgtgcttggtgacaaagtgtttgatatggtaccaagagaatgaacagtgcatggtgactggtggtgacgtgttgcagaaaaaaggactcaaagagagtgaaaggtggaccaacgtgtacttcttgctcgggttctttgtgctgtatcgtgtgctttgcttcttggttttggttagaagggtttcgagatccaaaacttaatagacaccgagaaagaaatggtgatcaaacgctgataactttaagcgttgtagtgttttttttttttttatcatcctattgtattatgaactcgtttaatttgttttatttgatttctatataaagtat

SEQ ID NO: 8408 - DNA, 2041 bp, Vitis vinifera
gtcaccaacatatccctcaacacctctctctctgaaccaaaacctctcttcctccacccatctccaccacctcctccatggaagaccactcttcattaccacccccaccacacaaaacttatagaataacagcctcttcaatctcttacaccaaaccaaccaccaataactacaccattgtccccaccttcctcttccaaccctgcactacaactccaccaacctacattctccgggacatctgcctgactgcttatccatctcaagttctcgctattgttggcccaagtggagcagggaagtccacccttctcgacattttagctgctcgaacctcgcctacaagtggctctctccttctcaattcttcccctctcaaccgttcttcattcaggaagctctcagcttatgtacctcaacatgatgcatgcttaccccagcttactgtttctgaaacttttgccttcgcagccagcctccttgttcccaaatcttccaaaattgccatcatagtagcctctcttctcagtgagctcaggctaactcacctagcacataccaggctcgcccatgggctatctggcggtgagcgtcgacgagtctctataggcctcagccttctccatgaccctgccgtgttgcttcttgatgagccaacatctgggcttgacagcaattcggctttcaatgtgatgcagaccctgcagtcgattgcgcaatcacgccaccgcactgtgatcttgtccattcatcaacctagtttcaagatcctttccaccattgataaagtccttttgctctcaaaaggaactgttatccaccatggaactctttcttcacttgaaacgttcttactctcccatggcttcactgttccttcgcagctcaattcccttgaatacgctatggaaatactgagccaactccatgagcataaaccccttacaccaccatcacttcctccatcaccagaaattcctgaaatttctccttctaatcatagcggatcaatgatcagatataggagctcaagactccatgaagtactcgctttgtacaacaggttttggaagatcgtttacagaaccagacagcttctcctcgtgaacgcattggaagctcttggtgtgggccttgttctaggaaccatttacatcaacattggattcgacaagcaaggaatggagaagcgattaggcctctttgccttcactctcaccttcctcctctcttcaacaaccgaaactctcccaattttcatcaatgaaaggccaattctactcagggaaacttcaagtggggtgtacaggctctcgtcatatctcatcgcaaacacattggttttcttgccatacttgctggccatcgccatcatttactcagtctccgtatacttcttagtgggtctctgtgctacatggcaagcttttgcctactttgttttggtgatatgggtaatagtcctcatggcaaattcatttgttctcttcctgagttcggtagctccaaactacatcgccggaacatcactagtcacaatatttctgggcgctttctttctcttctccggctacttcatctcaaaagacagcatgcccaagtactggctgttcatgcacttcttctccatgtacaaatatgccttggatgccttcctcatcaatgagtactcatgccttgtttcaaggtgtttgttatggtacgaagagaacaagacatgtatggcgactgggcgtgatgtgctgcagaagaaagggctccatgagaggcagagatggaccaacatctacatgttgattggattctttttcttctatcgtgtgctttgctttctggttttgatcaggagggttcgaagatcaaagaattgaagccatggctaaatcatgtgatttctatttactcattgtcttaaagttaaatgtaagtttccattttcattttggtgtcaaaactcaagctcatgtgttgcattctgaagcttcatttggtctatcatataataaattgaaaatagcgtgaataaagctagttttgttca

SEQ ID NO: 8409 - DNA, 1801 bp, Vitis vinifera
cacctcctccatggaagaccactcttcattaccacccccaccacacaaaacttatagaataacagcctcttcaatctcttacaccaaaccaaccaccaataactacaccattgtccccaccttcctcttccaaccctgcactacaactccaccaacctacattctccgggacatctgcctgactgcttatccatctcaagttctcgctattgttggcccaagtggagcagggaagtccacccttctcgacattttagctgctcgaacctcgcctacaagtggctctctccttctcaattcttcccctctcaaccgttcttcattcaggaagctctcagcttatgtacctcaacatgatgcatgcttaccccagcttactgtttctgaaacttttgccttcgcagccagcctccttgttcccaaatcttccaaaattgccatcatagtagcctctcttctcagtgagctcaggctaactcacctagcacataccaggctcgcccatgggctatctggcggtgagcgtcgacgagtctctataggcctcagccttctccatgaccctgccgtgttgcttcttgatgagccaacatctgggcttgacagcaattcggctttcaatgtgatgcagaccctgcagtcgattgcgcaatcacgccaccgcactgtgatcttgtccattcatcaacctagtttcaagatcctttccaccattgataaagtccttttgctctcaaaaggaactgttatccaccatggaactctttcttcacttgaaacgttcttactctcccatggcttcactgttccttcgcagctcaattcccttgaatacgctatggaaatactgagccaactccatgagcataaaccccttacaccaccatcacttcctccatcaccagaaattcctgaaatttctccttctaatcatagcggatcaatgatcagatataggagctcaagactccatgaagtactcgctttgtacaacaggttttggaagatcgtttacagaaccagacagcttctcctcgtgaacgcattggaagctcttggtgtgggccttgttctaggaaccatttacatcaacattggattcgacaagcaaggaatggagaagcgattaggcctctttgccttcactctcaccttcctcctctcttcaacaaccgaaactctcccaattttcatcaatgaaaggccaattctactcagggaaacttcaagtggggtgtacaggctctcgtcatatctcatcgcaaacacattggttttcttgccatacttgctggccatcgccatcatttactcagtctccgtatacttcttagtgggtctctgtgctacatggcaagcttttgcctactttgttttggtgatatgggtaatagtcctcatggcaaattcatttgttctcttcctgagttcggtagctccaaactacatcgccggaacatcactagtcacaatatttctgggcgctttctttctcttctccggctacttcatctcaaaagacagcatgcccaagtactggctgttcatgcacttcttctccatgtacaaatatgccttggatgccttcctcatcaatgagtactcatgccttgtttcaaggtgtttgttatggtacgaagagaacaagacatgtatggcgactgggcgtgatgtgctgcagaagaaagggctccatgagaggcagagatggaccaacatctacatgttgattggattctttttcttctatcgtgtgctttgctttctggttttgatcaggagggttcgaagatcaaagaat

SEQ ID NO: 8410 - DNA, 1515 bp, Medicago truncatula
atggctccttcttctgatcatatcaatcatctttctcatccatgtatatatggggattatgtgtcttcacacccagagagaaagtctggtttcatgaaatggctcagtaagcttttcaaaggtgggtccaatagaggaaggagtggtcgtcatcattatgattctgcagaggaaggcatgtcttggcgtgctccatctagagctttggatgatcgtgctagagctcagaaggagaaagaggatttgggccatgcaatgtcactttcttcagctgaagatatgaagagaccaaatgctcatcaaggatataggtggggggaagaaaataatgaagattatggaaaggcacttcatgataactttaactcatctgcacaccctccttatgcacctgcaccattttatcccaatgaatatagaagactatgcggtggctgcaatcaggagataatctatggaaattgtttaggctgcatggatacttattttcatccagactgctttcgatgccactcttgtcgttctcccattaccgagcgcgagttttctttgtcagggaagcatccatatcacaaatcttgttttaaagagttgactcacccaaaatgtgaagtttgcttccaatttattcctataaatgctgctggtttgattgagtatagatgccaccccttttggtcccaaaagtattgtccatctcatgaatatgataacacagctcgctgctgtagttgtgaaagattagagccacggaatacgaaatactatagactcgaggacgggcgaagcttgtgcttagagtgcatggaatctgctataatggatactggtgactgtcagcctctataccattcaatcagagattattatgaaggaatgcatatgagaattgatcagcaagttcctatgcttcttgttgaaagagaagcgctaaatgatgctattgttggagagaagactggatttcatcatttgccagaaacaaggggtttatgcctttcagaagagcaaactgtaaccagtatacatagaaggccaagaattggaggccatagacttattgggatgagaactcaacctcaaaagctgataagaaaatgtgaagttacagcaattcttgttctatatggtctaccaaggttactaacgggtgctatactagcccatgagttgatgcatgcatggttacgccttaaaggttatcgcaatctcagtcctgaagtagaggaaggcatatgtcaggttctgtcatatatgtggcttgagtcagaagttatgccaacaacaaactcacattgcatggcatcaacatccacagctgttgcttcttcctcaaagaaaggtgcaaagtctcatgttgaaaacaaattgggtgaattcttcaagaatcaaattgtcaatgattcttctccagcttatggtggtggttttagagctgcaaatgaagctgttaataaatatggtctacgtagtactctcgaacatattcgtttgactggttttttccctgtgtaa

SEQ ID NO: 8411 - DNA, 1551 bp, Glycine max
atggcttcttcttcagatgttaaccatctttcacatccttgcatctatgagagaaagtccggtttcatgaaatggcttagtaagcttttcagaggtgggtccaatagaggaaggggctgtcgtcacctgcatgagccagcagaggaaagcatagttcggggtgctccatctagagctttggatgatcgtggtagagctcagaaggagaaagaggatttaggccatgcaatggcactttcttcagccgaagatttaaagagaccaaacggatataattggggagaagacaccggtgatgattactcaaaggcacctcacgatacccttaactcatctgcacaccctccatttgcccctacaccattttatccccatccccacaaatatagagtatgtggtggctgcaaccaagagataatgtatggaaattgtttgggctgcatggatacttattttcacccaaattgttttcgctgtcactcttgtggttaccccattaccgagcgcgagttttccttgtcagggaagcatccatatcacaagtcctgttttaaagagctgactcatcctaaatgtgaagtttgcttccaatttattcctataaatgctgctggtttgattgagtataggtgccaccccttttggtcgcaaaagtattgtccatctcatgagtatgataatacagctcgctgctgtagttgtgaaagattggagcctctgaacataaaatactatagactagaagatggacggagtttgtgtttagagtgcatggaatctgctataatggataccggtgattgccaacccctataccattctatcagagactactatgaaggaatgcagatgagaatagatcaacaagttcccatgcttctagttgagagggaagcactgaatgaagctattgtaggggagaaaaatggttttcatcacttaccggaaacaagaggtttatgcctttcagaagagcagactgtcaccagtatacatagaagaccaagaattggaggccatcgactaatagggatgagaactcaacctcaaaaactgactagaaaatgtgaagtcacagcaattcttgttctatatggtcttcctaggttactcacaggtgcaatacttgcccatgagttgatgcatgcatggctacgccttcatggttatcgcaaccttactcccgaagtagaggaaggcatttgtcaggttctttcgtatatgtggcttgagtcagaagtaatgcctagctttcaaaacatgccatcaacatccacaagtgctggttcttcctactcttcttcctcctcctcctcctcctcgtcgtcctcctcctcctcaaagaagggtgcaaaatctcatgttgaaaataaattgggtgaatttttcaagaatcagattgccaatgattcttccccagcttatggtggtggctttagagctgctaatgaagctgtcaataaatatggtttgcgtagaacacttgaccatattcattggactggttttttcccagtggaaaaagaacgcaagttctctaagtatggatag

SEQ ID NO: 8412 - DNA, 1479 bp, Glycine max
atggctccttcttcagatgttaaccatctttcacatccttgtatctatgaaagaaagtctggtttcatgaaatggcttaataagcttttcagaggtgggcccaatagaggaaggggtggtcgccacctgcatgagccagcagaggaaagcagagtttggggtgctccatctagagcgttggatgatcgtgctagagctcagaaggagaaagaggatctaggccatgcaatggcactttcttcagccgaagatttaaagagaccaaacggatataattggggagaagacactggtgatgattactcgaaggcacctcgtgatacccttaactcatctgcacaccctccctttgcccctacaccattttatccccacgaatatagaatatgtggtggctgcaaccaagagataatgtatggaaattgtttgggctgcatggatacttattttcacccaaattgttttcgctgtcactcttgtggttaccccattacagagcgtgagttttccttgtcagggaagcatccatatcacaagtcatgttttaaagagttgaatcatccaaaatgtgaagtttgcttccaatttattcctataaatgctgctggtttgattgagtataggtgccaccccttttggtcccaaaagtattgtccatctcatgaatatgataatacagctcgctgctgtagttgtgaaagattggagcctttgaacataaaatactatagactagaagatggacggagtttgtgtttagagtgcatggaatctgctataatggataccggtgattgccagcccctttaccattctatcagagattactatgaaggaatgcagatgagaatagatcaacaaattcccatgcttctagttgagagagaagcacttaatgaagctattgtaggggagaaaaatggttttcatcacttaccagaaacaagaggcttatgcctttcagaagagcagactgtcaccagtatacatagaagaccaagaattggaggccatcgactaatcgggatgcgaactcaacctcaaaaactgactagaaaatgtgaagttacagcaattcttgttctatatggtcttcctaggttactcacaggtgctatacttgcccatgagttgatgcatgcatggctacgccttaatggttatcgcaaccttaatcctgaagtagaggaaggcatttgtcaggttctttcgtatatgtggcttgagtcagaagtaatgcctagctttcaaaacatgccatcaacatccacaagtgctgcctcttcctactcctcctcaaagaagggtgcaaagtctcatgttgaaaataaattgggtgaatttttcaagaatcagattgccaatgattcttccccagcttatggtggtggctttagagctgctaatgaagctgttaatagatatggtttgcgtagaacacttgaccatattcattggactggttttttcccagtgtaa

SEQ ID NO: 8413 - DNA, 1488 bp, Glycine max
atggctcctacctcagatatcaatcatctttctcatccttgtatatacgagagaaagtctggttttatgaaatggtttggtaagattttcaacattggatccagtagaggaaggggtggtggtcgtcatctgcagcagcctgttgaggaaaacatggtttggcctgctcctgctagatccttggatgaccgtgctagatctcggaaggaggaagaggatctagatcacgcaattgcactttctttaggcgaaaattttaagagaccaactggatatagatggcgaacaggaactgatgaagattatgcaaaggctcttcaggatcgcaggttctcatctgcacatcctccatatgcccctgtacctttttatccccggggatatggaacatgtggagggtgcaaccaagagatactctatggcaattgtttaggagttggccatagttattttcatccagactgctttcggtgtcactcttgtcgttaccccattactgagcgtgagttttctttgtcagggaagcatccatatcacaagtcctgttttaaggaattgacacaccctaaatgtgaagtttgccatcaatatataccaataaatgctgctggtttgattgaatatagatgccacccctattggaaccaaaagtattgcccatctcatgaatatgataatacagctcggtgctgtagttgtgaaagattagagtcgcggggtgaaagatactatagattggaagatggaaggattttgtgttttgagtgcatggaatctgctataacagacactggtgaatgtcaacccctttatcattccatcagagactattatgaaggaatgaacatgaaaattgatcaacaagtaccaatgcttctcgttgggagagaagcacttaatgaagccattgttggggagaagaatggcttccatcacttaccagaaacaaggggcttatgcctttcagaagagcaaactgtcacaagtgtatatagatggccaagaattggaggccatcgattaataagcatgagatctcaagctcaaaggctgcctagaaaatgtgaagttacagctattcttgttctctatggtcttccaaggttactcacaggtgctatacttgcacatgagttgatgcatgcttggttacgcctcaaaggttaccaaaaccttagtcttgaagtagaggaaggtatttgtcaagttctttcttacatgtggcttgatgcagaagtcatgtcatgtgctagaaccacgccctcaacatcatcatcagcttcttcctcctcttactctaactcatcaaagaaaggtgtgaaatctcttgttgaaaataaattgggtgagtttttcatgaaccagattgccaatgattcttccccagcttatggtggtggattcagagcagccaatcaagctgtgaataaatatggtttacgttgcactttggagcatattcgtttgactggtaatttcccactgtaa

SEQ ID NO: 8414 - DNA, 1593 bp, Glycine max
atggctcctccctcagatatcaatcatctttctcacccttgtatatacgagagaaagtctggttttatgaaatggtttggtaagattttcaacattgggtccagtagaggaaggggtggtggtcgccatctgcagcagcctgtagaggaaaacatggtttggccagctccagctaaatccttggatgattgtgctagatctcggaaggaggaagaggatctagatcatgcaattgcactttctttaggcgaaaattttaagagaccaactggatatagatggcgaacaggaactgatgaagattatgcaaaggctcttcaagatcgcatgttctcatctgcccatccaccatatgcccctgtacctttttatacccggggatatggaacatgtggagggtgcaaccaagagatactctatggcaattgtttaggagttggtcataattattttcatccagactgctttcggtgtcactcttgtcgttaccccattactgagcgtgagttttctttgtcagggaagcatccatatcacaaaacctgttttaaggaattgacacaccctaaatgtgaagtttgccatcaatatataccaataaatgctgctggtttgattgagtatagatgccacccctattggaatcaaaagtattgtccatctcatgaatatgataatacagctcgctgctgtagttgtgaaagattagagtcacgggatgaaagatactatagattggaagatggaaggattttgtgctttgagtgcatggaatctgctataacggacactggtgaatgtcaacccctttatcatgctatcagagactattatgaaggaatgaatatgaaaattgatcaacaagtcccaatgcttctcgttgggagagaagcacttaatgaagccattgttggggagaagaatggcttccatcacttaccagaaacaaggggattatgcctttcagaagagcaaactgtcacaagtgtatatagatggccaaaaattggaggccatcgattaataggcatgagatctcaagctcaacggctgcctagaaagtgtgaagttacagctattcttgttctgtatggtcttccaaggttactcacaggtgctatacttgcacatgagttgatgcatgcttggttacgcctcaaaggttaccaaaaccttagtcctgaagtagaggaaggtatttgtcaggttctttcttacatgtggcttgatgcagaggtcatgtcatgtgctagaaccatgtcatcaacatcagcagcagcttcttcctcctcctactctagttcatcaaagaaaggtgtgaaatctcatgttgaaaataaattgggtgagtttttcatgaaccagattgccaatgattcttccccagcttatggtggtggctttagagcagccaatgaggctgtgaataaatatggtttgcgttgcactctggagcatattcgtttgactggtcatttcccactgtaataaggacacgttctcataggagtttgcaatctagtgtttgatgttggattgcttcaaatataagagacaaggttggacagtttccctcctgttatttcattcccc

SEQ ID NO: 8415 - DNA, 1518 bp, Vitis vinifera
atggcttcttcaggcgtcaaccacctctctcagccttgcatatatgggcagcttgcttcttcttatgcggagcggaagtccaggttcatgaaatggctgagtaagcttttcaagagtggggggtcgggtcgtggagttattggtggacagcatccccagtttctcggagacgaaaacatggtttggcgagtacccccgagatccttggatggtcgtcctagaagtgataaagagaaagaggatttagaccatgcaattgcactttcgctagctgaagatttgaagaggccaaagggatatggatggggttcagacactgatgaagatctttctaggtcactgcatgatagcctgaatacatcctcctatcctccttatgctcctacaccatattatccaagtgggtatagagtatgtggagcatgcaaacaggatatagggtttggaaattatttaggatgcatgggaactttttttcatccagagtgctttcgctgtcgctcttgtggttacccaattactgagcatgagttttctttgtcagggagggatgcataccacaagtcctgtttcaaagagttgactcatcccaaatgtgaagtttgccaccaatttatcccaacaaatggtgctggtttaattgagtacaggtgccaccccttttggtcccagaaatattgcccatcgcatgagcatgataatgtagctcgttgctgtagctgtgaacgcttggagtcttggaatgcgagatacatatccttgggagatggacggagtttatgcttagagtgcatggaatcagctataatggataccggtgattgccattccctttaccatgcaatcagggatttttttgaagggatgaacatgaaactagatcaggaaattcccatgcttctggttgaaagacaagcccttaatgaagctattgtaggagagaagaatggacaccaccacttgccagagacgaggggtttgtgcctctctgaagagcaaactgttaaaagtatccaagtacttagaaggcccagacttgcaggacagcgactagtaggaatgagatcacaacctcaaaagctgactcgaaaatgtgaagttacagctattcttgtactgtatggcctaccaaggttactgacaggagctattcttgctcatgaactgatgcatgggtggctacgccttaaaggcttccgaaatcttagtcctgaggtagaggaaggtatctgtcaggtgctctcatacatgtggctggagtcagaagtaatgcctggatttaatagaaatatggcatccacatcatcaggagcagcttcctcctcctcatcttcttctaaaaagggtggaaaatcagaagtagagaagaagctgggagagtttttcatgcaccagattgcacatgatgtatccccagcatacggagaaggattcagggcggccaatgctgcagtgaataagtttggtttgcgcatcactcttgaccacattcgcttaacaggaagcttccctctgtaa

SEQ ID NO: 8416 - DNA, 2007 bp, Glycine max; identical to SEQ ID NO: 8406

SEQ ID NO: 8417 - DNA, 1833 bp, Medicago truncatula; identical to SEQ ID NO: 8405

SEQ ID NO: 8418 - DNA, 1325 bp, Glycine max
aaaatttcttcacatttacaatgaagctatccactctattcctattcctattccacctggctcatgctgctctgtctgacgaagctactttcattagagatggcctcaaatcctattcccagcttgatctccctcactcggtttttggttctgaaagtgtagccttcgattgccatggtaaaggaccatatgttggcgtgtctgatggtagaatcctcaagtggcacgagacaaagagagagtggattgactttgcagttacctcgccacacaggaacaagaaattatgtgatgggttaacaaatgacaagatggaatcaatgtgtggaagacccttgggcctcaaattcaacactttaacttgtgaactgtacattgccgatgcatactttgggcttctggtggtaggaccaggtggtggtgtggcaaagcagttagccacttctgcggaaggggtaccatttaggttcacaaatgccttggacatcgacaccaaaacaggtgaagtatatttcacagatagcagcatcatgttccaaagaagggtatacatatcaataattctgagcggggatagaactggaaggttactaaaatacgttccaagtacccaaagtgtacatgttttggtcaaaggtttagcattccctaacggcgtggcgcttagcaaggacaattccttcattatagtagcagaatcaaccacttttaaaattctcaagattcaagttagagactccaagaccaacaacaacaatatagaaccttttgcacaggttccacgctccccagataacataaagaggaacgccaaaggagaattttgggtagcgctgaacagtggcaggggattgattcagaaattggaaaatgaaatcgaaaccacacttccttggaatgcagatcctgtggcaattaaatttgatgaaaaggggagggccattgaggtattagatggagaatatggacgacaactggactctgttagtgaagtggaagaacatgaaggaagtttgtggataggctctgcggtgcaaccatacattggtcttataaaagcttagttaggcctttgtgtgtgtgaaaaaattatcaagtggtcctaaccattctttatatgacacataattaagtagtatttgtttttctcataagttagaaagaaaacttaaggatgtgtcacataaaaattagtaaagactataaataaatggtggtttaaaactacctaataacttctcgtgtgttttgcttccaattctaaattattcaaattccaaaacaaaatgtatttggataaaataatgttggattagttttcattt

SEQ ID NO: 8419 - DNA, 1444 bp, Glycine max
ttcatgtccatttaatttttcatgtgaagtatatccctagggaaaaataatttcttcacatttacaatgaagcaatccactctattcctgttcctattcctattccccctcgttcatgctctttcttacgaagctgcttatattagagatggcctcaaatcctattcccagcttgatctccctcactccgtttttggttctgaaagtgtagccttcgattgccatgggaaaggaccatatgttggagtgtctgatggtagaattctcaagtggcaagagacaaagagagagtggattgactttgcagttacctcgccacacaggaacaagaaattatgcgacgggttacaaaatgacaagatggaatcaatgtgtggaagacccttaggcctcaaattcaacactgtaacttgtgaactgtacattgccgatgcatactttgggcttctggtggtaggaccaagtggtggtgtggcaaagcaattagccacttctgctgaaggggtcccatttaggttcacaaatgccttggacatcgacaccaaaactggtgaagtatatttcacagatagcagcatcttgttccaaagaagggtatacatatcaataattctgagcggggatagaactggaaggttactaaaatacgttccaagtacccaaagtgtacatgttttggtcaaaggtttagcgttccctaacggtgtggcacttagcaaggacaattccttcattctagtagcagaatcaaccacttttaaaattctcaagattcaacttagagactccaagaccaacaacaacaacaatatagagccttttgctcaggttccacgctccccagataacataaagaggaacaacaaaggagaattttgggtggcacagaacagtggcaggggattgattcagaaattgggaaatgaaattgaaaccacacttccttggaatgcagatcctgtggcaattaaatttgatgaaaaggggagggccattgtggtattagatggagaatatggaagacaattggactctgttagtgaagtggaagaacatgaaggaagtttgtggataggctctgctgtgcaaccattcattggtcttataaaagcttaggcctttatttacgtgtttgtggaaaaattattaagtggtcctcaatcactaccttattcatggtgttagcagatttttatatgacacataattaagtatgtgtcacgtaaaaattagttaagactatagataagtaatgatttaaaattacctaataatttttcgtgtttgtgtgttttattttcaggtcaaattttaaaatccaaattccaaaataaaatgtattttggataaaataaggttgggttagttttctttatctgatgttaaaagacttttcttctgattttaagaataataaaaaatggtattctcattcttaatttta

SEQ ID NO: 8420 - DNA, 1456 bp, Glycine max
tttttttttttttttttcttttttttttttttttaaaaatgaaaataccattttttattattcttaaaatcaaaaaaaaagtcttttaacatcaaataaagaaaactaacccaaccttattttatccaaaatacattttattttggaatttggattttaaaatttgacctgaaaataaaacacacaaacacgaaaaattattaggtaattttaaatcattacttatctatagtcttaactaatttttacgtgacacatacttaattatgtgtcatataaaaatctgctaacaccatgaataaggtagtgattgaggaccacttaataatttttccacaaacacgtaaataaaggcctaagcttttataaaaccaatgaatggttgcacagcaaaacctatccacaaacttccttcatgttcttccacttcactaacagagtccaattgtcttccatattctccatctaataccacaatggccctccccttttcatcaaatttaattgccacaggatctgcattccaaggaagtgtggtttcaatttcatttcccaatttctgcatcaatcccctgccactgttctgtgccacccaaaattctcctttgttgttcctctttatgttatctggggagcgtggaacctgagcaaaaggctctatattgttgttgttgttggtcttggagtctctaagttgaatcttgagaattttaaaagtggttgattctgctactagaatgaaggaattgtccttgctaagtgccacaccgttagggaacgctaaacctttgaccaaaacatgtacactttgggtacttggaacgtattttagtaaccttccagttctatccccgctcagaattattgatatgtatacccttctttggaacaagatgctgctatctgtgaaatatacttcaccagttttggtgtcgatgtccaaggcatttgtgaacctaaatgggaccccttcagcagaagtggctaattgctttgccacaccaccacttggtcctaccaccagaagcccaaagtatgcatcggcaatgtacagttcacaagttacagtgttgaatttgaggcctaagggtcttccacacattgattccatcttgtcattttgtaacccgtcgcataatttcttgttcctgtgtggcgaggtaactgcaaagtcaatccactctctctttgtctcttgccacttgagaattctaccatcagacactccaacatatggtcctttcccatggcaatcgaaggctacactttcagaaccaaaaacggagtgagggagatcaagctgggaataggatttgaggccatctctaatataagcagcttcgtaagaaagagcatgaacgagggggaataggaataggaacaggaatagagtggattgcttcattgtaaatgtgaagaaattatttttccctagggatatacttcacatgaaaaa

SEQ ID NO: 8421 - DNA, 1502 bp, Glycine max
atgttcctgttccagaagggttctcatctccatcgtctccttctgtcaaagaagtactactaccattttccgcttccacgcaatgcggttaccatcgccgattccgtcgaacacccctcagacgccaccatagccaaactagtcctcgaatcagacccacgcaccgtctccgaagccctaaccaagcccacaatccaatggaccccagacctagtaaacaaagtcatgaagcgcctctggaaccacgggcccaaggccctccaattcttcaaacacctagaccgccaccacccttcctacacccactccccctcctccttcgaccacgccgtcgacatcgcggcccgcatgcgcgacttcaactccgcctgggccctcgtgggccgcatgcgctccctccgcctcggcccgtctcccaaaaccctcgccatcctcgccgagcgctacgcctccaacggtaagccccaccgcgccgtccgaactttcctctccatggccgagcacggcatccgccaagatctccactccttcaacaccctcctcgacatcctctgcaaatcgaagcgcgtcgaaaccgcgcacagcctcctcaaaacgctcacatcgaggttcagacccgacaccgttacctataacatacttgcgaacggttattgcttgatcaaacgcacgccgatggcgcttcgggttttgaaggagatggtgcagcgtgggattgagcctacgatggtcacgtataacaccatgctgaaagggtattttaggagtaatcagattaaggaggcttgggagttttatttggagatgaagaagaggaagtgtgagattgatgttgtgacttacaccactgtgattcacgggttcggggtggcgggtgatgttaagaaagcaaaaagggtttttcatgagatggtgaaggagggtgtggttcctaatgttgctacttacaatgctttgattcaggttttgtgtaagaaggatagtgtggagaatgcagtggtggttttcgaggagatggcgagggagggtgtgtgtgtgccgaatgtggttacttacaatgttgttatacgaggtttgtgtcatgttggggacatggagagggcgttggggtttatggagaggatgggggagcatggtttgagggcttgtgttcaaacatataatgttgtgattcggtatttttgtgatgccggggaggttgagaaggctttggaggtgtttgggaagatgggggatgggtcatgcttgcccaatttggacacttataatgttttgattagtgcgatgtttgtcaggaagaaatcggaggatttggtggtggctgggaagttgttgatggacatggttgatagagggttcttgccgcgcaagtttacttttaatagggtgttgaatggacttgttattactggcaatcaggattttgcaaaggagatactgagaatgcagagcaggtgtggccgtattgttcggcgtttgaaattgtgacttgttttattgtt

SEQ ID NO: 8422 - DNA, 1479 bp, Glycine max
atgttcctgttccagaaggcttccgcttctcatgtccagcttctgattgggtcaaagaagtactttcagttccatcttccccgtgacgcagttaacattgccgaggcctcagacgcaaccatagccaaactagtcctggaatcagacccacgcaccctctccgaagccctaaccaagcccagaatccactggaccccagagctagtaaacaaaacccttaagcgcctctggaaccacgggcccaaggccctcctattcttcaaacacctcgaccgccacctcccttcctacacccactccccctcctccttcgaccacgccgtcgacatcgcggcccgcatgcgcgacttcaactccgcctgggccctcgtgggccgcatgcgctccctccgcctcggcccgtctcccaaaaccctcgctatcctcgccgagcgctacgcctccatcggcaagccccaccgcgccgtccgcaccttcctctccatgcacgagcacggcctccaccaagatctccactccttcaacaccctccttgacatcctctgcaaatcgaaccgcgtcgaaaccgctcacgacctcctcagaactctcaaatctaggttcagacccgacaccgttagttacaacattctcgcgaacggttattgcttgaaaaaacgcacgccgatggcgctgcgggttttgaaggagatggtacagcgtgggattgagcctacgatggtcacgtataacaccatgctgaaggggtattttaggagtaatcagattaaggaggcttgggagttttacttggagatgaagaagaggaagtgtgagattgatgttgtgtcttacaccactgtgattcacgggtttggagaggcgggtgaggttaagaaagcaaaaagggtttttgatgagatggtgaaggagggtgtggctcctaatgttgctacttacaatgctttgattcaggttttttgtaagaaggatagtgtgcagaacgcagtggcggtttttgaggagatggtgagggagggggtgtgttcgccgaatgtggttactttcaatgttgttatacgaggtttgtgtcatgttggggacatggagagggcgttggggtttatggagaggatgggggagcatggtttgagggctagtgttcagacttataatgttgtgattcggtatttttgtgatgctggggagattgagaagggtttggaggtgtttgggaagatgggggatgggttgtgtttgccgaatttggatacttataatgttctgattagtgcgatgtttgtgaggaagaaatcggaggatttggtggtggctgggaagttgttgatggagatggttgagagaggcttcttgccacgcaagtttacttttaatagggtgctaaatggacttgttattactggcaatcaggattttgcaaaggatatactcagaatgcagagcaggtgtggccgtgttgttcggcgtttgaaattgtga

SEQ ID NO: 8423 - DNA, 1291 bp, Glycine max
gaaatggggggcaaagcaaattaaacagccctaaagagagagagaggaaacccgcccatcaggccaacacctttcttcctttttcattctcaaattctcaatcaaatcgcatcacatcccattcatgcccaaattccagatctaaccaacactcccaaatgtcccacattcccaccgccggctacggcaccctcgccggcgccactcccactcccactcccaccggaattactccatccaccgccgccacctcctcggtgactccccgtccatggcgcgagtttctagacctatcagccctctcccgcccctactcctacgacgacgccatgatccgagtccgaagaaacctgagctacttccgcttcaactacgccgccgtcacgctcctcatcgtcttcctcagcctcctctggcaccctatctccatgatcgtcttcctcctcgtcctcgtcgcctggtactacttctacttctcccgcgacgtccccctcgtcgttttcaaccaaaccctcgacgacagaaccgtgctctgcgttttgggattgctcactgtcgtttcgctcgtctccactcacgtcggcctcaacgtcctgctctcgttaatcgtctcggtggttctcgttggcttgcacgctgcgtttagggttaccgaggatttgtttcttgacgaggaaagttcgttgctttccgttgtggggactcagcctatcagaacaaattatacccccatttgattatattatattcgcttccgcaaccaccatcgagttcttgacttcccccccttaatttgacaagtttaaattcttaattgagaaggcagagttcaaatttcgaagatgggtcctttgtttcggagaccagtcacttattgaaacagtgttgtaactgtgtctgtggtgaggcattgatcaacattgaattggaatttggaattaggtgtgttatgtcaatttctgtcagagagatacgggaattttctgaggaactggattggttaaagtagtgactcacaatggagttattttgcttgttcatcttgtttttcagttccttgtttagtttctatttgataagtttgagtctcttgctgctcatcctcattttttatcgttgttaatgtatctcactgatggttctgtttttgttggctgctgtgttgcccttggtaattttgatcatttgctcgaccttcaattgaattcattgcgaaatgctgattgtattttacacttgtggttttgtaaatgttcgttttctcattgcatatggcttaagttggtttgcc

SEQ ID NO: 8424 - DNA, 752 bp, Glycine max
ggccctattttgaaataatgaaaaaagtgaaatggggggcaaagcaaattaaacagccctaaagagagagagaaacccggccatcagggcaacaccattccttggtctctgaatctcaaaatctcaatcaaatcgcatcccatccatgtacaaatttcagatctaaccaacactcccaaatgtcccacattcccaccgccggctacggcaccctcgccggcgccactcccactggaaccaccaccaccaccaccaccaccactacctccttggtgactccccgtccatggcgcgagtttctagacctctcagccctctcctgcccctactcctacgacgacgccatgatccgggtccgaagaaacctgagccacttccgcttcaactacgccgccatcacgctcctcatcgtcttcctcagcctcctctggcaccccgtctccatgatcgtcttcctcctcgtcctcgtcgcctggtactacctctacttctctcgcgacggcctcctcgtcgttttcaaccaaaccctcgacgacagaaccgtgctctgcgttttgggtttgctcactgtcgctgcgctcgtctccactcacgtcggcctcaacgtcttgctctcgctgatcgtcgccgtggttcttgttggcttgcacgccgcatttagggttaccgaggatttgtttcttgacgaggaaagttcgttgctttccgttgtgggaactcagcctctcagaacaaattatacccccatttga

SEQ ID NO: 8425 - DNA, 2068 bp, Glycine max
atgaaacagaaacacgccttctttaaatccccaaatcttaatttctgtcccttctctcactcccactccgtccatcgccgtttacgcgtcgcagatattcctctctcagacgaagatcacgacggcgacgccgtccgagaaacaccgtcgaccaaatgcttttcgcctcggaggctcgttgcttcgctgctcgcaccgctgaggccgaccaagggtctccgactccagcaacggcgccagaacgagaccggtgatttggaggcgccgtcgccgtcgtcgccgacgaacgaacttaaagggagcgacgaatcgaataatcagatatacgagaaactaatgtttgcttttcttttagggatgaaaaaggcaaaaatgctttacacttttactctttcatcgacttcaggacagttacatgagagtgatacatcttttaagctaggggttggttgtggtttgctatatctgattgcagcaagtaaaaatgagctcagcaagatgattgagctgcagaaagaaatggaaatgctccttcaaaatgcgaaaggggaactgcaaagtaaagattcacttcttaagccattgaaacaaagtgacacacttgccctttccataactgatattcaagaagtttccagctctagtagtcatctttctattcattcgaatatacaatatgttcaaccagagtcaaaaagcgatacggttcctaatcggtttctggaatataacactagcgaacaagatgaatgtgcagaagagataaatgagctccgggcagaatttgaaattgagttgcagcgcttgcagttgtatttggatggagaagctggatttgatgatgcacaacaagagggagtcaaggtaactcttgaggattctagttcaaaaagccatagttcaagttttggtgaaataataatggaacctcaaggagcaacttatgatgtatcttttggagttcctccaattgaattggagagaaggttgcatgaactgcttgaagcaagactggaagaacggatatcagagctggagtctgcattagaatgtaagacgcaaaagcttattaagaaagagatagaggttacttggtggaaagacactgcacaacttatctcacaacatgttccagaaacttctcggttcacttttccacttgatcctgatatttctttgaagttgagtcaacttggaggagtacaaaatggcggaaaggcagagtataactatacggttgattcggcgagagcgtctttggttagacaagaggacaccatcatttttggtttgattgagagagccaggttccccttaaattctccaacctacaatcaaagttacgcttccattcctcaatttcgtggcacattgctcgattttctcgttcgtgacacggaggtcattcaagctaaggctggaagatacactaaccttgaagaaaatcctttcttcccagaaaatttaccaccttcggttgagccacattaccccttctcacagtttttgcatccttcagccgctatgatcaacataaacaatgtcatttggaaactgtacattgatgagctgcttccaatatttgttgcttctggtgatgatggaaactatgcacaaactgctgctaccgatctttcattgttgcaggcaatctctagaaggattcattacggaaagtttattgccgaggccaaattcagagaatctcctaaaggctatgagcctttaattcgtgctaaggacaaagaagcattgatgaaattattgacaattgagagcgttgaagagatggtggtgaagagggttaaaaagaaggccatggtgttagggcaggaagtgagccttgatcgtaatgtcaagggaataaaatacaaggttgatccatcagtagtttctttcttgtaccagaaatggttaatacccctcacaaaaaacgttgaagtcgaatacttattaagccgcttagactgaagtcatttcaatgctatcaatctatgtgaaatatctaaggatttccgagactatcaattatagaaaacatgagaaaaataagatttcacttttttag

SEQ ID NO: 8426 - DNA, 1323 bp, Glycine max
atggcaatgctggccaagaccgactccgaggttagcagcctcacgcagtcctcgccgacgcgatccccgcgacgggcagtgtactatgtgcagagcccgtcgcgagactcatcgcacgacggggagaagactacgaactcgtttcactcgagtccgctgcagagcccattgggctccccgccccactcccactccaactcctccttgggccatcactcgcgcgagtccgcctccacgcgcttctctggctcgcgcaagagcagctcctcgggcaacaaccgcaagggcccgtggcggccctggaaggaccagttccatgccatcgaggaggagggcctcatcgatgctcacgacaatgcccgtggcttccctcgttgctgctatttcccagcatttgtcatcggcttcgtcctcctcttctccgcattctccctcattctctggggtgctagtcgcccccaaaagcccgccatttctctcaagagtataacctttgatcaattcgtgatacaagccggagcggacatgtcaggagttgccacaagtttggtgtccatgaattcatctgtgaaaatgacgtttcgtaacaccgctacatttttcggggtccatgtgacctcaactcccgtggatctcaattattatcaacttactctagccactggaactatgccaaagttttatcaatctaggaagagccaaagatctgttagagtgatggtgattgggagtcatataccactgtacggaggaggagcaaacctgaacagtgtgaacggtaaaccggttgaaccggtgccactgacgttgagcgtgatggtgcggtctagggcttatgttttgggcaaattggtgaagccaaagttctacaagaaaatagagtgttccatcgttatggatccgaagaagatgggcaaggccatttcactggtcaagaaatgcacttaccagtaaagtcagctacatgattattattaattaatgaaatcaaacaataaggtaaatttaagggtatggttgcattacacgaaatttccatgaaacagccgaaagggtagtttggatctagtcggtggctcaattcccagctcaagataaaattattatttttaatttttaatatttttcttactatctcagtttctctttcctttttttcctatctaatgtatcccggagtacgtagttgcggtagtcaagacaagaaataaaatattgaatttgggaattgtattgtatcccaacccaaagagagagtagattgttgggtcaaataatagaatacaatatgctttattgttttactatctatataaaattcat

SEQ ID NO: 8427 - DNA, 957 bp, Glycine max
atgacaatgctggccaaaaccgactccgaggttagcagcctcacgcagtcttcgccggcgcggtccccgcgacgggacgtgtactacgtgcaaagtccgtcgcgggactcgtcccacgacggcgagaagactacgaactcgttccactcgagtccgctgcagagccccttaggctccccgccccactcccactccaactcctccctgggccgccactcccgcgagtccgcctccacgcggttctcgggctcacgcaagagcagctcctccggcaacaaccgcaagggtccgtggaggccctggaaggaccagttccacgccatcgaggaagagggcctcctcgaccccaacgacaatgcccaccatggcttccctcgtcgctgctatttccccgcgtttgtcgtcggcttcgtcgtcctcttctccgcgttctccctcattctctggggtgctagtcgccctcaaaagcccgccatttctctcaagagtataacgtttgaccaattcgtgatacaagcgggagcggatatgtcaggagttgccacaagtttggtgtccatgaattcatctgtgaaaatgacgtttcgtaacaccgctacatttttcggggtccatgtgacctcaactcccgtggatctcaattattatcaacttactgtagccactggaactatgccaaagttttatcaatcaaggaagagccaaagatctgttcgggtaatggtaattgggagtcatattccactgtacggaggtggagccaacctgaacagtgtgaacggtaaaccggttgaaccggtgccgttgacgttgagcgtgatggtgcggtcgagggcttatgttttaggcaaattggtgaagccaaagttctacaagaaaatagagtgttccatcgttatggatccgaagaagatgggcaaggcaatttcactcgtcaagaaatgcacttaccagtaa

SEQ ID NO: 8428 - DNA, 957 bp, Glycine max; identical to SEQ ID NO: 8427

SEQ ID NO: 8429 - DNA, 1323 bp, Glycine max; identical to SEQ ID NO: 8426

SEQ ID NO: 8430 - DNA, 1808 bp, Glycine max
cattcctccgtttcaaagttttccaaccgcattcccaatggatcctcaagctccggcgacgggcaccaccgttcggagcgccgcggaaccatctcaacctcagccaccaaaaccatcccctcctctccctctccctccaccttccacatcatcaacccctccacaccctcccccaatccctaaccctaaccctagcccaggcccaggcccaggcccgggcccaattcaagccccgagccccaaaccccccactcccactcccacgcctccccaaccccgccctccccagcccttcaaccgcgctttaccacctccgtcgcagcctcagttcccgcacttctcctccccctctccgccgtcctcagctcccagcgccgccccgcctccgcggggtggtatggcgatcggtgtgcccgcgcaccaccagagcccctcccctccgttttcgtcctccttcggtcaacattttggagggctgggccgcaccgcagtcaacgtcgctgaatctacatccaattcaagcacttctcaagcgagaacgccggtgcaaggaatggggatgttagggtctcaaatgaggccaagtggaatcggttcacatcaacagaggtctgtgcaatcgtcacttagacctccaacctctgccccgaataatcaacccgctggttcacaaagcttccaagggcatggacttatgagaccctcatcagtgggatcaacggctactccatctccgagttcatcacaaagcatgcagtcacttaatcagccatggttgtcatctgggtcacaagggaagcctcctttgccatccgcagcttataggcagcaattgaacccacaatccatgcagcaaaggtcacatattcctccgatgcagcaatccacaccaacatcctcgcagcagcagcaacaacaacctttgctgtctaatcaatcacaggagcatttcgggcaacaagttccgccatccagggctcctctacacatgcctcatcagccacaggttacgaggttacaggggccaggaaatcagaaaccttcatctcttgtggcggcacaatctagtgcagcgcagccagggactcaaagtagattaacaaactcagataccgatgaatcttctaatagtattctcagcaaaagaagtatccatgagctagtcaatcaggttgatccactggagaagttggagcctgaagttgcagacattcttgtagatattgcagaaaattttctagagtctataaccaggtctggttgttcactagccaagcatcggaaatcaacaactttagaatcaaaggacatactgctccatcttgagaaaaattggaatatgactcttcctgggtttggtggtgatgagattaaaagctacagaagaccgattacaagtgatattcacaaggagcgtctagcagttataaagaaatcaatggcttcaactgaggcagcacatgggaagggctctgctggccaggcatctggtagtgcaaagggtaatcaagggaagacacctttgaatatcattggctcgccaaacctaaaaaattcataggatgcatgccgtgtttatggtttacacggcaatggaggaaccactttggtggagggagatcatcggtctttttgggctgttttccgagcattccatgtactggagaaagagtctgaatttagaagcgttgccgaaaacaagatgaggggaatcaagattgatatgaatcgtcttgcaactgaaaaccgtaaataaagaaagaaaaatgaattggcttcatcaaatgtttttgtactgacaatattaa

SEQ ID NO: 8431 - DNA, 1961 bp, Glycine max
agagccccagattacaccaacgttcactgagtgacattcctccgttttaaactttccaaccgcattcccaatggatcctcaagctccggcgacggccaccaccgctcgaagcgccgccgcggaaccctcgcaatctcaacccccaaaaccatcccctcctctccctctccctccaccttccacatcatcaacccctcccatctcagctcctccacagcctcccccaaacactaaccctagccctaaccctaaccccagccctgcccctggcccgggcccaattcaagccccgagccccaaaccccccactcccactcccactaccactcccacgcctccccagcccttcaaccgcgctttgtcgccgccatcgcaaccgcagttcccgcactactcctccccttctccgccttcctccgctcccggcgccgccccgccgccgcggggcggcatggcgatcggtgtgcccgcgcaccaccagagcccctcccctccgttttcgtcctccttcggtcaacattttggggggttgggtcgaaccggagtcaacgtcgctgaatctacctccaattcaagcacctctcaagtgaggacgccggtgcaaggaacggggatgttagggtctcaaatgcggccaagtggaatcggtgcacatcaacagagacccgtgcaatcgtcgcttagacctccaccaccctctgcaccgaataatcaaccggctggttcacaaagttttcaagggcatggacttatgagatcctcatcagtgggatcacctgctactccgtctccgagttcatcactaagcatgcagtcacttaatcagccatggttgtcatctgggccacaagggaagcctcctttgccatccgcagcttataggcagcaattgaacccacaatccatgcagcaaaggccacatattcctctgcagcagcaatccacaccaacacctttgctggctaatcaatcgcaggagcattttgggcaacaagttctgccacccagggctcctctacatgtacctcatcagccacagattatgagggtacacgggccaggaaatcagaaaccttcatctcttgtggcagcacaatctagtgcagctcaaccagggactcgaagtagattaacaaacacagatactgatgaatcttctaatagtattctcagcaaaagaagtatccatgagctagtcaatcaggtagatccattggagaagttggagcctgaagttgcagacattcttgtagatattgcagaaaattttctagagtctataactaggtctggctgttcattagccaagcatcggaaatcaacaactttagaagcaaaggacatactgctccatcttgagaaaaattggaatatgacacttcttgggtttggcggtgatgatattaaaagctacagaagaccgactacaagtgatattcacaaagagcgtctaacagttataaaaaaatcaatggctgcaactgaggcagcacatgggaagggctctgctggccaggcatctggtagtgcaaagggtaatcaagggaagacacctttgaatatcattggcttgccaaacctaaaaaatttataggatgcatgccgtgtttatgctttacacaacaatggaggaaccactttggtggaggctgttttctgagcattccatgtaccagaacctgagcaggagtctgaatttagaagcgttaccgaaaacaagatgaggggaatcaagattgatatggaatcgtcttgcaactgaaaaccgtaaagaaaggaagaaaaatgatttggcttcagctacatcaaatgtttttgtgttgataatagtaagaaagtcattggttgggtaggctgggccatttattgttataatcgactttctaatttagatgcaaatagtatcctgaaatatatatgcaattatttttcccgaaatactatacaattttttttgtgcc

SEQ ID NO: 8432 - DNA, 1479 bp, Glycine max; identical to SEQ ID NO: 8422

SEQ ID NO: 8433 - DNA, 1502 bp, Glycine max; identical to SEQ ID NO: 8421

SEQ ID NO: 8434 - DNA, 1807 bp, Homo sapiens
gagaggctaaacctaaaacccttacctttccttcccgccctcataatgagggacacaaactgagagtgaaatgcagaaactgctacgcccttcttcagttcccttcctctctatctctgtcaccgtggctactccctttctttcgttgcctcccaaagttgcaaaccaaccaatgtcagcagctgctgctggttcttctctcaagcgccaactctcttattcccgctatttggcgctctctagtaccaacacttgctctgtctgcaggtgtctcagtctaacccacacccactcccaccccaagaataacaagacccttcttctccttaaccactctagaaaccgctccttgcattcggcttcagaaggctctttcatcacccaacccgaccctgttgagtatggttctcttgtggactcaaaagagaagccctttaactccaggctaaataggaggcaaaagggttctacttcttcttctcctgctccgtcaaatcctgatttgctggccatccccggtgtgggtcccagaaatttcagaaagctcgttcagaaaggtatcgctggtgttgcgcaactcaagcaactctacaaggataagagtgttgacgaggaggagttggaagacaattcctcttcctctgttcagaagaagcgcttaacattctgtgttgagggtaacattagcgttggcaagactaccttcctccagagaatagcgaatgaaacgatcgagttgcgtgatcttgttgaggtggttcctgaacccattagcaagtggcaggatgttggacctgatcactttaacattttggatgctttttatgccgagccgcaacggtatgcctacacctttcagaactatgtgtttgtcacacgggtcatgcaggaaagagagtcatctgctggaatcaagcctcttcgtttgatggagaggagtgttttcagtgacaggatggtttttgtacgagctgtccatgaagctaactggatgaatgggatggagatcagtatctatgactcgtggtttgatcctgtagtatcctccttgcctggacttattcctgatggttttatctatcttagggcaagtcctgacacttgccataagagaatgatgttaagaaaaagaacagaagaaggtggagtcagccttgactatctctgcgacctccatgaaaagcatgaaagctggttatttccctcccaaagtggtaatcatggagtattatctgtcaatcagctgccccatcatattgacaactctttacaccctgatataagagaccgcgttttttatctggagggtggtcacatgcattcaagcattcagaaggttcctgctttggttctggactgtgaacccaatattgatttcagcaaagatatcgaagcaaagaggcaatatgcacgccaagttgcagaattttttgaatttgtgaagaaaaggaatgaggtctcatccaaggaaggaagtagccaagcccaaccgcaggtgctgctacctcatgagggtggcctgtggctaccagatgggaagccttttccccgggaagctctcaaatctttggacttcagacaagcagcaacgtcattcatgtccggctagtgactgctaaaccttgtgattcagggcaaagctatactactaatgtccccttgttgatgtgttcacgtttttcttgcatgtaaagattgactccggaccttgactgatgtaaaatagtggtggtatttgtggttgcgtaacgctttgctgacacacactacttggtcgtagattatatactcttgttgctgtgattag

SEQ ID NO: 8435 - DNA, 2001 bp, Glycine max
atgcagaaactgctacgcccttcttcagttcccttcctctctatctctgtcaccgtggctactccctttctttcgttgcctcccaaagttgcaaaccaaccaatgtcagcagctgctgctggttcttctctcaagcgccaactctcttattcccgctatttggcgctctctagtaccaacacttgctctgtctgcaggtgtctcagtctaacccacacccactcccaccccaagaataacaagacccttcttctccttaaccactctagaaaccgctccttgcattcggcttcagaaggctctttcatcacccaacccgaccctgttgagtatggttctcttgtggactcaaaagagaagccctttaactccaggctaaataggaggcaaaagggttctacttcttcttctcctgctccgtcaaatcctgatttgctggccatccccggtgtgggtcccagaaatttcagaaagctcgttcagaaaggtatcgctggtgttgcgcaactcaagcaactctacaaggataagttctttggcaaatctagtgacaagatggttgagtatctacagaattctgttggaataatccacaagaaccatgctgagagtataactactttcattaaacagagtgttgacgaggaggagttggaagacaattcctcttcctctgttcagaagaagcgcttaacattctgtgttgagggtaacattagcgttggcaagactaccttcctccagagaatagcgaatgaaacgatcgagttgcgtgatcttgttgaggtggttcctgaacccattagcaagtggcaggatgttggacctgatcactttaacattttggatgctttttatgccgagccgcaacggtatgcctacacctttcagaactatgtgtttgtcacacgggtcatgcaggaaagagagtcatctgctggaatcaagcctcttcgtttgatggagaggagtgttttcagtgacaggatggtttttgtacgagctgtccatgaagctaactggatgaatgggatggagatcagtatctatgactcgtggtttgatcctgtagtatcctccttgcctggacttattcctgatggttttatctatcttagggcaagtcctgacacttgccataagagaatgatgttaagaaaaagaacagaagaaggtggagtcagccttgactatctctgcgacctccatgaaaagcatgaaagctggttatttccctcccaaagtggtaatcatggagtattatctgtcaatcagctgccccatcatattgacaactctttacaccctgatataagagaccgcgttttttatctggagggtggtcacatgcattcaagcattcagaaggttcctgctttggttctggactgtgaacccaatattgatttcagcaaagatatcgaagcaaagaggcaatatgcacgccaagttgcagaattttttgaatttgtgaagaaaaggaatgaggtctcatccaaggaaggaagtagccaagcccaaccgcaggtgctgctacctcatgagggtggcctgtggctaccagatgggaagccttttccccgggaagctctcaaatctttggacttcagacaagcagcaacgtcattcatgtccggctagtgactgctaaaccttgtgattcagggcaaagctatactactaatgtccccttgttgatgtgttcacgtttttcttgcatgtaaagattgactccggaccttgactgatgtaaaatagtggtggtatttgtggttgcgtaacgctttgctgacacacactacttggtcgtagattatatactcttgttgctgtgattagaaagatggtcttgagcataatatcattttgcctactccttatgtttatatcagcatctgttatccgaagtcctagctagtgctttcaagaaccaaatatggtgttggaacatcagattttgtcggttgatttttctaattaatttctaattctcttggcttt

SEQ ID NO: 8436 - DNA, 1885 bp, Glycine max
atgcagaaactgctacgcccttcttcttctccggtcgccatcctctctatctccgtcaccgtggctactccctttctctcgttgccccccaaagtttcaaacttggtaccaatgtcagcagcgttcacttcttcttccctcaatccccaactttcttattctcgctatttggctctctctaccaacacttgctctgtctgcaggtgtctcagtctaacccactcccacaccaggaacaacaacaagacccttcttcttcttaacccctctagaaacctctccttacattcggcttcagaaggctccttcatcacccaacatgaccctgttgaggacgcaaaagagaagaagccctttaacttcaggctcaataggaggcaaaagggttcttcttcttcctccccagctccgtcaaatcctgatttgctggccatccccggtgtgggtcccagaaatttcagaaagctcgttcagaaaggcatcgctggtgttgcgcaactcaagcaactctacaaggataagttctttggaaaatctagtgacaagatggttgagtatctacagagttccgttggaataatccacaagaaccatgctgaaagtataactactttcattaaaaagagtgttgacgacgacgaggagaagttggaagacaattcctcctcctctgtgcagaagaagcgcttaacattctgtgttgagggtaatatcagtgttggcaagactactttccttcagagaatagcaaacgaaacaattgaattgcgtgatcttgttgaggtggttcctgaacccattagcaagtggcaggatgttggacctgatcacttcaacattttggatgctttttacgccgaaccgcaaaggtatgcctacaccttccagaactatgtgtttgtcacaagggtcatgcaggaaagagagtcatctgttggaatcaagcctcttcgtttgatggagaggagcgttttcagtgacaggatggtttttgtacgagctgtccatgaagctaactggatgaatgggatggagatcagtatctatgactcgtggtttgatcctgtagtatcctccttgcctggacttattcctgatggttttatctatcttagggcaagtcctgatacttgccataagagaatgatgttaagaaaaagagcagaagaaggtggagtcagccttgactatctccgtgaccttcatgaaaagcacgaaagctggttatttccctcccaaagtggtaaccatggagtattatcagtcaatcagctgcctcatcatattgacaactctttacaccctgatataagagaccgtgttttttatctggagggtggtcacatgcattcaagcattcagaaggttcctgctttggttttggactgtgaacccaatattgatttcagcaaggatattgaagcgaagaggcaatatgcacgccaagttgcagaattttttgaatttgtgaagaaaaggaacgaggtttcatccaaggaaggaagtagccaagcccaaccacaggtgctgctacctcatgagggtggcctgtggctaccagatggaaagccttttccccaggaagccctcaaatctttggacttcagacgagcagcgtcgttcatgtctggctagtgactgctaaaccttgtgattctgggcaaagatatactactaatgtccccttgttgatgtattcacggtttttattgcatgtaaagattgactttggaccttgactgatgtaaaacagtggcggtatttacggttgcctaatgctttgctgacacactacttggtcgtagattatatattcttattgctgtgattagaaagattgtctttataatttattattattccctcgagcatataatttttgccc

SEQ ID NO: 8437 - DNA, 1961 bp, Glycine max; identical to SEQ ID NO: 8431

SEQ ID NO: 8438 - DNA, 1808 bp, Glycine max; identical to SEQ ID NO: 8430

SEQ ID NO: 8439 - DNA, 1596 bp, Glycine max
atggttcgtaacgaaagcagcaacaaagagaaggataaagacctcgatcagtttttgtttgatcggaacgacgatgatttggtcgatgaagaacaacaggagattgaaggtgtgaagtacgagagtgagagtagtagtgatggtgacgacgcaaatcggagagcacagcctgactctttctcttctcagcaatggcctcagagttacaaagagactacagattcttacacgatagctgctgctccaaattttgagtcagttctacgggggccaagtttcatatattcaagttttgacaatcgttcaaagagtaacttagacatcgatggaaagacaccttttctatctgctgcagaaggcattagacaatcaacttggtgggagaaagcctcggtacaacggcttgtttctggagaattgcccattggatatggatgcagcttcactcaaacaattttcaatggcattaatgtgatggctggagttggtcttctatctacgccatacacagtaaatcaagctgggtggatgagcatggcagtgatgcttctttttgcagttatgtgttgttatacagccacccttttgagatactgttttgaaaatagggaagaaatcattacctacccagatataggagaagccgcatttgggagatatggtcgaattgctgtctcgatcattttgtacactgaactatattcatattgtgtggaattcatcaccttggaaggagataatctcactagtctgtttcctggtacatccttagatttgggtggtttccagttagactcgatgcatttgtttggagttttgacagcacttattattctcccaactgtttggttgaaggatcttcgtataatctcttatctatcagctggaggggttattgcaacagttttgattattatttgcgtgttttgtgttggaacaatagacggtgtcggattccatcacacgggtcaattggtaaaatggaatggcattccatttgctattggtgtctatggattttgctttgcaggacattcggttttcccaaatatttaccagtctatggctgacaaaaaacaatttaccaaagcactaataatatgttttgttttgtgtgttttgatatatggaggcactgcaatcatgggatatctcatgtttggtgatggcactttgtctcagataacattgaatatgccaccaggcacatttgcttccaaagttgcattgtggacaacagtgataaacaaatatgctttgttgatgaacccactggcaaggagtctagaggagttgctgccagatagaatttcatcctcatattggtgcttcattcttcttaggacaacacttgttgcatctaccgtttgtgttgcctttttggttcccttttttgggcttgtgatggctttaattggttctctctttagtatacttgtgtcagcgataatgccaagtttatgttttctgaaaattattgggaaaaaagctacaaggacacaggttgtactcagtgttgcaattgctgcattcggagtcatttgtggaatccttggaacatattcctctctgttgagtatcgctgatagttactga

SEQ ID NO: 8440 - DNA, 1647 bp, Glycine max
atggttcgtaacgacagcagcaacaaagagaaggagaaaaacctcgatgatcagcctttgttcgatctgaactacgatggcgacgaggaagatgccgtcgtcgacaaagaacagcaggagattgaaggtgtgaagtaccagagtgagagtagtagtgatggcgacgacgacgatggtggtggtaggcatgctgcgaatgggagagcacagcctgactctttctcttctcagcaatggcctcagagttacaaagagactacagattcttacacaatagctgctgctccaaattttgagtcagttctgcgggggccgagttttatatattctagttttgacaatcgttcaaagagtaacttagacatcgatggaaagacaccttttctgtctgctccagaaggcattagacaatcaacttggtgggagaaagcctcagtagaacggcttgtttccggagaattgcctattggatatggatgcagcttcactcaaacaattttcaatggcattaatgtgatagctggagttggccttctatctacaccatttacagtaaatcaagctgggtggatgagcttggcagtgatgcttctttttgcagttatgtgttgttacacagccacccttctgagatactgctttgaaagcagagaaggaatcattacctacccagatgtaggagaagctgcatttggaagatatggccgtattgctgtatcgataattttgtacactgaattatattcatattgtgtggaattcatcaccttggaaggagataacctcactagtctgtttcctggtacatccttagatttgggtggtttcaagttagactctatgcatatgtttggagttttgacagcacttattattctcccaacggtttggctgaaggatcttcgtataatctcttatctatcaggtggaggggttgttgcaacaattttgattatgatttgcgtgttttgtgttgggacaatagacagtgttggattccatcacacgggtcaattggtaaaatggaatggcattccatttgctattggtgtctatggattttgctttgcaggacattcggttttcccaaatatttaccagtctatggctgacaagaaacaatttaccaaagcactaataatatgttttgttttgtgtgttttgatatatggaggcactgcaagcatgggatatctcatgtttggtgatggcactttgtctcagataacattgaatatgccaccaggcgcatttgcttccaaagttgcattgtggacaactgtgatttcattatataacaaatatgctttgttgatgaacccactggcaaggagtctagaggagttgctgccagatagaatttcatcttcatattggtgcttcatgcttcttagaacaacacttgttgcatctacagtttgtgttgcctttctagttcccttttttgggcttgtgatggctttaattggttctctctttagtatacttgtgtcagcgataatgccaagtttatgttttctgaaaattattgggaaaaaagctacaaagacacaggttgcactcagtgttgcaattgctgcattcggagtcatttgtggaatccttggaacatattcctctctgttgagtattgcggatagttactga

SEQ ID NO: 8441 - DNA, 1790 bp, Glycine max
atggctagtaacacaaacaccaacaacagcaacaagaaggagaaagaccttgagtttttctttgaggaagatatcaacgaattgggtgcacaacaaatggatgctgaaactgccaagttagagagtgagagtagcagcagcgatgacgagggaaatgatacaacacgccgtcactctttcacttctcagcaatggcctcaaagttacaaagagacaacagattcttacacacttgccgcaactccaaattttgaatcaattctacgagttccaagtattatatattccagttttgaaagtcgttcaaagaataacttggacatagatggaaagactccttttctctctggtcacgaaggcattactcaatcaacatcgtggaaggaaggtttagtgcaaaaacatttatctggtgaattacccattggtcgtgagtgcagctttcttcaaacagttttcaatgcgactaatgtgatggctggagtcggtattctgtctacaccttatacattgaaagaagctgggtggatgagcatggtgttgatggttctttttgcagtcatttgttgttatacagccacccttatgagatattgctttgaaagcagagaaggaatcactagctatccagatataggagaagctgcatttggaaaatatggtcgtattattgtctcaatcatattgtacactgaattatattcatgttgtgtggaattcatcaccttggaaggagacaacctcactgggctattcccaggaacatccttagatttgggtagttttcggttagactctgtgcacttgtttggaattttggcggcacttatcattatccccactgtttggttgaaggatcttcgtataatctctattttgtcagctggaggagtttttgcaacactgttgattgttgtatgtgtgttttgtgttgggacaataaatggtgttggattccatcacactggtcaattggtcaattggagtggcattccattagctattggtatccatgggttttgctttgcaggacattcagtttttccaaatatttatcaatctatggcagacaaaagacaatttactaaagcactaataatatgttttgtattgtctatcacaatatatggaggtgttgcaatcatgggatttctcatgtttggtggtgagactttgtctcaaataacattaaatatgccacgagatgcatttgcttccaaggttgcattgtggaccacggtaattaacccattcaccaaatatgctttgttgatgaacccattggcgagaagtctcgaagagttgctaccagatagaatctcaagtacttatcgatgtttcattcttcttagaacagcacttgttgtatctaccgtttgtgctgcttttcttattcctttttttgggtttgtgatggctttaattggttctctcttcagtgtacttgtgtcagtgataatgccaagtttatgttttatgaaaattgtgggaaaaaaagcaactgctacacaggttgcgttgagcgttgtaattactacatttggagtcatttgtgggattctaggaacatattcatctgtgcagaatattgtcaacagttactgagacctctagcctttcgcattggatggttacgattgagtactgttaactcgttacaaatgtttactcatggcaagtgcagctatttcaattatgtgaaaattacacctttatttatgaccaagcacactttattttaagattcaaaatttttctattgaaatatgtaagttttgagtaatgtgtta

SEQ ID NO: 8442 - DNA, 1967 bp, Glycine max
gaggcagaagaagacaataactatcttcttccaaataaaaaaaaaaaaagaaaaaggaaggagataggaaagggttaattgaatccaaaaaaaagaagagaaaaacaaaatgggcagggtttggacttcgatgatagcattgttgctttgcctgatgacatcatcggttcggggcgaggacccttacatttactacacatggaacgtgacctacggcaccattgccccattgggtgtcccccaacagggtatcctcatcaatggtcagtttcccggccccgaaatcaactccaccagcaacaacaacgtggtcatcaatgtcttcaacaacctcgatgagcctctcttgttcacatggcatggtgtccaacagaggaagaactcttggcaagatggcacattgggtgcccagtgccctatcgccccaggcaccaactacacctaccgctttcaggttaaggatcaaattggaacttacttctactacccgaccaccggcttgcaacgcgcagtgggtggcttcgggggtttaaggatcttcagccgtctgttgatcccagtgccctatgctgatcccgccgatgagtactgggtgctcatcggtgactggttcggcaagagccacactgccttgaaacaaacattggacagcggacgcagcattggcaggcccagtggggtccacatcaacggcaagaacggcgggctcgaggccctctacaccatggagcccggaaagacctataagtacagaatctgcaacgttgggctcaaggaagccctcaacttcaggatccagggccaccccatgaagctcgttgagaccgaaggctcccacgttgttcaaaacacctatgactccctcgacgtccacgtcggacagtgcttcaccgtcctcgttaccgccgaccaggagcccagggactacttcatggtcgcctccacgcgcttcacgaagaaggttataactgccacgcgcgtgattcgttactcgaatggcgtcgggcccgcatcccctcttcttccccctgcaccccaccaaggctgggcctggtctcttaaccagttccgctccttccgttggaaccttaccgccagcgctgcaaggcccaaccctcagggctcataccactacggtcagattaacatcacccgcaccatcaagttggtcggcacccgaagcaagatcggcggcaagctccgttacgcactcaacggtgtctcccacgtcgaccccgaaacccctctcaagctcgccgagtactacggtgtcgccgacaaggtcttcaagtacaacctcatctctgacgccccagacgccgccatcgcctcccgcgaccccatcatcgcccccaacgtcatcaacgccaccttccgcaacttcatcgaagtcatcctcgagaaccccaccaaggtcacccagtcctacaaccttgatggctactctttctttgccgtcgcggttgagccggggcagtggagcccagagaagaggaagtgctacaaccttcttgatgctgtcagcaggcacaccatccaggtgttcccaaagtcttgggccgcaatcatgttgacttttgacaacgctggaatgtggaacttgaggtcggagatggcagagaatcgttacctgggacagcaattgtacgtgagtgtcttgtctcccaacaggtcccttagggatgagtacaacctcccagagacccagcttgtctgcggaatcgtcaaggatatgcctaagccaccaccttactccagttaagagatttttcttctgcgatcatcatcagtgccaccacgtcgtagctccaaaattgttccatcatgagattgagacgaggggttaattaattagctctagttcatttctcatgtttcttgcgtggtcactgatgtacaaccctttcctattcattttctatatcaatatcacataaatatatatatgaaagtctccttccttttcc

SEQ ID NO: 8443 - DNA, 1620 bp, Glycine max
atggcactgatgctttgcctgatggcagcatcggttaggagcgaggacccttatatttactacacatggaaagtgacatatggtaccattgcccctatgggtgttccccagcagggtatcctgatcaatggccagttccccggccctgaaatcaactccaccagcaacaacaatgttgtcatcaatgtcttcaacaacctcgacgagcccctcttgttcacatggcatggtgtccaacacaggaagaactcctggcaagatggtacattgggtgtccagtgccccattgccccaggaaccaattatacctatcactttcaggttaaggatcaaattggaacttatttctactacccgaccaccggcttgcaacgcgcaatcggtggattcgggggtttgaggatcttcagtcgtctgttgattccagtgccctatgccgatcccgccgatgagtattgggtgctcatcggcgactggttcggcaagagccacactgccttgaaacagaagttggatagcgggcgcagcatcggcaggcccgttggggtccacattaacggcaagaatggtgggcttgagcccctttacaccatggagcccgggaagacttacaagtacagaatctgcaatgttgggctcaaagactccctcaacttcaggatccaaggccaccccttgaagctcgttgagaccgaagggtcccacgtggttcaaaacaactacgactccctcgacgtccacgtcggacagtgctacactgtcctcgtgaccgccgaccaggagcccaaggactacttcatggtcgcctccacgcgcttcacgaagaaggttctcaccgccacgcgcgtgattcgttactcgaatggcgtggggcccgcatccggcgggcttccacccgcaccccaaggctgggcttggtctattaaccaattccgctccttccgttggaacctaaccgctagtgctgccaggcccaaccctcagggctcataccactacggtcaaattaacatcacccgcaccatcaagttggtcaacaccgttagcagggccaacggcaagctccgttatggactcaatggcgtctcccacgtcgacacccaaacacctctcaagcttgccgagtactatggcgtcgccgataaggtcttcaagtacaatctcatctccgactcccccgacaccgccttccctgacctcaccgtcgctcccaacgtcatcaacgccaccttccgtgacttcatcgaagtcatcttcgagaaccctggcaaggtcattcagtcctacaaccttgacggctattctttcttcgctctcgcggttgagccagggaagtggaccccagagaagaggaagaactacaaccttcttgatgctataagcaggcacaccattcaagtgttccctaactcttgggcagcaatcatgttaacctttgacaacgctggaatgtggaacttgaggtcggagatggcagagaatcgttacctgggacaacagttgtacgtgagtgtcttgtctccaaacaggtctctaagggatgagtacaacctcccagagacccagcttctatgcggaattgtcaaggatatgcctaagccaccaccttactccagttaa

SEQ ID NO: 8444 - DNA, 1650 bp, Medicago truncatula
atgggtcgtggagcggtgttagcttttatgctatgccttttaggcgtcaccgtttacggtgaagatccttacatttactatacatggaaggttacctatggtaccatttcaccacttggaacaccccagcagggtatccttattaacggtcaattcccaggacctgaaatcaacagcactagcaataacaatgttgttgttaatgtattcaacaaccttgatgaaccattgcttttcacatggcacggtgttcaacagaggaagaattcatggcaagatggtaccgctggtgttcaatgccccattcttcctgggactaactatacctacaaattccaagtgaaggatcaaattggaagttacttttactaccctaccacaggtcttcaaagagccgttggtggtttcggtggtcttagaatcttcagtcgtctgttgatccctgttccttatgctgatcctgaggatgagtattgggttctcattggtgactggtacggtaagagccacaaaactcttaagatggagttggacagtggtcgttcaattggaagacctgccggtgttatcataaacggtaaaaatgctaaaggtgatggtagcgatgagccactctacacaatgaagccgggaaaaacctacaaatacagaatctgcaatactggtcttaaggacacccttaacttcaggttccaaggacatggaatgaagttggttgaaaccgaaggatcacacgttgttcaaaatgtttatgactctcttgacgttcacgttggacaatgctacactgtcctcgtgaccgccgataaagagccaagggactattacatgattgcctccacccgtatgaccaagtacaatctacttggaaagggtattatacgttacaccaacggaaaaggtcccgcttcacctgtgctaccacctgcacctgtcggttgggcttggtctctcaaccagttccgatcattccgttggaacttaaccgcttctgctgcaagacccaaccctcagggatcttaccattacggtcagatcaacattacccgcacaatcaagtttgttaactctgttagcaatgttaacggtaaactccgttatgctattaacggtgtttcccatgttgatcctgaaactcctgtgaagcttgctgagtactacggtgttgcggataaggtgttcaagtacaacatcatctccgatgaacccccaaccgatctcaaggccatcaccatcgcacctaatgtcatgcaaactactttccgtaccttcattgagatcatcttcgagaaccccgaaaaggtcctccaatcttacaatttgggtggttattctttctttgccgtcgctggtgagccaggaacatggaccccagagaagaggaagggctacaaccttttggatgccatcagcagacacacaattcaggtgttccctaaatcatgggctgcaatcatgttgacattcgacaatgctggtatgtggcaattgaggtcagagcatgcagagcaccgttacctgggacaacaactttatctcagtgttgaatcagaagaaaagtctactagggatgaatacaaccttcctgagactcaacttgtttgcggtatcgttaaggatatgccaaggcctccaccaaaatacgtttag

SEQ ID NO: 8445 - DNA, 1825 bp, Medicago truncatula
atgggtcgtggagcggtgttagcttttatgctatgccttttaggcgtcaccgtttacggtgaagatccttacatttactatacatggaaggttacctatggtaccatttcaccacttggaacaccccagcagggtatccttattaacggtcaattcccaggacctgaaatcaacagcactagcaataacaatgttgttgttaatgtattcaacaaccttgatgaaccattgcttttcacatggcacggtgttcaacagaggaagaattcatggcaagatggtaccgctggtgttcaatgccccattcttcctgggactaactatacctacaaattccaagtgaaggatcaaattggaagttacttttactaccctaccacaggtcttcaaagagccgttggtggtttcggtggtcttagaatcttcagtcgtctgttgatccctgttccttatgctgatcctgaggatgagtattgggttctcattggtgactggtacggtaagagccacaaaactcttaagatggagttggacagtggtcgttcaattggaagacctgccggtgttatcataaacggtaaaaatgctaaaggtgatggtagagatgagccactctacacaatgaagccgggaaaaacctacaaatacagaatctgcaatactggtcttaaggacacccttaacttcaggttccaaggacatggaatgaagttggttgaaaccgaaggatcacacgttgttcaaaatgtttatgactctcttgacgttcacgttggacaatgctacactgtcctcgtgaccgccgataaagagccaagggactattacatgattgcctccacccgtatgaccaagtacaatctacttggaaagggtattgttcgttacaccaacggaaaaggtcccgcttcacctgtgctaccacctgcacctgtcggttgggcttggtctctcaaccagttccgatcattccgttggaacttaaccgcttctgctgcaagacccaaccctcagggatcttaccattacggtcagatcaacattacccgcacaatcaagtttgttaactctgttagcaatgttaacggtaaactccgttatgctattaacggtgtttcccatgttgatcctgaaactcctgtgaagcttgctgagtactacggtgttgcggataaggtgttcaagtacaacatcatctccgatgaacccccaaccgatctcagggccatcaccatcgcacctaatgtcatgcaaactactttccgtaccttcattgagatcatcttcgagaaccccgaaaaggtcctccaatcttacaatttgggtggttattctttctttgccgtcgctggtgagccaggaacatggaccccagagaagaggaagggctacaaccttttggatgccatcagcagacacacaattcaggtgttccctaaatcatgggctgcaatcatgttgacattcgacaatgctggtatgtggcaattgaggtcagagcatgcagagcaccgttacctgggacaacaactttatctcagtgttgaatcagaagaaaagtctactagggatgaatacaaccttcctgagactcaacttgtttgcggtatcgtcaaggatatgccaaggcctccaccaaaatacgtttagagtgttgtttgaaattactcatttctctctatgtcgtgagcttcatgtgattgttagcactaagtcatagagattcattatattgtatgttatctattggttgatttatatataatcaaccctcttactatatttaattattcaattatccccttaattaatattaacatttgtt

SEQ ID NO: 8446 - DNA, 1650 bp, Medicago truncatula
atgggtcgtggagcggtgttagcttttatgctatgccttttaggcgtcaccgtttacggtgaagatccttacatttactatacatggaaggttacctatggtaccatttcaccacttggaacaccccagcagggtatccttattaacggtcaattcccaggacctgaaatcaacagcactagcaataacaatgttgttgttaatgtattcaacaaccttgatgaaccattgcttttcacatggcacggtgttcaacagaggaagaattcatggcaagatggtaccgctggtgttcaatgccccattcttcctgggactaactatacctacaaattccaagtgaaggatcaaattggaagttacttttactaccctaccacaggtcttcaaagagccgttggtggtttcggtggtcttagaatcttcagtcgtctgttgatccctgttccttatgctgatcctgaggatgagtattgggttctcattggtgactggtacggtaagagccacaaaactcttaagatggagttggacagtggtcgttcaattggaagacctgccggtgttatcataaacggtaaaaatgctaaaggtgatggtagcgatgagccactctacacaatgaagccgggaaaaacctacaaatatagaatctgcaatactggtcttaaggacacccttaacttcaggttccaaggacatggaatgaagttggttgaaaccgaaggatcacacgttgttcaaaatgtttatgactctcttgacgttcacgttggacaatgctacactgtcctcgtgaccgccgataaagagccaagggactattacatgattgcctccacccgtatgaccaagtacaatctagttggaaagggtattgttcgttacaccaacggaaaaggtcccgcttcacctttgctaccatctgcacctgtcggttgggcttggtctctcaaccagttccgatcattccgttggaacttaaccgcttctgctgcaagacccaaccctcagggatcttaccattacggtcagatcaacattacccgcacaatcaagtttgttaactctgttagcaatgttaacggtaaactccgttatgctattaacggtgtttcccatgttgatcctgaaactcctgtgaagcttgctgagtactacggtgttgcggataaggtgttcaagtacaacatcatctccgatgaacccccaaccgatctcagggccatcaccatcgcacctaatgtcatgcaaactactttccgtaccttcattgaaatcatcttcgagaaccccggaaaggtcctccaatcttacaatttgggtggttattctttcttcgccgtcgctggtgagccaggtacatggaccccagagaagaggaagggctacaaccttttggatgccatcagcagacacacaattcaggtgttccctaaatcatgggctgcaatcatgttgacattcgacaatgctggtatgtggcaattgaggtcagagcatgcagagcaccgttacctgggacaacaactttatctcagtgttgaatcagaagaaaagtctactagggatgaatacaaccttcctgagactcaacttgtttgcggtatcgtcaaggatatgccaaggcctccaccaaaatacgtttag

SEQ ID NO: 8447 - DNA, 1650 bp, Medicago truncatula
atgggtcgtggagcggtgttagcttttatgctatgccttttaggcgtcaccgtttacggtgaagatccttacatttactatacatggaaggttacctatggtaccatttcaccacttggaacaccccagcagggtatccttattaacggtcaattcccaggacctgaaatcaacagcactagcaataacaatgttgttgttaatgtattcaacaaccttgatgaaccattgcttttcacatggcacggtgttcaacagaggaagaattcatggcaagatggtaccgctggtgttcaatgccccattcttcctgggactaactatacctacaaattccaagtgaaggatcaaattggaagttacttttactaccctaccacaggtcttcaaagagccgttggtggtttcggtggtcttagaatcttcagtcgtctgttgatccctgttccttatgctgatcctgaggatgagtattgggttctcattggtgactggtacggtaagagccacaaaactcttaagatggagttggacagtggtcgttcaattggaagacctgccggtgttatcataaacggtaaaaatgctaaaggtgatggtagcgatgagccactctacacaatgaagccgggaaaaacctacaaatatagaatctgcaatactggtcttaaggacacccttaacttcaggttccaaggacatggaatgaagttggttgaaaccgaaggatcacacgttgttcaaaatgtttatgactctcttgacgttcacgttggacaatgctacactgtcctcgtgaccgccgataaagagccaagggactattacatgattgcctccacccgtatgaccaagtacaatctacttggaaagggtattgttcgttacaccaacggaaaaggtcccgcttcacctgtgctaccacctgcacctgtcggttgggcttggtctctcaaccagttccgatcattccgttggaacttaaccgcttctgctgcaagacccaaccctcagggatcttaccattacggtcagatcaacattacccgcacaatcaagtttgttaactctgttagcaatgttaacggtaaactctgttatgctattaacggtgtttcccatgttgatcctgaaactcctgtgaagcttgctgagtactacggtgttgcggataaggtgttcaagtacaacatcatctccgatgaacccccaaccgatctcaaggccatcaccatcgcacctaatgtcatgcaaactactttccgtaccttcattgagatcatcttcgagaaccccgaaaaggtcctccaatcttacaatttgggtggttattctttctttgccgtcgctggtgagccaggaacatggaccccagagaagaggaagggctacaaccttctggatgccatcagcagacacacaattcaggtgttccctaaatcatgggctgcaatcatgttgacattcgacaatgctggtatgtggcaattgaggtcagagcatgcagagcaccgttacctgggacaacaactttatctcagtgttgaatcagaagaaaagtctactagggatgaatacaaccttcctgagactcaacttgtttgcggtatcgtcaaggatatgccaaggcctccaccaaaatacgtttag

SEQ ID NO: 8448 - DNA, 1638 bp, Medicago truncatula
atgactcgtggggctatcatagctttgatggtttgccttatggcaacagcagtgaggtctgaagatccttatgtgtactatacatggaaggttacctatggtaacattgcacctttgggtactcctcaaaagggtattctcatcaacggtcaattcccgggacctgaaattaacggtaccagcaacaacaacattgtagttaacgttttcaacaaccttgatgagccactccttttcacatggagcggtattcaacaaaggaaaaactcgtgggccgatggaacatcgggagtccaatgtcctattgccccgggaaccaactacacctacaaattccaggttaaggatcaaattggtagttacttttactaccctactaccggtctcatgagagctgccggtggtatcggtggaattagagtctacagccgattgttgatccctgtcccatatgctgatcccgctgacgaatattgggttcttatgggtgattggtacggaaagagtcacactcaattgcaaaagttccttgacagtggccgatccatgggaagacctgatggagtccacatcatgggaaaatccaacagtgctgagccactctacaaaatggagccaggaaagacctacaagtacagactctgcaacgttggtctcaaggattctcttaacttcagaatccaagatcacccaatgaagctcgtcgaaatggaaggttcccacaccgttcaaaacgtttatgattcccttgacgttcacgtaggacaatgcttctctgtcctcgtgactgctgacaaggaacccaagcaatacaaaatggtcgcttccacacgtttcaccaagaccgttcttaccacaactgctgttatctcttacactaacggtaatggccctgcctcacctgttctcccacctgcaccagttggttgggcttggtctttgaaccaggttcgttctttccgctggaacttaaccgctagtgctgctaggcccaatcctcaaggttcttaccattacggacagatcaacatcacccgtaccatcaagctcgttaacaatccttttaacattgatggaaagcttcgttatactcttaacggagtttcccacgaggacgatgaaaccccactcaagcttgctgaatactatggtgttgctaacaaggttttccaatacgacctcacctctgataatccccctgctgtcatcggtaaccttagagtggaagctaatgtcctcaacgtcactttccgcaccttcgttgagatcatcttcgagaaccctacaaaggtcatccagtcttacaatttggatggttactctttcttcgccgtggctgttgagccaggcaaatggacaccagagaagagaaagaactacaaccttttggatgcagtgagcaggcacacagtgcaagtgttccccaagtcatgggccgcaattatgttgacattcgacaacgctggtatgtggaacttgagatcagaaatggctgagaacaggtaccttggccaacaaatgtacatgagtgtgttgtcccctgaaaaatccaacagggatgagtacaatcttccagatactcatcaagtctgcggcattgtcaaggatatgccaaggcctgcactacaatacacttaa

SEQ ID NO: 8449 - DNA, 1765 bp, Medicago truncatula
agcaactatcttcttccaataagaaggaggagataggaaataagagtttcatctcattctctcttttctagcattttatttcttttatcaaaaaaataaataaataaataaaatgggccgtggagcgatgttagcagctttgatgctatgcctcttaggcgtcaccgtttatggtgaagatccttacatttactatacatggaaggttacctatggtaccatttcaccacttggaacaccccagcagggtatccttattaacggtcaattcccaggacctgaaatcaacagcactagcaacaacaatgtcgttgttaatgtattcaacaaccttgatgaaccattgcttttcacatggcacggtgttcaacagaggaagaattcatggcaagatggtacccttggtgttcaatgccctattcttcctggaactaactacacctacaaatttcaagtgaaggatcaaattggaagttacttttactaccctaccacaggtcttcaaagagccgttggtggtttcggtggtcttagaatcttcagtcgtctgttgatccctgttccttatgctgatcctgaggatgagtattgggttctcattggtgactggtacggtaagagccacaaaactcttaagatggagttggacagtggtcgttcaattggaagacctgctggtgttatcataaacggtaaaaatgctaaaggtgatggtagcgatgagccactatacacaatgaagccgggaaaaacctacaaatatagaatctgcaatactggtcttaaggacacccttaacttcaggttccaaggacatggaatgaagttggttgaaactgaaggctcacatgttgttcaaaatgtctatgactctctcgacgttcatgttgggcaatgctacactgtcctcgtgaccgccgataaagagccaaaggactattacatggttgcctccacccgtatgaccaagtacaatctacttggaaagggtattatacgttacaccaacggaaaaggtcccgcttcacctatgctaccacctgcacctgtcggttgggcttggtctctcaaccagttccgatcattccgttggaacttaaccgcttctgctgcaagacccaaccctcagggatcttaccattacggtcagatcaacattacccgcacaatcaagtttgttaactctgttagcaatgttaacggtaaactccgttatgctattaacggtgtttcccatgttgatcctgaaactcctgtgaagcttgctgagtactacggtgttgcggataaggtgttcaagtacaacatcatctccgatgaacccccaatcgatctcagggccatcaccattgcacctaatgtcatgcaaactactttccgtaccttcattgaaatcatcttcgagaaccccggaaaggtcctccaatcttacaatttgggtggttattctttcttcgtcgtcgctggtgagccaggtacatggaccccagagaagaggaagggctacaaccttttggatgccatcagcagacacacaattcaggtgttccctaaatcatgggctgcaatcatgttgacattcgacaatgctggtatgtggcaattgaggtcagagcatgcagagcaccgttacctgggacaacaactttatctcagtgttgaatcagaagaaaagtctactagggatgaatacaaccttcctgagactcaacttgtttgcggtatcgtcaaggatatgccaaggcctccaccaaaatacgtttag

SEQ ID NO: 8450 - DNA, 1659 bp, Glycine max
atgaaaagggtaatgttactggtattgtcatgcctatggatcgaatcattattgacggtggtccggggtgaagacccttatctctactttacatggaatgttacttacggcaccatctctccattgggtataccccaacaaggcattttcatcaatggccaatttccaggacccaatatcaattccaccagcaacaacaatctagttatcaatgtcttcaataatcttgatgagccattccttttcacttggaatggcatccaacacagaaagaattcatggcaagatggggttgcaggaactaactgccccattcctccagggacaaacttcacgtatcgtatccaggtgaaggaccaaataggcagttacttctactacccaagcacagccatgcatagggcagctggtggttttggtggccttcgtgtaaacagtcgcttgcttattcctgtgccttacccagatcctgaggatgaatacaccgttctcattggtgactggtacacaaagagtcacaccattctgaggaagttattggatagcgggcgctctcttggtaggcctgaaggtgtccttatcaatggcaaaacagctaaaggtgatggaaaagacgaaccactcttcaccatgaagcctgcaaagacctacaaatatagaatatgcaacgttggccttaagaactccctaaactataggatccaaggccattccatgaagcttgtcgagatggaaggctcccacgtggtgcaaaacatgtacgactctcttgatgtgcatgtaggggaatgtttttctgtgcttgttacagcggacaaggaaccaaaggattactacatggtggcttccacacgtttcaccaagactgttctaataggtaaaggtatcattcgttacacaaatggtaagggtcctgcctcacccgacatccccccggctccagtgggttgggcttggtctcttaaccaattccataccttccgttggaatctcaccgctagtgccgccaggcccaaccctcagggttcctacaaatatggtcaaatcaacattactcgtactatcaagctcgttaactcagttagtaagtctaacggtaagcttcgttatgcccttaatggtgtctcacatgtcgatcccgaaactccactcaagctagctgaatactttggaatttcggacaaggttttcaaatatgatactatcccagacaacccatcacctaacattggaaacgctgtaaccgtacaaccaaatgttcttaacattacccatcgcaacttcatcgaaatcatctttgagaaccctgaaaaaacaatccaatcatatcacttggatggttattcgttcttcgtactcggcatagagccaggcacttggaccccagagaagaggaagtcctacaaccttctagatgccgtgagcagacacacagttcatgtgttcccaaaatgttgggccgccatcatgttgacattcgacaatgctgggatgtggaacctaagatcggatattgctgaaagtcgctatcttggccagcagttatacattagtgttttgtcccctgagcattctcttagagacgagtacaatatgccagacagtaacttgctttgtggtcttgtaaagaatttgccaaaaccagcaccatactcctaa

SEQ ID NO: 8451 - DNA, 2600 bp, Lotus japonicus
cccccctttctctcagctcccaactacttctcacacctaacaattcttgtgagagagactctttcttcttcttcattcttcattcttcattcttcgttcttcaatcgatcaatttccatggaagaatcaagctccatgaagatttcgcctctggatctgatgtccgccatgatcaagggcacactcgacccttccaacgtctcctccacctccggcgccggctccgtcttcctcgagaatcgtgagttcgtcatggtgcttaccacctccatcgccgtcctcatcggatgcgtcgtcgttttcatttggcgcagatccaccggtaacaaggctaagtccatcgagcctcccaagcgcgtcgtcgagaagcttagcgacgaggctgaggttgacgacggtaccagaaaggtcaccatcttcttcggtactcagactggtactgctgaaggattcgccaaggcgattgcggaagaggcaaaagtgcgatacgaaaaagccaagttcaaaattgttgatatggatgattatgcccaggacgatgatgagtatgaggaaaagctcaagaaagagacactggcacttttcttcttagctacatatggtgatggtgagccaactgataatgcggcgagattttacaaatggtttctggagggagatgagaaagaagaaggatggcttcgaaatcttgagtatgctgtttttggtctggggaacaggcagtatgagcattttaataaggtcgccattgaagtggatgataagcttgctgattttggtgggaagcgtcttgtcaaagtaggtctaggagatgatgatcaatgcatagaagatgactttactgcatggaaagaagaattgtggccagcattggatgaattgcttagaggtgatgatgatacaactgtgtctacaccctatacggctgctgtgttggagtatcgtgttgttattcatgatccattagatgcatctgtcgatgaaaagaagtggcataatgttaatggccatgctattgtggatgctcaacatccagtcaggtcaaatgtggctgtgcgaaaggagcttcatactcctgtgtcagatcgttcttgcacacatttagaatttgacatttcaggcactggagttgcatatgaaacaggggaccatgttggtgtttactgtgagaatttatctgaaactgtggaagaagcagtaaggttactaggtttgtcaccagatacctatttctccgtccatactgatgatgaagatgggaaaccacttagtggaagctccttgccacctactttcccaccatgtactttaagaacagcaattgcccgatatgcagatgtcttgagttcacccaaaaagtctgttttgcttgccttagctgctcatgcatctaatccatctgaagccgaccgcctacgacatcttgcttcacctgctggaaaggatgaatattcagagtgggtgattgccagtcaaagaagtctccttgaggtcatggctgaatttccatcagccaaacctccaattggtgtctttttcgcagcaattgctcctcgcctgcagccaagattttattcgatctcatcatctcctaggatggctccatccagaattcacgttacctgtgcattagtgaatgataaaatgcccactggtaggattcataggggagtgtgttcaacatggatgaagaattctgtgccattggagaaaagtcaggactgcagttgggctccaatatttgttagacagtccaattttaaactccctgctgataataaagtgcctataatcatgataggtcctggcacaggattggctcctttcaggggtttcttgcaggaaagattagctctgaaagaggatggagctgaacttggcccctccgttttattcttcggatgcaggaatcgtcaaatggactacatctatgaagatgagttgaaccactttgtcaacagtggtgcgctttctgagctcattgttgccttctcacgggagggacctaccaaggaatatgtgcaacataaaatgatggagaaggcttcggatatttggaacatgatatctcagggagcttacatttatgtgtgtggggatgccaagggcatggctagggatgtgcaccgtactctgcacacaattttgcaagagcagggttctctcgatagttccaaggctgagggtatggttaagaacctacaattgaatggtaggtatttgcgtgatgtatggtgatcatatctgaacgaagcacatggaggtaatagaagtctagtggggtagtaagatattggaagagccttatttgtgctgtcttccattggggtcctcaaaaaaaaaaaaagggaggggagggggtctgcttgttgtcatcatggcaatagcccccatgattcttttttcactatactattaaatggattctttttttatggtttaatttaaaactactttgtttgtaactagattctgaataatgtatctagctttcttgtaatatttagacctgtaagaagggcttagagatgcagatgattccttgtatttgtatgaaccgataaacaattgttcggagatgaagaaaatattatttctgc

SEQ ID NO: 8452 - DNA, 2620 bp, Glycine max
acccgtttctttcttcagagtctctctctctctctcaactcccaattactttgttgcatttcacacaccaacttcccatagaagagagaagagagaagagactcttccttccatcctgcaactcaaatcatcatgcaagactccagctcaatgaagatctcccctctggatctcatgtccgccatcttcaagggcaagctcgacccctccaacgtctcctcctccaccaacgccgccgccgccgccttcctcctcgagaaccgcgacttcctcatgctcctcaccacctccgtcgccgtcctcatcggctgcgtcgtcgtcttcatctggcgcagatcatcctcccccaaggccaagcctctcgagcctcctaaacgcgtcgtcgagaagcttcccgaaatcgaagtcgacgacggcaccaagaaggtcaccatcctcttcggcactcaaaccggcaccgccgaaggcttcgccaaggccacagctgaagaggccaaagcgcgatacgagaaggccacgttcagagtcgtcgatatggatgattatgccgccgatgacgatgaatacgaggaaaggttcaaaaaagagactcacgttcttttctttttagctacatatggtgatggtgagccaactgataatgccgcgagattttataaatggtttacagaggggggtgagaaaggagaagggtggcttcagaatcttcactatggtgtgtttggccttggaaacaggcagtatgagcattttaacaaggtggcgaaggtagtggatgacatgctcgttgagcaaggggggaagcgccttgtgccagtgggtctaggtgatgatgatcaatgcattgaggatgactttactgcatggaaagaagaactgtggccagcattggatgaattgcttagagatgaggacgatgcaactgtgtctacaccttatactgctgcagttttggagtaccgggttgttattcatgatccattggaagcatctgtcgacgaaaagaagtggcataatgtaaatggtcacgccattgtggatgctcaacatccagtcagggcaaatgtggctgtgagaaaggagcttcatactcctgcatctgatcgatcttgcactcatttggaatttgacatttcaggcactggagttacatatgaaactggggaccatgttggtgtttactgtgagaatttgtctgaaactgtggaagaggcaataaggttaataggtttgtcaccagatacctatttctcaatccatactgatgatgaagatggcaaaccacgtagcggaagctccttgccacctacattcccaccctgtactctaagaacagcacttacacgatatgcagatgttttgagttcacccaaaaagtctgccttgcttgccttagctgctcatgcatctgatccatctgaagctgatcgactaagacatcttgcctcacctgctggaaaggatgaatattcagagtgggtgattgcctctcagagaagtctccttgaggtcatggctgaatttccatcagccaaacctccaattggtgtcttttttgcagcagttgctcctcgcctgcagcctagattttattcgatctcctcatctccaagaatggtgccaaacagaattcatgttacctgtgcattagtacatgagaaaatgcccaccggaaggattcacaaaggagtgtgttcaacatggatgaagaattctgtaccattggagaaaagccaggactgcagttgggctcctatttttgttaggacctccaactttagactcccttctgataataaagtgcctataatcatgattggtcctggcactggattggctcctttcagaggtttcttgcaggaaagattagctctgaaagaaggaggagctgaactcggcccctcagttttattctttggatgcaggaaccgtcaaatggactacatctatgaagacgagttgagtcacttcgttaatactggcgcacttgatgagctcattcttgccttctctcgagagggacccaccaaggagtatgtacaacataaaatgatggagaaggcttcagaaatttggagcatgatatcacaaggagcttacatttatgtgtgtggtgatgccaagggcatggccagggatgtacaccgcgccctgcacacaattttgcaagagcagggttctctcgatagttccaaggctgagagcatggtaaagaatctacaaactactggcagatatttgcgcgatgtatggtgatgatatctgaatgcaagccgtgggggtgacgaagatattaataaaacatagagttgtggctagaggattttgaaagggccttatttgtgccacctttcattagtgccctcaaaattgagggggggcgcttgttgccatcacgacgacatttcctacgattctttttcactatattttctaaaggattctttttggttcgtgtaatttattatatactgtttatacctagactatgaactattttacttcagttttctttttgtaatgtatgatgaacctcaaagaaaggttcagagacgcagacaattccttgtactgtatgaactataaaaaaatgtttggaggtaaagaaattattttgtgc

SEQ ID NO: 8453 - DNA, 2545 bp, Pisum sativum
tcgagcgccgcccgggcaggtctcacacaagagtctctctctctcctctctctctctctctcatctacttcatacctaccagagagactcttccattcaattattcaatcatgcaagattcaagtacaatgaaattttctccactggatctgatgaccgccataatcaaaggcaagttcaatccatccaatgattcatctcaggctccggcttcaatcatattcgagaatcgcgagtttgttatgatcttaacaacttcaatcgccgttctcatcggttgcgtcgtcgttttaatatggcgcagatccaattccaataaatctaagcaaattgaagttcccaaacttgtaatcaagaagcttccggaacttgatgtcgatgacggtaagaaaaaggtcaccgtcttctttggtactcaaaccggcaccgccgaaggtttcgccaaggcgatagcggaagaggctaaagcgcgttacgagaaggccaagtttagagttgttgatatggatgattatgcggctgatgatgatgagtacttggaaaaattgaaaagggagacaatggctcttttctttttagctacatatggggatggtgagccaactgataatgcggcgcgattttataaatggtttacggaggaatatgaaggggaagaagattcgtttaagaatcttagttatggtgtgtttggacttgggaataggcagtatgagcattttaacaaggtggcaaaggtagtagatgataagcttcttgagcaaggtggtaagcgtcttgtcccagtgggtctaggagatgatgatcaatgcatagaagatgattttactgcatggaaagaagaactatggccagcgttggatcaattgctaagagacgaggatgatacacctgtagccacaccttatactgctgctgtttcggagtaccgggttgttattcatgacccattagatgcaactgttgacgaaaagaagcggcataatgtaaatggccatgctgttgtggacgctcaacatccagtcagagctaatgtggctgtgcgaagggagcttcatactcctgcatcagatcgttcttgcactcatttagaatttgacatttcaggcactggagttgtatatgaaacaggggaccatgttggtgtttactgtgagaatttatcagatactgtggaagaggcagaaaggatactaggtttgtcaccagacacctatctctccatccatactgatgatgaagaagggaagcctcttggtggaagttccttgcctcctcctttcccaccatgtactctaagaactgcacttactaaatatgcagatcttttgagttcacctaaaaagtctgccttggttgccttagctgctcatgcatctgatccatctgaagccgatcgactaagacatcttgcctcacctgctggaaaggatgagtatgcagagtgggtgatttcctctcaaagaagtctccttgaggttatggctgaattttcgtcagccaaacctccaattggtgtcttttttgcggcagttgctcctcgcctgcagcccagatattattcaatatcatcatctccaagaatggcgccatccagaattcatgttacctgtgcattagtgcatgataaaatgcccactggacggattcataaaggagtatgttcaacttggatgaagaattctgtaccattggagaaaaatcaggactgtagttgggctcctatctttgttaggcagtccaatttcaggctcccagctgataataaagtgcctgtaattatgataggtcctggcactgggttggctcctttcagaggtttcttgcaggaaagattagctctgaaagaagatggagctgaactgggcccctctgttttgttctttggatgtaggaaccgtcaagtggactatatctatgaggacgaattgaaccactttgttaacggtggcgcactttctgagctcattgtcgccttctcacgagatgggcctacaaaggaatatgtccaacataaaatgatggagaaggcttcagatatttggaatatgatatctcagggagcttacgtttatgtgtgtggtgatgccaagggtatggctagggatgtacaccgcactttgcacacaattttgcaagagcagggctctttggacagttccaagactgagagcatggttaagaacctacaaatgactggcagatatctgcgtgatgtatggtaatgaagaaccgggtaatctatattgagactagtagtggatagaagataagatattgatgcccctcaacagagagaagtgattatttctgcatgttacatcatgtcaacaattcttatgattctttttttgttcgtgttacttatactttgtttatacatatagattatgtattttacttttcttgtattgtaagaacctgtaaggagggttcagagattcagacaattccttgtattgtaacctataataaaattatttgcagaaaaatatattttttctgtgagtgttattattaaaaaaaaaaaaaaaaaaaaaaaaaa

SEQ ID NO: 8454 - DNA, 2735 bp, Glycine max
ctgggttggtgggcgttgttggttcagtgttgtgttgtgttgtttccctcccaacaatataacctcctctctcccacccttttctttcttcagagtctctctctcaactcccaactactttgttgcattacacgcaccaaccagagagtgagagagagagaagagactcttccttccttcaatttcttcaaccaccaccagcatgcaagactccggctccatgaagatctcccctctggatctcatgtccgccatcatcaagggcaagctcgacccctccaacgtctcctcctcctcctccaacgccgcagctgccgtcctcctcgagaaccgccagttcctcatgctcctcaccacctccgtcgccgtcctcgtcggctgcttcgtcgtcttcatctggcggagatcctcctcccccaaggccaagcctctcgaaccaccaaagcgcgttatcgagaagcttcccgaaatcgaggtcgacgacggcaccaagaaggtcaccatcttcttcggcactcaaaccggcaccgccgaaggcttcgccaaggccatagcggaagaggccaaggcgcgatacgataaggccacgttcagagtagtcgatatggatgattatgctgccgatgacgatgaatacgaggaaaggttcaaaaaggagactcacgctcttttctttttagctacatatggtgatggtgagccaactgataatgcagcgagattttataaatggtttacggaggggggtgagaaaggagaaggatggcttgagaatcttcactatggtgtgtttggccttggaaacaggcaatatgagcattttaacaaggtggcgaaggtagtggatgacatgcttgctgagcaaggggggaagcgtcttgtgccagtgggcctaggagatgatgatcaatgcattgaggatgactttactgcatggaaagaagaactctggccagcattggatgacttgcttagagatgaggacgatacaactgtgtctacaccatatactgctgctgttttagagtaccgggttgttattcatgatccattggaagcttctgtcgacgaaaagaagtggcataatgtaaatggtcatgccattgtggatgctcaacatccagttagggcaaatgtggctgtgagaaaggagcttcatactcctgcatctgatcgatcttgcactcatttggaatttgacatttcaggcacgggagttacatatgaaaccggggaccatgttggtgtttactgtgagaatttgtctgaaactgtggaagaggcgataaggttaataggtttgtcaccagatacctatttctcaatccatactgatgatgaggatggaaaaccacttggtggaagctccttgccacctacattcccaccctgtactctaagaaaagcacttgcacaatatgcggatgttttgagttcacccaaaaagtctgccttgcttgccttagctgctcatgcatctgatccatctgaagctgatcgactaagacatcttgcctcacctgctggaaaggatgaatattcagaatgggtgattacctctcagagaagtctccttgaggtcatggctgaatttccatcagccaaacctccaattggtgtcttttttgcagcagttgctcctcgcctgcagcctagattttattcaatctcctcatctccaagaatggtgccaaacagaattcatgttacctgtgcattagtacatgataaaatgcccactggaaggattcacaagggagtgtgttcaacatggatgaagaattctgtgccattggagaaaagccaggactgcagttgggctcctatttttgttaggacgtccaactttagactccctgctgataataaagtgcctataatcatgattggtccaggcactggattagctcctttcaggggtttcttgcaggaaagattagctctgaaaggagggggagctgaacttggcccttcagttttattctttggatgcaggaaccgtcaaatggactacatctatgaagacgagttgaatcacttcgttaatactggtgcactttctgagctcattcttgccttctctcgagagggacccaccaaggagtatgtacaacataaaatgatggagaaggcttcagaaatttggagcatgatatctcaaggagcttacatttatgtgtgtggtgatgccaagggcatggccagggatgtacaccgtgccctgcacacaattttgcaagagcagggttctctcgatagttccaaggctgagagcatggtaaagaatctacaaactactggcagatatttgcgcgatgtatggtgatgatatctgaatgcaagcctcggggtgacgaagatattaataaaacctagagttatggctataagatattgaaagggccttatttgcgccacctttcatagtgccctcaaaattgatgggggttcttgttgccatcccgacaacatttcctaccattctttttcactatattttctaaagaattctttttggttcgtgtaatttatatactgtttatacctagactatgaacgatttactttagctttcatgtaatgtatgatgaacctcaaagaaaggttcagagacgcagacaattccttgtactgtatgaactataaaagaatgtttggaggtaaagaaactattttgtgcaagtgttattactagatttaaatttaatatcccaaaaaatgcaataatcccatgc

SEQ ID NO: 8455 - DNA, 2106 bp, Medicago truncatula
atgcaagattcaagctcaatgaaattttctccacttgatctaatgtcagcactaatcaaaggcaaaatcgatccatccaatggaaccgttccagcttcactcatacttgagaaccgcgaattcgttatgatcttaacaacttcaatagctgttctcatcggttgcgtcgtcgttttaatttggcgtagatccaattctcaaaaaccaaaaccaattgaagttcctaaacgcgttatcgagaaacttcctgaacttgaaatcgatgacggtaccaaaaaagttaccgttttctttggcactcaaaccggtaccgccgaaggttttgccaaggcgatagcggaagaggcaaaagcgcgttatgagaaggccaagtttaaagtagttgatatggatgattatgctgctgatgacgatgaatacgaggagaaattaaaaaaggagacaatggctcttttcttcttagctacatatggtgatggtgagccaactgataatgccgcgagattttataaatggttcgaggaatttgaaggggaagaagattcgtttaagaatcttcagtatggtgtgtttggacttgggaacagacagtatgagcattttaataaggtggctaaaatagttgatgataagcttcttgagaaaggtgggaatcgtcttgtccccgtgggtcttggagatgatgatcagtgtatagaagatgattttactgcatggaaagaagaactatggccagcgttggatcaattgctaagagatgaggatgatgcaactgtggctacaccttatactgcttctgttttggagtaccgggttgttattcgtgatcaattggatgcaactgtggacgaaaagaagcagcttaatggaaatggccatgctgttgtggacgctcatcatccagtcagggctaatgtggctgtgcgaaaggagcttcatactcctgcatcagatcgttcttgcactcatttagaatttgacatttcaggcaccggagttgtatatgaaacaggggaccatgttggtgtttactgtgagaatttatccgacactgtggaagaggcagaaaggatactaggtttgtccccggacacctatttctccgtccataccgatgacgaagatgggaaacctcttggtggaagctccttgcctcctcctttcccaccctgtactttaagaacagcgcttgctaaatacgcagatgttttgagttcacctaaaaagtctgccttgcttgccttagctgctcatgcatctgatccatctgaagcggatcgactaagacatcttgcctcacctgctggaaaggatgagtatgcagagtgggtgattgcctctcaaagaagtctccttgaggttatggctgaattttcatcagccaaacctccaattggtgtcttttttgcatcagttgctcctcgcctacagccaagatattattcaatttcatcatctccaagagtggcaccatccagaattcatgttacctgcgcgttagtgcatgataaaatgcccactggacggattcatcaaggagtgtgttcaacttggatgaagaattctgcaccattggagaaaagtcaggactgtagttgggctcctatctttgttaggcagtccaatttcagactccctgctgataataaagtgcctataattatgataggtcctggcactgggttggctcctttcagaggtttcttgcaggaaagattagctttgaaagaagaaggagctgagctaggcccctctgttttattctttggttgcaggaaccgtcaagtggactatatctacgaagatgaattgaaccatttcgttcatggtggcgcactttctgagctcattgttgccttctcacgagaggggcctactaaggaatatgtccaacataaaatgatagagaaggcttcagatatttggaacatgatatctcagggagcttacatttatgtgtgtggtgatgccaagggtatggctaaggatgtacaccgcactctacatacaattttgcaagaacagggctctttggacaattccaagactgagagcatggttaagaacctacaaatgactggcagatatttgcgtgatgtatggtaa

SEQ ID NO: 8456 - DNA, 2880 bp, Vitis vinifera
ttctttgtagggagagcctctcaattcaactatcacccacctacacacacccaactcaccaaatcattgcttcaatttttgttgttctgtgagttgggggggctctctcttttgattcttcctctcggaaaatatatttatcttttctacaatttggatctgtttggtttgctccgattctagtttttcgtttaataattcgggaggatttggtgttccggcgaagcgtccggaatcatcatgcaatcgagctctgtgaaggtgtcaccgtttgatctgatgtcggcgataatcaagggaagcatggaccaatcgaatgtgtcgtcagagtcgggcggcgctgccgcgatggtgttagagaaccgggagtttatcatgatcttgacgacgtctatcgcggtgttgatcgggtgcgttgtggtgttgatatggcggagatccggccagaagcagtcgaagacgccggagcctcccaagccgttgattgtgaaggacctggaagtggaggtggatgacggcaagcagaaggtcaccatcttcttcggaacacagacgggaactgcggaaggcttcgctaaggcccttgctgaagaagccaaagctcggtatgaaaaggcgatcttcaaagttgttgatttggatgattatgctggtgatgatgacgagtatgaagagaaattgaagaaggaaactttgggcttcttcttcttggctaggtatggagatggtgagccaaccgataacgcggccaggttttataagtggtttgcagaggggaaagagagaggggaatggcttcaaaatcttaaatacggagtgtttggccttggaaataggcaatatgagcatttcaataaggttgcaaaggtggtcgatgatatcattaccgagcagggtggaaagcgcattgtcccagtgggtcttggggatgatgaccaatgcattgaggatgacttcgctgcatggcgtgagttgctgtggcctgagttggatcagttgcttcgggatgaggatgatgcaacaactgtttctaccccttacacagctgctgtgttggaatacagggttgtatttcatgacccagaaggtgcatcactgcaggacaagagctggggtagtgcaaatggtcatactgttcatgatgctcaacatccatgcagagctaatgtggctgtgaggaaggagcttcatacccctgcatccgatcgttcttgtacgcatctggaattcgacatatctggcactggacttacatatgaaacaggagatcatgttggtgtgtactgtgagaatctgcctgaaacagtggaggaggctgaaaggttgttaggtttttcaccagatgtttacttttccattcataccgaaagagaggatggcacaccacttagtggaagctctttgtcacctcctttcccaccatgcactttaagaacagcactaactcggtatgcagatgttttgagttctcccaaaaagtctgctttggttgctctagccgcccatgcttctgatcccagtgaagctgataggttgaaatatcttgcatctccttctggaaaggatgaatatgcacaatgggtagttgcaagtcagagaagtctccttgagataatggctgaattcccatcagccaagcctccacttggagttttctttgcagcagttgctccacgcttgcagcccagatattattccatatcatcttccccaaagatggtgccatctagaattcatgtcacttgtgccttggtttgtgataagatgcccacaggacggattcacaagggtatttgttcaacttggatgaagtatgctgtgcccttggaggaaagccaagattgcagctgggcgccaatttttgttaggcaatccaacttcaaacttcctgctgatacttcagtgccgattatcatgattggccctggcaccggattagctccttttaggggtttcctgcaggaaagatttgctcttaaagaagctggagcagaactaggatcatccatattattctttggatgcaggaaccgaaaaatggactacatttatgaagatgagctgaatggctttgttgaatctggtgcgctctcagagctgattgttgctttctcacgtgaaggacccaccaaggaatatgtacagcataagatgatggagaaggcgtcggatatttggaatgtaatttctcagggaggctacatttatgtctgtggtgatgccaaaggcatggcaagggatgtccacagaactcttcataccatcttgcaagagcagggatctctagacagctccaaggctgagagcatggtgaagaatctgcaaatgactgggaggtatctacgtgatgtgtggtgattactcttctatgcaggcttcggtagaaaaaggaaaatgaagggaaaaaaaataaaattgcgtaaaacattattttaccgaggccaaattgtcgggataaaccgagtacatgggaaggccttgaaatccttcaggcagaaattgcagtttgtccctatagtgattggttctgtgattctttttactctttccttaagaggaatttttttgttcatgtaatttatatatatattattattgataataatttctaggcatagttactggactttgtaattttccttatatgaaccaacaagaaggttcaaatgacaaacaaagacttcgattttcgggttcctaatgtaattctcttcttgggttgatttatttttgcttgggacaaactatattcacttgtcttgtgcaaaactattgaaattaagggtctttttggataggaataggctgtaatgaaaaatgagatgttaatggagaattttccattcacagaataaaatgtaggtttcagtagatttctat

SEQ ID NO: 8457 - DNA, 2653 bp, Gossypium hirsutum
tgcaggtcgacggtccgctctcaaagtctcaaccaccacggaattcccatatttcattttaaacaaacaaaactgagagagcttctcccctgccaattcttcatttcttcatttatacacttgctctaatctctcaaacaatggattcttcatcatcatcatcatcttcaggtccctcacctctcgatctcatgtcggctttagtcaaggccaaaatggacccttccaacgcttcctccgactctgctgctcaagtaaccaccgtccttttcgagaacagagagttcgttatgattttaactacctccattgctgtgctcatcggctgcgtcgtcattttgatctggcgtagatccgcttctcaaaagcctaaacaaatccagcttcctcttaagccttcgatcattaaagaaccagaacttgaagttgacgatggaaagaaaaaagtcaccatcctcttcggtactcaaaccggcaccgccgaaggcttcgctaaggctctagtcgaggaggcaaaagcacgctatgaaaaggcgacttttaatattgtagatttggatgattatgcagcagatgatgaagaatacgaggagaagatgaagaaagataatttggctttcttcttcttggccacttatggagacggtgagccaacagataatgcagccaggttctataaatggttcactgagggaaaagagaggggagaatggcttcagaacatgaagtatgggattttcggccttggtaacaaacagtatgaacattttaacaaggttgcaaaggtggttgatgaactccttaccgagcagggagcgaagcgcatagttcctttgggtcttggagatgatgaccaatgcatagaagatgacttcactgcatggcgtgaattagtgtggcccgagttagatcagcttctgcgtgatgaagatgatgcaactgtttctaccccgtacactgctgctgttttggaataccgtgttgtattttatgatcctgcagatgcaccccttgaggataagaactggagtaatgcaaatggtcatgctacttatgatgctcaacatccttgcaggtctaatgtggctgtgaggaaggagcttcatgctcctgaatctgatcggtcttgcacccaccttgaatttgacattgctggaactggactttcatacgagacaggcgatcatgtcggtgtttactgtgagaacctggatgaagttgtagatgaagcattgagtttactgggcttatcacccgacacttatttctctgttcacactgataaagaggatggtacaccacttggtggaagttctttaccttcttctttccccccttgtactctgagaacagcactggcacgatatgctgatcttttgagctcgccaaaaaaggctgccttacttgctttggctgctcatgcctctgatccaactgaagccgatcgactaagacaccttgcatcacctgctggaaaggatgagtatgctcaatggattgttgcaaaccagagaagtctccttgaggtcatggcggaatttccttcagccaagcctccacttggtgttttctttgcagctgttgctccaaggttgcagcctagatattattcgatatcatcctcaccaaggttggcaccatcaaggattcatgtaacttgtgcattggtttatgagaaaacgccaacaggtcgtattcacaaaggtgtttgttcaacttggatgaagaatgctgtgtcctcggggaaaagcgatgactgcggctgggcacccatttttgtcaggcaatcaaactttaaacttccttcagatactaaagtgcccatcataatgattggtcctggtactggattggctcctttcaggggattccttcaggaaaggcttgcactgaaagaagctggtgctgagttgggtccatctgtattgttctttggctgcagaaaccggaaaatggatttcatatatgaagatgagctcaacaactttgtcaacagtggtgcactatctgagcttgtggttgccttttcacgtgagggacctaccaaggaatatgtgcaacataaaatgatggagaaggccaaggacatatgggacatgatttctcagggaggttacctgtatgtgtgtggtgatgccaagggcatggctagagatgttcatcgagctcttcacactattttccaagagcagggatcactagacagctcaaaggctgagagcatggtgaaaaatctgcaaatgagcggcaggtacctacgcgatgtatggtgatgattacgatgaaagaaactttataaaaatatacggcggtcaaaaagaaacttgcgagaagggttaaatgggtggaattgaatttattttgtatcaaagttaagaagtgttgcgattcttttatatatatattagtgtcgggataattttggatgatatgatgtaatattttaatatagaagacaatgtaatataatggagaaggtagagtaatggtattggaatttgtcttttataagaaagaaccggcaaatcggttcaaatgacaagcagcaagtgttgcttgctactccgaaatgttactcgaactcttcctatatactggtaatatatgttttaagtttggaatctcaaaaaaaaaaaaaaaaaaaaaaaaaaaa

SEQ ID NO: 8458 - DNA, 2610 bp, Populus trichocarpa x Populus deltoides
ctctgcctacgcccaccaaccatacaacaagcaagaagcagagagagatcttttttcctccttgaagaagaagagtagtaataagaaggaactggtttgtgaatctttgtaaacaacatggagtcatcaagcagctcgatcaaagtgtctccacttgatcttatgcaagccataatcaaaggcaaagtggaccccgcgaatgtttcatcggagtccggtggttctgttgctgaggtagcaactttgatcctcgagaatcgtgagtttgttatgatcttaactacttccatcgctgttttgatcggctgcgtcgtcgttttgatttggagaagatcatctgggtatcagagacccaaagtacctgtgcctcccaagcccttgattgttaaagaccttgaacctgaagttgacgatggcaagaaaaaggtcaccatctttttcggcacccaaaccggtacggcagaaggatttgctaaggctctagctgaggaggcaaaagctcggtatgacaaggctacatttaaaactgttgatatggatgattacgcgggtgatgatgatgaatacgaagagaaattgaagaaagaggatctggttattttcttcttggccacatacggagatggtgagcctactgataatgcggcaaggttctacaaatggtttacagagggaaatgagagaggggaatggctcaaggaccttccatatgcagtttttggccttggcaacaggcagtacgagcattttaacaagattgctatagtggtggataaaatctttgctgaccagggtgggaagcgccttgccccagtgggtcttggtgatgatgatcaatgcatggaagatgactttgctgcatggcgggaattgttgtggcctgagatggaccagttgcttcttgatggagacgatccaacagctgtttctactccttatgctgccactgtatcagaatatcgggttgtattccatagccctgaagatgccccattagaggatgataactggagtaatgcaaatggccatgctgtctatgatgctcagcatccatgcagggctaatgttgctgtgaggagggagcttcataccccggcatctgatcgttcatgtacccatctggagtttgaaatatcaggcaccggacttgcatatggaactggggatcatgttggtgtgtactgtgaaaatctaagtgaaactgtagaggaagcactgcagttgttgggtttatcaccagatacttatttctctatccacaatgataatgaggatggcacgccacttagtggaggcgccttgccacctccattcccaccgtccaccttaaaaactgctctagctcgatatgctgatcttttgagtttgcccaaaaagtctgctctaatggctttagcagctcatgctactgatccaacagaagctgatcgactaaggcatcttgcatcgcctgctgggaaggatgaatatgcacaattgttagttgcaaatcagagaagcctccttgaggtcatggctgaatttccatcagccaagcccccacttggtgtcttctttgcttcagttgcacctcggttgcagccaagatactactctatttcatcatctccaaggatggctccatcaagaattcatgttacatgtgcactggttcttgagaaaacactaggaggtcgtattcacaaaggagtttgctcaacttggatgaagaacgctgtgcctctggagaaaagccatgattgcagctgggcacctgtttttgttaggcaatcaaacttcaaacttccagcagatgctaaagttcccatcattatgattggccctggaactggtttagctcccttcagaggtttcctccaggaaagattagccctgaaagaagcaggatcagaactgggatcctctgtattattctttggttgcaggaaccgcaaaatggattttatctatgaagacgagctcaacaacttcgttgaaagtggtgcactttctgaactagttgttgccttctcccgtgagggacctaccaaggaatacgtgcagcataagatgatgcagaaggcttctgatatctggaacatgatttcacaaggtggatatttatatgtttgtggtgatgccaaaggcatggctaaagatgtccacagagcgctccacactattgtgcaagagcagggatcccttgacaactcgaagacggaaagctttgtgaagagtctgcaaatgaatggcaggtatctacgtgatgtatggtaattaatcgttcgtgtaggccatgaagaaaggagggtgatgtgaaagtttactctataaataccgaagccttactggaattgaaggaattttaagcgagaggctacttttgacgcctgccttgtgtcccttcaagtggtcatcgaacgtgctatcattatagcaaattgtgattcttttctctcttctctcacgaaggaattttttggtcttgtaatttatatatacataatgtaataaatgagtagcagccctagttcatgacttcattttccttttgatgaacccaacaaaatggttcaaatgacagacaaatattcttgttgtacgtctaagtgtttgtatgaatggatgatg

SEQ ID NO: 8459 - DNA, 1832 bp, Glycine max
atggagattcaacaaagcttgaagctcacaatccacaagaaatggccatcatcacccaaaaaaccacctaaagaaacagaaccaataaccaccaccccaactactccaaagctgaaatggaagaaaatcttcttccaaaccaaaaccaaaacccaaactcaaacacccccagaagaattcctctgccctatttctcattccctcatgttcgacccagtcatcgtctcctccggccactccttcgaacgctcctccgtggaagcctgcataaatgtcaattttacccctcaactccccgacggcaccacccccgatttctccaccctcatccccaacctcgccctcaaatccgccatcctcaaatggtgccaatccacccacacaccaccccctccacaccccaacaacaacaacaaccacctcgtacaaaccttaatctcctcgaacccaagcctcaaaatctccgaccaagatttgattttgaattctctgaacgaaaacccaccactgacgaacctccgccaccacgcggaaaccgaggttccgataagacggacacatttgtacacaagttccgatgaatccatagcgacaacgtcagcctcaacgccgccacttcaactctccacgcgcccaagctgctgctactactcttcaccttcgtcttcagaactcgaacccgccacaaccccagaagaagaagaaatcatgacaaagctcaaaaaccctcaacacagtataatcgaagaagcgcttatctctctcagaaaactaacgagaataagagaagaaacaaggcttcaactttgcactcctcggttactctccgcgttacgttccctcgttttgtcgaagcacgtgaacgttcaggtgaacgctcttgcatcggtggtgaacctatcgttggagaaaagtaataaggtgaggatcgtgcggtcggggatggttccgccgttgatcgaggttttgaagtttggatcctctgaggcgcaggagcacggtgcgggcgcgctgtttagtttggcaatggatgatgataacaaaaccgcgattggggttttgggtggtttggctccgttgcttcacatgctccgatccgagagcgagcggactcggcatgactcggctttggcgctttatcatttgtctttggttcagagtaaccggtccaagatggttaaactcggttcggttccggttcttttgagcatggttaaatcgggtcatatgatgggtcgggttatgttgatattggggaatttgggttccgggtcggacggccgggccgcaatgttggatgcgggtgtggtggagtgtttagtggggttgctcagtgggcccgaaccggggaccgggtcaactcgggagagttgtgtggcagtgatgtatgcactgagtcacggcgggttgaggtttaaggcggtggcgaaggcggccggggtggtggaggtgttgcaaaaggtggagaagatggggagtgagagggccaggcggaaggtgaggaagatattggagataatgaggacaaaggaggtggaggaggaggatgtggattgggaggagttgctagactcggggttgggttgccggactcggagtagactcggtggtgggttggatgagtcaagtgcaaactcggccgagttttgagtaaagttgatttttttttataaaaaaaatgtaaatgtttgattttttaagattatgttgttattaaggttcttttggttcacatgcttttttggatttttcttttaaaaaaatccattgtttttatgatttttgaagttggatgaagaattgataaatgggagtattttttttttaatttg

SEQ ID NO: 8460 - DNA, 2210 bp, Glycine max
aattgggcagattttccaaaagcaaaggaaccaaacctctctctctctctctctctcccacacccttccctgcaactgcaacaccgagtcatcacttcggtcacacacacactttcctctctactcttcaacacacctaaaagcccaaaacactatcacctaattttagtaaccccatcaactcaaaactcacaaaagacccaatgttattgaaactccgatgacacccctcaattaactctctcacattcaaccgtgtgagagagggcataacttgaaccatcccaatggagattcaacaaagcttgaagctcacaatccacaagaaatggccatcatcacccaaaaaaccaccaaaagaatcagaaccaataacccccacccccaacacaccaaagctgaaatggaagaaaatcttcttccaaaccaaaaccaaaacccaaatacaaaccccaccagaagaattcctctgtcctatttcgcgttccctcatgttcgaccccgtcatcgtctcctccggccactcctacgaacgctcctccgtcgaagcctgcaaaaatgtcaattttacccctcaactccccgacggcaccacccccgatttctccaccctcatccccaacctcgccctcaaatcagccatcctcaaatggtgccaatccacccacacacctcctcctcaccccaacaacaaccccgtacaaaccttaatctcctccaaccctaacctcgtacacaccataaacccctcgaacacaaacctcaaaatctccgacaaagatttgattttgaattctctgaacgaaaacccaccagtgaagaacctctgccaccacgcggaaaccgaggttcccataaggccgacacacttgtacacgagctccgaggaatccatagcgacaacctcggcctcaacgccgccgcttcagttctccacgcgcccgagctgctgctactactcttcaccttcgtcttcagaactcgaacccgcgacaatcccagaagaagaagagatcatgacaaagctcaaaaaccctcaactcaatgcaatcgaagaagcgcttatctctctcagaaaactaacgagaataagagaagaaacaaggcttcaactttgcacccctcggttactctccgcgttacgctcactcgttttgtcgaagcacgtgaacgttcaggtgaacgctctggcatcggtggtgaacctctcgttggagaagagtaataaagtgaagatcgtgcggtcggggatggttccgccgttgatcgaggttttgaagtttggatcctctgaggcgcaggagcacggtgcgggcgcgttgtttagtttggcattggatgatgataacaaaaccgcgattggggttttggggggtttggcaccgttgcttcacatgctccgatccgagagcgagcggactcggcatgactcggcattggcgctttaccatttgtctttggtccagagtaaccgatccaagatggttaaactcggttcggttccggttctattgaatatggttaagtcgggtcacatgacgggtcgggttttgttgattttggggaacttgggttccgggtcggacgggagggccacgatgcttgatgcgggcatggtggagtgtttggtggggttgctcagtggggccgagtcaaggagcgggtcgactcgagagagttgcgtgtcggtgatgtacgcgctgagccacggcgggttgaggtttaaggcagtggcgaaggtggctggggtgatggaggtgatgcaaaaggtggagaaggtggggactgagagagctaggaataaggtgaggaagatattggagattatgagggccaaggaagtggaggaagaggatcatgtggattgggaggagttgctcgactcgggattgccttgccggactaggactagactcggtgctgggttggacgactcaactcctaactcggcccagttttgagtacagttgaatattttgttaaaatgtaaatgtttggttttttaagattaggttgttaattaaggttcttttggttcacaggctgcttttggattcttcttctaaaaaaaaaaattccattgtttttatcatttttgaagttggatgaagaattggtaaatgtgagtattttctttttaatttgatttatatgtattatcagtgtaaattgttttacttaattataattttgattttcttagttttatg

SEQ ID NO: 8461 - DNA, 1112 bp, Glycine max
acatacaaaagaggttatcccatctctcctcgttatttttgctgtcctcttttgaatcatgacgctcttatcctctcacctacttgtcttctccgccgtccaccaccgtgcgccgccgaccaccaccacccggaacagcccaacaacaaaccacactgtgcggtttctgtgttctcccggcgtgccgccagctgtccgcttggatcaaaggttgccgcgctttgttgtccccggcgccggagcagaagatctgctctacaatgccggagccaccgtcggcgttcttggcggcggttacgccctcgtccgtgcctttgacgaactcactcggagaaacatcctccaacagggtctgagcagaaagctggtccatatattatctggcttgctttttctggtttcttggcctattttcagcaactcccctaaggctcgctactttgccgcttttgttcctctcgtcaattgcttgaggcttttggtcaatggtctctcactggcttctgatgagggactcatcaaatccgtcaccagagaaggagatccactagaattgctaaggggtcccctttattatgttctgatactgattttatctgctcttgtgttctggcgtgagtctccaattggtgtgatctccttggcaatgatgtgtgcaggggatggcatagctgatatcattggtagaagatatgggtccatgaagattccctacaatgaacataagagtttagccggtagcatgtctatgcttgtctttggattcttggtttcaatagggatgctctactactattcagttttaggacatgtgcagttggattgggcaagcactctgcccagagttgcttttatttctttcgtggcaacattggtggagtctcttcccattactaaggtagtagatgacaacatttctgttccactagctaccatggcagtggcatttttcactttccatcattaactcttaggagtctactggtctagttcccctgtaatgtcttacttgccttccctatccaattttttcctgctagtgcgacaatatgaaatttagtttgttccttgtaaagaaattagtgaaaattttatagcataaagaatgggtc

SEQ ID NO: 8462 - DNA, 897 bp, Glycine max
atgacgctcttatcctctcccctacttgttttctccgccgtccaccgtcgtgctcctccgccatccaccaccaccccaaccacaaaccacactgtccggtttctgtgttctcccgacgtgccagctgtccgcttggatcaaaggttgccgcgctttgttgtccccgtcgcagcagaagatctgctctacaatgccggagccaccgtcggcgttctcggcggcggttacgctctcgtccgtgcctttgatgaactcactcggagaaacatcctccaacagggtctgagcagaaagctggttcatatattgtctggcttgctttttctggtttcttggccaattttcagcaactcccctaaggctcgctactttgctgcttttgttcctctggtcaactgcttgaggcttttggtcaatggtctgtcactcgcttctgatgagggactcatcaaatctgtgaccagagaaggagatccactagaattgctaaggggtcccctttattatgttctgatactgattttttgtgctcttgtgttctggcgtgagtctccagttggtgtggtctccttggctatgatgtgtgcaggggatggtatagctgatatcattggtagaagatatggatccttgaagattccttacaatcaacataagagtttagctggtagcatgtctatgcttgtctttggattcttggtttcaattgggatgctctactactattcagttctaggacatgtgcagttggattgggcaagcactgtgcccagagttgcttttatttctttcgtggcaacattggtggagtcccttcccattactaaggtaatagatgacaacatctctgttccactagctaccatggtagtggcatttttcactttccatcattaa

SEQ ID NO: 8463 - DNA, 2917 bp, Glycine max
  misc_feature (1598)..(1615): n is a, c, g, or t
atggcttcttctacggttgttcccgttcctcctgttccagttgagggcggaaagccaagccgcggcgttagcattcggtctcgcctaagcaaactgtgccaacagggacaacctcacttggcacgccatcttctggacacgcttccacgtgcctcctccgcggtctggaacaccgtcatcatcggcttcatctgcaaccacatgcctttggaggccctccatctgtacgcggaaatgaagtccagcccggacaccccttccgattgctacaccttctcttccaccctcaaggcctgctccctaacccagaacctcttggccggtaaggccattcattcccattttcttcgctcccaatccaactctcgaatcgtctacaactccctcttgaacatgtactccgtctgcttgcccccctccactgttcaatcccaactcgactacgtcctcaaagtgttcgcctttatgcgcaaacgaaacgtcgtcgcctggaacaccttgatttcctggtatgtcaaaacccacagacagcttcacgcacttcgcgccttcgccaccctcattaaaacttccatcactcccactcccgttactttcgtcaatgtcttccctgctgtccccgatcccaaaaccgctcttatgttttatgccttgcttcttaaatttggtgctgactatgccaatgacgtcttcgctgttagctccgcaatcgttatgtttgctgatcttggttgcttagactatgctaggatggtttttgaccgttgttccaacaaaaatacagaggtttggaataccatgattggtggttatgttcaaaataactgtccccttcaagggattgatgttttccttcgagccttggagtcagaggaggccgtgtgcgatgaggtcacttttctgtccgttatctgtgctgtttcgctgctgcagcaaattaaattggctcagcagctgcatgcatttgttcttaaaagtttggcagttactcccgttattgttgtcaatgctatcatggttatgtactccagatgcaattttgttgatacttccttgaaggtttttgataacatgcctcaaagggatgctgtttcgtggaatactataatttcttcctttgtacaaaatggtttggatgaggaagcactcatgcttgtgtgcgagatggagaagcagaagtttcccattgattccgtcactgcgacggcccttctttctgcggcttctaacattaggagctcttacattggaaggcaaacccacgcatatctaattcgccatgggatacagtttgagggtatggagagttatctgattgatatgtatgcgaaatccaggttggttaggacttctgagttgttatttgagcagaactgcccaagtgatagagatctggccacatggaatgctatgattgctggttatacacagaatggtctcagcgataaagccattctcattcttagagaggcattagttcacaaggtaatgccaaatgcagtgaccttagcatcgattctcccagcttgtagttcaatgggaagcacaacctttgccaggcaacttcatgcatttgccatacgacattctgacgatcnnnnnnnnnnnnnnnnnnaagctcttgccttgtatgattcgatgctgagatgtgggattaagcctgatgcagttacttttgttgccatcttgtctgcttgcagttatagtggtttggttgaagaaggtcttcacatatttgagtctatggacaaagtacatcaagttaagccctcaattgaacattattgttgtgttgcagacatgttagggagggttgggagggtggtcgaagcctatgagtttgtccagagattgggtgaggatggtaatgccatagaaatctggggttctattcttggggcctgcaaaaatcatgggtactttgaattgggaaaagttattgctgaaaagttgcttaatatggaaacagaaaaaaggatcgctggatatcatgttttgctctcaaatatctatgcagaggaaggagagtgggaaaatgttgatagagtgagaaatcagatgaaggaaaaaggtttgcaaaaggaaatgggatgtagttgggttgagattgctgggtgtgtgaacttctttgtatccagagatgagaagcaccctcaaagtggtgagatatattatatcttggacaaattgaccatggacatgaaggatgctggttataagccatgcaacaattcaaatttaaataggattttggaatctagtgactgaaatgcatgtattataacaaattttatcaaagtgagctgttggctgctctgcagtgggcagctttcaaaaaattgagtttggttcgttgttacagcagtcacagggttggttataaccaatgatagtttcatgaccagtgcacacatacatgacccgaactgctattggtcattcatttgaaacagttctttcagtgatgaacaacacattcaattcatgtacaataccattgtgcagttgaatagtgacacaagtttgatcctaccttttacccctgatacaagaaatggtgtgatgattactgttatattgagcaccgggatgaaaggagagggctacgagaaatattcctgcgtgggtacccgtcggagagaaaaggtgggattgccctctacagattgacactaaacacgacacggtaataattgtgatgaagacaatacgctagattcaatttgttattgaacttagctcgccggaaaagactctactacatgacatagttgcatattttattaatcaattatcagattgaattgataaatatttacttttcattgaattaggtattagtcaatgtgatgtaattaatcacttgtttagctgaatttcactttagatgtcacaatcacttactaacattcatacc

SEQ ID NO: 8464 - DNA, 2487 bp, Medicago truncatula
atgaatgaaagcaacgcgataaccagaatcggaacttcaccaatcattcctcttccaatttcaacaacacaccccccaaatcaaattcacaccctaccaaatcaaaaacaaaaacaaaaacaaaaacaatggaacaaagctatcagcacaagcattcgttcacgtctcagcaaactctgccgcgaaggtcaacctcatctcgctcttcatcttctcgattctcttcctcgtccttccaccgtcgtctggaactccgtcatcatcggcttcatctgcaacaacttgcctcatcaagctcttcttttatacgccaaaatgagatcaaattcttcttgttctacttttgatccttatacattctcttccactcttaaagcttgtgctttaactaaagatattcttactggaaaagctatacattctcattttcttcgttctcattcgaatactaatactggtcctagtagaattgtatataactctttgttgaatatgtatgcttcttgtcaacatgagtatgcactcaatgtgtttgatgttatgcgtaggagaaatgttgttgcttggaatactttgattttgtcgtttgttaagatgaatcgttatcctcaagcggttgaggcatttgctaatatgattaatcaatctgttatgcctagtccggttacttttgtgaatctttttcctgctttgtcgaaattgggtgattctagaactgtgaagatgttttatgggtttatgaggaaatttggtgatcagtatgttagtgatgtgtttgttgtaagctctgcgatacttatgttttctgatgttggttgtatggattatgcgcgaatggtttttgatcgatgtttgaataaaaatactgagatttggaatactatgattgttgcgtatgttcaaaataattgcccggttgaagcgattgatgtgtttattcaagcgttggagtcggaggagggtgtatgcgatgatgtaactttgctctctgttcttactgctgtttcacagttgcagcaaatcaaattggctgaacagtttcatgcatttgttataaaaagtttgccgggttcgctgattataattttaaatgctgtaatggttatgtactcaaggtgtaatcatgttgatacttcgttgaaggtttttgataagatgttagaaagggatgctgtttcgtggaatactataatatctgcttttgtacagaatggttttgatgaggaagcgcttatgcttgtgtgtgaaatgcagaagcaaaagtttttgattgattctgttaccgcaactgcccttctttctgcagcttctaaccttaggaacttgtatgttggaaagcaaactcatgcttatctgattcgccgtgggatacagtttgagggcatggagagttatttgattgatatgtatgcaaaatccggctcgattaggactgctgaattgttgtttgagcagaactgctcaagtgatagagaccaggccacatggaatgctatcattgctggttatactcagaatgggctcaatgagaaagctattctccttcttaaacagatgttggtgcaaaacgtaataccaaatgcagtgacattggcatccattcttcctgcttgtagttcaatgggaagcatgggattggctaggcaacttcatggattctccattcgtcgtttcttggagaaaaatgtttatgtgggaacttccttaactgacacgtattccaaatgtggtgcaattagttacgctgaaaatgtctttttgagaacacctgagaagaattcagtcacatacaccacaatgatgatgtgctatggtcagcatgggatgggtaagagagctcttaccttgtatgattctatgctgagatctggcattaggcctgatgcagttacttttgttgccatcttgtctgcttgtaattatagtggattggttgacgaaggccttcaaatatttgaatctatggagaaagtacataaaatcaagccctcaatagaacattattgttgtgttgcagacatgttagggagggttgggagggtggttgaagcctatgagtttgtcaagggattgggtgaggatgctaacaccatggaaatctggggatctcttcttgggtcttgtagaaatcatgggcattttgaattaggaaaagctgttgctaaaaaattgctgaatatgggaatggataaaagaatggcaggatatcatgttctgctctcgaatatttatgctgaggaaggagagtgggaaaaagttgatagagtgagaaagcagatgaaagaaaaaggtctgcacaaggaaacgggatgtagttgggttgagattgctgggtttgtaaactgctttgtatctagagatgagaagcaccctcaaagtagtgaaatatattatatgttggacatgttgactctagacatgaagtatgcagggtataagccacaatatagcttaaatttaaatacgattttggattcggatgaatga

SEQ ID NO: 8465 - DNA, 1090 bp, Glycine max
atggaatttggagagaacaacatgttcagccttaacacccacacaaaagaggaaaatggaaacactggcggtaacagtaacaataacaatattgttaatgtttggtattcatcatgggatgctactactacaactaatgcaccacacaccaccacggccgcggagggctacgccggcggcggtcaccgcctccatcaccaccaactatacggcggcgaagggtgtcacgtgcaggcggaccctcacctcacgtgcttgcatcttggtaaaagacattactttgaggatgctactaacggtgatgatgctaacaatgttacttctctggggaaccgacacgtgtgcggtggtggtggtgcgggttttgtttttgcgggtaacgataagagagcgagggggtattatggtggaggaggaggtggggctggcggtggtggtggtggtgggaaatcggcgccgtttgcgatggttcctcgatgtcaggtagaggggtgccacgtggcgcttgtgaacgcgaaggagtaccacaggaggcacagagtttgcgataagcattccaaggcacccaaagctgtggtcttagggttggagcagagattctgtcagcagtgtagcaggtttcatgtggtgtcagagtttgatgactcaaagaggagttgtaggaggagattggcaggtcataacgagcgaagaagaaagagctctcacctttctgttactaggaattctagacaagggtgtgctctctctcttctgtcatctgggagtagtagtgaaaattggctatctcatcatgcggatttctccacaagatgcagtgcagcattgcgtgaattgatagcagaaaaccgtgctgccctaatcactagacaacaacaacttgtttatgatagagactggcctcatgttgtgccccaccatgatgctgcagtggaagaagaagaagaagactttgaagacttacaacaacaacaacaaccacctgagcccaattattttccacaacaacatatgtttccacagacataataataataatagttcctgaacttggttggaggtgaccccaaatatatctaatgcactttac

SEQ ID NO: 8466 - DNA, 1029 bp, Glycine max
atggactttggagagaacaacatgttcagccttaacacccacaccaaagaggaaaacgaaaacactcctaacaataacaacaacattgtcaatgtttggtattcatcatgggatgctactactactaatagtaatacactacacacctccaccacggcggcggaaggctacgccggcggaagtcacagccaccaccaccagcaactatacggcggtgaagggtgtcacgtgcaggctgaccctcacctcacgtgcttgcatcttggtaaaagacattactttgaggatgttacaactaacggtgatgttaacaatgctacccctttggggaaccgacacgtgtgcagtggtggtggtgcgggttatgtttttgcgggtaacgataagagagggagggggtattatagaggaggaggagcggctggtggtgggaaaacggcgccgtttgcgatggttcctcgatgtcaggtggagggatgccacgtggcgctggtgaacgcgaaggagtaccacaggaggcacagagtttgcgatatgcattccaaggcacccaaagcagtggtgttagggttggagcagagattctgtcagcagtgtagcaggtttcatgtggtgtcagagtttgatgattcaaagaggagttgtaggaggagattggcgggccataacgagcgaagaagaaagagctctcacctttctgttactaggaattctagacaagggtgtgctctctctcttctgtcatctgggagtggaagtagggatcatcataattggctatctcatcatgcggatttctccacaagatgcagtgcagcattgcgtgaattgatagcagaaaatcgtgctgccctaatgactagacaacaacaacaacttgtttatgatcgagtttggcctcatcttgttgtggcgccccaccatgatgcggatgctgcagtggaagaagaagactttgaggacttacaacaacaacaacaacctgagtccaattattttccacaacatatgtttccacagacacaataa

SEQ ID NO: 8467 - DNA, 1412 bp, Glycine max
atggcttcagacgccaaactctcctcttctgagtccctcaacggtttgaaattcggccaaaaaatctattttgaggatgttggtcttgctactccagccacctctcttacttcttcttcttcttcttcttctgctgctactgttacttcttcttcttcttcaaggaaaggaagaggtgggtctgttcaaccagctcaacctcccaggtgtcaagttgaagggtgcaaagtagatctgagtgatgcaaaagcttactattctagacacaaggtctgtggcatgcactctaaatccccttcagtcattgttgctggtcttcaacaaaggttttgtcaacagtgtagcaggtttcatcagcttcctgagtttgatcaaggaaaaagaagttgccgtaggcgactagctggccataatgaacgtcggagaaagcccccaacaagctccctcttaacctctcgctatgccagactttcttcgtctgcttttgataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgagctgtgctctctctcttctgtcaaatcaaacatggggttctagaaacacagcaccaagtcttgggttgagtaacatgataaatttcaacgggacacccttgacacaacttgctgcatcatctcatggtgcatcaatccatcaacttccaaatacctcgtggtttttcaagggcattgattctggtaactgttcgcccgaggtggtccctgatctaggtctcggtcagatttcacagcctctcaatagccaacttcatggtgagctggacctgtcccaacagggcaggaggcattatatggatctagaacagtccagggcatatgaatctgctcattggtcactttaatgcacttgtttttttttgtcagctttgtaataacatgtagcagaaacctgtgcctacttggttacttaccagattgatgataactattgcttgttgttttgttttgttttaactgataagcaaggtgggtagccttgcctcatttgtggaactttcaggcaccgaatgaatctcacctgagagtgtgttttgttagtagtgtcttaaacacaggtatggtgttttctgccattgccgtcacctctggaattatttgtgattgggaggacagcctctttgatgtttgctaccaccgctccattttatttgatattatcttttgactatctgtc

SEQ ID NO: 8468 - DNA, 1278 bp, Glycine max
atggcttcagacgcaaaactctcatcttctgagtccctcaacggtttgaaattcggccaaaaaatctattttgaggatgtgggttttgctactcccgctacctctcttacttcttctgctactactgctaccactgttacttcttcttcttcttcctcttcaagaaaaggaagaggtggttctgttcaaccagctcaacctccaaggtgtcaagttgaagggtgcgaagtagatctgagtaatgcaaaaacttactattctagacacaaagtttgtggcatgcactctaaatcccctacagtcattgttgctggtcttcaacaaaggttttgtcaacagtgtagcaggtttcatcagcttcctgagtttgatcaaggaaaaagaagttgccgcaggcgactagctggccataatgaacgtcggagaaagcccccacccagctccctcttgacctctcgctatgctagactttcttcatctgcttttgatcatagtggcagaggtggcaactttctgatggaattggcttcatacccaaaacttagtctgagaaattcacttccaactcctaggtcatccgagctagcgcctggaaatcaaacctccaccctcagctggcacgggaactcggagacatcatctgaccttttcttgcaaggttcggtgggtgggacaagcttcgccggcccgggacatcctccaggggaaagttacactggggtcaccacctcgagctgtgctctctctcttctgtcaaatcaaacatggggttctagaaacccagcaccaagtcttgggttgaataacatggtaaatttccacgggacgcccatgacacagcctgctgcatcatctcatggtgcatcaatccatcaacttccaaataccccgtggtgtttcaagggcattgattctggtaactgttcgcccgagggggtccctgatctaggtctcggtcagatttcgcagcctctcagtagccaacttcacggtgagctggacctgtcccaacaaggcaggagacattatatggatctagaacagtccagggcatatgaatctgctcattggtcactttaatgcacttgtttttgtttttgtttttttgtcaggtttgtaataaaatgtagcacaaacctgtgcctacttggttactgaccagattgatgataactatttcttgttttggtttgttcaaactgataagcaaggtgggtagccttgcctcatttgtggaactttctggcggcgaatgaaatcacccgactgtgttttgtt

SEQ ID NO: 8469 - DNA, 1278 bp, Glycine max; identical to SEQ ID NO: 8468

SEQ ID NO: 8470 - DNA, 1412 bp, Glycine max; identical to SEQ ID NO: 8467

SEQ ID NO: 8471 - DNA, 1639 bp, Glycine max
aatcttttaaaattgatgcatttattcttttggcttcctctgagaacccaattctaatatccctcttgtgtgttgaattgattgacccctttatcctgttttggttcccaacaagtcaaagtcttcttcagctttgtggtgaaaacaaacaccaaggggattcaaattcaagttctgattcctttgtgagtgccttacacaagtttaggtttggtttggcatcataaaagggacataaagcaaaaaatagttttgtggggagcaactgttggttatggattgggatgggaaagagtttgcttgggatccacgtgggttggagctgctggccaatggtgaaggccagaagagtgaagcagcttcagtggatttgaggcttggtggggaaaaaatagccccagatgttgctaaagacacaaaagaatcgaaaaccgtgtcatcgccatctggttcgtcgaaaagatcccgccttcagaatggatcacagaacatgtgttgttctgttgatggatgcaattctgacctcagtgattgcagagattatcacaggcgccatagggtctgcgaaaagcactccaaaaccccggttgtgttggtgggggggaaacaacagaggttctgccaacaatgcagcaggtttcattcacttggggagtttgatgaggttaagaggagttgtaggaaacggcttgacgggcataacaggcgccggaggaaacctcagccaccgtctcttttcatggctgctgagaagttcatgtacaattacaaaggacctagaatcctacactttggtagccctgaggcttatgccaaccctattatgagaaacatgtggcctgctgctgccaaaactggagctgaatctggttatgatcctcctcgacttttatacagaatcgacaagcataagcaagataagggacatcctctttggcaagaaaatgaccctaaagtaggcagtggtgatgaagcaatgccgggaactcccatttgtcagcctattcatggcaccattgccccatcaacgggtggaaagagcacccgaaagctctctacagatgcaaaacctggatcctttgactcaggttgtgctctctatcttctgtcaacacttcagtcacaaagtccagagttgagtatggcgcaatctagcatcacctgtccaatgcaatctccatccggatctgtgcattttgatgctgtgaatgagtattcatgctcagaaacggaaaaagataagcccagtggtcaagtattggtttttgatgcaaacacaaccaaccttcattacaacggaatgctgcagatggggctggatggattggttgaaaatgaggacccactgacacttcccttcttgtgggagtaggtagctaactaagtggttatgtctttgttgggaaatttttggattcaaaaccttgtgagtgtactccaatgattaaagcttaaacttgttgaagctttcaataagggtcctttgtggctgtcaatcttgttgtggtagcacaattgattatgcggcggatgatgaaatcgattgtatgccgataactatgttctttcagttgtcttgagatcagtttgaacagttcagaaattattttctttagtgaaagattttcaatttcattga

SEQ ID NO: 8472 - DNA, 1551 bp, Glycine max
ggtgacctacttttttactcgaacaagttctttctcctctcagagagaaacatcaaaatggggcttgcaccttctatgcccattttcttggaggctttatccgcagctatcagaatttaagagattcaagattagtacataactatgtgtgttaggtttaggtttggctttggcatcttaaaagggacataaagcaaaccatagttttgttggttggttatggattgggatgggaaagagtttgcttgggatccacgtgggttggagctggctaatggtgaaggccagaagagtgaagcagcttcagtggatttgaggcttggtgaggaaaaaacagccccagatgttgttgctaaggacacaaaagactcaaaaaccgtgtcatcgccatccgggtcgtcgaaaagatcccgccttcagaatggattacagaacatgtgttgttctgttgatggatgcaattctgatctcagtgattgcagagagtatcataggcgccatagggtctgcgaaaagcactccaaaaccccggttgtgatggtgggggggaaacaacagaggttctgccagcaatgcagcaggtttcattcgcttggggagtttgatgaggttaagaggagttgtaggaaacggcttgacgggcataacaggcgccggaggaaacctcagccaccctctcttttcatggctgctgagaagttcatgtacaattacaaaggacctagaatcctacactttggtagccctgaggcttatgccaaccctattatgagagacatgtggcctgctgctgccaaaactggagctgaatctggtcatgattctcctcgacttttatacagaattgacaagcataagcaagataagggacatcctctttggcaagaaaatgaccctaaagtaggcagtggtgatgaagcaatgccgggaactcccatttgtcagcctattcatggcaccatcgccccatcaatgggtggaaagagcaaccgaaagctctctacagatgcaaaacctggatcctttgactcaggttgtgctctctatcttctgtcaacacttcaatcacaaagtccagagttgagtatggtgcaatctagcatcacctgccctgtgcaatctccatcaggatctgtgcattttgatgctgtgaatgagtatgcatgctcagaaacggaaagagataagcctagtggtcaagtattggttttcgatgcaaaaacaaccaaccttcattacaacggaatgctgcaaatggatctcgatggatttgttgaaaatgaggacccactagcacttcctttcttgtgggagtaggtagctaactaagtggttatgtctttgttgggaaattatggattcaaaaccttgtgtgtgtactgtgtactccaatgattaaagcttaaacttgttgaagctttcaataagggtcctttgttgctgtcaatcttgttgtggtagcacaattgattatgctgcggaggatgaaatggattgtatgcgaactatgttctttcagttgtcatgagatcagtttgaacagttcagaag

SEQ ID NO: 8473 - DNA, 1677 bp, Glycine max
atggagtggaatgcaaaatctctcgggcaatgggactgggagcacttattcttcaatacaaaagcagctgagaatccaaggttacaaccaactgattgtagcagtgaagcagatccagaaatcaatgttggactgttgtatccatcaggtggtagtgcttgttctggctctgaactaatacatgcttcttcatcaaggagctcaaaatcagcttccaacaattcatcatcaaatggggatagcagggaatctatattgactctggaaggttctcaggatgattccactgggaagaaagaattgtgcaatggagagccggttgaaacttctccagcagcagtgccctctcctgtctctggtgaaccattgctcactctaaagcttggtaaacgattgtactttgaggatgtctgcaccggaagtgattccaagaaaccatcttcctttgaggttcccattttatcagggaagaaatataaaacaagtagtcagactgtacagcatccaagctgccaggtggaaggctgtggccttgacctctcatctgctaaagattaccatcgcaaacacagagtttgtgaagctcattccaaatcccctaaggtggttatagctggtttggaacgtcgattttgccagcaatgtagcaggttccatgctctgtcagagtttgatgacaaaaaaagaagctgtaggcaacgactttcagatcacaatgcaaggcgccgcaaaactcagcctgactcaatccaattaaatccatcagctttgtcttcatctccctatgatgggaggcaaataatgagcccatttgcattttcaaggactgctacaaatttagcttggcaagatatgcacagcagcaagcacccccaaacaaaagaattcctcccgaagcctgccaaagccttcaataagataccgagtatagtctctatgctttctgatgattccagtggccttctaacatctagaggcatagcaacgaagagtattagaattattgttgcaggtatggaagttccaaatggtacacaagatgttaaccgtgctctctctcttctgtcaacgaattcatcatggtgtccatatgagaccaagtccctttctctggaacactccactcggacaacacactcaatcactcagcatcgtttaccacttccttcctcggagtattggcacactgatcaacaaaattcaagcatgtgtatctcattctcggattgcgatagcagcaatcgctttcaagactttcagctcttgagctcaccctatgaatcaggttttccgtgcaaccaactggattaacaacactatgcttctactacaacaagatttctagtctgcatgttatttttaaatggagattaactaaaactgcatggaactcgctccatttcccgaatggtgtttgtaccagactgcgctcatttagtttctacataaccaacctaccatgtctccactggcaacaacttttaataccttagcttcttactattgttacgcacatctccatgcttcatcatactactatttaccttgcaggcttataataaataaataacttgtaaaatttaggctgttagaaacacatcccatatcattcgtttccggagtttggaagctttacatgtttctactttctatcttcattatattattggttaaatt

SEQ ID NO: 8474 - DNA, 1745 bp, Glycine max
gacatggggatagaacaagtgatttaatgttgtctttgaaaaattaatcgatgttttcccttaggaattagcagttcattcatagattctgtaaaatttggggatgtttcttaaactctagcttcttaatgtgttttttaatcattggtctaccccatttatacagtttgcagatcacagtgaccatttgtgtatgaatttctaaggtcttgtcatggagtgtaatgcaaaatctctcgggcaatgggactgggagcacttattcttcttcaatacaaaagcagctgaaaatccaaggttacaaccaactgattgtagcagtgaagcagatcgggaaatcaacgttggaatgttgcatccatcaggtggtagtgcttgttctggctctgaactaatacatgcttcttcatcaaggagctcaaaatcagcttccaacaattcatcatcaaatggggatagcaaggcatctatattgactctggaaggttctcatgatgattccactgggaagaaagaattgtgcaatggagagccaattgaaacttctcctgcagcagtgccctctcctgtctctggtgaaccgttgctcactctaaagcttggtaaacgattgtactttgaggatgtctgtaccggaagtgattccaagaaaccatcttcctttgacattcccatttcatcaggaaagaaacataaaaccagtagtcagactttacagcatccaagctgccaggtggaaggctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagagtttgatgacaaaaaaagaagctgtaggcgacgtctttcagatcacaatgcaaggcgccgcaaacctcagcctgactcaatccaattaaatccatcagctttgtcttcatcaccctatgatgggaggcaaatagtgagtccatttgcattttcaaggactgccacaaatttagcttggcaagatatgcacccccagacaaaagaatttctcccgaagcctgcaaaagccttcaataagataccgagtattgtctccatgctttctgatgattccagtggccttctaacatctagaggcatagcaacgaagagtactgttccagatgttgcaggtatggaagatcccattaggttgtctgatccaaacggtacacaagatgttaaccgtgctctctctcttctgtcaacgaattcttcatcttcatggggtgcatatgagactaagtccctttctttggaacactccactcgggcaacacactcaatcactcagcatcacttaccacttccttcctcggcagagtattggcacactgatcatcaacaacattcaagcatgtgtatctcattcacggattgcgatagcagcaatcgctttcaagactttcagctgttgagctcaccctatgaatcaccttttccttgcaaccaactggattaacaacactatgcttctacttcaacaaaatttctagggtgctgtctttcatttgcttgctttttcaaatggagattaattaaaactgcatgttgattgcagttcgaatggtgtaagacctgttctcttgaaaactcccaagacattttcattttgtaccagactgcgctcatttcaattttaactttaatttctacttaac

SEQ ID NO: 8475 - DNA, 1761 bp, Glycine max
ggacatggggatagaacaagtgatttaatgttgtctttgaaaaattaatcgatgttttcccttaggaattagcagttcattcatagattctgtaaaatttggggatgtttcttaaactctagcttcttaatgtgttttttaatcattggtctaccccatttatacagtttgcagatcacagtgaccatttgtgtatgaatttctaaggtcttgtcatggagtgtaatgcaaaatctctcgggcaatgggactgggagcacttattcttcttcaatacaaaagcagctgaaaatccaaggttacaaccaactgattgtagcagtgaagcagatcgggaaatcaacgttggaatgttgcatccatcaggtggtagtgcttgttctggctctgaactaatacatgcttcttcatcaaggagctcaaaatcagcttccaacaattcatcatcaaatggggatagcaaggcatctatattgactctggaaggttctcatgatgattccactgggaagaaagaattgtgcaatggagagccaattgaaacttctcctgcagcagtgccctctcctgtctctggtgaaccgttgctcactctaaagcttggtaaacgattgtactttgaggatgtctgtaccggaagtgattccaagaaaccatcttcctttgacattcccatttcatcaggaaagaaacataaaaccagtagtcagactttacagcatccaagctgccaggtggaaagctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagagtttgatgacaaaaaaagaagctgtaggcgacgtctttcagatcacaatgcaaggcgccgcaaacctcagcctgactcaatccaattaaatccatcagctttgtcttcatcaccctatgatgggaggcaaatagtgagtccatttgcattttcaaggactgccacaaatttagcttggcaagatatgcacccccagacaaaagaatttctcccgaagcctgcaaaagccttcaataagataccgagtattgtctccatgctttctgatgattccagtggccttctaacatctagaggcatagcaacgaagagtactgttccagatgttgcaggtatggaagatcccattaggttgtctgatccaaacggtacacaagatgttaaccgtgctctctctcttctgtcaacgaattcttcatcttcatggggtgcatatgagactaagtccctttctttggaacactccactcgggcaacacactcaatcactcagcatcacttaccacttccttcctcggcagagtattggcacactgatcatcaacaacattcaagcatgtgtatctcattcacggattgcgatagcagcaatcgctttcaagactttcagctgttgagctcaccctatgaatcaccttttccttgcaaccaactggattaacaacactatgcttctacttcaacaaaatttctagggtgctgtccttcatttgcttgctttttcaaatggagattaattaaaactgcatgttgattgcagttcgaatggtgtaagacctgttctcttgaaaactcccaagacattttcattttgtaccagactgcgctcatttcaattttaactttaatttctactaaaaaaaaaaaaaaaaaaa

SEQ ID NO: 8476 - DNA, 1383 bp, Medicago truncatula
atggagtggaacgtgaaatctcccgggcaatgggactgggaaaacttattcttcttgaattcaaaagcagcagaaactcacaggttacaatctactgattggagtatggaggaagatcgagaaatcaatgttgggatgttgattccatctggtggtagcggctattcagtgtctaaactaatgcatgcttcatcctcgaggagctcaaaatctgcttccaataattcatcatcaaatgaggacagcaagacatcgatgttaactcaagaaggttctccagacaattccaccggtaagaaagaatcgtctaaaggagatccaattgaaacttctccagcagcagaaccattgctcacactaaagcttggtaaaagattatactttgaggatgttagcactggaagtcattccaagaaagcctcttcctctgcagttcctcttttgtgcggaaagaaaggtaaatcgagcagtcagaacatgctaaatccaagctgccaggtggaaggttgtggcctcgacctctcttttgctaaagattaccatcggaaacatagaatttgtgacagtcattccaaatcgcctgtggtggtagtagctggtttggagcgtcgattttgccagcaatgtagcaggttccatgatctctcagagtttgatgataaaaaaagaagctgcagacgccgtctttcagatcacaatgcaaggcgtcgcaaacctcagcctgaagcagtgaaattgaatccatcagctctctcttcgtctccctatggtataaatatcaagagtccctcccctaaaagatcgattaatgggaggcaagcaatgggcccatttgcttttccaaagaatacttcaaatttagcatggccagacatgcccaacagcaagctcccccaaaccaaagattttatgctcaaaactccaaaaaacttcaacaagattgtcactatgctttctgatgattcaagtggccactttatatccaaaggcaaaggaaccaatattgctgtcccagaaacaactgttattcacattgatagaatacatattacaggtctagaagatccaaataccttgtctgatccaagtgctacacaagatgttaaccgtgctctctctcttctgtcaaccaattcatggggtgcatatgataccaagcccccctccttcgtacactccaatcggacaaccggcacccctcagtatgcaactgctcagcgctcacctttttcgtcaccggaatattggcacactgatcaacatcaggccagctccagtgcctgtatctcgttctcgggttacgacaatagcaatcgctatcaagactttcagctgttcagcgaaccctatgagtcaagtttcccttgcaaccagctggattaa

SEQ ID NO: 8477 - DNA, 860 bp, Helianthus annuus
atggactgaaggagtagaaaactcaaaccacaatcacagcagcagcagcagctttctatatatacagcatggctctgccgaatcagcaaactgttgattacccgagtttcaagcttgtaattgtcggtgatggtggaactggaaaaactacttttgtgaagagacacttgaccggagaatttgagaagaaatatgaaccaaccattggtgttgaggttcatcccttggatttcttcaccaattgtggaaagattcggttttactgctgggacacagctggacaggagaaatttggtggtcttcgtgatggatattatattcacggtcaatgtgccattatcatgtttgatgtaaccgcaagattgacttacaagaatgttcccacatggcatcgtgatctttgccgtgtgtgtgaaaacatcccaatcgtgctttgcggtaacaaggttgatgtaaagaaccgtcaagtgaaggcaaaacaggttactttccatagaaagaagaacctgcagtattatgagatctcagccaagagcaattacaactttgagaagccatttctttatctcgcccggaaacttgctggagaccccaatttgcattttgtcgagtctcctgcccttgctcctccagaagtgcaaatagacatggccgcacaacaacagcatgaagcagagcttgctgcagctgctagccagccgcttccagatgatgatgatgatgcttttgaatagggtccaaaagttgaagcggattttatgagggtttgtgtctgttgagttttggattgttgaatggttttattataaacgtttggtaggatgcagtgaggtttgtgtttgcaaaaaaaaaaaaaaaaa

SEQ ID NO: 8478 - DNA, 974 bp, Vitis vinifera
ctctctgcggacgcattttcacaggggtaaatatggctttgcctaatcagcagactgttgactacccaagtttcaagcttgtaatcgtcggggatggtggaacaggaaaaacaacatttgttaaaagacatcttacaggcgagtttgagaaaaaatatgaaccaaccattggtgtggaagttcatccgctggatttcttcacaaactgtggtaagattagattctattgctgggacactgctgggcaggagaagtttggtggtcttagagatggatattacatccatgggcaatgtgccattatcatgtttgatgttactgctcgcttgacatacaagaatgttccaacatggcaccgtgatctttgccgggtttgtgaaaatatccccattgtgctttgtggtaacaaggttgatgtcaagaacaggcaggtgaaggcaaagcaggttactttccaccggaagaagaatttgcagtattatgagatatcagctaagagcaattataattttgagaagccttttctctacctcgccaggaaacttgctggggatcctaatttgcattttgtcgagtctcctgctctagctcctccggaagttcacatcgacttggctgcacagcaacagcatgaggctgaacttgctgcagctgctagtcaaccccttccagatgacgatgatgatgcgtttgaatagatggagggttgttccctgttgtccaatgtcttcccaatttttctcccatacatttaggacttggtagtttttttcccctttttttgggctttttttgtttctccctatatttttctcttgtggtgagatttgaggtgggtggggtttttcaatttttggtttggtattgtgagatttatgctggtgttttgtgtatgacaaagattacatatttgaaattatgtggacttgcgaatgccccttttcccttttcctttctatatatatcttcgcata

SEQ ID NO: 8479 - DNA, 2132 bp, Vitis vinifera
gcaatcgcgtcaaacaaaagccaaacctcaagcccaccgcttctatttatctactatcaaaacccttctctctatctacaaacgcaattcaaattctcactcatctctccgtctctctttctctctcttcattcatatggtgacctcctcctccctcttgatcttttattttcaatctagggttagggttagtttttttttttttgtttttttttgttaaatctaattttttcatgatctgatcggctgctgtttttgattgtttggtttggtttaggcacttccgaatcagcagactgttgattacccgagcttcaagctcgtcatcgtcggtgacggtggcacaggtataattttgttttatctaaaaaatgttatgctatgtttggttggccagaaagtgttggaatattacgattttaaatattggattcttgacactgtttgggaatcgggtaatgggaaaaatctctgtttttcttaccggattacagggaaagaaagtagtacaagcttaaaggttcaaactttgcttgtgtgtgtggttttttaaatcatgtactcattttttttctcagcaatcagtggagggttatgaggtttcgagatcttttttttaaacgttgaactatttgaaaaaaaattcttatatcttatgttattattgttgtgatgtggaaaaatgaacaaattagtttttcattccccgggatacccgatcagcatgaaaataaaattcaagattttcttttccacgttttactaacaagaaagtggggatttggggtttagatctgctttttgtttgtctattctcttcaaggctttcaattgaaatcttgtttattcaacatcaatgtgatttatctcaattgtactgcttcagggaaaaccacctttgtcaagcggcatcttactggagagtttgagaagaaatatgagcgtaagctattatgatttgtttgaatccttcattgtgtgcttctggttattatatattgacatatatttgaaatctctattttgcagcaacaattggtgttgaagtccacccattggacttcttcacaaattgtggtaagatcaggttttattgctgggatacagctgggcaagagaagtttggagggctaagagatggctactagtaagttgtcgccatcaagtttcgttcttgtgttttttggttaattgggaatttatggaattaacaaactatattttggaagatattctgcctctttgttctatttattctttcctctttccttggttgggaaaagttgtttgagggtttcaagtaaagaactgatctacaatgatttagattggaagtagttaccttatgggcgatgatagtacagagtcctcacttatatttcaataagtgtttatgacacttgtattagtgagtcttgcaaaagattctacctttactggtggaagaacatggctggaacatgttttgaagtcatctaaaattcatctttaatacatgtcttatttgttagttaacattgctttttcatatacatcataataatggtatgtaaattccgtatatgcagtattcatgggcaatgtgccataataatgtttgacgtcactgctcgattgacctacaagaatgttcccacatggcatagggatctctgcaggttcttttttgtgtgtgcccttgtttattcattatattgtatcatatagtaaggatatttcactggtaaatttaaattgattttctgtcataatgtcagggtgtgtgagaatatcccaattgttctatgcggaaataaggttgatgttaagaacaggcaggtgaaagcgaagcaggtcacatttcacaggaagaagaatcttcagtactatgagatttctgcaaagagcaactacaactttgagaagcctttcttgtatcttgccaggaagcttgctgggtaattgaaaaattgttaagaagtcattaatttccctttgttatttgtcctgtttcattgttctacactatgtaattctttgttatttatggttaatcattcactacatgctgcagggacgcaaacctccactttgttgagtcacctgctcttgctccaccagaagtgcaaattgacatggctgcacaacaacag

SEQ ID NO: 8480 - DNA, 990 bp, Arabidopsis thaliana
atctgcgtcattcctaagctcactatactctctgtttaaaaaaacctatctctctctctctctctcgccgccttcctctcaccctcttcgcatagcttcactttcgccgatggctctacctaaccagcaaaccgtggattaccctagcttcaagctcgttatcgttggcgatggaggcacagggaagaccacatttgtaaagagacatcttactggagagtttgagaagaagtatgaacccactattggtgttgaggttcatcctcttgatttcttcactaactgtggcaagatccgtttctactgttgggatactgctggccaagagaaatttggtggtcttagggatggttactacatccatggacaatgtgctatcatcatgtttgatgtcacagcacgactgacatacaagaatgttccaacatggcaccgtgatctttgcagggtttgtgaaaacatcccaattgttctttgtgggaataaagttgatgtgaagaacaggcaagtcaaggccaagcaggtaacattccacaggaagaagaacctccagtattacgagatatctgccaagagcaactacaacttcgagaagccattcttgtaccttgctagaaagctcgccggggacgctaatcttcactttgtggaatcacctgcccttgctcccccggaagttcaaatcgacttggctgctcagcagcagcatgaggcggagcttgcagcagcagcaagtcagccacttcctgatgacgatgatgacaccttcgagtagagaaagagagatgtgatctgtcactgattacccgttagggcttgtctgaacttttttttgttcatggtgctatttttatgtgtccgtactttgaaatgaatcgatgacattagtaattttcatttttaagtttttaactgtcgctatgaaagtgaaaaccttttgattacaaaccttacatgcttcacaatttcaattgtatctctattaatcct

SEQ ID NO: 8481 - DNA, 1160 bp, Glycine max
cttgaaaccctcccaatataaaccctcgcttcgttgtgtgctctctctttcttctgcatcactttccattctcttcaacctaacgcagcatcgctatactcttcattccatggctttgcccaatcagcaaaccgtggattaccctagtttcaaactcgttatcgtcggtgatggtggcacaggaaagacaacctttgtgaaaaggcatctcaccggagaattcgagaagaaatatgagccaaccatcggtgtggaggttcacccattggattttttcacaaactgtggaaagattcgattctactgctgggatactgctggacaggagaagtttggtggcctcagagatggatactatatccatgggcaatgtgctattataatgtttgatgttactgcccggctaacatacaaaaatgttcccacctggcaccgtgatctttgcagggtctgtgaaaacatcccaattgttctttgcggtaacaaggttgatgtcaagaacaggcaagtgaaagcaaagcaggttactttccacaggaagaagaatttgcagtactatgagatttcagctaagagcaactacaatttcgagaagcctttcctctatttggccaggaaacttgcaggtgatcctaatttgcactttgtggaatctcctgcattggctccaccagaagttcaaattgatttagctgcacagcaacagcacgaggctgagcttcttgcagctgctagtcagcccctccctgacgatgatgatgaatcttttgagtagagggctgtttttctgagtgcgctggtatttgtatgctactgtatgtgctgttgggggttgtagtgttgacatttttggatgcgaattcgaggatctgaatcaattatcatccagatttgttgcttaaatttaaaacctcagtttaatatatcaaccatgggcgttaaaaagatgaggatttggttgtttcgacaaattttggggtcttttaatataccatgcgaattggggtttagccgatggagggtagagtttgttcctttttgggtttttttttaaagttaaactcgatactattgattagaaaaatgagggtttatgttccttttgtcacagtttatcacccaacgtgaagcaaatcggtcgatttctatattatttattt

SEQ ID NO: 8482 - DNA, 1008 bp, Dimocarpus longan
caagaccaaaagctctccctctaattcaaaatctagaacgctctcagaaccaaaccaagaagaaatggctctaccgaatcagcagactgttgattatccgagtttcaagctagtgatcgtcggcgatggtggaactgggaagactacgtttgtgaaaaggcatcttaccggagagtttgagaagaaatacgaacccaccattggtgtcgaagttcatccactggacttcttcacaaactgtgggaaaattcgcttctattgctgggacactgcaggccaagagaagtttggtggacttagagatggatactatatccatgggcaatgtgctatcatcatgtttgatgtcactgctcggttgacttacaagaatgttccaacatggcacagggatctttgcagggtctgtgagaacatcccaattgttctctgcggaaacaaggttgatgttaagaacaggcaagtgaaagccaagcaagttactttccacaggaaaaagaacttgcaatactatgagatctcagcaaagagcaattacaactttgagaagcctttcttgtaccttgccagaaagcttgccggggatgctaacttgcatttcgttgagtctcctgccctcgcacctcctgaggttcaaatcgatttggcagctcaacaacagcatgaggctgaactgcaagctgctgctagtcaaccacttccagatgacgatgatgatgcattcgagtaaaacagcaggatggggaattgtgtgattgttggagttggggttgatgaacagctttgtgtttgaggatgtggaatttgtgtctttttgacatgagttttggattggattattcctggcgtattgctagttagcgtgttttcttacataccatttcatgtcggtgtctttcttttcgttggcttttgttcctatttttacgttgacgtgaatcttgttattggacagggagccatccaattttatgtaggatgttttaagcgttgctcctaaaaaaaaaa

SEQ ID NO: 8483 - DNA, 1029 bp, Vitis vinifera
aaacgcaattcaaattctcactcatctctccgtctctctttctctctcttcattcatatggcacttccgaatcagcagactgttgattacccgagcttcaagctcgtcatcgtcggtgacggtggcacagggaaaaccacctttgtcaagcggcatcttactggagagtttgagaagaaatatgagccaacaattggtgttgaagtccacccattggacttcttcacaaattgtggtaagatcaggttttattgctgggatacagctgggcaagagaagtttggagggctaagagatggctactatattcatgggcaatgtgccataataatgtttgacgtcactgctcgattgacctacaagaatgttcccacatggcatagggatctctgcagggtgtgtgagaatatcccaattgttctatgcggaaataaggttgatgttaagaacaggcaggtgaaagcgaagcaggtcacatttcacaggaagaagaatcttcagtactatgagatttctgcaaagagcaactacaactttgagaagcctttcttgtatcttgccaggaagcttgctggggacgcaaacctccactttgttgagtcacctgctcttgctccaccagaagtgcaaattgacatggctgcacaacaacagcatgaagctgaattaatggcagctgcagcacagccccttcctgatgatgatgatgatgcatttgattaagtgactgtagaagctttatccaaattgattctttcagaaagttagaagtaggttttggtcctggggaattctctacaatgtatgctgcctgctgctgttgcttattgtttggattggttggcctttggtggttcagaacactggggaatagtgcctctgctttggtccctagagtgttgtgttttacagattgatatataagtatctttgcttctttcatctcccttctacttggagggaactatttgattaaaaaattttgctctgattatatttacctttttattttagccaaatttgttcaaa

SEQ ID NO: 8484 - DNA, 1191 bp, Glycine max
atggattggaatttgaaagcaccttcttgggatttgagtgaagtggatcaggcaaacttacccaacatggaaacaatggaaggctcaagcagatatggaatgtatagaactaagggggaattttctgttgacttgaagcttggccaagtgggaaattctggcagggaatcatcagtgttgactaagtccaaagatggtggtgctgttggagtctccaaaatgatatcctcatcttcttcagggtcagctaagagagctcgttcccttagcaacgggacacaaacagtgtcatgccttgtggacgggtgccactctgatctcagtaactgcagagactatcataggcgccataaggtctgtgaagtccattccaagactgcacaggtcacaattggaggccagaaacaaaggttctgccagcagtgtagcaggttccattcactggaggaatttgatgaggggaaaaggagctgcaggaagcggttagatgggcacaaccgacggagaagaaagccacaaccagaagttgttctaacgcggtctgctagttttttgtcgaattaccaccaaggcacacaattgctatctttctcaagttcacatgtgtacccatccactactgtggtgaatcctactttgggtggagttgttacttctggtgatgtaaggcttcatgggcagaaccaccaccaccaccaaatgcatttggttgataaacaggacctgtttcttggatcttctccaaccggttacaaggaagggaagcatttggcattcatgcaaggtgaccacaccctcaacaaccagagcccacatcttccaggtgcttccgtgggcccggcccagatgtttcttaggaccagcccgtattcagaaagcggtggattgagatgcaaaatgttctgcgatagcctaacaggttcggcccacggcaacacctctcgtgctctctctcttctgtcatcaccaccacagccgcacagtcctggaaatggattaaaccaaatggtgaaccctcactcgccacttatgcaacccttgggcctgagcctgcatgataacagcctgggctccgtggacccggttttgggccccaacgggagtgaccattcctcatcaatgcatcacataggttctaatggatcccaggtgaatgaggcccctccactatttccctttcaatgggaatag

SEQ ID NO: 8485 - DNA, 1630 bp, Glycine max
ggtggtgaagggaagaagtaagcttccttcagctacagttgtctacaacactcacttctatctcttttaatgtttttttagttttttttttctcttcctataatacatctatttgcttcattgtattctgtagcaacttaattgtaactccggtttccttggacctctttcaacttggctgctgttgttagtcattattacgtattttcaacactctctctggtgaagaaaggtgagcaaagaaagacaaagaggggctgaaaaagtgtaagtgtttttgttatggactggaatttgaaagcactttcttgggatttgagtgaagtggatcaggcaaacttacccaacatggaaacaatggaaggctcaagcagatatggaatgtatagaactaagggggaattttctgttgacttgaagcttggccaggtggggaattctggcacagaatcagtgttgactaagtccaaagatgctgttggagtctccaaaatgacatcctcatctacttcagggtcatctaagagagctcgtgcccttagcaacgggacacaaacagtgtcatgccttgtggatgggtgccacgctgatctcagtaactgcagggactatcataggcgccataaggtctgtgaagtccattccaagactgcacaggtctcaattggaggccagaaacaaaggttctgccagcagtgtagcaggttccattcactggaggaatttgatgaggggaaaaggagctgcaggaagcggttagacgggcacaaccgacggagaagaaagccccaaccagaatctctaacgcgctctggtagttttttgtcgaattaccaaggcacacagttgctacctttctcaagttcacatgagtacccatccacaactgtggtgaatcctacttggggtggagttcttacaacttctggtgatgttaggcttcatgggcacaaccaacaccaccaccaggtgcatttggctgataaacaggacctttttcttggatcttctccagccggttacaaagaagggaagcaattggcattcatgcaaggtgaccacaccctcaacaaccggagcccacatcttccaggtgcttccgtgggccaggcccagatgtttcttaggaccagcctgtattcagaaagcgatgggctgagatgcaaaatgttctgtgatagcctaacaagttcgatccaagacaacaacacctctcgtgctctctctcttctgtcatcaccaccacaaccgctcagtcctggaaatggattaaacctgatggtgaactctcactcgccccttatgcaacccttgggcctgagcctgcatgataacagcctgggctccgtggaccctgttttgggccccaatgattcttcatcaatgtataacataggttctaatggatctcaggggaatgaggcccctccactatttccctttcaatgggaatagactttataaggggactcgtcctttggatgttgattctttccctcgtactatttcaatgttcaatttatcttttaatgaaggcaatgaaccattatctatcacgtttaacaaaatggtgtggaaattttcatgtctttaaaagtgttgctgtgtactatcaaaaactatattcccg

SEQ ID NO: 8486 - DNA, 1163 bp, Glycine max
ttttttttttttttttttttatttttttttttttttttttttttaaaaacaatcaagccttgtcttattaggtgggattatctatcatggaccatttatctaatcatgaactaaaatctcaatgaaattgaaaatctttcactaaaaaaaataatttctgaactgttcaaactgatctcaaaacaactgaaaaaacatagttatcggcatacaatcgatttcatcatccgccgcataatcaattgtgctaccacaacaagattgacagccacaaaggacccttattgaaagcttcaacaagtttaagctttaatcattggagtacactcacaaggttttgaatccaaaaatttcccaacaaaaacataaccacttagttagctacctactcccacaaaaagggaagtgtcagtgggtcctcattttcaaccaatccatccagccccatctgcagcattccgttgtaatgaaggttggttgtgtttgcatcaaaaaccaatacttgaccactgggcttatctttttccgtttctgaacatgaatactcattcacagcatcaaaatgcacagatccggatggagattgcattggacaggtgatgctagattgcgccatactcaactctggactttgtgactgaagtgttgacagaagatagagagcacaacctgagtcaaaggatccaggttttgcatctgtagagagctttcgggtgctctttccacccgttgatggggcaatggtgccatgaataggctgacaaatgggagttcccggcattgcttcatcaccactgcctactttagggtcattttcttgccaaagaggatgtcccttatcttgcttatgcttgtcgattctgtataaaagtcgaggaggatcataaccagattcagctccagttttggcagcagcaggccacatgtttctcataatagggttggcataagcctcagggctaccaaagtgtaggattctaggtcctttgtaattgtacatgaacttctcagcagccatgaaaagagacggtggctgaggtttcctccggcgcctgttatgcccatcaagccgtttcctacaactcctcttaacctcatcaaactccccaagtgaatgaaacctgctgcattgtcggcagaacctctgttgttcccccccacca

SEQ ID NO: 8487 - DNA, 1077 bp, Glycine max
atgggttctgcttcagtcaccaaagcaccaccctcttcctcctcatcacccaactcttcttctactgagtcccttgatggcttgaagtttggccagaaaatctactttgaggaagtgagtgttgctgcagcagcagcaacaacaactcaagggggcaacaaaacaagaggtggggtttctgcttcaaagaagggaaggggtggctcagtgcaagctcctaggtgtcaggttgcgggctgcaaagtagatctgagtggtgctaaggcttactattctaggcacaaagtttgtgccatgcactccaagtcccctactgtcactgttgctggtttggagcaaaggttttgccaacagtgtagcaggtttcatctgctttctgaatttgatcaaggaaaacgtagctgccgcaagcgacttgctggccataatgagcgccgacgaaagcccccaccaagctccgtattaacctctcgctatggcagactctctctgcctatttttgataacaatggtcgagacgatggctttctgatggaatttgcttcataccccaagcttactttgagaaatacattgccaactcaaagatcaactgagccggctccagggaaccatgctgcaacactcacctggcaaggaggttcagacactccatctgaatttttcctgcaaggatcagggagtagtggtggaacaagcttccttagttcaaaacatcccttagtggaaagttacactggagtcactgactcaaactgtgctctctctcttctgtcaagtcaaacctggggttccagaaacacagccccagcaacaagttttgaactgaacaacaacttgttcaatttcaatgggacatccatgacacaatttgctgtggcgtctttgcaagctgcagccatccatcaacttccaaatgctacctcatggttgtacctaaagggagttgattctggtaattgttcgcctgagcgtgtccccaatcacggtcttgctcaaatttctccccctcttcatagccatgttcatagtgagcttgatgtgtcacagcagggcaggaggcattacatgatctag

SEQ ID NO: 8488 - DNA, 1122 bp, Glycine max
atgagttctggttcagtcaccaaagcaccaccaccctcttcttcttcatcacccaactcttcctctgagtcccttgatggcttgaagtttggccagaaaatctactttgaggatgtgagtgttgcagcaacaacaacaactcaaggggcctacaaaacaagtcgtgtggtttcttccccttcttctgcttcaaagaagggaaggggtggttctttgcaacctcctaggtgtcaggttgagggctgcaaagtagatctgagtggtgctaaggcttactattctaggcacaaagtttgtaccatgcactccaagttccctactgttattgttgctggtttggagcaaaggttttgccaacagtgtagcaggtttcatctgctttctgaatttgatgaaggaaaacgaagctgccgcaggcgacttgctggtcataatgagcgccgacgaaagcccccgccaagctccacactagcctctcactatggcagactctctacgcctatttttgataacagtggccgagccggtggctttctgatggaatttgcttcatacccaaaggttacattgcgaaatacactgccaacacaaagatcagccgagccggctctcggtaaccatgctgcaacacttacctggcaaggaagctcagacacaccatctgaatttttcctgcaagaatcagggagtggtggaacaagcttccttggttccaaacatcccttactggaaagttacactggagtgactgactcaaactgtgctctctctcttctgtcaagacaaacctggggttccagaaacacagccccagcaacaagtgttgagctgaacaacaacttgttgaatttcaatgggacatccatgacacaattttccgcggcttcttcacaaactgcagccatccatcaacttccaaatgccacctcatggttgtacctaaagggagttggttctggtgattgttcgcctgagggtgtccccgatcttggtctaggtcaaatttcgccgcctcttgatagccatcttcatggtgagcttaatgtgtcacagcagggcaggaggcattacatggatctaggggaatccagggcatgtgagtcttctcactggtctctttga

SEQ ID NO: 8489 - DNA, 1551 bp, Glycine max; identical to SEQ ID NO: 8472

SEQ ID NO: 8490 - DNA, 1639 bp, Glycine max; identical to SEQ ID NO: 8471

SEQ ID NO: 8491 - DNA, 2609 bp, Glycine max
atggaaggagagggaagcattcatgtacaagttgatgaactacaaaggatgaggctcagcgaaaccatcagcataggcaccaccatgtttgagcctcgtggactcagcagcatagacaagctggacagtaataatagcactgccaattctgtgtcttcaacaacctcagcaccagaaaagaagctcacccttttcgctcttcagcttgcggtgcttgaaaaagcagcaaccgggttgggaactctcggcttcatttgggcaaccgttgtccttctcggcggtttcgccatcaccttagaaaaaaccgacttctggttcatcaccatcatacttgtagttgaaggaaccaggattttcagcaggagtcatgaacttgaatggcagcaccaagccacatggtccatcactgaggtacttgtaactcccagtacaaaggtactgagagagattttcaaaaaccatcaccaccaatatgtttcaacagatactaccccaacaaggacacgaactaggatgtgggttagctcagatgttccactcctaccatatgctaaatggtttttcctttcgaggcatgtcagtagacttctctattggcttcagcttctttctgcaacggcttgtgtggttctctcgttaataaagctcgtcaagcatgattatggagaggtggcaaagggggacactgacaagaggaaccgcaaatctgctctctctatcttctatgccttggctctttcggaagctttgttgttcctaatggaaaaggcctattgggaatggcaagtcagctattgtaaactgttggaagaggtcaacaaggagtgtgagttggggccatcaggaatggtgtccactagaaggctcttctatgatgcctattcaagatgtgtcaatggaagcatatttgatggcttgaaaatggatatggtaggtttttctatggacttgttggcttctaactcccctgatgagcagctcattggagcaaggattcttaggcagttttcaatcagtgaaagattttgtgatgacacccttcaaaagattggaattgacatatcaatggtggagagactagttgagatgttgaattggacagacttcaaggacgaagagattaggctctcagctgctgagattttgtcaaaactagctggcaagaagcagaactctctccgcatagccggaataccgggagctatggaatcaatatcatctcttttacaaactaataggagtgtgattcctgcagctgatgagattggtgaaaagaaacttgtatttgatcaccaaaattatgggttctggacttttaaccacttgggactcctcatactgaaaaaacttgcacgtgaccttgacaactgtggaaagattggaaacacaaggggcctccttccaaagatcatagacttcacacatgctgaagagtggttgctaaagagtgaaaatgttactccatcccaagttctgacactgaagagatctctgcaactggtgaagatgctggctagcacagttggcaccactgggaaacatcttcgaagagagattgcggagatagttttcaccatcagcaatattagagatattttaaggcatggagagaagcatcctcttctacagaaactttgcatagaaattttaaccagtctggcattggaagaggatgcaacggaaagaatagggggtacaggtggagtacttaaagaattgttcaacatatttttcaaacacaacataccagaaaatcagaaacatgtaaaaattgttgctggtgaggcccttgcaatgctggctttagaaagcaagagtaactgccatcgaattttaaagttgaaagtactagaaaagctcgctgaagcattgaaagatccattgctccgtgtcaatgcagctagaattctaagaaatttatgcacctatagtggatcagaatggttcatccagctaaagggggtaacaactgcagcacccataatacttcgggcgatcatgtcagaagacaacaagatacaagaggtgatgattggactagcagcaaatgttttcagatacatgacctctcatgaatcaagcattgtatttgaagaagctggaattactgaggctgaacttgcaaacaaattagttcagattctcaagaaataccagtatcccccaactaagattccaaggataaggaggttcgtaatagagctggctatttggatgatgaaagacaaagcagaaaacatagaaacctttaagggtctgggaatggaggaggtgttggagggtgtcttagagaccacatcagaacttgaaagctttaatgttttctctggcactgttggactgaaccggcacactctaacaactcagtcactggttgagatggcattgaaattgatggaagatagttaaactatcgaccatagtactattaacacaaaatcagttatccatgttggcctagagagactaatgttgcaacttgcaggtgtgtggatacactaaactgttgtatattctcctaaaggcatacatgtttgcagcgtctcaaaagatggcctaactcaataatttattcattaatttttcagattcaacgttgaaataaatta

SEQ ID NO: 8492 - DNA, 2364 bp, Glycine max
atggaaggagagggaagcattcatgtacaagttgatgaactccaaagggtgaggctcagcgaaaccatcagcataggcaccaccatgtttgagcctcgtggactcagcagcatagacaagttggacagtaataatagcactgccaattctgtgtcttcaacaacctcagcaccagaaaagaagctaacccttttcgctcttcagcttgcagtgcttgagaaagcagcaaccgggttaggaactctcggtttcatttgggcaaccgttgtcctgctcggcggtttcgccatcaccttggagaaaaccgatttctggttcatcaccatcatacttgtagttgaaggaaccaggattttcagcaggagtcatgaacttgaatggcagcaccaagccacatggtctatcactgaggtaaaccatcagcaccaatatgtttctacagatactaccccaacaaggacaccaactaggatgtggattagctcagatgttccactcctgccatatgctaaatggtttttcctttcaaggcatgttagtaggcttctctattggcttcaacttctttctgcaacagcttgtgtggttctctcgttaataaagctcgtcaagcatgattatggagaggtggcaaaaggggacactgacaagaggaatcgcaaatctgctctctccatcttctatgccttggctcttgcagaagctttattgttcctgatggaaaaggcctattgggagtggcaagtcagctattgtaaactgttggaagaggtcgacaaggagtgtgagttggggtcatcaggaatggtgtccactagaaggttcttctatgatgcctattcaagatgtgtcaatggaagcatatttgatggcttgaaaatggatatggtaggtttttccatggacttgttggcttctaactcccctgatgagcagctcattggagcaagaattctgaggcagttttcaatcagtgaaagattttctgatgacacccttcaaaagattggaattgacatatcaatggtggagagactagttgagatgttgaattggacagaccccaaggaggaagagattaggctctcagctgctgagattttgtcaaaactagctggcaagaagcagaactctctccgcatagccggaataccaggagctatggaatcaatatcatcgcttctacaaactaataggagtgtgattcctgcagctgatgagattggtgaaaataaacttttatttgatcaccaaaattacgggttctggacatttaaccacttgggactcctcatactgaaaaaacttgcacgtgaccttgacaactgtggaaagattggaaacactaggggcctccttccaaagatcatagacttcacacgtgccgaagagtggttgctcaagagtgaaaatgttactccatctcaagttctgacactgaagagatctctgcaactggtgaagatgctggctagtacagatggcaccactgggaaacatcttcgaagagagatttcggagatagttttcaccatcagctatattagagatattttaagatatggagagaagcatccccttctgcagaaactgagcatagaaattttaaccagtctggcattggaagaggatgcaacggaaagaatagggggtacaggtggagtacttaaagaattgttcaacatatttttcaaacacaacataccagaaaatcagaaacatgtaaaaattgttgctggtgaggcccttgcaatgctggctttagaaagcaagagtaactgccatcgaattttgaagttgaaagtactagagaggctcgtagaagcattgaaagatccattgcttcgtgtcaatgcagctagaattctacgaaatttatgcacctatagtggatcagaatggttcatccagctaaagggagtaacagctgcagcacccatacttcaggcgatcatatcagaagaaaacaagatacaagaggtgattgttggactagcaggaaatgttttcagatacatgacctctcatgaatcaagcattgtatttgaagaagctggaatcacggaggctgaacttgcaaacaaattagttcagattctcaagaaacaccagtatcccccaactaaggttccaaggataaggaggtttgtcatagagctggctatttggatgatgaaagacaaagctgaaaacatagatacctacaagggtctgggaatggatgaggtgttggagggtgtcttagagaccacatcagaacttgaaagctttaatgttttctctggcactgttggactgaaccggcacactctaacaactcagtcactggttgagatggcattgaaattgatggaagataggtaa

SEQ ID NO: 8493 - DNA, 2469 bp, Glycine max
atggatcgtagactttctgtgaaaatagaaggagagggaagtgttcatatacaagttgctgaactccacaggctaagcgagacaagcaaaaccagcacaatgtttgagcctcgtggactcagcagcattgagaagagagacagtgatgcagctgataactactctttctcttcagcaacggctagagcaccagaaaagaagctgaccctcttcgctcttcgtcttgcggtgcttgaaaaagcagccactagccttggaactcttggtttcatatgggcaaccgttgtccttcttggcggttttgccatcactttggacaaaaccgatttctggttcatcaccatcatactgttgattgaagggacaaggattttcagtaggagccatgagcttgagtggcagcatcaagccacatggtctataactgaagttggaatcaacagtttcaggatgctaaggtcctccccaaacttgcttcttcaaagtatcaagagccttttcaggccaattgtaatcaagaagcaaaggagagacatggtggaggctaatgttaccccgaggacaccaactcgcatgtggattagttcagatgttccacttcttccatatgctagatggtttttcctttcaaggcatatcagcaagcttttgtattggcttcagcttttttcggccatggcttgtgtggttctttcgtcgatgaagctcatcaagcataattatggggaggttgccaagggagacactgacaagaggaaccgcgagtcagctttgaatatcttctatgcattggctttggctgaggctttgcttttcttgatggaaaaggcttactgggaatggaagatcagctactgcaaactgttggatgaggttaacaaggagtgtgggttggggccatcggggatggtgtcgattagaaggttcttttatgattcctattctaggtgtgtcaatgggagcatatttgatgggttgaaaatggacattgtctgttttgctatggatctcttggcgtcaaactcacccgatgagcagctcatcggaggaagaattcttcgccaatttgcggtgagtgaacggttttctgatgatacccttcagaagcttggaatttccatttctgtagtggagaggctagttgagatgttgaattggacagaccacaaggaggaagagattaggctctcagctgcagagattttatcagcactagctggcaagaagcagaattctctccgcatagctgggataccaggcgctatggaatcgatatcatctcttctccaaactaacaggaattgcatacatgcagctgatgaaattggagaaaagaaactcatatttgatcatcccaattatggctactggacatttaaccatttgggactcctcattctgaagaaacttgcccgtgatcacgacaactgtggaaagattggaaacacaagaggcctgctcccaaagatcatagacttcacacatgctgaagaggggttgttgaagaatgagaatgttacaccatctcaaattctgacggtgaagagatctctgcagctggtgaagatgttgactagcacaacaggcacctatgggaaacatcttcgaagggagatttcggagatagttttcacaataagcaacattagagatattctaaggcatggagagaaacaccccttgttacagaaactgagcatagaaattttaaccagtctggcattggaagaggaggcaacagaaaggattggaggcacaggtggagtacttaaagaattgtttaacatatttttcaaagattgcattgctgaaaatcagaaagatgtaaccactgttgctggggaggccctagcaatgctggcattggaaagcaagaacaactgtcataggattttgaagttgaaagttttggaaaggctgatagaggcattgaaatttccactgcttcgtgtcaatgccgctagaattctaagaaatttatgcacctacagtggatcagaaggcttcaaacagttaatgggggttacagctgcagcacccacagtgcttcaggcaatcatgtcacaagaaaacaagctccaagaagtgatgattggactagcggcaagtgttttcacattcatgacttcctctgaatcaagcactgtatttgaagaatctgggatcactgaggctgaactggcaaataaattaatccatattctcaagaaacaccgatatcctccaactaaggtcccgaggataaggaggtttgtgatagagctggcaatttggatgatgaaagaaagagaagaaaacattcatactttcaaggatttgggaatggaggaggtgctggaaggtgtcttagagaccacttcagagcttgaaagctttaatgttttctctggtaccgtgggactgaaccggcacaatctaacaattcactcactggttgagacagcattgaagttgctggaagataggtaa

SEQ ID NO: 8494 - DNA, 2493 bp, Glycine max
atggatcataggctttctgtgaaaaaagaaggagagggaatcgttcacatacaagttgctgaactccacaggctaagcgagacaagcaaaaccagcaccatgtttgagcctcgtggactcagcagtattgagaagagagacagtgatgcagataactctttctctgcagcaacagctagagcaccagaaaagaagctgaccctctttgcgcttcgtcttgcggtgcttgaaaaagcagccactagccttggaactcttggtttcatatgggcaaccgttgtccttcttggcggtttcgccatcactttggacataaccgatttctggttcatcaccatcatactgttgattgaagggacaaggattttcagcagaagccatgagcttgagtggcagcaccaagccacatggtctataactgatgctggaatcaacagtttcaggatgctaaggtcctccccaaacttgcttcttcaaagtatcgagagccttttcaggccaattgtaaccaagaagcaaaggagagacatgatggagtctaatgttacccccaggtatagggataataccaccattagcatatggacaccaactcgcatgtggattagttcagatgttccacttcttccatatgctagatggtttttcctttcaaggcatatcagcaagcttctgtattggcttcagcttttttcggcgacggcttgtgttgttctttcgtcgatgaaactcgtcaagcataattatggggaggttgacaagggagacactgacaagaggaaccgggagtctgctttgaatatattttatgccttggctttggctgaggctttgcttttcttgatggaaaaggcttactgggaatggaagatcagctactgcaaactgttggatgaggttagcaaggagtgtgggttgggaccatcagggatggtgtcaattagaaggttcttttatgatgcctattctaggtgtgtcaatgggagcatatttgatgggttgaaaatggacattgtctgttttgctatggatctcttggcctcaaactctcctgatgagcagctcattggaggaagaattcttcgccaattcgctgtgagtgaacggttttctgatgatacccttcagaagcttggaatttccatatctgtggtggagaggctagttgagatgttgaattggacagaccacaaggaggaagagattaggctctcagctgcagagattttatctgcactagctggcaagaagcagaactctctgcgtatagctgggataccgggcgctatggagtcgatatcatctcttctccaaactaacaggaattgcatacatgcagctgatgaaattggagaaaagaaactcatatttgatcatcccaattatggctactggacatttaaccatttgggactcctcattctgaagaaacttgcccgtgatcatgacaactgtggaaagattggaaacacaagaggcctgctcccaaagatcatagactttgcacatgctgaagagaggttgctgaagaatgagaatgctacaccatctcaaattctgacagtgaagagatctctgcagctggtgaagatgctggctagcacaacaggcacctacgggaaacatcttcgaagggagatttcggagatagttttcacaatcagcaacatcagagatattctaaggcatggagagaaacaccccttgttacagaaactgagtatagaaattttaaccagtcttgcattggaagaggaggcaacagaaaggattggaggcacaggtggagtacttaaagaattgttcaacatatttttcaaagattacattgctgaaaatcggaaagatgtaaccactgttgctggggaggccctagcaatgctggtattggaaagcaagagcaactgtcataggattttgaagttgaaagtattggaaaggctgatagaggcattgaaagttccgccacttcatatcaatgctgctagaattctaagaaatttatgcacctacagtggatcagaatgcttcaaacagttatggggggttacagctgcagcacccacagtacttcaggcaatcatgtcacaagaaaacaagctacaggaagtgatgattggactagcggcaagtgttttctcattcatgacttcctctgaatcaagcactgtatttgaagaatctgggatcaccgaggctgaactggcaaataaactaatccatattctcaagaaacaccgatatcctccaactaaggtccccaggataaggagatttgtgatagagctggcaatttggatgatgaaagaaagagaagaaaacattcatactttcaaggatttgggaatggaggaggtgctggagggtgtcttagagaccacttcagagcttgaaagctttaatgttttctctggtactgtgggactgaaccggcacaatctaacaattcactcactggttgaaacagcattgaagtttctggaagataggtaa

SEQ ID NO: 8495 - DNA, 2586 bp, Medicago truncatula
gtcttttttcatagatagtaccacaaacatttacattgagtttcaaacaacatatataatatcatcatcatcatggatcataagatttgtgtagatggagaaggaggaggaagcattcatctagaagttggtgaacttaggaggctaagcgagacaacgagcaaatgcgccacaatgtttgagcctcgtcgtggccttagcagtctagagaagagagatagtggtgaaggtgataaagaagattctaatgagtcttcaacaacagttagagcaccggaaaagaaacttactctctttgctctgcgccttgccgtgcttgaaaaagcagcaactggtttgggaactcttggttttatatgggcgactgttgtccttctcggtggtttcgccattaccttagacaaaacagacttttggttcatcacaatcatactcttgattgaagggacacggattttcagcaggagtcatgagcttgagtggcagcaccaagccacatggtctattactgagtcaggaatgcatagttttcggatgctgagatcaagttcaaattccattcttcaaagtataaagaatctttgcagacctattaatgccgccgtaaagaagcacagaaaagacaccgtggaggctaatgtcattgtaccgaggtttttggataacagaatcacaaggacaacgactaggacgtggattagttcagacgttccacttttaccatatgctaaatggtttttcatttcagggcatatcagcaaggttctgtattggcttcagcttctttctgcaacagcttgcgtggttctgtcttcgacaaagctcatcaggcataattatggagtgattgccaagggagataccgataagaggaaccgcgaatctgctctcgacatcttttatgcattggctcttgcagaagctttgttgttcttaacagagaaggcttattgggagtggaaattaagctactgtgaactattggatgaggttaacaaagagtgtgagttaggaccgtcagggatggtttctatcaggagattcttttatgatgcttattcaaggtgtgtcaatgggagtatctttgatggattgaaaatggatatggtgtcttttgctatggatcttttggcctcaaactcacctgatgagaagctcattggagcgagaattcttcgacaatttgctaacagtgagaggttttcagacgatacacttcaaaagattggaatttctatatctttggtggagagactagttgagatgttgaattggacagaccacaaggaggaagaaattaggatgtctgctgcggagattttatcaaaactagcaggcaagaagcagaactctctacgcatagccgggataccgggagctatggaatcaatatcgtctcttctacaaactaacaggaattgtatgcatgctgctgatgaagttgcagaaaagaaactcatatttgatcacccgaattacgggttctggacatttaaccatttaggactactcattctgaaaaagctcgcacacgatcacgacaattgtggaaagattggaaatacaagaggcctacttccaaagatcgtagatttcacacatgcagaagaaagcctgctgaagaatgaaaatgttactccctcacaaattctaacagtgaagagatccctgcagctggtgaaaatgctggctagcacaacaggaacatatggaaaacatcttagaaaagagatttctgaggtagttttcacaatcagcaatatcagagatattttaagacatggtgagaaacaccccttgttacagaaactgagcatagaaattttaacaagtcttgcattggaagatgaggcatcagaaaggattggaggtacaggtggagtgcttaaagaattgttcaacatatttttcagacaaaacattcctgaaaaccagaaagatgtaacaactgttgctggtgaggccttatcaatgctggcattagaaagcaagagcaactgtcatcggattttgaagttgagagtgctcgaaaggcttattgaagcattgaaagtaccactgattcgtgtcagtgccgctagaattctaagaaatttatgcaactacagtggatcagaatgcttcaaccagttaaagggagttacagcagcagctccaacaatacttcaggcaatcatgtcacaagagaataagctacaagaagtgatggttggactagcagcaaatgttttcacattcatggcttcttctgaatcaagaactgtgtttaaagaagctggaatcactgaggttgaattggctaaaaaattagtccagattctaaagaaacatcaatatccagcaacaaaggttccaaggataaggaggtttgtgattgagctggctatttggatgatgatagacaaagaagaaaacataagtaattttaaggatcttcaaatggaagaggtgttggagggtgtattagagaccacatcagagcttgaaagctttaacgttttctctggtactgtcggtctaaatcggcacagtctaacaattcactcactggttgagacagcattgatgttgctggaagacaagtaa

SEQ ID NO: 8496 - DNA, 3049 bp, Vitis vinifera
agaagctgatcatcaggttcgcacaccatggataaagaggaggaggatggagggagtgttcatttgcaggtttcagagctgacaaagctgagtggagcctgcagttcaggagacaccatgtttacaccccagagcaggattgagaagggagacagcaacaattcaaattctgtttctgagataaggccagcagtttctgcaccagagaagcagctcacaatctttgctcttaggcttgcagttctggagaaggtagctactagtctgggaactctggggtttatctgggcaacagttgttcttctaggaggttttgccattactttggcgaagaccgacttctggttcatcaccattattctgttgattgaagggactcggatttttagcaggagccatgagcttgagtggcagcaccaagccacctggtcggttacagatgctgggattaatagtttccgggccctgaggtcaagctcacacttcctatttgaaactgtgaaatcaatttgcaggccaattgcagttaggaaacaaagccaacatagtagagaagtttcagggaggaacaaccctgaggcaagtccgggaaactgggggactaggaagatgccgagtcgaacatggaagacttcagatgttcctctgctgccatatgcgccttgggttttcctgtccaggaatatcagtaagcttctctattggctccagcttttatctgcaacagcctgtgttgttctctcattgctgaagctcatcaaacatgactatggggaggtggcaaaaggggattctgacaagaggaaccggaaatctgctctgactattttctatgccttggccttggcagaggctttgatgtttctagtggagaaagcttactgggagtggaagctcagcttctgtagactgttggagaaggtgaataaggagtgtgacttgggggatacaggtatggtttcaatcagaaggttcttctatgatgcctattccaaatgtgttaatggaagcatttttgatggtctgaaaatggacatggtttcttttgccatggatctcttggcctccaattcccctgatgaacaacttattggagctagaattctccggcagttcgccatgagtgagaggtattctgatgacacccttcagaagattggtataaatttacctgtgattgaaagattagtcgagatgttgaactggaaagatccccaagaagaagagatcaggcaatccgccgcagaaatcctttcaaaactagcagggaaaaagcaaaactccctcagggttgccggaatacctggtgcgatggaatcaatttcatctctgctgcaaacccacagaaaccccagcagtgcacctgatgaaatctgtgagaagaaaatcatcttcgaccaaggaaactacgggtactggacattcaatcatctgggacttcttatcctgaagaaactggctcgtgaccatgataactgtggaaagattggaaacacaaggggcctcctgccaaaaatcgtagactttacacatgctgaagacaggctgttgaaggatgagaatgtgacacaatctcagattctcaccgtgaagagatctctgcaactggtcaagatgctggcaagcacaacaggcagcacagggaagcttctcagaagtgagatttcagaggtagttttcacaatcagcaacatcagagaaatcctgaggaatggggagaaacatccaaagctacaaaaactgggcatagagattttaaccagtctggcactggaagagaatgcaacagagaggattgggggcacaggtggagttcttaaaggactgttcaacattttcttcaagcagggaatggcaggggaccagaatcatgtaaagatagcagctggtcaagctctggcaatgctgacaatggacagtaagagtaactgtcatcgcatactcaaactcaaggtgttggaaaagctggtgggagccttggaggttccattgcttagcgtgaatgctgctagaatcttaagaaatttatgcgccttcagtggatcagagtgcttcaaccagttgacgggggtcagagctgcagcaccaacagtgctcaaggcgattatgtcagaagagaacaaactgcaggaagtaatgcttggactagcagcacatggtttcaaattcatgacttccgaagaatcaagcgttttcttcgagaaaactgggattaaagaagtgcatttagctcatgaactggtggagattctgaggaagtacaagtatccaccaattaaggttccaagaataaggcgtttcaccatagagttagcaatttggatgatgcgagacaaagaaacaaatgttcatattttcaaggatttggggatggagaaggagctggagggtgtgttagagacaacctcagagatagaaagtttcaacattttctctggtactgttgggctgaaccgccatggcacaagcatgcattccttagttgagactgcattgaagttgctggaagaacagtaaaattcagatcagcaacatgaatatacaaataaaatgattgtgtaaataataaatattcatccatccatccaacttataatatattcttttttccctgagtaataaataagtacatggaagacatggtgtaccttacatttgaagcaaattattgatttctaattgctctgccgcattgtgtaaatatctgtaatggatccttagtacagggaaatactccatgaatttagttaaaattgataaacaaagatgggaagatacaaaagttttgcttggctgctgggaaatctccatatttgtccccttccagaagccaaataatgggcagtagagttgggcattttgcaaagtcctgatttttttttcatgggtttctttttgtcccattccttgtcaaccacttaggcattttttggatcatgggttgtcgctataccatcattgctattcctaggttccatagtttttgtcttagtcctacttgaaaccttagggtcccagagtatttctcctatgggtcagcctattagtt

SEQ ID NO: 8497 - DNA, 2575 bp, Vitis vinifera
atggataaagaggaggaggatggagggagtgttcatttgcaggtttcagagctgacaaagctgagtggagcctgcagttcaggagacaccatgtttacaccccagagcaggattgagaagggagacagcaacaattcaaattctgtttctgagataaggccagcagtttctgcaccagagaagcagctcacaatctttgctcttaggcttgcagttctggagaaggtagctactagtctgggaactctsgggtttatctgggcaacagttgttcttctaggaggttttgccattactttggcgaagaccgacttctggttcatcaccattattctgttgattgaagggactcggatttttagcaggagccatgagcttgagtggcagcaccaagccacctggtcggttacagatgctgggattaatagtttccgggccctgaggtcaagctcacacttcctatttgaaactgtgaaatcaatttgcaggccaattgcagttaggaaacaaagccaacatagtagagaagtttcagggaggaacaaccctgaggcaagtccgggaaactgggggactaggaagatgccgagtcgaacatggaagacttcagatgttcctctgctgccatatgcgccttgggttttcctgtccaggaatatcagtaagcttctctattggctccagcttttatctgcaacagcctgtgttgttctctcattgctgaagctcatcaaacatgactatggggaggtggcaaaaggggattctgacaagaggaaccggaaatctgctctgactattttctatgccttggccttggcagaggctttgatgtttctaatggagaaagcttactgggagtggaagctcagcttctgtagactgttggagaaggtgaataaggagtgtgacttgggggatacaggtatggtttcaatcagaaggttcttctatgatgcctattccaaatgtgttaatggaagcatttttgatggtctgaaaatggacatggtttcttttgccatggatctcttggcctccaattcccctgatgaacaacttattggagctagaattctccggcagttcgccatgagtgagaggtattctgatgacacccttcagaagattggtataaatttacctgtgattgaaagattagtcgagatgctgaactggaaagatccccaagaagaagagatcaggcaatccgccgcagaaatcctttcaaaactagcagggaaaaagcaaaactccctcagggttgccggaatacctggtgcgatggaatcaatttcatctctgctgcaaacccacagaaaccccagcagtgcacctgatgaaatctgtgagaagaaaatcatcttcgaccaaggaaactacgggtactggacattcaatcatctgggacttcttatcctgaagaaactggctcgtgaccatgataactgtggaaagattggaaacacaaggggcctcctgccaaaaatcgtagactttacacatgctgaagacaggctgttgaaggatgagaatgtgacacaatctcagattctcaccgtgaagagatctctgcaactggtcaagatgctggcaagcacaacaggcagcacagggaagcttctcagaagtgagatttcagaggtagttttcacaatcagcaacatcagagaaatcctgaggaatggggagaaacatccaaagctacaaaaactgggcatagagattttaaccagtctggcactggaagagaatgcaacagagaggattgggggcacaggtggagttcttaaaggactgttcaacattttcttcaagcagggaatggcaggggaccagaatcatgtaaagatagcagctggtcaagctctggcaatgctgacaatggacagtaagagtaactgtcatcgcatactcaaactcaaggtgttggaaaagctgstgggagccttggaggttccattgcttagagtgaatgctgctagaatcttaagaaatttatgcgccttcagtggatcagagtgcttcaaccagttgatgggggtcagagctgcagcaccaacagtaagttgatttcattatctcagaataggcactwaaatatttgttgccattccttcttagaatttcttccttcttcctcctgtggcaggtgctcaaggcgattatgtcagaagagaacaaactgcaggaagtaatgcttggactwgctgcacatggtttcaaattcatgacttccgaagaatcaagcattttcttcgagaaaactgggattaaagaagtgtatttagctcatgaactggtcgagattctgaggaagtacaagtatccaccaattaaggttccaagaataaggcgtttcaccatagagttagcaatttggatgatgcgagacaaagaaacaaatgttcatattttcaaggatttggggatggagaaggagctggagggtgtgttagagacaacctcagagatagaaagrttcaacattttctctggtactgttgggctgaaccgccatggcacaagcatgcattckttayttgagactgcattgaagttgctggaagaacag

SEQ ID NO: 8498 - DNA, 1630 bp, Glycine max; identical to SEQ ID NO: 8485

SEQ ID NO: 8499 - DNA, 1191 bp, Glycine max; identical to SEQ ID NO: 8484

SEQ ID NO: 8500 - DNA, 1745 bp, Glycine max; identical to SEQ ID NO: 8474

SEQ ID NO: 8501 - DNA, 1677 bp, Glycine max; identical to SEQ ID NO: 8473

SEQ ID NO: 8502 - DNA, 2004 bp, Glycine max
tcaagctacaaacttaccatagcgaattagcatcactgttgggacactgttcgggagtcaattgttgtttggtcgtgtttaattgtcttgcacctgacctggttctgttgcatgtgatggaatcttggagctatgtccctgaagaaaaggagtgtgtctccaatgaggcactctcacctcccaacactctcgggaggagtaaaaattctttcttgggctgggaactcaaaaccccatgtggtttttccaacgacatgttgggtttgggtcaccacagcattgagaatcaaggttttgaggaattgggttttcctgaaatgttgggaaaacacatgtccgatgatctaattgggagtgttccaaccagaaaggtgaatggtaatagacaacaacaacacagtgacagaatcactggcactgttgtggatgccccaagtgggttttctcaaagaggggactcaaattcaaagctttcaaactcaaattccctcattgatttgaagctgggtcgatttgctgaccatggagatttcactgatcgggcgttttccaaagttttgtcttcttctgagtcatcaacgcctcctaagagagtgagagcttcagggttgcactctcagactgcatattgccaagtctatggctgcaacaaggatctcagctcctgcaaggactaccacaagaggcacaaggtctgtgaggttcactccaagactgccattgttatagtcaatggcattgagcaaaggttttgccagcaatgtagtaggtttcatttgctggctgaatttgatgatggtaagcggagctgccgaaaacgccttgcaggtcataatgagcgtagaagaaaaccacaaatgggtattcacccaggaaagtctgggaggttgcttcagccatgtgggggtaattatacatatagcagattccagggatccatgctaacttcatcttttatctgcccagagatgcttccaagtggggtcacgtgttctgagaaatatggtatgagtgacttttggagacctatcaaagcagaacacgggactggttttaggaatctttcctctatggctgcaaccaatggacatcctccatcaagatctttatttccatcatataacggaaatcaatttccttttcttcatgaaaacagtgctacatccaccacaggaagcatcttctgtgagagcaatagcccctatccatctgcccttggggcccaaaattctgggttgagaccactattccaggacactgtaggaaatgagaacttcaatgtttttgatacctcatcaactgttcaaggattgtcggggatttcagactcttgttgtgctctctctcttctgtcatctcaatcccagaactcttcaagccaatcatcaggaattcccttggctcactccttggttattccaagcagtcatagccataactacaacatgagtcaggtctctgaaaagataggaataagctcacagacttcttcaagccgagtgtcagatagttttccatcagaactaaatcatgcagatggaagtcatctcagtcctgtattaatatcagacaataattgtattgtaaactttgatatggcagatggtatcttccaagcttcagattacttgaatgtaaaagatcatctttccggtgaagatggtgcaaccattgacttactacaattgtcatcacagcttcagcgagttgagcatgagaggcaatccttgcaggtgaagcaagagaatgattcttcttgcactctgcggattacataaagtgcttttggaagaggaaacaaattgtgcaagcatgtgacagacacgcctacgcctatcatcttggacattgtagggcacagggaaatagaaacttcaaatggtgccattctcatctgttgctaactatttaaaatagcttgcttgtgctgattcggttcaagaacttgtctgcagaataactgatctactaaacacactaggctatatctatgatatttgttgg

SEQ ID NO: 8503 - DNA, 2062 bp, Glycine max
atggaatcttggagctatatccctgaagaaaaggagtgtgtctccaatgaggcaccctcacctcccaacactctcgggaggagtaaaaattctttcttgggctgggaactcaaaaccccatgtggtttttccaccgacatgttgggtttgggtcaccacagcattgagaatcaaggtttcgaggaattggggtttcctgaaatgttgggaaaacacatgtccgatgatctagttgccagtgttccaaccagaaaggtggatggtaatagacaacaacaacaacaccacagtgacagaatcactggcactgttgtggatgccccaagtgggttttctcaaagaggggactcaaattccctcatcgatttgaagctgggtcgatttgctgagcatggagatttcactgatccagcgttttccaaagttctgtcttcttctgagtcatcaacgcctcctaagagagtgcgaacttcagggttacattctcagactgcatattgccaagtctatggctgcaacaaggatcttagctcctgtaaggactaccacaagaggcacaaggtgtgtgaggttcactccaagactgccattgttatagtcaatggcattgagcaaaggttttgccagcaatgtagtaggtttcatttgctggctgaatttgatgatggcaagcgaagctgccgaaaacgccttgcaggtcataatgagcgtagaagaaaaccacaaatgggtattcacccaggaaagtctgggacgttgcttcagccatatagcagattccagggatccatgctaacatcatcttttatccgaccagagatgcttccaagtggggtcatgtgttccgagaaatatggtatgagtgacttctggagacctatcaaagcagaacacgggactggttttaggaatctttcttctatggctgcaaccaatggacatcctctgccaagatctttattttcatcatataacggaaaacaatttccctttcttcatgaaaacagttctacatccaccacaggaagcatcttctgtgagagcaatagccactatccatctgcccttggggcccaaaattctggattgagaccactattccaggacactgtaggaaatgaggacttcagtgtttttgatacctcaccaaatgttcaaggattatcagggatttcagactcttgttgtgctctctctcttctgtcatctcaatcccagaactcttcaagccaatcatcaggaattcccttggctcactccttggttattccaagcagtcatagccatcactacaacatgagtcaggtctctgacaagataggaataagctcacagacttcttcaagccgagtgtcagatagttttccaccagaactaaatcatgccgatggaagccatctcagtcctgtattaatatcaggcaataatgatattataaactttgatatggcagatggtatcttccaaggttcagattacttgaatgtgaaagatcgtctttccgatgaagatggtgcaaccattgacttgctacaattgtcatcacagcttcagcgagttgagcatgagaggcaatccttgcaggtgaagcaagagaatgattcttcttgcactctgcggattacataaagtgcttttggaagaggaaactagttgtgaagcatgtgaaagacacgcctatgccaatcatcttaagacaatgtaggccacaggggaatagaaacttcaaatggtgccattctgttgctaactatttacattagcttgcttgtgctgattcggttcaagaacaacttgtctgcagaataactgatctaaacacgccaggctatatctatgatatttgttgggacacaattgtccctctctgtgttaatatatccatctggatgtaataaacaaaagagccttagatgtatcaaaatgtgttcttcatggcataaacacttcaaatcagggcaattgtttactagaattgacgctcgattaagttagtgacaactttggtaatgactttttgtcgtactgaattattaatcattaatcctgcatggggtattgt

SEQ ID NO: 8504 - DNA, 2067 bp, Glycine max
atggagtcttggagctatgttgctgaggagaaagggtatgtctccagtgaggcactatcacctcccaacacacttgagagaagcaaaggttcctgttttggttgggaactgaaaaccccatgtagtttttccaatgacatgttgggtttgggccagcaaaacgttgaggatcaaggttttggggagttgggttttccaggaatgttggggaagcagttgtgcggtgatgatcctaatcctattggtgctgttcagagcagaaaggtggatgatgttgttgttgactgcagaatcactagtcctagtcctgttgtggctgccccaaatggattttcttcaagggaggacttcaattccaagctttcaaacgctctggtggactctaatggtggaaattcactcattgatttgaagctgggttggtttgctgaccatggagatgccatggttccaacattttccaagggagcccccattttgtcttcttccgagttgtcgacgccaccaaagagggtgagagcttcgggggcgcattctcagactgcttactgcctagtctatggctgtaacaaggatctgagtggttgcaaagactaccacaagaggcacaaagtttgtgaggttcactccaagacttccaaagttatagtgaatggcattgaacaaaggttttgtcagcaatgtagtaggtttcatttgctggctgaatttgatgatggtaagcgtagctgtcgtaaacgccttgcaggccacaatgagcgtcgaagaaagccacaagtgggtattcactctggaaaagctgggaggttgcttcagccatatgctggtattgcagatagcagattccaggagaccatgctaacatcgtcttttatctgccaagagatactccccagtggagtcttgtcttctgagaaatatggagcaagtgacatgtggagacctatcaaagctgaagacagcaccggttttacttttaggcccctttcttctattcctattaccaatggacatcctcagtcacgatctttatttccttcgtatagtggaaaacaacttccatttcttcatgaaaatggtgctacatctgccacaggaaacatcttctctgaaaacaataaccaatataatcctccttccctcggtggccaaagttccgggtcacaatcactattccaggacagctccttaggaagggaggacttcaatgttttcgacacagaatcagctgttcaaggactatcaggaatttctgactctggctgtgctctctctcttctgtcatctcaatcccagaactcttcgggccaatcatcagggattcccattgctcacccgatggttattccaagcagccacagccattacaacatgagtcgggtttctgaaaagatgataggaataagttcacaggcttcaagtggagtgtcagataggtttccacctgaattcaatcctgtagatggaagtcatcttagtcccatattgatatcagataataatgaaatcatcaattttgaaatggcaaatgggatcttccaagggtcggatttcgtgaacgtgaaagatcgcctttcctgtgaagacagcctcaccattgacttgcttcaactatcgtcgcaacttcagcgtgtcgagaatcagaggctgtccttgcaggtgaaacaagaaaatgattcttcctgctctctgcggattacttgagatgctttcaagtttaaagaggaaccacttgtgcttgtgtgcaacatgttgtgacagactccaatgccactcatccaattccttaacaatgtagggcacaatgaggagaagcttaagatggtcattggtatcagctgctaactagtttacatggttctctcgggctaattcgttttaagaagctgaacaatgattcggacaaaatagtccctcagtctaaatgtatccatctggatatatataaataataaaccaaagcctgagatgtatcaaagtgtgcccttctgattcgtgccataaaaatacttcaatttggacttttgttaactagaaactgaagtctatgatgaatattaattctgc

SEQ ID NO: 8505 - DNA, 2062 bp, Glycine max; identical to SEQ ID NO: 8503

SEQ ID NO: 8506 - DNA, 2004 bp, Glycine max; identical to SEQ ID NO: 8502

SEQ ID NO: 8507 - DNA, 1546 bp, Glycine max
atggaatcttggagttatgtccccgaagagaaaggctatttgttttctgatgaaatggatttttcacttgatgctttcatgagaagtagaaaagcattggttgaatgggacaacaaatccaactttgttgagaaagatggatttaattcagacagagaggtagttagaagcatggaatttgtggatttgggattccctgacttgttgcaaaagtcttttcatggaagccagcctctagagacatctagctatgaactagatagtaataattctagtaaaagagggaattcctccccacatgtcattgccttggattcttctatgggggaagaggaatccgattcaaagcatttgagttctctagttgaatccaagactcatgattcttcactgattgatctgaagctagggagattagcagattgtaaaggtgcaagtagtgataaagttgcaaaagaagggttcactttaacatctatacatccgaccacactttggaagagagctcgcacttccagcttgcctgcacaggctcctgtatgtcaagtttatggttgtaacatggatcttagctcctcaaaagattaccacaaaaggcataaagtttgtgatgctcactccaaaacagctaaagttattgtaaatggaattgaacagaggttttgtcagcagtgcagcaggtttcatttgctagctgagttcgatgatggtaagcgcagttgtcgcaggcgtctagcaggacacaatgaacgccgaaggaaaccccaatttgattacgtgactggtaaacagcacaagattcttcagtcatatcaaggtactaagtatctggggtcttcattacagaataaaccccagtttccctttcaagacatatttcaaagcagcatccttttccccggaaagcatgctcaattctctcagagtggacgtgtcaaactggaagaggactcgatttacggttcccaacttgctgcaccggtcacacttgatcaggaatcatcaagctgtgctctctctcttctgtcagatcagtcacagtatccgtcatgccacgcagcaggcaatccattagccagtccccaagtctttagtggcatccgcatacccgacagagacagccgagtttccaaaaagcctttgaggataagccctgcagataaacttgcaccaaatgagtcctttccatgtgatacaatctccaaggaagttatcaagaatagatccgccgcaacattttccagtgttggtcatgctcttgaagtccataatggagatgatatctgccaaccatcagagttgttcagcattaaacacagtctttcctcggaacatgcagccacggttgatttgttccaattgtcttcacatcttcagagggtggagcagcaaagaaattctgttttggtgaagtgggaaaatgaggactactgtttcccaactgtgtgaaaggttgcacattgtttaagcctcaaagtgccattaacatgcccattttcgttgatacctatgtttgcgatgctataatagtggcctagtgggactg

SEQ ID NO: 8508 - DNA, 1643 bp, Glycine max
atgttgactcacgctctatctgcttcaacgttaccactactgtaaacgaaaaaagaaagaaaaaaaacacttctttctctgtcttactgttcactctgctgtgtaccaaaaccaaaaccactcacaaggtgccactaatctgtcaggtttcttcattatttcacatcatctgtgacttcaattgagttgtactaatggaatcttggagttatgtccctgaagagaaaggctatttgttttctgatgaaatggagttttcacttgatgctttcatgagaagtagaaaggcattggttgaatgggacaacaaatccaactttgttgagagagatggatttaattcagacagagaggtagttaaaagcatggaatttgtggatttgggattccctgacttgttgcaaaagtcttttcatggaagcctgcctctagagacatctagctatgaactcgatagtaataattctagtaaaagagggaattcctccacacatgtcattgctttggattcttctatgggggaagaagaatccaattcaaagcatttaagttctctagttgagtccaagactcaggattcttcactgattgatctgaaactagggagattagcagattgtaaaggtgcaagcagtgataaagttgagaaagaaggattcactttaacttccatacatccgaccacgctttcgaagagagctcgcacttccagcttgcctgcacaggctcctgtatgtcaagtttatggttgtaacatggatcttagctcctcaaaagattaccacaaaagacataaagtttgtgatgctcactccaaaacagctaaagttattgtaaatggcattgaacaaaggttttgtcagcagtgcagcaggttccatttgcttgtcgagttcgatgatggtaagcgcagttgtcgcaggcgtctagcaggacacaatgaacgccgaaggaaaccccaatttgattacatgactggtaaacaacacaagattcttcagtcatatcaaggtactaagtatctggggtcttcactacagaacaaacccatgtttccctttcaagacatatttcaaagcagcatccttttccccggaaagcatgctcaaatctctcagagtggacgcgtcaaactggaagaggactcgatttacagttcccaacttactgcacccatcacacttgatcaggaatcatcaagctgtgctctctctcttctgtcagatcagtcacagtatctgtcacaccacgcagcatgcaatccattaaccagtcatcgagtctttagtggcatctgcatacccaacagagatggtcaaatttccgaaactcctttgaggataagctctgcagataaacatgcaccaaatgagtcctttccatgtaatacaacctccaaggaggttatcaagaatagatccgctgcgacattttctaacactggtcatgctctccgagtccaccacggagatgatatttgccaaccatcagagttgctcgacgtcaaacaccatttttcctcggaacatgcagccacggttgatttgttccaactgtcctcacatcttcagagggtggagcagcaaagaaattctgttttggtgaagtgggaaaatgaggactactgtttcccaactgtgtga

SEQ ID NO: 8509 - DNA, 1266 bp, Glycine max
atggactggaatttgaaagcaccttcttgggatttggtggatgtggataaggcaaccttacaacaacacagaggagcaatggaggagcaaaaccgatttggagtttatagaatgaaaggggagttttctgttgacttgaagcttggtcatcatgtggggaattctggcactgaatcagcactagccaacaagtccaaagatgctgctgctgcaggagtttccaaaatggcatcctcaccttcagggtcttctaagagagctagagccataaacagcacatccctcacagtggcatgccttgtggatgggtgcaattcagatcttagcaattgtagagattatcataggcgccataaggtgtgtgagctccattccaagaccccagaggtcacaattggtggcttcaagcaaaggttctgccaacaatgtagcaggttccattcgctggagcaatttgatgaaagaaaaagaagctgcagaaaacgtttagatggacacaatagaaggagaagaaagccccagccagaacctctctcgagacctggtagttttttgtcgaattaccaaggcacccaattgctacccttctcaagcccacacgtatatccatccactgccatagtgagcccagcttggagtgcttcacttgtcacttcctctgcagatgctaggttgcacaaccacaaccaacaacaacaccaccaccaccaacaagacctttttcttggatcttcccacaaagaagggaagcaagtagcattcttacacaacaaccatccctccacagctgcagcactcagcagccaaaccccgccaccttttccatcctcttccgttcgccacacccttctcaggaccgaccctctatcagaaacttgcggcggagctagaagcaaaatgttctgtgaaagcttaacaacaacaacaactaacaataattcggtgcatgacactactccttgtgctctctctcttctgtcatcatcacagacgcacacaccagggaatggcttgaaccaaatggtgcagcctcctccctcaatgtccctcatgcagcccttaggcctgagcttgcaggataataacagcttagagtctgtggatcattgttcctccatgtatagcttggcttctgatcatggatcccagtgcaatgaagcagcccctcaactgtttccctttcaatgggaatagatattaattactttatctcaaggattattcaccactttgtttgttcattcctaatgaattctttccccccaa

SEQ ID NO: 8510 - DNA, 1122 bp, Glycine max; identical to SEQ ID NO: 8488

SEQ ID NO: 8511 - DNA, 1077 bp, Glycine max; identical to SEQ ID NO: 8487

SEQ ID NO: 8512 - DNA, 1551 bp, Glycine max; identical to SEQ ID NO: 8472

SEQ ID NO: 8513 - DNA, 1639 bp, Glycine max; identical to SEQ ID NO: 8471

SEQ ID NO: 8514 - DNA, 655 bp, Glycine max
cttttatcataaccttcttctggagctctgtggaagttactatggacacaagcaggtctgagggaaaaagggtcatgaggtacaaagaagaagatgatgataatgatgatgaagaagaagaagaggcggtgagtgagatgggttttgaagaagatggaaggaggaataagagagtaataagagatctctatggaaagagagggtccaaaggtggaggctcaataacaccttcttgccaagtggacaattgtgatgctgatctgagtgaagctaagcagtaccacagaagacacaaggtttgtgagtaccatgccaaggctccttccgtacacatggcagggctgcaacaaaggttttgccaacaatgtagcagattccatgtgctatcagaatttgatgactcaaagaggagttgtagaacgcggttggctgggcataatgagaggcgtcgcaaatatgcagttgactagctaccatggacaatgatttcttctatgggatggacattaataatcattgaggcaagcatgtgattaatgaaattaaatttcccattcaaatcttcataaatcattgttgctggtctctaaagatgctctctatcttctgtcaagattttcatatgcaaagatttttctgttagttacaactatga

SEQ ID NO: 8515 - DNA, 734 bp, Glycine max
tttttttcttctcataaccttcttctggatctctctggaagttattatggacacaagcaggtatgagggaaaaagggtcttgaggtacaaagaggaagatgaaaatgatgatgatgaagaagaagaagaggtgagtgaggtgggttttggagcagacagaagaaggaataagagagtaatgagagatctccatggaaagagatcagggtccaaaggtggaggctcaatgccaccttcttgtcaagtggataattgtgatgctgatctgagtgaagctaagcagtaccacagaagacacaaggtttgtgagtaccatgccaaagctccttccgtacacatggcagggctgcaacaaaggttttgccaacaatgtagcagattccatgagctatcagaatttgatgactcaaagaggagttgtagaacgcggttggctgggcataatgagagacgtcgcaaaaatgcagttgactaccatggagaatgatttcttctatgggatggacattaacaatcattgaggcaagcatgtgattgaaatgaaattttccattgaaatcttcatacttaaatcattgttgctgatctctaaggatgctctctatcttctgtcaatattttcatatgcaaacattgttgctgttcgttacaattatgaaaggatagttccacgtagaacttttattatattttggtttgagagaaatggaaagaatgaagggattttaatgagt

SEQ ID NO: 8516 - DNA, 447 bp, Glycine max; identical to SEQ ID NO: 8130

SEQ ID NO: 8517 - DNA, 1499 bp, Glycine max; identical to SEQ ID NO: 8168

SEQ ID NO: 8518 - DNA, 1720 bp, Glycine max; identical to SEQ ID NO: 8139

SEQ ID NO: 8519 - DNA, 1479 bp, Glycine max; identical to SEQ ID NO: 8141

SEQ ID NO: 8520 - DNA, 2097 bp, Glycine max; identical to SEQ ID NO: 8166

SEQ ID NO: 8521 - DNA, 2091 bp, Glycine max; identical to SEQ ID NO: 8167

SEQ ID NO: 8522 - DNA, 1499 bp, Glycine max; identical to SEQ ID NO: 8168

SEQ ID NO: 8523 - DNA, 1720 bp, Glycine max; identical to SEQ ID NO: 8139

SEQ ID NO: 8524 - DNA, 1533 bp, Glycine max; identical to SEQ ID NO: 8152

SEQ ID NO: 8525 - DNA, 1533 bp, Glycine max; identical to SEQ ID NO: 8153

SEQ ID NO: 8526 - DNA, 2461 bp, Glycine max
gtaatgattgtaatatacttcacgttctgagaagaaaaggtatgaaagatttctgtgttccccggcggcagcagcgcccccttcaatccacatgaaacaaccactcaacctaaaccttctcattctcaccaacatcacacttttgtgtctatgatatactaacagtaatttccttagatttcttctctgttttcactcccattgccttttcacgatgaacacaattacccttattcgcaaccgcgccattaattccgctcgcaggattctcaccggttctagaacttcattgtttttcgggtccactcctgcaaaatctgaccacactctttccattgctaacaattcgctgaaacctcgtttcaatcatgaccgcgccaatcaccacccttttcaaattcatcgcacaaagggtattgatgttgctcagaaagtttttggcttaccctcttcgaatttcgcccctccatctatgcattttagtttgagcacatcgagcagggacgtttccaccttcaaggttcgaaatttctcgacctctgttgagacccgcgtcaaggacaacaacaattttgagaggatttacgtacagggtggcatgaacaatgtgaaaccattggtggtggaaagtgttcataaggaggatgagagggatttgggtggtgatgtgaatgtgagtgtgggaaagactaaaggggaggaggactcagaggtggaaaaagaagcatggaagttgttgcagggtgctgttgtgacttattgtggcaaccctgtgggaactatggctgcaaatgatcctggggacaagatacccttgaattatgatcaggtctttattagggattttataccttcagcacttgctttcttgcttagaggagaaagtgagattgtcaagaactttcttcttcacaccttgcaattgcagagttgggagaaaacggtggactgctacagtccagggcagggcttgatgcctgcaagtttcaaagttagaactgttgctcttgatgaagataaccatgaagaagttttagatcctgattttggggaatcagctattggtcgtgttgcacctgtagattcaggattgtggtggatcatcctcttgcgggcttatgggaagctcactggtgactgcagcttgcaagaaagggcggatgttcaaacaggcttaaaaatgatccttaacttgtgtttaacagatgggtttgatatgtttccttctctgttagtcactgatgggtcttgcatgatagacaggcggatgggaattcatggtcacccccttgagatccaagcattattttactcagctcttcgctgctcacgtgagatgcttgttgcaactgatggaaccaataatcttattagagccattaacaacagactcagtgcactgtcatttcacattagagaatattattgggtggatatgaaaaagatgaatgaaatatacaggtataaaactgaagagtactccacagatgccatcaacaaattcaacatctacccagaacaaattccattgtggttaatggattggattcctgaagaaggtgggtatctgattgggaatttgcagccagctcacatggacttccggtttttctcacttggaaatctttggtctattgtctcatcattgggcaccccaagacagaaccaggctattttaaatctgatagaagcaaaatgggatgatcttgtgggccatatgcctcttaagatatgttatcctgccttggataatgaagagtggcgcatagttactggttgtgacccaaagaataccccttggtcatatcacaatggtggatcttggccaacccttctgtggcagttcacactggcatgcatcaaaatggggagaattgaacttgcccagaaagcagttgctttggctgagaaaagactgccagttgattcttggcctgaatactatgatacacgtactggaaaatttatcggaaaacaagcccgaatgtatcaaacatggaccatagctggtttccttacatccaagatgcttttgaagaatcctgagatggcatccatgttattctgggaggaggattacgagcttcttgacatatgtgtttgtggacttagcaagagtggcaggaaaaggtgttcccgtggtgccgcaaggtctcaaattcttgtatgacgaattcctagagtagtgtacattcatagccagggggatcatatatttatattgtgcgtttggtaggttatagaaaaagttaaattggaaaataaacaccttctccattgctgtaattatggttaagaaggctttcctttgttctgggagggcaattctcacttttttttttaacaattaggggatagagatttaaaagtatgagctcttgtgtgtatatgcacaaatattcacattgatttatctcattatacagttgctcctttgcagcattttataatgagtttcctt

SEQ ID NO: 8527 - DNA, 2224 bp, Glycine max
atgaacataattacccttattcgcaaccgcgccatgaattctgctcgcaggattctcatcggttctagaaattcatcgttttccgggtccacacctgcaaaatctgaccacactctttccattgctaacaattcgctgaaacctcgtttctatcatgaccactccaatcaccacctttttcaaattcatcgcacaaagggtattgctcagaaattttttggcttaccctcttcgaatttcgccccttcaccaatgcatttcagttttagcacatttaacagcgacgtttccaccttcaaggttcgaaatttctcgaactctgttgagacccgcatcaatgacaacaattttgagaggatttacgtacagggtggaatgaacaatgtgaagccgttggtggtggaaggtgttcataaggatgatgagagtgttgcaggagagaagaatttaggtggtgatgtgaatgcgagcgtgggaaagagtaaaggggaggactcagaggtggaaaaagaagcatggaagttgttgcagggtgctgttgtgacttattgtggcaaccccgtgggaactatggctgcaaatgatcctggtgacaagctacccttgaattatgatcaggtctttattagggattttatcccttcagcacttgctttcttgcttagaggagaaagtgagatcgtcaagaactttcttcttcacaccttgcaattgcagagttgggagaaaacagtggactgctacagtccagggcagggcttgatgcctgcaagtttcaaagttagaactgttgctcttgatgaagataatcatgaggaagttttagatcctgattttggggaatcagctattggtcgtgttgcacctgtagattcaggattgtggtggatcatcctcttgcgggcttacgggaagctcactggtgactgcagcttgcaagaaagggcggatgttcaaacaggcttaaaaatgatccttaacttgtgtttaacagatgggttcgatatgtttccttctctgttagtcactgatgggtcttgcatgatagacaggcggatgggcattcatggtcacccccttgagatccaagcattattttactcagctcttcgctgctcacgtgagatgcttgttgcaactgatggaaccaaaaatcttattagagccattaacaacagactcagtgcactgtcatttcacattagagaatattattgggtggatatgaaaaagatgaatgaaatatacaggtataaaactgaagagtactccatggatgccatcaacaaattcaacatctatccagaacaaattccgttgtggttaatggattggattcctgaagaaggtggatatttgattgggaatttgcagccagctcacatggacttccggtttttctcacttggaaatctttggtctattgtctcatcattgggcaccccaagacagaaccatgctattttaaatctgatagaagcaaaatgggatgatcttgtggggcatatgcctcttaagatatgttatcctgccttggataatgaagagtggcgcatagttactggctgtgacccaaagaataccccttggtcatatcacaatggtggatcttggccaacccttctgtggcagttcacattggcatgcatcaaaatggggagaattgaacttgcccagaaagcagttgctttggctgagaaaagactgccagttgattcttggccagaatactatgatacacgtactggaaaatttattggaaaacaagcccgaatgtatcaaacatggaccatagctggtttccttacatccaagatgcttttgaagaatcctgagatggcatccatgttattctgggaggaggattacgagcttcttgatatatgtgtttgtggacttagcaagagtggcaggaaaaggtgttcccgtggtgccgcaaggtctcaaattcgtgtatgatgaattcctagggaagggtacattcatagccaggggatcatatatttatattgtgcgtttggtaggttatagtaaaagttaaattggaaaattaacaccttctcctttgttctaggagggcgattctcacatttttactttttttttgcattgaggggatagagatttaaaagtatgacctcttgtctgtatatgaacaaatattcacattgatttatctcattatacagttgctcctttgcagcattttataatgtgtttcttt

SEQ ID NO: 8528 - DNA, 1907 bp, Medicago truncatula
agatttttccactccttcaaacaacttctgactccttcttcatacaaaacctcgaattacaccttcatacacatttcaacaatttctgctacgctacaattacaataccccattcttccgtgatgaacacaataatcctaattcgcaaccgcgctataaattccgcgcgtagaatcctcactagttcttcaaattcatcgatttttcggcccccgttacttccccatgctaatgattttcttcaacctcgtctcaatcttaaccacaccaacaatcacaacccttttcgaatactagggtttcagggattcaatgttcaatgtttctcaacttctgttgaaacgcgtgtgaatgagaataattttgagaggatttacattcaaggtggtgtgaatgtgaaaccattagtggtggaaagtgttgttgtaaaagaagaagaagaatctcatgtggagaaacaagcttggaaattgttgaaggatgctgttgtgacttattgcgggaatcctgtggggacagtggctgctaatgatcctggtgataagttgccgttgaattatgatcaagtgtttattcgggattttgttccgtcggctcttgcttttttgcttaaaggggatactgagattgttaagtactttcttcttcataccttgcaattgcagagttgggagaaaactgtggactgctacagtccaggacagggtttgatgcctgctagtttcaaagttagaaccgtagctcttgacggagatacacgtgaagaagttttagatcctgattttggggaatcagctattggtcgagttgcacctgtagattcaggattgtggtggatcatcctattacgggcttatgggaagatcaccggtgactacagtttgcaagaaagggttgatgttcaaacaggcttgaaaatgattcttaaattgtgtctaacagatggttttgatatgtttccatctctgctagtcactgatgggtcttgtatgatagacaggcgtatgggcattcatggtcatccccttgaaatccaagcattattttactcagctcttcgatgctcgcgtgaaatgcttgttgtaactgatggaaccaatgatcttgttagagccattaacaacagactgagtgcactatcgttccacattagacaatattattgggtggatatgaaaaagattaatgaaatatatagatacaacacagaagagtactccatggatgccatcaacaaattcaacatctatcctgaacaaattcctttctgggtaatggattggattcctgaaaaaggtggatatctaattggaaatctacaaccagctcacatggatttccggtttttcacacttggaaatctttggtccattatttcatctctgagcactccaagacagaacgaggctattttgaatctgatagaagcaaaatgggacgaacttgtggggcatatgcctcttaagatatgttatcctgccttggataatgaagagtggcggataattactggcagcgacccaaagaataccccttggtcatatcacaatggcggatcgtggccaacccttctgtggcagttcacactggcatgcatcaaaatggggagaattgaactagcccagaaagcagttgatttagccgagaaaaggctgccagttgattcttggcctgaatattatgatactcgttctggaaaatttatcggaaaacaatccaggctgtatcaaacatggaccatagctgggttccttacatccaagttgcttttaaaaaatccaaaaatggcgtccatgttattttctgaggaagattatgatcttcttgatatatgtgtttgtggacttagcaagaggggaaggaaaaaatgctcccgtggtgctgccaagtctcaaattcttgtatga

SEQ ID NO: 8529 - DNA, 4275 bp, Vitis vinifera
atgattaccatccattgttttgcaaactccaccatgaaatcctcctctagaatcctactatttcgccgaaacttgccgttttctggatgcccacttccaaaatcccaccatttcttggccagtaatctatccaattttcgcattaattctgatcatacttgtaaatttcgttcctgccctttacagaacttggggtttcgtcgcgttattgatcatacccagaagttttctcgggtacccagtccggggtttggccaatctagggttatttccagcggtaatgttaggcgtctatctgtgatttctagtgtttcttccgatgttaggagtttttcgacgtcggttgagacccgtgtgaatgacaagaactttgagaagatttatgttcagggtggtatgaatgtgaagccattggtggtggaaagaattgatatagatgaaacaatagaaaataatgaagaatctaggatagaagttgatggaaattttttgaatggggagaatgtgaagggtgtggatgagagtgaggttttgattacaaagagagaggagtctgaggctgagaaagaggcttggaagttgttgcaagattcagttgtgatgtattgcggtagcccaattgggactatggccgcaaatgatcccggtgacaagacgccgctcaattatgatcaagtgtttatccgggacttcgtaccatcggcactcgctttcttgcttaagggagagggggagattgtgaggaacttcctccttcataccttgcaattgcaggtgattcacatgctcttctgttttaaggttttgtatctgttgtagtaattgtgaaattccattattatttatgaagtttcatcaaatgatgttgttttaatgtcgaattatgcttttgccattcaattcggagagatgatgattttggtgattggctcaaatttcgcatcaagcttgtgaattcaaatgccatgggaattataatttagtagtttcattatgaggtggtttctaaatgcccatgttagaaaatctctgttgctagttttggtcccccattgaccattaaattgagacgaaaggggggtggagtgttgctttaggaaaaactctcattatatcatatcatcatgttccacatcagataggagaagaagtttctagaactttgtgtggtggagacatgtttttaagccatgaggacttactgggccaaagtggacaatatccacacaagatgaagcaggtcatcatgtataaatacatccaggggaatcatgcacatttagtctcccttttcaccaccaaagaaattgcagttgctttcatacataatattaacagggggattatctatagttggaagttgtaaattggtatggatttgtttgtgatgttattgagaaaagtatattgcttcttcctcgagtaatgcaattaacattttccataaaatttgaaggtgtctattcattctatgtttacattattttagccaatcattagcattgggtgtaatgcatgtaaagtgtggccgtttattgtatgatggttctgtaggcactgaatattttctcttttgctccttagagttgggagaaaacagtggactgctacagcccagggcaggggctgatgccagcaagttttaaagttaggacagtgcctcttgatggcaataatgaggctcatgaagaagttttagatccagattttggtgagtcagctattggtcgtgttgcacctgtggattccggtaagagaacaattgtatccctgtcttgtttagctgtggacaattccttttgggacaacctttttcccttaaacttagttggtttgttatatgtatcttgacttctttgacagggttgtggtggattatcttattaagggcttatggaaagatcactggtgactatacattacaagaaagggtggacgtccagacgggcataaaactgattctaaacttgtgtttgactgatggatttgatatgtttccttctctgcttgtaactgatggctcctgtatgatagatcggcggatgggtattcatggtcacccccttgagatccaggtgagttgaattaccaataactgcatttgtcgggcttcttaatagaatcaacaacttcacttattgttgttttaacttatgacaagaagtttgattccgcaggccttattctactctgctcttcgctgctcccgtgagatgctcactcagaatgatgcatcaataaatttagtgagggccataaataacaggctcagtgcattgtcattccacatcagggaatactattgggtggatatgaaaaagattaatgagatataccgatataagacagaggaatactccactgatgccaccaacaagttcaatatctaccctgatcagattcccagttggctaatggattgggtcccagaggaaggcgggtatctgataggaaatctacagccagctcacatggacttcaggttcttcacacttggaaatctttggtcaattatttcatccttggggactccaaaacagaatcagggtattcttgataccattcaagctaaatgggatgatcttgtggggcatatgcctcttaaaatatgttaccctgctttggagtatgaggagtggcgtataatcactggcagtgacccaaagaatacgtgagtagaatttctcatgctgtttctgcacacttgtttgtgaaaatcccttaacactgattccttttgtttggattttacagcccctggtcatatcataatggtggatcttggccaacgcttttatggcaggtaagctgggatttgattccagtatgcatgtttttgaggaattagggctgcgagtcaggtggtgtgagttgggttgggattgcgtccaacctgaacccaacctaaattaatgaacactcagaccaaaccccaacctaacctcgaacctaaggtgcttaacttgagcccaactcactctcatttttttgagctcgaattaagtttcggttaggctcggctccggttgagtgggtgtttgggttgtatgggtcaaattgggttgggttgggtttaacctgcttgttttttttaacttcatctttgatatgtttatcaaaatttaaatactaaggctatgtttggttccccgaaaatttaagggaaaatgcaagggaaagaaaataaagagaaaaagtaaaagaaaaataaaaaatagattcaaggtcaataaattatttttatataatactttaaactcatttcactttttttagctcatcgatataaaaattaaagaatttaaaaatgtataagtttctaacttattcaaattatatttgattttctttcatattttttcatagtacaatcaaatatgagaaaaatcattttccttaatatttttctcctttctttaatactttatgagaaccaaacacaacccaaataatacattatcttgagagaataagaaaaaaaatccatttatctttttggaaaaatgaaatagtatataatataattaaatttcatatttaaaaaaaattatttgaaagcatataaattgaataatcttatttttataagattattcaatttatatgcttatattactatatgtaataagattaataatcttattacatatagtaatataaattataaaatattatatcaattttgggttaagcttaggtcacccaaacccttagcccaattggtttccgttgagaaaattcaacccaagtattaaaaatgcttgtacaagccttctcaaatatgcggttgagtttagactgtttagtcaaccttcctaagttgcacccctgtgagaggaggaatgctaaataaacctaaattctccctcacattggattcacatgtctgctatcctattaactgagcttgacatgctcactaataaatcatctcttccgcttatttcagttcacattggcttgcattaagatgggcagaccagaactagccaggaaggcggttgctgatgcagagaagaggctcgcagttgatcgttggccagaatattatgatacccggaacggaagattcattggaaagcaatccaggctctttcaaacatggacaattgctgggtacctgacatctaagatgctcttggagaacccagagatggcagccttgctattctgggaggaggactatgatcttcttgagatatgtgtctgtggcctcagcaaaactggccggagaaaatgctcacgattcgccgccaggtcacagattcttgtgta

SEQ ID NO: 8530 - DNA, 4269 bp, Vitis vinifera
ttaccatccattgttttgcaaactccaccatgaaatcctcctctagaatcctactatttcgccgaaacttgccgttttctggatgcccacttccaaaatcccaccatttcttggccagtaatctatccaattttcgcattaattctgatcatacttgtaaatttcgttcctgccctttacagaacttggggtttcgtcgcgttattgatcatacccagaagttttctcgggtacccagtccggggtttggccaatctagggttatttccagcggtaatgttaggcgtctatctgtgatttctagtgtttcttccgatgttaggagtttttcgacgtcggttgagacccgtgtgaatgacaagaactttgagaagatttatgttcagggtggtatgaatgtgaagccattggtggtggaaagaattgatatagatgaaacaatagaaaataatgaagaatctaggatagaagttgatggaaattttttgaatggggagaatgtgaagggtgtggatgagagtgaggttttgattacaaagagagaggagtctgaggctgagaaagaggcttggaagttgttgcaagattcagttgtgatgtattgcggtagcccaattgggactatggccgcaaatgatcccggtgacaagacgccgctcaattatgatcaagtgtttatccgggacttcgtaccatcggcactcgctttcttgcttaagggagagggggagattgtgaggaacttcctccttcataccttgcaattgcaggtgattcacatgctcttctgttttaaggttttgtatctgttgtagtaattgtgaaattccattattatttatgaagtttcatcaaatgatgttgttttaatgtcgaattatgcttttgccattcaattcggagagatgatgattttggtgattggctcaaatttcgcatcaagcttgtgaattcaaatgccatgggaattataatttagtagtttcattatgaggtggtttctaaatgcccatgttagaaaatctctgttgctagttttggtcccccattgaccattaaattgagacgaaaggggggtggagtgttgctttaggaaaaactctcattatatcatatcatcatgttccacatcagataggagaagaagtttctagaactttgtgtggtggagacatgtttttaagccatgaggacttactgggccaaagtggacaatatccacacaagatgaagcaggtcatcatgtataaatacatccaggggaatcatgcacatttagtctcccttttcaccaccaaagaaattgcagttgctttcatacataatattaacagggggattatctatagttggaagttgtaaattggtatggatttgtttgtgatgttattgagaaaagtatattgcttcttcctcgagtaatgcaattaacattttccataaaatttgaaggtgtctattcattctatgtttacattattttagccaatcattagcattgggtgtaatgcatgtaaagtgtggccgtttattgtatgatggttctgtaggcactgaatattttctcttttgctccttagagttgggagaaaacagtggactgctacagcccagggcaggggctgatgccagcaagttttaaagttaggacagtgcctcttgatggcaataatgaggctcatgaagaagttttagatccagattttggtgagtcagctattggtcgtgttgcacctgtggattccggtaagagaacaattgtatccctgtcttgtttagctgtggacaattccttttgggacaacctttttcccttaaacttagttggtttgttatatgtatcttgacttctttgacagggttgtggtggattatcttattaagggcttatggaaagatcactggtgactatacattacaagaaagggtggacgtccagacgggcataaaactgattctaaacttgtgtttgactgatggatttgatatgtttccttctctgcttgtaactgatggctcctgtatgatagatcggcggatgggtattcatggtcacccccttgagatccaggtgagttgaattaccaataactgcatttgtcgggcttcttaatagaatcaacaacttcacttattgttgttttaacttatgacaagaagtttgattccgcaggccttattctactctgctcttcgctgctcccgtgagatgctcactcagaatgatgcatcaataaatttagtgagggccataaataacaggctcagtgcattgtcattccacatcagggaatactattgggtggatatgaaaaagattaatgagatataccgatataagacagaggaatactccactgatgccaccaacaagttcaatatctaccctgatcagattcccagttggctaatggattgggtcccagaggaaggcgggtatctgataggaaatctacagccagctcacatggacttcaggttcttcacacttggaaatctttggtcaattatttcatccttggggactccaaaacagaatcagggtattcttgataccattcaagctaaatgggatgatcttgtggggcatatgcctcttaaaatatgttaccctgctttggagtatgaggagtggcgtataatcactggcagtgacccaaagaatacgtgagtagaatttctcatgctgtttctgcacacttgtttgtgaaaatcccttaacactgattccttttgtttggattttacagcccctggtcatatcataatggtggatcttggccaacgcttttatggcaggtaagctgggatttgattccagtatgcatgtttttgaggaattagggctgcgagtcaggtggtgtgagttgggttgggattgcgtccaacctgaacccaacctaaattaatgaacactcagaccaaaccccaacctaacctcgaacctaaggtgcttaacttgagcccaactcactctcatttttttgagctcgaattaagtttcggttaggctcggctccggttgagtgggtgtttgggttgtatgggtcaaattgggttgggttgggtttaacctgcttgttttttttaacttcatctttgatatgtttatcaaaatttaaatactaaggctatgtttggttccccgaaaatttaagggaaaatgcaagggaaagaaaataaagagaaaaagtaaaagaaaaataaaaaatagattcaaggtcaataaattatttttatataatactttaaactcatttcactttttttagctcatcgatataaaaattaaagaatttaaaaatgtataagtttctaacttattcaaattatatttgattttctttcatattttttcatagtacaatcaaatatgagaaaaatcattttccttaatatttttctcctttctttaatactttatgagaaccaaacacaacccaaataatacattatcttgagagaataagaaaaaaaatccatttatctttttggaaaaatgaaatagtatataatataattaaatttcatatttaaaaaaaattatttgaaagcatataaattgaataatcttatttttataagattattcaatttatatgcttatattactatatgtaataagattaataatcttattacatatagtaatataaattataaaatattatatcaattttgggttaagcttaggtcacccaaacccttagcccaattggtttccgttgagaaaattcaacccaagtattaaaaatgcttgtacaagccttctcaaatatgcggttgagtttagactgtttagtcaaccttcctaagttgcacccctgtgagaggaggaatgctaaataaacctaaattctccctcacattggattcacatgtctgctatcctattaactgagcttgacatgctcactaataaatcatctcttccgcttatttcagttcacattggcttgcattaagatgggcagaccagaactagccaggaaggcggttgctgatgcagagaagaggctcgcagttgatcgttggccagaatattatgatacccggaacggaagattcattggaaagcaatccaggctctttcaaacatggacaattgctgggtacctgacatctaagatgctcttggagaacccagagatggcagccttgctattctgggaggaggactatgatcttcttgagatatgtgtctgtggcctcagcaaaactggccggagaaaatgctcacgattcgccgccaggtcacagattcttgtg

SEQ ID NO: 8531 - DNA, 2321 bp, Vitis vinifera
atgaaatcctcctctagaatcctactatttcgccgaaacttgccgttttctggatgcccacttccaaaatcccaccatttcttggccagtaatctatccaattttcgcattaattctgatcatacttgtaaatttcgttcctgccctttacagaacttggggtttcgtcgcgttattgatcatacccagaagttttctcgggtacccagtccggggtttggccaatctagggttatttccagcggtaatgttaggcgtctatctgtgatttctagtgtttcttccgatgttaggagtttttcgacgtcggttgagacccgtgtgaatgacaagaactttgagaagatttatgttcagggtggtatgaatgtgaagccattggtggtggaaagaattgatatagatgaaacaatagaaaataatgaagaatctaggatagaagttgatggaaattttttgaatggggagaatgtgaagggtgtggatgagagtgaggttttgattacaaagagagaggagtctgaggctgagaaagaggcttggaagttgttgcaagattcagttgtgatgtattgcggtagcccaattgggactatggccgcaaatgatcccggtgacaagacgccgctcaattatgatcaagtgtttatccgggacttcgtaccatcggcactcgctttcttgcttaagggagagggggagattgtgaggaacttcctccttcataccttgcaattgcagagttgggagaaaacagtggactgctacagcccagggcaggggctgatgccagcaagttttaaagttaggacagtgcctcttgatggcaataatgaggctcatgaagaagttttagatccagattttggtgagtcagctattggtcgtgttgcacctgtggattccgggttgtggtggattatcttattaagggcttatggaaagatcactggtgactatacattacaagaaagggtggacgtccagacgggcataaaactgattctaaacttgtgtttgactgatggatttgatatgtttccttctctgcttgtaactgatggctcctgtatgatagatcggcggatgggtattcatggtcacccccttgagatccaggccttattctactctgctcttcgctgctcccgtgagatgctcactcagaatgatgcatcaataaatttagtgagggccataaataacaggctcagtgcattgtcattccacatcagggaatactattgggtggatatgaaaaagattaatgagatataccgatataagacagaggaatactccactgatgccaccaacaagttcaatatctaccctgatcagattcccagttggctaatggattgggtcccagaggaaggcgggtatctgataggaaatctacagccagctcacatggacttcaggttcttcacacttggaaatctttggtcaattatttcatccttggggactccaaaacagaatcagggtattcttgataccattcaagctaaatgggatgatcttgtggggcatatgcctcttaaaatatgttaccctgctttggagtatgaggagtggcgtataatcactggcagtgacccaaagaataccccctggtcatatcataatggtggatcttggccaacgcttttatggcagttcacattggcttgcattaagatgggcagaccagaactagccaggaaggcggttgctgatgcagagaagaggctcgcagttgatcgttggccagaatattatgatacccggaacggaagattcattggaaagcaatccaggctctttcaaacatggacaattgctgggtacctgacatctaagatgctcttggagaacccagagatggcagccttgctattctgggaggaggactatgatcttcttgagatatgtgtctgtggcctcagcaaaactggccggagaaaatgctcacgattcgccgccaggtcacagattcttgtgtagtaagaatccattctcttcaaggctgaatttgaatgccttttagaattgtacagttccaaggttagaacagagtcgagaagcatagttctgaacccttaaaatttacatgaaagagttcagtagttcactaactcctgctgcagaaataatatacgttttcgtccgatcaaccagacaagttgatcagcatcggaatactagtctatggggagccttagaactagaaaaatggttccattgatggctgtctgtatgtatgttatgtaacattcattacatgtttacactgataatctcatttctcaaagcattgataagaaatggtttttctg

SEQ ID NO: 8532 - DNA, 2630 bp, Vitis vinifera
attcaaaccatttcgctcgtcaacgtgttttttttcttcaactgtaagttaaaaaatcattccatttgatttccatttctcattttatatacatatatagtgatttttatcctcctttttgcctatattttttactctctgttgatcaaattttcaggatcgacagagctctgtatatatataaaaattgttccatttcaacctcatttgatatatataatattttgattttttacggatcatgaactcgagcagttatattggaattacgaccatgaaaccctactgtagagttctaaccagctgtaggaattcctccattttcaaattcccatcttcaaaatcaaaccatttcattgctgataattcgtcgaaatttcaatccaagttgatccatagccggagattccactgttgtagcgctcaaattctgggtaagaaatgtggaatcaattcgaatcggagggcttttcggttgtccgatccgaattggggccaaattagggtttacagaagttgtagtggtgctcatggaggtaggagaggtgttttggtgatctcgaatgtggcgtcggattttaggaagcattcgacgtcggtggagagtcatgtgaatgagaaggggtttgagagcatttatatcaatggtggattgaatgtgaagccattggtgattgaaagaattgagaggggtcatgtagaggaggagtcgggcttagaatttaaggacccggatgtgaattttgatcattcagagggtttgaataaggaaaaggttgagagagaggtgcccgagattgaaaaagaggcatggaggctgttgagaagtgcagttgtggattactgtggaaatccggtggggactgttgcagctaatgacccaggggataagcaaccgctgaattatgatcaggtctttattcgggattttgtcccatcagcgcttgcattcttgcttaaaggagagggagagattgtgaagaattttctccttcatacattacagttacagagttgggagaagactgtggactgctacagccctgggcaagggttgatgccagcaagttttaaagttagaactgtgcctcttgatggcggcaatggagcatttgaggaagttttggatcctgattttggtgaatcagcgattgggcgtgttgcccctgttgattctgggttgtggtggatcattttgttgagagcttatggaaagatcacgggtgactatgcattgcaagaaagagtagatgtccagacaggcataagactgatccttaatttatgtttaactgatgggtttgacatgttcccttctcttttagtcactgatggttcctgcatgattgatagacgcatgggtattcacggccaccctcttgaaatccaagccttattctattcagcactacgttgctcccgtgagatgatcactgtcaatgatggaaccaagaatttggtgagggccatcaacaaccgattaagtgccctgtcatttcatatccgagagtattattgggtggatatgaagaagatcaatgagatatatcgttacaagacagaggaatactctacagatgccatcaacaagttcaacatttatccggatcaaattcctacctggctggtagattggatacctgaccaaggtggctatcttattggcaatctacaacctgcacatatggatttcagatttttcacccttggaaatctttggtccattatatcatctttgggtactgccaaacagaatgagggtattctgaatttaattgaagccaaatgggatgatcttgtggcacatatgcctcttaaaatatgttaccctgctctagagaatgaggaatggcgtataatcactggcagtgacccaaaaaacacgccatggtcatatcataatggtggatcttggccaacactcctgtggcagttcacattggcctgcattaagatgggaaggccagaattagcaagaaaggcagttgctttagctgaagagagactttcagtagaccactggcctgaatattatgacacacgaaatgggcggttcataggcaagcagtcacggctctaccaaacatggacaattgctggattcctgacttcaaagatgctcttggaaaacccagagatggcgtccctgttggcttgggaagaggactatgagctccttgagatttgtgtctgcgcacttagcaaaaccggtcgaaagaagtgctcacgcagtgctgcaagatcccagattcccgtccagtgagaattccttcatcctaattaacacttccattgcctgttgtagtatttaccgtcgtttaggcaaccataggacacaacaataaacacgaggaagagcatggtgggtgacttggttttatacaagagagacaatgcttctcagattcttggctgacaagttagtcccttgtattttctgacagccactttagcttaaaatatttgttagatgtatgtacattcaattgaaatagatgactgatatgtagtcggatggatggctgacgtttttagagagcctctgcctttacatgaatgttcttcaaattgtaagtttgtaaccaactggtgttgtatcaacatttatatattcatatgacttcaattta

SEQ ID NO: 8533 - DNA, 4269 bp, Vitis vinifera
ttaccatccattgttttgcaaactccaccatgaaatcctcctctagaatcctactattacgccgaaacttgccgttttctggatgcccacttccaaaattccaccatttcttggccagtaatctatccaattttcgcattaattctgatcatacttgtaaatttcgttcctgccctttacagaacttggggtttcgtcgcgttattgatcatacccagaagttttctcgggtacccagtccggggtttggccaagctagggttatttccagcggtaatgttaggcgtctatctgtgatttctagtgtttcttccgatgttaggagtttttcgacgtcggttgagacccgtgtgaatgacaagaactttgagaagatttatgttcagggtggtatgaatgtgaagccattggtggtggaaagaattgatatagatgaaacaatagaaaataatgaagaatctaggatagaagttgatggaaattttttgaatggggagaatgtgaagggtgtggatgagagtgaggttttgattacaaagagagaggagtctgaggctgagaaagaggcttggaagttgttgcaagattcagttgtgatgtattgcggtagcccaattgggactatggccgcaaatgatcccggtgacaagacgccgctcaattatgatcaagtgtttattcgggacttcgtaccgtcggcactcgctttcttgcttaagggagagggggagattgtgaggaacttcctccttcataccttgcaattgcaggtgattcacatgctcttctgttttaaggttttgtatctgttgtagtaattgtgaaattccattattatttatgaagtttcatcaaatgatgttgttttaatgtcgaattatgcttttgccattcaattcggagagatgatgactttggtgattggctcaaatttcgcatcaagcttgtgaattcaaatgctatgggaattataatttagtagtttcattatgaggtggtttctaaatgcccatgttagaaaatctctgttgctagttttggtcccccattgaccattaaattgagacgaaaggggggtggagtgttgctttaggaaaaactctcattatatcatatcatcatgttccacatcagataggagaagaagtttctagaactttgtgtggtggagacatgtttttaagccatgaggacttactgggccaaagtggacaatatccacacaagatgaagcaggtcatcatgtataaatacatccaggggaatcatgcacatttagtctcccttttcatcaccaaagaaattgcagttgctttcatacataatattaacagggggattatctatagttggaagttgtaaattggtatggatttgtttgtgatgttattaagaaaagtatattgcttcttccttgagtaatgcaattaacattttccataaaatttgaaggtgtctattcattctatgtttacattattttagccaatcattagcattgggtgtaatgcttgtaaagtgtggccatttattgtatgatggttctgtaggcactgaatattttctcttttgctccttagagttgggagaaaacagtggactgctacagcccagggcaggggctgatgccagcaagttttaaagttaggacggtgcctcttgatggcaataatgaggctcatgaagaagttttagatccagattttggcgagtcagctattggtcgtgttgcacctgtggattccggtaagagaacaattgtatccctgtcttgtttagctgtggacaattccttttgggacaacctttttcccttaaacttagttggtttgttatatgtatcttgacttctttgacagggttgtggtggattatcttattaagggcttatggaaagatcactggtgactatacattacaagaaagggtggacgtccagacgggcataaaactgattctaaacttgtgtttgactgatggatttgatatgtttccttctctgcttgtaactgatggctcctgtatgatagatcggcggatgggtattcatggtcacccccttgagatccaggtgagttgaattaccaataactgcattcgtcgggcttcttaatagaatcaacaacttcacttattgttgttttaacttatgacaagaagtttgattccacaggccttattctactcagctcttcgctgctcccgtgagatgctcactcagaatgatgcatcaataaatttagtgagggccataaataacaggctcagtgcattgtcattccacatcagggaatactattgggtggatatgaaaaagattaatgagatataccgatataagacagaggaatactccactgatgccaccaacaagttcaatatctaccctgatcagattcccagttggctaatggattgggtcccagaggaaggcgggtatctgataggaaatctacagccagctcacatggacttcaggttcttcacacttggaaatctttggtcaattatttcatccttggggactccaaaacagaatcagggtattcttgatactattcaagctaaatgggatgatcttgtggggcatatgcctcttaaaatatgttaccctgctttggagtatgaggagtggcatataatcactggcagtgacccaaagaatacgtgagtagaatttctcatgctgtttctgcacacttgtttgtgaaaatcccttaacactgattccttttgtttggattttacagcccctggtcatatcataatggtggatcttggccaacgcttttatggcaggtaagctgggatttgattccagtatgcatgtttttgaggaattagggctgcgagtcaggtggtgtgagttgggttgggattgcgtccaacctgaacccaacctaaattaatgaacactcagcccaaaccccaacctaacctctaacctaaggtgtttaacttgagcccaactcactctcatttttttgagctcgaattaagtttcggttaggctcggctccggttgagtgggtgtttgggttgtatgggtcaaattgggttgggttgggtttaacctgcttgttttttttaacttcatcttcgatatgtttatcaaaatttaaatactaaggctatgtttgattccctgaaaatttaagggaaaatgcaagggaaagaaaataaagagaaaaagtaaaagaaaaataaaaaatagatttaaggtcaataaattatttttatatactactttaaactcatttaactttttttagctcatcgatataaaaattaaataatttgaaaatgtataagtttctaacttattcaaattatatttgattttctttcatattttttcatagtacaatcgaatatgagaaaaatcattttccttaatatttttctcctttctttaatactttatgagaaccaaacacaacccaaataatacattatcttgagagaataagaaaaaaaatccatttatctttttggaaaaatgaaatagtatataatataattaaatttcataattaaaaaaaattatttgaaagcatataaattgaataatcttatttttataagattattcaatttatatgcttatattactatatgtaataagattaataatcttattacatatagtaatataaattataaaatattatatcaattttgggttaagcttaggtcacccaaacccttagcccaattggtttccgttgagaaaattcaacccaagtattaaaaatgcttatacaagccttctcaaatatgcggttgagtttagactgtttagtcaaccttcctaagttgcacccctgtgagaggaggaatgctaaataaacctaaattctccctcacattggattcacatgtctgctatcctagtaactgagcttgacatgctcactaataaatcatctcttccggttatttcagttcacattggcttgcattaagatgggcagaccagaactagccaggaaggcggttgctgatgcagagaagaggctcgcagttgatcgttggccagaatattatgatacccggaacggaagattcattggaaagcaatccaggctctttcaaacatggacaattgctgggtacctgacatctaagatgctcttggagaacccagagatggcagccttgctattctgggaggaggactatgatcttctcgagatatgtgtctgtggcctcagcaaaactggccggagaaaatgctcacgattcgccgccaggtcacagattcttgtg

SEQ ID NO: 8534 - DNA, 3715 bp, Vitis vinifera
atgaactcgagcagttatattggaattacgaccatgaaaccctactgtagagttctaaccagctgtaggaattcctccattttcaaattcccatcttcaaaatcaaaccatttcattgctgataattcgtcgaaatttcaatccaagttgarccawagccggagattccactgttgtagcgctcaaattctgggtaagaaatgtggaatcaattcgaatcggagggcttttcggttmtccgatccgaattggggccaaattagggtttacagaagttgtagtggtgctcatggaggtaggagaggtgttttggtgatctcgaatgtggcgtcggattttagaaagcattcgacgtcggtggagagtcatgtgaatgagaaggggtttgagagcatttatatcaatggtggattgaatgtgaagccattggtgattgaaagaattgagaggggtcatgtagaggaggagtcyggcttagaatttaaggacccggatgtgaattttgatcattcagagggtttgaataaggaaaaggttgagagagaggtgcccgagattgaaaaagaggcatggaggctgttgagaagtgcggttgtggattactgtggaaatccggtggggactgttgcagctaatgacccaggggataagcaaccgctgaattatgatcaggtctttattcgggattttgtcccatcagcgcttgcattcttgcttaaaggagagggagagattgtgaagaattttctccttcatacattacagttacaggtgagttgtggtttttattttgatttttcttctggtttgatgttgatgttactgtttgtttcccttttatgttaagtgaatttctgctragtgatgcacatgatttcattatttttgtgtgtaataraataagggcattatcatycatcttttgaaatttattcaattatcgggtttacctagcattgtaaactagaaatccatcattcaaatgaaaagaaattgagagtcatctccacagacaatgataraggagaggtttaagggtttcttgaaattcaagtttaggattgttttttatttactttgtggtgatggctgctactttctgtaaaagcctattcttgtaatgatttttttttttttttttgcataaatcatatgtgaaagaaacatgagttaaaaattttctgtacaacacccacatgattattaaacaaattatggaaagaatcagtgaggccttatacagaaactaaatgggaaaaattttgaatccyttatttggtcagatgtcctgacttataatgaaatttagcatcacaaacgccaaagaacaaggaatatcttttcctcatttacaagaaaaaaaagaattcctagtttcatcatggaaaataatacccctttgacaaaatatgaagccacaatgaagggtaatagcatactggggaagcctattgaaggcctgtagttcaaatagctagcttgtgcaaatttgggatttctgtgagctttgacataaatttaaacatatcgttttggtgtttgttgcttagagttgggagaagactgtggactgctacagccctgggcaagggttgatgccagcaagttttaaagttagaactgtgcctcttgatggkggcaatggagcatttgaggaagttttggatcctgattttggtgaatcagcgattgggcgtgttgcccctgttgattctggtaggtttagctttgctacatgatctgttgttatttttctcagttgcttcatatccagatgttratccagtgcttttcatgcaataagattaattcttacctacacatattaaataacaatctgacagttygcattgtgtaaaatctgaagcactgttttatatgttaactactctgacagggttgtggtggatcattttgttgagagcttatggaaagatcacgggtgactatgcattgcaagaaagagtagatgtccagacaggcataagactgatccttaatttatgtttaactgatgggtttgacatgttcccrtctcttttagtcactgatggttcctgcatgattgatagacgcatgggtattcacggccaccctcttgaaatccaagtaagttgtgcatgctstgtgtagttrtgagctttttgtatgtattggattattwagcttggattttggtgaactattcttctccatttattacttgttcaagaagattagatattaaggtagaattagttatgttgctaatggttgtatggcatcttcctttggctattattttgcaattcttgcttattccctccatgtgaatgtttggatgagtaggttttcaagwtcatgtgttcaacatatatctcatgtctttctttacagctttcgattggtgcttcaagtttctggtctcttatcattttgttgacaaatcttatttcacaggccttattctattcagcactacgttgctcccgtgagatgktcactgtcaatgatggaaccaagaatttggtgagggccatcaacaaccgattaagtgccctgtcatttcatatccgagagtattattgggtggatatgaagaagatcaatgagatatatcgttacaagacagaggaatactctacagatgccatcaacaagttcaacatttatccggatcaaattcctacctggctggtagattggatacctgaccaaggtggctatcttattggcaatctacaacctgckcatatggatttcagatttttcacccttggaaatctttggtccattatatcatctttgggtactgccaaacagaatgagggtattctgaatttaattgaagccaaatgggatgatcttgtggcacatatgcctcttaaaatatgttaccctgctctagagaatgaggaatggcgtataatcactggcagtgacccaaaaaacacgtgaggctctttagagtttcrtgttcttttcttgcstcaacctcatttgtcagcacctccacatcaattctagtaaaatattcttattcaaacactgaatttctctgcttacttgcaggccatggtcatatcataatggtggatcttggccaacactcctgtggcaggtaaaatttctcgtgattatatagtatgagttccctgaaccttttttgtaaagcttccagaatgattatctttctacatgttaattcattagaaagcacttcttatcttcacagtgtttttgtcccccatcatccttttcctcattataaatcattttgaaccaaattgaggttcaacaattaggtctaccaaaagagcagttgctgaaaaattaatccgcatctatataataatgatggggaatgctggccatatcatactaatgcttctsgttctctgcatttcagttcacattggcctgcattaagatgggaaggccagaattagcaagaaaggcagttgctttagctgaagagagactttcagtagaccactggcctgaatattatgacacacgaaatgggcggttcataggcaagcagtcacggctctaccaaacatggacaattgctggattcctgacttcaaagatgctcttggaaaacccagagatggcgtccctgttggcttgggaagaggactatgagctccttgagatttgtgtctgcgcacttagcaaaaccggtcgaaagaagtgctcacgcagtgctgcaagatcccagattcccgtccag

SEQ ID NO: 8535 - DNA, 2009 bp, Glycine max; identical to SEQ ID NO: 8144

SEQ ID NO: 8536 - DNA, 1662 bp, Glycine max; identical to SEQ ID NO: 8145

SEQ ID NO: 8537 - DNA, 1479 bp, Glycine max; identical to SEQ ID NO: 8141

SEQ ID NO: 8538 - DNA, 1720 bp, Glycine max; identical to SEQ ID NO: 8139

SEQ ID NO: 8539 - DNA, 2421 bp, Glycine max; identical to SEQ ID NO: 8149

SEQ ID NO: 8540 - DNA, 2478 bp, Medicago truncatula; identical to SEQ ID NO: 8150

SEQ ID NO: 8541 - DNA, 2544 bp, Medicago truncatula; identical to SEQ ID NO: 8151

SEQ ID NO: 8542 - DNA, 1662 bp, Glycine max; identical to SEQ ID NO: 8145

SEQ ID NO: 8543 - DNA, 2009 bp, Glycine max; identical to SEQ ID NO: 8144

SEQ ID NO: 8544 - DNA, 1533 bp, Glycine max; identical to SEQ ID NO: 8153

SEQ ID NO: 8545 - DNA, 1533 bp, Glycine max; identical to SEQ ID NO: 8152

SEQ ID NO: 8546 - DNA, 1551 bp, Glycine max; identical to SEQ ID NO: 8472

SEQ ID NO: 8547 - DNA, 1639 bp, Glycine max; identical to SEQ ID NO: 8471

SEQ ID NO: 8548 - DNA, 1677 bp, Glycine max; identical to SEQ ID NO: 8473

SEQ ID NO: 8549 - DNA, 1745 bp, Glycine max; identical to SEQ ID NO: 8474

SEQ ID NO: 8550 - DNA, 1761 bp, Glycine max; identical to SEQ ID NO: 8475

SEQ ID NO: 8551 - DNA, 1383 bp, Medicago truncatula; identical to SEQ ID NO: 8476

SEQ ID NO: 8552 - DNA, 1630 bp, Glycine max; identical to SEQ ID NO: 8485

SEQ ID NO: 8553 - DNA, 1191 bp, Glycine max; identical to SEQ ID NO: 8484

SEQ ID NO: 8554 - DNA, 756 bp, Glycine max
atgctaagcataacacacaactaacaaaatggagcctgtggtccacacctcttcccccttctttctccacctttttggctccctataaactccgtctttcactcacaatgctccaagagacaaggctctaaccgttttcttgctccagcactttcttctacttcttcatcatcattgtcaccaccactcacaatggagatcaagagtagagagaggatacaagtgtcaattgaaaaggtgaggagagacagcacagttgaagttgaagatgaagaagaggaggatgaaagtgtggttggtggtgagggtggtcttgcagaagatgagaagaagaaaggtggtggagggagtgggagaagagggtcaagtggagtttctccaccttcttgtcaggcagagatgtgtggtgctgatttgactgttgcaaagaggtaccatcgccgccataaggtgtgtgagcttcattccaaggctccttctgtgatggttgcaggactgaggcagaggttttgccagcaatgtagcaggttccaagagctggcagagtttgatgaagctaaaagaagctgccggagacgcttggccagacataacgagcggcgccggaaaagcaatgctgaaacttgcaatgaaggatgcagtggaagcaaagggcagcaccctacagaaagccactgcagaaatgctgatgtctggggaagaattcagatgaacattgcaaagaattctggctacaactccttccatattagatga

SEQ ID NO: 8555 - DNA, 1189 bp, Glycine max
attcatgcaaaatcaatccccactccccacttactctaagaattgatatttaaactttgctttatttgcttatcattacaagacaaaaaaatccccatgcattacttctcccaccctatgctaaccaaagcacacaactaattaacaaaatggagcctgtggtccacacctcttcccccttctttctccacctttttggctccctataaactccctctttcactcacaatgctccaaaagacaaggctctaactgttttcttgctccagcactttcttcttcttcatcatcattgtcagaccactcacaatggagatcaagagtggagagaggaggcaagtgtcaattgagaaggtgaggagagacaacacagttgaagtagaagatgaagaagaggaggatgaaagtgtggttggtggtgagggtggtcttgcagaagatgaaaggaagaaaattggtggaggaagtgggagaagagggtcaagtggagtttctccaccttcttgtcaggcagagatatgtggtgctgatttgactgttgcaaagaggtaccatcgccgtcataaggtgtgtgagcttcattccaaggctccttctgtgatggttgcaggactgaggcagaggttttgccagcaatgtagcaggttccatgagctggcagagtttgatgaagctaaaagaagctgccggagacgcttggccagacacaacgagcggcgccggaaaagcaacgctgaaacttgcaatgaaggatgcagtggcagcaaagggcagcaccctgcagaaacccactgcagaaatactgatgactggggaagaattcagatgaacattgcaaagaattctggctacaagttcttccatatcagatgaatccaatgtgttcatcagcatgctccctctcttctgtcaatgaatcttcacagtttacatgccaaggcatataataaaggccccttttttatgttacgagaataagcatctaaaccagaatgaaaaactcccaacatctaaaggaggtgtcgtatgtataatactagttcatttcccttaagctctatattctatttacttagtcagtttcttctgtttctgtgtgccttggaatataagtattctgttgtgccacccttaatatggtgtacccctattcccccttgattagaataaaatccattgcttctttgac

SEQ ID NO: 8556 - DNA, 1211 bp, Glycine max
gattcatgcaaaatcaatccccactccccacttactctaagaattgatatttaaactttgctttatttgcttatcattacaagacaaaaaaatccccatgcattacttctcccaccctatgctaaccaaagcacacaactaattaacaaaatggagcctgtggtccacacctcttcccccttctttctccacctttttggctccctataaactccctctttcactcacaatgctccaaaagacaaggctctaactgttttcttgctccagcactttcttcttcttcatcatcattgtcagaccactcacaatggagatcaagagtggagagaggaggcaagtgtcaattgagaaggtgaggagagacaacacagttgaagtagaagatgaagaagaggaggatgaaagtgtggttggtggtgagggtggtcttgcagaagatgaaaggaagaaaattggtggaggaagtgggagaagagggtcaagtggagtttctccaccttcttgtcaggcagagatatgtggtgctgatttgactgttgcaaagaggttccatcgccgtcataaggtgtgtgagcttcattccaaggctccttctgtgatggttgcaggactgaggcagaggttttgccagcaatgtagcaggttccatgagctggcagagtttgatgaagctaaaagaagctgccggagacgcttggccagacacaacgagcggcgccggaaaagcaacgctgaaacttgcaatgaaggatgcagtggcagcaaagggcagcaccctgcagaaacccactgcagaaatactgatgactggggaagaattcagatgaacattgcaaagaattctggctacaagttcttccatatcagatgaatccaatgtgttcatcagcatgctccctttcttctgtcaatgaatcttcacagtttacatgccaaggcatataataaaggccccttttttatgttacgagaataagcatctaaaccagaatgaaaaactcccaacatctaaaggaggtgtcgtatgtataatactagttcatttcccttaagctctatattctatttacttagtcagtttcttctgtttctgtgtgccttggaatataagtattctgttgtgccacccttaatatggtgtacccctattcccccttgattagaataaaatccattgcttctttgaccaaaaaaaaaaaaaaaaaaaa

SEQ ID NO: 8557 - DNA, 2004 bp, Glycine max; identical to SEQ ID NO: 8502

SEQ ID NO: 8558 - DNA, 2062 bp, Glycine max; identical to SEQ ID NO: 8503

SEQ ID NO: 8559 - DNA, 2067 bp, Glycine max; identical to SEQ ID NO: 8504

SEQ ID NO: 8560 - DNA, 1090 bp, Glycine max; identical to SEQ ID NO: 8465

SEQ ID NO: 8561 - DNA, 1029 bp, Glycine max; identical to SEQ ID NO: 8466

SEQ ID NO: 8562 - DNA, 1412 bp, Glycine max; identical to SEQ ID NO: 8467

SEQ ID NO: 8563 - DNA, 1278 bp, Glycine max; identical to SEQ ID NO: 8468

SEQ ID NO: 8564 - DNA, 2062 bp, Glycine max; identical to SEQ ID NO: 8503

SEQ ID NO: 8565 - DNA, 2004 bp, Glycine max; identical to SEQ ID NO: 8502

SEQ ID NO: 8566 - DNA, 1745 bp, Glycine max; identical to SEQ ID NO: 8474

SEQ ID NO: 8567 - DNA, 1677 bp, Glycine max; identical to SEQ ID NO: 8473

SEQ ID NO: 8568 - DNA, 655 bp, Glycine max; identical to SEQ ID NO: 8514

SEQ ID NO: 8569 - DNA, 734 bp, Glycine max; identical to SEQ ID NO: 8515

SEQ ID NO: 8570 - DNA, 886 bp, Vitis vinifera
ctgctcctttctcccacataccatcaccttcttgaagtgtttttctgattgttcaattccctcatttatggaagctaagaagatggtgaagaaggagatggagggcactgaggaggttgatgaggatgatcaattgggctgttctgaggatgacaagaagaagaaggccgcagctgggggctccgggaagaaggccgccgccgcgatgaggtgctgtcaagctgagaggtgcactgctgatctcactgatgctaagcagtaccataggaggcataaggtctgtgagcatcatgccaaggctcaagtggtggttgtgggcggaatccggcagcgcttctgtcagcaatgcagcagattccatgagctctcagagtttgatgaagccaaaagaagttgccgcaggcgtttggcaggacacaatgaaaggcgcagaaagaactcagctgatcatgcagaaggctcaagccggaaaggcactcagttgaaggaaatcgtttgtgggcaggttgatgatagaggcagaattcagattacaatccaagagaatgccgcttacaagcatttccagatcagatgatcaaaagttgtaattgttttcccaccagcatgctctctctcttctgtcattgtgaggcactgctagaataatgacagtggttctactgttctacctcatatgtatgtattgaagaaatgtactcaagcatagcatagcatatgctagctgcagcaggaggattgtaacattcatttcacagccctggcgtcatatggcttgttggggggcagtaggtatctgtgagggatgaaatgagtttgacatacaaacttgcttaatattgcttagactatatgtatcttgtatttgtcaattgggctcttaccc

SEQ ID NO: 8571 - DNA, 925 bp, Betula platyphylla
gcgggggtacgtgtgtgtttgagttttgtgtgtgtttgtttttgacaattctctcgtcaccaccaccaccttctcctatgtacaacaaaaaacaaacaagacccagaaagtatgaccatgtggtcctaattccctcactcacacactaaaacttctcctcttttttgtcaccttttctgccaactataattcagtgaatcagtcccaacccccccaacacacccacatccagaaactggttaatatcttcttccttccttccttttaaaagttcttgttttggggtaccatgaatctgggcaaggttgatgggagctgttaccagaagatggtgaagaaggaggcggaggaagatcaggtttctgatgaggaattggtggagagtggtgtggaggaagagaagaagaagaaaggggtggtgggtagtggtggaaagaggtgctgtcaagctgagaagtgtacggcggatctgagtgatggaaagcagtaccacaagaggcataaggtgtgtgaacatcatgccaaggctcaggttgtgcttgtgggtgggatgaggcagaggttttgtcagcaatgcagcagatttcatgagttatcagaatttgatgaaaccaagaggagttgccggaggcggttggccggacataacgaacggcgaagggagaacactgctgagtctcatgcagaaggctcaagccgcaagggcacaggcactcatcagttgaaggatattgtttgtgggcaggttgatgataggggaagaattcagataactatccatgagaactccacttacaagcatttccagatcagataagatctcaagctactatgctctctctcttctgtcataggatgtaatattgagagttccaaccttgttctgtatcacctatttactgggaattgtatttaggtcaagtac

SEQ ID NO: 8572 - DNA, 2067 bp, Glycine max; identical to SEQ ID NO: 8504

SEQ ID NO: 8573 - DNA, 1546 bp, Glycine max; identical to SEQ ID NO: 8507

SEQ ID NO: 8574 - DNA, 1643 bp, Glycine max; identical to SEQ ID NO: 8508

SEQ ID NO: 8575 - DNA, 1266 bp, Glycine max; identical to SEQ ID NO: 8509

SEQ ID NO: 8576 - DNA, 1090 bp, Glycine max; identical to SEQ ID NO: 8465

SEQ ID NO: 8577 - DNA, 1412 bp, Glycine max; identical to SEQ ID NO: 8467

SEQ ID NO: 8578 - DNA, 1278 bp, Glycine max; identical to SEQ ID NO: 8468

SEQ ID NO: 8579 - DNA, 1412 bp, Glycine max; identical to SEQ ID NO: 8467

SEQ ID NO: 8580 - DNA, 1639 bp, Glycine max; identical to SEQ ID NO: 8471

SEQ ID NO: 8581 - DNA, 1677 bp, Glycine max; identical to SEQ ID NO: 8473

SEQ ID NO: 8582 - DNA, 1191 bp, Glycine max; identical to SEQ ID NO: 8484

SEQ ID NO: 8583 - DNA, 1630 bp, Glycine max; identical to SEQ ID NO: 8485

SEQ ID NO: 8584 - DNA, 655 bp, Glycine max; identical to SEQ ID NO: 8514

SEQ ID NO: 8585 - DNA, 1163 bp, Glycine max; identical to SEQ ID NO: 8486

SEQ ID NO: 8586 - DNA, 1077 bp, Glycine max; identical to SEQ ID NO: 8487

SEQ ID NO: 8587 - DNA, 1122 bp, Glycine max; identical to SEQ ID NO: 8488

SEQ ID NO: 8588 - DNA, 1551 bp, Glycine max; identical to SEQ ID NO: 8472

SEQ ID NO: 8589 - DNA, 1630 bp, Glycine max; identical to SEQ ID NO: 8485

SEQ ID NO: 8590 - DNA, 1038 bp, Glycine max
acctaaactaaactaaacaaaagagaaataaataataaaaaggagaagatgatttagaaattggtttgtgaagagaagaggatgaataagagtgggggaggagagatgagtaagtggccgttcacaatgtctcagtggcaggaactggaacatcaagctttgatttacaaatacatggtggctggtcttcctgtccctcctgatctagtccttcccattcagaacagcttccactccatttcccaaaccttcttgcaccatccctctaccaccatgagttattgttccttctatgggaagaaggtggacccggagccaggacgatgcaggaggactgatgggaaaaagtggaggtgctccaaggaagcctacccagactccaagtactgtgagcgacacatgcaccgtggccgcaaccgttcaagaaagcctgtggaatcacaaactatgactcagtcatcatctaatgtgtcatcattgactgtaactgctggcagcagcagcagtgcaactggaaatttccataaccttaccaccacaaatgcatatggtaatccccaagggactggttctggatcagaccaaacccactatcacatggattccattccctatgggatcccaagtaaagaatacaggtattttcaaggacctaaatctgagggaggtgaacatagtttcttgtccaaaactttaggaagcaacaaggttcttcacatggagtcacagatggataacactttgatgccaaccagtggagttgcctcattctctacattgagatcaaataataattccatgttgcagggtgattatctgcagccttctttcttatctagtgagtatgcctcagcagaaactgtgaagcaagagggtcagttccttcgacctttctttgatgaatggcctaaaaggagggactcatggtctggtctggaagatgagggatccaaccacactcaactctcaatatccattcctatgtcagcatcaaatttctctacaactagctctcattccccacatggtgagatttaa

SEQ ID NO: 8591 - DNA, 1016 bp, Glycine max
actcaactaaactaaactaaagaaaagaataataaaaaggagaagatggtttagaattggtttgagaagagaagagtgggggaggagagatgagtaagtggcctttcacaatatctcagtggcaggaactggaacatcaagctttaatttacaaatacatggtggctggtcttcctgtgcctcctgatctagtcattcccattcagaacagcttccactccatttcccaaaccttcttgcaccatccctctaccaccatgagttattgttccttctatgggaagaaggtggacccggagccaggacgatgcaggaggactgatgggaaaaagtggaggtgctccaaggaagcctacccagactccaagtactgtgagcgacacatgcaccgtggccgcaaccgttcaagaaagcctgtggaatcacaaactatgacacagtcatcatccaatgtgtcatcattgactgtaactgctggcagcagcaccagtgcaactggaaatttccagaacctttccaccacaaatgcatatggtaatccccaagggactgcttctggaacagaccaaacccactatcacatggattccattccctatgggatcccaagtaaagaatacaggtattttcaaggatctaaatctgaggaacatagtttcttgtccaaaactttaggaagcaacagggttctacacatggagccacagatggacaacactttgatgccaaccggtggagttgcctcattctctacattgagatcaaataataattccatgttgcagggtgattatctgcagccttctttcttatctagtgaatatgcctcggcagaaactgtgaagcaagagggtcagtcccttcgaccgttctttgatgaatggcctaaaagcagggactcatggtctggtctggaagatgagagatccaatcacactcaactctcaatatccattcctatgtcatcgtcaaatttctctgcaactagctctcattccccacatggtgagatttaa

SEQ ID NO: 8592 - DNA, 1223 bp, Glycine max
atgaacaacagcagtggcggaggaggacgaggaactttgatgggtttgagtaatgggtattgtgggaggtcgccattcacagtgtctcagtggcaggaactggagcaccaagctttgatcttcaagtacatgcttgcgggtcttcctgttcctctcgatctcgtgttccccattcagaacagcttccactctactatctcgctctcgcacgctttctttcaccatcccacgttgagttactgttccttctatgggaagaaggtggaccctgagccaggacgatgcaggaggactgatggaaaaaagtggaggtgctccaaggaagcatacccagactccaagtactgcgagcgccacatgcaccgtggccgcaaccgttcaagaaagcctgtggaatcacaaactatgactcactcatcttcaactgtcacatcactcactgtcactgggggtagtggtgccagcaaaggaactgtaaatttccaaaacctttctacaaatacctttggtaatctccagggtaccgattctggaactgaccacaccaattatcatctagattccattccctatgcgattccaagtaaagaatacaggtatgttcaaggacttaaatctgagggtggtgagcactgctttttttctgaagcttctggaagcaacaaggttctccaaatggagtcacagctggaaaacacatggcctttgatgtcaaccagagttgcctctttttctacgtcaaaatcaagtaatgattccctgttgcatagtgattatccccggcattcgtttttatctggtgaatatgtgtcgggagaacacgtaaaggaggagggccagcctcttcgacctttttttaatgaatggcctaaaagcagggagtcatggtctggtctagaagatgagagatccaaccaaacagccttctccacaactcaactctcaatatccattcctatgtcttccaatttctctgcaacgagctctcagtccccacatggtgaagatgagattcaatttaggtaaagtttcagcttctatgtatggattagctgaatcttgcaattatattgttgcggataattaagagcagtccttcgagattttcggtgcaatgttatgaaaggatcaaataagtctagtagtatatgtgtggtccaaaggaatcccatgttcaagtattttcattcaagctgagctgttgtacaactttatggaacctc

SEQ ID NO: 8593 - DNA, 1141 bp, Glycine max
caaatggttccttccgacaaagctcgatccgagtgtgatctcatgtttcggctctaactatgtttgatttcgatacccaacaagagtgtcgtgttattaataggactaagagtagcgcaagtagacaacagtggaaaacatgaacatcagtggcggaggaggaactgtgatgggtttcagtagtaatgggaggtccccattcacagtgtctcagtggcaggaactggagcaccaagctttgattttcaagtacatggttgcgggtcttcctgtgcctcccgatctcgtcctccccattcagaagagcttcgactctactctctctcacgctttctttcaccatcccacactgagttattgttccttctatgggaagaaggtggaccctgagccaggacgatgcaggaggactgatggaaaaaagtggaggtgctccaaggaagcatacccagactccaagtactgcgagcgccacatgcaccgtggccgcaaccgttcaagaaagcctgtggaatcacaaactatgactcactcgtcttcaactgtcacatcactcactgtgactggtggtggtgacagtaatggaactgtaaacttccaaaaccttcccacaaatgcctttggtaatctccagggtactgattctggaactgaccgcacgaattatcatctagattccattccctatgcgattccaagtaaagaatacaggtgtcttcaaggacttaaatctgagggtggtgaacactgcttcttttctgaagcttctggaagcaacaaggttctccaaatggagtcacagctggaaaacacatggccttcgatgtcaaccagagttgcctctttttctacatcaaaatcaagtactgattccctgttgcatagtgattatccccaacattcgtttttatctggtgaatatgcatcgggagaacacgtgaaggaggagggccagcctcttcgacctttttctaatgaatggcctaaaagcagggagtcatggtctggtctggaagatgatatatccaaccaaacagccttctccacaactcaactctcaatatccattcctatgtcttccgatttctctgcaacgagctctcagtccccacatgataattagagcagtccttcaagattt

SEQ ID NO: 8594 - DNA, 1745 bp, Glycine max; identical to SEQ ID NO: 8474

SEQ ID NO: 8595 - DNA, 2004 bp, Glycine max; identical to SEQ ID NO: 8502

SEQ ID NO: 8596 - DNA, 659 bp, Glycine max
atggagagggagagagcattgtttgagagggtgagaaagaatagcacagtggaagaggaagtggaaaatgaagtagaggaggaggatgaaagtggcgttagtattactgaagaagagaagaagaaaggggttggtagtagtggtgggagaagagggtcaagtggaggtagtggaggggtttctccaccttcatgtcaagcagagaggtgtggtgctgatttaactgatgcaaagaggtaccatcgccgccacaaggtgtgtgagtttcattcaaaggcacctgttgtggtggttgcagggctaaggcagaggttttgccagcaatgtagcaggttccatgacctggcagagtttgatgaatccaagagaagctgccgccgccggttggccggacacaacgagcggcgccggaaaagcaacccggaagcttccaatgagggcagcaccaaaggccatcaccctaaggaaacaacacactgcaggcttgcaaatgagagggagagaattcagatgaacctaccagggagttccggctacaagtctttcaacatcagatgaagccaaagtgttcacaaagctctctctcttctgtcaccctttggtttcttacaacccaaggtatataataaaaaccactttgtattgtatgttcacatgag

SEQ ID NO: 8597 - DNA, 752 bp, Glycine max
aacaacaagcatacttacttgatcctccattatctccatcattgtcaccatcacctttctcctccccttttgttgcagaatggaaggtaggagagtggagaggaagaaaacattgtttgagagggtgagaaagaatagcacagtggatgaggaagtggaaaatgaaggggaggaggaggatgaaagtggtgttaatattactgaagaagagaagaagataggggttagtagtggtggtgggagaagagggtcaagtgggggtggtggaggggtttctccaccttcatgtcaagcagagaggtgtggtgctgatttaactgatgcaaagaggtaccatcgccgccacaaggtgtgtgagtttcattccaaggcacctgttgtggtggttgcaggactgaggcagaggttttgtcagcaatgtagcaggttccatgatctggcggagtttgacgaatccaagagaagctgccgcagacggttggctggacacaacgaacggcgcaggaaaaccaacccggaagctgccaatgagggcaacagcaaaggccaacaccctaaggaaacaacacattgcaggcttgcagatgagagggggagaattcagatgaacctaacagggagttctgaatacaagtctttcaacatcagatgaagccaaagtgttcagctagctctctctcttctgtcagcctctggtttcttacaagccaaggcatgtaataaagaccactttgtatgttcacatgagtaag

SEQ ID NO: 8598 - DNA, 1546 bp, Glycine max; identical to SEQ ID NO: 8507

SEQ ID NO: 8599 - DNA, 2062 bp, Glycine max; identical to SEQ ID NO: 8503

SEQ ID NO: 8600 - DNA, 752 bp, Glycine max; identical to SEQ ID NO: 8597

SEQ ID NO: 8601 - DNA, 659 bp, Glycine max; identical to SEQ ID NO: 8596

SEQ ID NO: 8602 - DNA, 2067 bp, Glycine max
atggattgggcttctgaggtaaacttgtataaaaggacagcacagcacagcacaggagatcttggtgcattcggcagacgagaaaacacaaatgggtcatgccgatctcccttgtttgctacaggacaaagagaacattctttcaccagatctgcaaaggaaaacaagaatgccttagatagagccaatgtgaaaaaaggtagagcagaagaaacacctcgttccttgctgctgttagaagtggaaggaaaaaattctgaaatggaatttctacccattttctctttcatttccctgttgttgtgtttggttctgtggcaagtaagtggtgaacctgttgaagacaaggaggctttgcttgactttgtgagcaagttccctccttcaaggcctctgaattggaatgagagttcccccatgtgtgattcttggactggagtgacttgcaatgtagacaagtccaaagtaatagcaattaggttgccaggggttggatttcatggcactattccgcctgatactattagccgcctctcagcactgcaaactttgagcctcagatccaatgtcataactggccatttcccttctgatttttccaatctgaagaacttgtcttttctctatcttcagttcaacaatatttctggtcctttgcctgatttctcagcctggaagaacctcactgttgtcaatttgtccaataaccatttcaatggcaccatcccttcctcccttaacaacttgactcagcttgctggtttgaaccttgcaaacaacagtctttctggagaaattcccgacctcaacctgtcaagattgcaggtgctgaatttgtccaacaacagcttgcagggaagtgtgcctaattccctgctaaggtttcctgagtctgcattcattgggaataacatttcctttggaagttttcccacgtccaggaagcgtggaaggctcagcgaagctgcgctgctgggagttattattgctgctggtgttttaggcctcgtgtgttttgtttctttggtgtttgtgtgctgctcaagaagagttgacgaggatgaggaaaccttcagtgggaagttgcacaagggagaaatgtctcctgagaaagcagtttcaaggaaccaggatgctaacaataaactggttttctttgaggggtgtaattatgcctatgatttggaggatttgttgagggcttctgctgaggtgctgggaaagggaacgtttggaactgcctataaggcaatacttgaggatgcaaccatggttgttgtgaagaggttgaaggaggtagccgctggaaagaaggattttgagcagcacatggagattgtaggaagtcttaagcatgagaatgtggttgagctcaaggcatattattattccaaagatgagaaactcatggtatatgattaccacagtcaggggagcatctcttccatgttgcatggcaaaagaggagaggatagggtgcctttagattgggatactcgactgaaaatagccttaggtgctgcaagaggcattgctcgtattcatgttgagaatggtggcaagcttgtacatggcaacatcaaatcctcaaacatcttcctcaacaccaaacagtatggctgcgtgtctgaccttggcctggcaaccatatcaagctcacttgccttaccaatatcacgagcagccggttaccgtgcaccagaagttacagacaccagaaaggcagcacagccctcagatgtttacagctttggtgtggtgttgctagagcttctgactgggaaatcccctatccacacaactggtggtgatgagattatccaccttgtgaggtgggttcattcagttgtgcgcgaggagtggacagctgaagtgtttgacttagagctgatgagatatcctaacatagaagaagagatggtggaaatgttacagatagccatgtcatgtgtggttaggatgcccgatcagaggcctaagatgtctgaagtagtgaagatgatagaaaatgtgaggcagattgatgcagatactcactcatcatctgggaaccaagtatcaacgtga

SEQ ID NO: 8603 - DNA, 2206 bp, Glycine max
atgtcgccggatctggatagtgataaggaggctttgcttgactttgtgaacaagttccctccttcaaggcctttgaattggaatgagagttcccccttgtgtgattcttggactggagtgacttgcaatgtagacaagtccaaagtaatagcaattaggttgccaggggttggatttcatggcagtattccacctgatactattagccgcctctcggcactgcaaactttgagcctcagatccaatgtaataactggccattttccttctgattttttcaatctcaagaacttgtcttttctctatcttcagttcaacaatatttctggtcctttgcctgacttctcagcctggaagaacctcactgttgtcaatttgtccgataaccatttcaatggcaccatcccttcctcccttagcaaattgactcagcttgctggtttgaaccttgcaaacaacaccctttctggagaaattcctgacctcaacctgtcaagactgcaggtgctgaatttgtccaacaacaacttgcagggcagtgttcctaaatccctgctaaggttttctgagtctgcattctctgggaataacatttcctttggaagttttcccacggtttctccggcgcctcaaccagcttatgagccgtctttcaagtccaggaagcatggaaggctcagcgaagcggcgctgctgggagttattgttgctgctggtgttttagtcctcgtgtgttttgtttctttgatgtttgtgtgctgctcaagaagaggtgatgaggatgaggaaacattcagtggaaagttgcacaagggagaaatgtctcctgagaaagcagtttcaaggaaccaggatgcaaataataaactggttttctttgagggatgtaattatgcctttgatttggaggatttattgagggcttctgctgaggttctgggaaagggaacgtttggaactgcctacaaggcaatacttgaggatgcaaccacggttgttgtgaagaggctgaaggaggtagccgttggaaagaaggattttgaacagcacatggagattgtaggaagtcttaagcatgagaatgtggttgagctcaaggcatattattattccaaagatgaaaaactcatggtatatgattaccacagtcaggggagcatctcttccatgttgcatggcaaaagaggagaggatagggtgcctttagattgggatactcggctgaaaatagccttaggtgctgcaagaggcattgctcgtatccatgttgagaatggtggcaagcttgtgcatggcaacataaaatgctcgaacatcttcctcaattccaaacagtatggctgtgtgtctgaccttggcctggcaaccatatcaagctcacttgccttaccaatatcacgagcagccggttaccgtgcacccgaagttacagacaccagaaaggcagcacagccctcagatgtttacagctttggtgtagtgttgctagagcttctgactgggaaatcccctatccacacaactggtggtgatgagattatccaccttgtgaggtgggttcattcggttgtgcgcgaggagtggacagctgaagtgtttgacttggagctgatgagatatcctaacatagaagaagagatggtggaaatgttgcagatagccatgtcatgtgtggttaggatgcctgatcagaggcctaagatgtctgaagttgtgaagatgattgaaaatgtgaggcagactgatgcacagactcactcatcatctgggaaccaagcagaacaacttaaattttctcaacgtgacaatggtaactctccttccactccctcctacttccagagaggaagtgaatgaaagaacctttgtttgtgatttgagtgcatcttgtcaatgtttaactccaagttctgaacaagagcgtggttattattattatcattattattttttctcatatttaagttgcctgagttatttaaatactattaactagtgggctagtatttgatttgaccctgcccaaaaggaagcgccatgcgctgccgtacagcaatctaagtggttataacttataatgtgaagcatttcttttgtgtgtaaactgtgcagtctttaccaagaaggtgcacctgtttgtttttcccttgcaagaggtctaacaactattacctcttgtttatttattatattagaattttttgag

SEQ ID NO: 8604 - DNA, 1266 bp, Glycine max; identical to SEQ ID NO: 8509

SEQ ID NO: 8605 - DNA, 1122 bp, Glycine max; identical to SEQ ID NO: 8488

SEQ ID NO: 8606 - DNA, 1077 bp, Glycine max; identical to SEQ ID NO: 8487

SEQ ID NO: 8607 - DNA, 1340 bp, Glycine max
ggtcgagttgggactctagtggtgctaaagtcgaacttaatcactctgtttctctcgttaccgttctctatctatgcccatctcttcaggcaatggcaaacaaacagcacaaccacaatgataacaacaaggagcttcaaccactccttgtgcttggtcctcctttcatgttcccaacctttgaagctcaaaaccttcacaactaccgtttcctcaatgccttttcctcccaaatccctctccaccaattcctcgccgagcaaaacgttgacccttcatccattcaagccatactctgcagccctcgccagaagatctccgcagacgccatccggctcctcccatcactcagcctcattgtgaccactagtaatggaacccgccacatagacttggctgagtgcagctaccgtggcattcaggttgcctctattccaggagatcaattagccgtggatgttgctgacatgactgtggggttgttgattgatgtcatgtggaacatttctgcagctgatcgacatcttaggaaatggggtccttctaagccctgcaatctttcttctggttccaagctagaaggcaagcgagtaggcattgttggattgggaaaaattggcagagaagttgctaaaaggctggaggccttcggctgcagaattatgtacaattcaagaaaccagaagccatttgtctcgtaccctttttactctaatgttgttgagcttgctggtaatagtgatgtccttgtgctttcttgctcattaaatgagcaaacaaggcacatagtcaaaagggaagtgatgttggcattggggaaagaaggagttattgtgaatattggacgtggagatctaattgatgaaaaggaattggtgagatgtttgatggaaggggagataaagggtgctggcttggatgtgtttgagaatgagcctaatgttcccaaagagctctttcctttggataatgttgtcctttcacctcatgctgcttcattgacttcacatcgtatatatgatgtttgtgaacgtgtagcagagtgtcttgaagcattcttttcaagtaaactaccggagtaccctggtcttggatgactaaattcatctttaagggcatttgtatgagactgagttatgatcttcttctctctctctcctttatctatatttatttcacaagtagttaaccatgttaagaagtaattaaaatgtctaataaaagttaattacttgtgaatcaaaattaatcatatttatatatttggacatgggatgtacatttgaaaaatgtacaactatcaatattctattatctattacacttatcactttttcttt

SEQ ID NO: 8608 - DNA, 1358 bp, Glycine max
ttttttttttttttttttatttttttttttttttttaataaaatattgatagttgtacatttttcaaatgtacatcccatgtccaaatatataaatatgattaattttgattcacaagtaattaacttttattaaacattttaattacttcttaacatggttaactacttgtgaaataaatatagataaaggagagagagagaaaaaaatcataactcagtctcatacaaatgcccttaaagatgaatttagtcatccaagaccagggtactccggtagtttacttgaaaagaatgcttcaagacactctgctacacgttcacaaacatcatatatacgatgtgaagtcaatgaagcagcatgaggtgaaaggacaacattatccaaaggaaagagctctttgggaacattaggctcattctcaaacacatccaagccagcaccctttatctccccttccatcaaacatctcaccaattccttttcatcaattagatctccacgtccaatattcacaataactccttctttccccaatgccaacatcacttcccttttgactatgtgccttgtttgctcatttaatgagcaagaaagcacaaggacatcactattaccagcaagctcaacaacattagagtaaaaagggtacgagacaaatggcttctggtttcttgaattgtacataattctgcagccgaaggcctccagccttttagcaacttctctgccaatttttcccaatccaacaatgcctactcgcttgccttctagcttggaaccagaagaaagattgcagggcttagaaggaccccgtttcctaagatgtcgatcagctgcagaaatgttccacatgacatcaatcaacaaccccacagtcatgtcagcaacatccacggctaatcgatctcctggaatagaggcaacctgaatgccacggtagctgcactctgccaagtctatgtggcgggttccattactagtggtcacaatgaggctgagtgatgggaggagccggatggcgtctgcggagatcttctggcgagggctgcagagtatggcttgaatggatgaagggtcaacgctttgctcggcgaggaattggtggagagggatttgggaggaaaaggcattgaggaaacggtagttgtgaaggttttgagcttcaaaggttgggaacatgaaaggaggaccaagcacaaggagtggttgaagctccttgttgctatcattgtggttgtgctgtttgtttgccattgcctgaagagatgggcatagatagagaacggtaacgagagaaacagagtgattaagttcgactttagcaccactagagtcccaactcgaccatgtgtccc

SEQ ID NO: 8609 - DNA, 999 bp, Glycine max
atggcagaaaaacacaaccacattgataataaggagattcaaccactccttgtgtttggtcctccattaatcttcccaacttttgaagctcgaaactttcacaaataccgattcctcaaagctttctcctcacaactccctctccaccaattcctcaccgagcaaaatgttgacccttcatccattcaagccatactctgcagcccttcacagcaggtctctacagatgtcatccagctcctcccatcgctctgcgtcattgtgaccagcagtgctggaaccgaccacatagacttggttgagtgtagccaccatggtattcaggttgtctctgttccaggagatcaagccaaggatgttgctgacatggctgtggggttgttgattgatgtgttgtggaaaatttctgccgctgatcgacatgttaggaaatggggtccttctatgcaccggaacctttcttttggttccaagcttaaaggcaagcgagtagggattgttggattgggaaaaattggcaaagaagttgctaaaaggcttgagccctttggttgcagaattatgtaccattcgagaaaccagaagccatttatctcgtaccctttttattctaaagttgttgagcttgctggtaatagtgatgtccttgtgctttgttgcccacttaacgagcaatcaaggcacttaatcaacagggaagtgatgttggcattggggaaagatggagctattgtcaacgttggacgtggagctctaattgatgaaaaggaattggtgcggtgtttgatggaagatgagataaggggtgctggcttggatgtgtttgagaatgagcctaatgttcccaacgagctctttccattggataatgtggtcctctccccacatgctgcttcattgacttcagatggtttcactgaagtatgtgaacttgcagctgaggctctagaattgttcttttcaagtaaattaccaagtattcgattgttggatggctaa

SEQ ID NO: 8610 - DNA, 990 bp, Glycine max
atggcagacaaaccgcacaaaaaccacaatgataacaacaaggagcatcaaccactccttgtgcttggtcctccattcatgttcccaatttttgaagctcaaaaccttcacaactaccatttcctcaatgccttctcctcattcaagttacctttattccagtttcttccaactcaatccattcaaaccatactatgcagccctcgccagaagatctctgcagatttcatcgggctcctcccattgctcagcctcattgtgaccagcagtgctggaaccgaccacatagacttggttgagtgcagccgccatgatattcaggttgtctctgttccaggagatcaagccaaggatgttgctgacatggccgtggggttgttgattgatgtactgtggaaaatttctgctgctgatcgacatgttaggaaatggggtctttctatgccccagaatctttcttttggttccaagctaaaaggcaagtgagtagggattgttggattgggaaaaattggcaaagaagttgctaaaaggcttgaggcctttgattgcagaattatgtaccattcaagaaacgagaagccatttatcttgtaccctttttattctaatgttgttgagcttgctggtaatagtgatgtccttgtgttttgttgcccacttaatgagcaaacaaggcacataatcaacagggaagtgatgctggggaaagatggagttattgtcaatgttggacgtggatctctaattgatgaaaaggaattggtgtggtgtttgatggaagaagagataagggatgctggcttggatttgtttgagaatgagcctaacgttcccaacgagctctttccattggataatgtcgtcctctccccacatgcagcttcattgacttcagatggtttcaccgaagtatgtgaacttgccgcagaggctctagaagtgttcttttcaagtaaactaccgagtactcaagtgttggatgactaa

SEQ ID NO: 8611 - DNA, 1293 bp, Glycine max
cacaactcagaaaggaaagctttgaggtttcttccgcattttagagtggtgagaggatggtgggtgttatttcgttggtaacagggatggctggtcctagtgggtttggatcagcttccactgcagaacaggttactgatggaattgatgccagcaacctcactgcaattatcacaggaggagcaagtggtataggcttggagacagcaagagtgttggctcttcgaaaggtccatgtgatcattgcagttcggaacatggtgtctgcaaaggaggctaaacaacaaatactagaggagaatgagtctgcacgagtggacgtaatgaagctcgacctttgctcagtgaattctattacatcatttgtggacaacttcatagctcttgatcttcctctcaacattttaataaacaatgctggagtaatgttctgcccattcaagctctcagaggatggcattgagatgcaatttgcaacaaaccatcttgacaaaatgcaacaaactgcaaaagccactggaatagagggcaggatcataaatctgtcatcaattgcccataactacacttatagaaaggggattagatttaataagatcaatgaacgaaaaggttatggtaacaagaaggcgtatgggcagtccaagttagcaaacatattacatacaaatgagctttctcgtcgcctgcaggaagagggtgtgaatatcacagccaactcggtccatccaggagtgataatgactcctcttatgagacactcatcttaccttatgcatttcttaaaggtcttcaccttttacatatggaagaacgtcccccagggagcagccacgacatgctatgttgctctccacccaagcgtgaaaggtgtaactgggaagtactttgtggattgcaatcaatgcaaaccaagttcacacgccaaaaacaaacagcttgcaaagaaactctgggatttcagtaacgatttgatcaaatcaatttcgaaagcttgagtgcacttgcagctaggtggttttctccttagggaaattaaaagccttcgttgtggtcaccagtttatgaaaactagctcgttatgcaataaaaagcacgttacagttatagttataatttgtcgttgtctgaggatgtttccaaacattttattccccactgaaccaccaggaggtgtttcatttcttttcatccaaacatttctgtatcaaacgtttcgtttcatccataagttagttgtgtagttacaatcaaataaaattgtttgcaatttactggcttatgtttatacca

SEQ ID NO: 8612 - DNA, 1237 bp, Glycine max
atggtgggtgttatttcgttggtaacaggaatggctggtccaagtgggtttggatcagcttcaactgcagaacaggttactgaaggagttgatgccagcaacctcactgcaattatcacaggaggagcaagtggtataggattggagacagcacgagtgttggctcttcgaaaggtccatgtcatcattgcagtacgaaacatggtgtctgcaaaagaggctaaacaacaaatactagaggagaatgagtctgcacgagtggacataatgaagctcgacctttgctcagtgaattctattagatcatttgtggacaacttcatagctcttgatcttcctctcaacattttaataaacaatgctggagtgatgttctgcccattcaagctctcagaggatggcattgagatgcaatttgcaacaaaccatcttgacaaaatgaaacaaactgcaaaagccactggaatagagggcaggatcataaatctgtcatcaattgcccataactacacttacagaaaggggattagatttaataagatcaatgaacggaaaggttacggtaacaagaaggcgtatggacagtccaagttagcaaacatattacatacaaatgagctttctcgtcgcctgcaggaagagggtgtgaacattacagcaaactcagtccacccaggagtgataatgactcctcttatgagacactcttcttaccttatgcacttcctcaaggtctttaccttttacatatggaagaacgtcccccagggagcagccacgacatgttatgttgctctccacccaagcgtgaaaggtgtaactgggaagtactttgtggattgcaatcaatgcaaaccaagttcacatgccaaaaacaaacagcttgcaaagaaactctgggatttcagtaacgatttgatcaaatcaatctcaaaagcttgagtgcaacttgcagcaaggtgcttttctccttatggaaattaaaagcatcgttgtggtcaccagtttataaaaactaactcgttatgcaataagaagcacgttacagttgtagttataattatttttcgttgtctgaggatgtttccaaacatttcattcccccactgaacccaccaggtgtttgttgcatttcttttcatccaaacatttatgtatcaaacatttcatttcatccataagttgtggctataatcaaatacaattattagcaatttacttgcttatgtttatacca

SEQ ID NO: 8613 - DNA, 1323 bp, Glycine max
cacaactcagaaaggaaagctttgaggtttcttccgcattttagagtggtgagaggatggtgggtgttatttcgttggtaacagggatggctggtcctagtgggtttggatcagcttccactgcagaacaggttactgatggaattgatgccagcaacctcactgcaattatcacaggaggagcaagtggtataggcttggagacagcaagagtgttggctcttcgaaaggtccatgtgatcattgcagttcggaacatggtgtctgcaaaggaggctaaacaacaaatactagaggagaatgagtctgcacgagtggacgtaatgaagctcgacctttgctcagtgaattctattacatcatttgtggacaacttcatagctcttgatcttcctctcaacattttaataaacaatgctggagtaatgttctgcccattcaagctctcagaggatggcattgagatgcaatttgcaacaaaccatcttggtcatttccacttgacaaacctgcttcttgacaaaatgcaacaaactgcaaaagccactggaatagagggcaggatcataaatctgtcatcaattgcccataactacacttatagaaaggggattagatttaataagatcaatgaacgaaaaggttatggtaacaagaaggcgtatgggcagtccaagttagcaaacatattacatacaaatgagctttctcgtcgcctgcaggaagagggtgtgaatatcacagccaactcggtccatccaggagtgataatgactcctcttatgagacactcatcttaccttatgcatttcttaaaggtcttcaccttttacatatggaagaacgtcccccagggagcagccacgacatgctatgttgctctccacccaagcgtgaaaggtgtaactgggaagtactttgtggattgcaatcaatgcaaaccaagttcacacgccaaaaacaaacagcttgcaaagaaactctgggatttcagtaacgatttgatcaaatcaatttcgaaagcttgagtgcacttgcagctaggtggttttctccttagggaaattaaaagccttcgttgtggtcaccagtttatgaaaactagctcgttatgcaataaaaagcacgttacagttatagttataatttgtcgttgtctgaggatgtttccaaacattttattccccactgaaccaccaggaggtgtttcatttcttttcatccaaacatttctgtatcaaacgtttcgtttcatccataagttagttgtgtagttacaatcaaataaaattgtttgcaatttactggcttatgtttatacca

SEQ ID NO: 8614 - DNA, 1267 bp, Glycine max
atggtgggtgttatttcgttggtaacaggaatggctggtccaagtgggtttggatcagcttcaactgcagaacaggttactgaaggagttgatgccagcaacctcactgcaattatcacaggaggagcaagtggtataggattggagacagcacgagtgttggctcttcgaaaggtccatgtcatcattgcagtacgaaacatggtgtctgcaaaagaggctaaacaacaaatactagaggagaatgagtctgcacgagtggacataatgaagctcgacctttgctcagtgaattctattagatcatttgtggacaacttcatagctcttgatcttcctctcaacattttaataaacaatgctggagtgatgttctgcccattcaagctctcagaggatggcattgagatgcaatttgcaacaaaccatattggtcatttccacttatcaaacctacttcttgacaaaatgaaacaaactgcaaaagccactggaatagagggcaggatcataaatctgtcatcaattgcccataactacacttacagaaaggggattagatttaataagatcaatgaacggaaaggttacggtaacaagaaggcgtatggacagtccaagttagcaaacatattacatacaaatgagctttctcgtcgcctgcaggaagagggtgtgaacattacagcaaactcagtccacccaggagtgataatgactcctcttatgagacactcttcttaccttatgcacttcctcaaggtctttaccttttacatatggaagaacgtcccccagggagcagccacgacatgttatgttgctctccacccaagcgtgaaaggtgtaactgggaagtactttgtggattgcaatcaatgcaaaccaagttcacatgccaaaaacaaacagcttgcaaagaaactctgggatttcagtaacgatttgatcaaatcaatctcaaaagcttgagtgcaacttgcagcaaggtgcttttctccttatggaaattaaaagcatcgttgtggtcaccagtttataaaaactaactcgttatgcaataagaagcacgttacagttgtagttataattatttttcgttgtctgaggatgtttccaaacatttcattcccccactgaacccaccaggtgtttgttgcatttcttttcatccaaacatttatgtatcaaacatttcatttcatccataagttgtggctataatcaaatacaattattagcaatttacttgcttatgtttatacca

SEQ ID NO: 8615 - DNA, 1154 bp, Medicago truncatula
gtgtcacaactcagaaaggaaagggtaccatattttagggctaaatttgaacaatggtgggtgtaatatccttgataacagggatggctggtccaagtgggtttggatcagcttcaactgcagagcaggttactcaaggaattgatgctagcaaccttaccgcaattatcacaggaggagcaagtggtatagggttggagacaacaagagtgttggctcttaggaaggtccatgttatcattgctgcaagaaacattgaatctgcagaggaagccaaacaacaaataacacaagagaacaaatctgcacgagtggacataatgaaacttgacctatgctcaacaaagtctgtccgatcattcgtcgacaacttcattgctcttgatcttcctctcaacatcttaataaacaatgctggaataatgttctgccccttcaaaatctcagaggagggaattgagatgcaatttgcaacaaaccatcttggccatttcctcttgacaaatcttcttcttgacaaaatgaaacaaactgcaaaaacaactggaatagaggggaggatcataaatctatcatcaattgctcatagatacacttactttagaaaggggattaaatttgagaagatcaatgataaaaaaggttattctagcaagaaggcctatggacagtccaagttagccaacatattacatgcaaatgaactctctcgtcgcctgcaggaagagggagtgaacatcacagtcaactctgtccacccaggagtgataatgactcctcttatgagatactcttcttacacaatgcacttgttgaagatcttcagcttttacatatggaagaacgtcccacagggagctgccacgacatgttatgttgcactccacccaagtgtaaaaggtgtaactgggaagtactttgtggattgcaatgaattcaagccaagtgcatatgcaaaaaataaactcttagcaaagaaactttgggatttcagcaacaagttgatcaattcaatttcaaaagcttgattgaccacactttctgtttggttcaccactttattataacctattattatatgccatactgtgttatatactaagctgcacgtttatttactgttaaagttattgttctatgaggatgtttccaaa

SEQ ID NO: 8616 - DNA, 1222 bp, Medicago truncatula
ggtgtcacaactcagaaaggaaagggtaccatattttagggctaaatttgaacaatggtgggtgtaatatccttgataacagggatggctggtccaagtgggtttggatcagcttcaactgcagagcaggttactcaaggaattgatgctagcaaccttaccgcaattatcacaggaggagcaagtggtatagggttggagacaacaagagtgttggctcttaggaaggtccatgttatcattgctgcaagaaacattgaatctgcagaggaagccaaacaacaaataacacaagagaacaaatctgcacgagtggacataatgaaacttgacctatgctcaacaaagtctgtccgatcattcgtcgacaacttcattgctcttgatcttcctctcaacatcttaataaacaatgctggaataatgttctgccccttcaaaatctcagaggagggaattgagatgcaatttgcaacaaaccatcttggccatttcctcttgacaaatcttcttcttgacaaaatgaaacaaactgcaaaaacaactggaatagaggggaggatcataaatctatcatcaattgctcatagatacacttactttagaaaggggattaaatttgagaagatcaatgataaaaaaggtcattctagcaagaaggcctatggacagtccaagttagccaacatattacatgcaaatgaactctctcgtcgcctgcaggaagagggggtgaacatcacagtcaactctgtccacccaggagtgataatgactcctcttatgagatactcttcttacacaatgcacttgttgaagatcttcagcttttacatatggaagaacgtcccacagggagctgccacgacatgttatgttgcactccacccaagtgtaaaaggtgtaactgggaagtactttgtggattgcaatgaattcaagccaagtgcatatgcaaaaaataaactcttagcaaagaaactttgggatttcagcaacaagttgatcaattcaatttcaaaagcttgattgaccacactttctgtttggttcaccactttattataacctattattatatgccatactgtgttatatactaagctgcacgtttatttactgttaaagttattgttctatgaggatgtttccagacacatgtgttattgtgatgtggaatttctgatcatatttattttacttaaaaaaaaaaaaaaaaaaa

SEQ ID NO: 8617 - DNA, 4922 bp, Medicago truncatula
gtgggtgtaatatccttgataacagggatggctggtccaagtgggtttggatcagcttcaactgcagagcaggttactcaaggaattgatgctagcaaccttaccgcaattatcacaggtagtgttacaaatttgaatctctctatagaagatcactttcatcatttgattttatatatgttcattacacaccttatacatgctatcaattaaatctggctcaaatgtaagaaacgattcaatatatccatccatagtaagttttttttttggtcaaccgcataatttttttggtcaaccatatatatagtaagtttatgcacattttaaaatttattacgtgaccatgttaacaacgtaataaatttttgtgggactcaaatgggcggcaagctctccctaagagttttaatgctgctgcatatccaaagctggattcgaattcaggatcttagttaagctagaagagacccgttccatctcatctaagcgctctcgggtagaaaaactaatatactctgttgtgaaaatatatatctttgacttttaaaagtaataaaagtatatatatatatatatatatatatatattaaaatattaaaaattagaatctattttgattatcataaaaaggtaaatgagactaatagagttaatagtgctttacccctataatatatgtcatttccgattttcccctataaaatatttttttttgaattttatccttttaaaactaatattttaatttttctttaaatgaaaactatagttataaggaaagagcagaaaaatacaaaaatttggatgtctaaagtctcaagaataatcaatcgcctttatgatgtacaatacttacactttggagtattgttacaatgcgccccaccttgtagtcccaaatgcaagacagacaagacaacacaagagatatatgacacaagtttgagcatgtcgtataggaaagatatgttcacatgtgccacgaaacaaaataatagaaaatagtactgtactaagaatttagaaaattaattgtttgatttcagtttatttatgaggaatgtacaaccattcgtaggacaacttacttatttgatagatactttatccgtttttacatataagtaaaaaagaaatgttaaataaccattaaaattctcaaatatttagaggggttggggttcgaaccccaacttcaatgtctgatattgtaattttgacatttttatcagttgagtcaggacttgtgcactctcgactttatatttattgtaacaagatcacacacttagttaataagagtaaattactactcccttaatttttttttttataaaagataaatgaatgaacaaaaattgatgtatttagtgtatgttatgaaccaaatatgtcaataaactcattaaaaagaactaaagagagtattttatgtttttatttttttagatttttttaatccatatgaaatgattaaacgccatatttacaatctaatggagaaagtggttattttaggttgataattgttcaggatgttttgctacaaacttttattttttcaagtaaaaacataatgttaataacttcgatctcaatttcgaatgaatcaattttacaaatgtcttcatcaacccatgtttgttcttggctacttcaatctatgtcatatgcacaacatgctaccttctgtgtttgctagtgagttagaaaaaaatagacgccggactacatataaatgaaaaaattcatatatatgtctaatgttttaaagttttgagtgaaacatgtgtccaattcacttgaatgattgcctagtttaatacgataactcactcaaatgttttaaggctctcccatgagtcccaacacttggtaacataaattattgttctgttttactaaatactaatataaaataaaaaaaataatgcaggaggagcaagtggtatagggttggagacaacaagagtgttggctcttaggaaggtccatgttatcattgctgcaagaaacattgaatctgcagaggaagccaaacaacaaataacacaagagaacaaatctgcacgagtggacataatgaaacttgacctatgctcaacaaagtctgtccgatcattcgtcgacaacttcattgctcttgatcttcctctcaacatcttaatgtttgtttctataactcttttatttatttatttagtaaacaaccgttttatttatttcaaaccatgaatttatctatctaagatgagtacaaaataaaataaataacctcaactattaatgagaaaatcaatggtgtctgcatgagggtaactcaatgatagagataatgcattctaatatatcggagttcaaaccaagaattccccatttatttaggtgaatttctagatactaagttacttaagaaacacaaaaatcaatagttgatatttcaatttcgaacacacctttaaatttgtgtgcatgtaaatgtaatatcatatcagttattgatttattcatcaattattgatattgttatactctgaattgaattacttaatttagaagagcaatatacattaaccacatctaacttaataaatttcaatgttttggtacattacatttgaattggacattacagttttggattgaaatattggctttgaatgtcagaaacaatgctggaataatgttctgccccttcaaaatctcagaggagggaattgagatgcaatttgcaacaaaccatcttggtaatgtctcatttatcattcacgacattattgtgttaaaaatgttttatggacacccactttttcatacatttgcggcatctagttaatgacgtgcaaaaacatgattaattcagttgagtagatggttaattcaattcaccttaaaaattatggttcattaaactacttgaactaaccacaatttcggtagtgaattgaactaaccacgtatccaactgaattaaccacattttaaatgcgattaatcaggtgttgtgctcgtgtataaagtggatgtccatgtatcattaatttattgtgctggaccttgttgtatagtaagttttagctttgtaccctattacttaattgttacctctatctaatccctttttaacttcttaggccatttcctcttgacaaatcttcttcttgacaaaatgaaacaaactgcaaaaacaactggaatagaggggaggatcataaatctatcatcaattgctcatagatacacttactttagaaaggggattaaatttgagaagatcaatgataaaaaagggtacttttgctttgactctaattgactaaagttaatttcttgtttcatatggttgtgaagagcactgtaatttattaaatttttgtgttgcttattgctttaactttttcagttattctagcaagaaggcctatggacagtccaagttagccaacatattacatgcaaatgaactctctcgtcgcctgcaggtaacccaacatattacaagtatctttgagtcagagccatcgattaaggaaacaagtataataaaaatattttaaaattgtttagccaaacttttaaaaatgtaagcaatgcttctttcaatattttttttttccttaaccggtaattttgtgaaaagaggaccctctgctataccaatcatcatatcctaattagtggactagttatggagcatgtatattaatttggtgtctcacatttgtcaacaggaagagggagtgaacatcacagtcaactctgtccacccaggagtgataatgactcctcttatgagatactcttcttacacaatgcgtatgttaattctccttaaacacaaaagacaaatataacattgtctatgatttcactcacaaggatatatactttgtgttaagtaatataatatagctcaaaatgaaaattaaatctaatacaattgcattggattaaattagcttttgtgtgtttctttagaaagagataataaactttagaatatacaagatatgcaataattttgtttgtttggacatatatataacattgctattatcggcagaactcatttaagattaaaagcactaatctagaaaagaaagacacatattttcattatgttatttgtatttcaattaatggaaatttgtggtgagattttcctttttttttaagaaaaaatttgtggtgagaataaaactactaatctagaaaattaagtgtattaaaaatatagaaatatgattggtaaatggcattgtattaaaatgctcactgatgtctatttgtttaataagaaatgttagtactttatacttcataaacaaatgctcactaaaataataaatgttgacacaaggatgctacttttgtatgataattgataagtgtattaaaaatatagaaatatgattggtaaatgaattaaaaaaaaaaaaaaaaaagttatgaatgtatgtaatcatgtattgaactagtttgatttgtttataaaattggaattgaattcattaatctcaatgtttttaatttataatctacatttgaatttatattgggtcagattgatttatatactccattgtttatgcagacttgttgaagatcttcagcttttacatatggaagaacgtcccacaggcattttatctaacttaacccttttagttttcctacacatgcaaaattgttaaagaaacatgtaatcactcatccttttttttttttgggtgcttttaatttgcagggagctgccacgacatgttatgttgcactccacccaagtgtaaaaggtgtaactgggaagtactttgtggattgcaatgaattcaagccaagtgcatatgcaaaaaataaactcttagcaaagaaactttgggatttcagcaacaagttgatcaattcaatttcaaaagct

SEQ ID NO: 8618 - DNA, 2674 bp, Medicago truncatula
atggtgggtattttctcgttggttacgggcatggctggaccaagtggatttggatcctctacaacagctgaacaagttactcaaggaattgatgcaagcaacctcactgcaattatcacaggttttttttttaattcaccttgtttgaacatgaaaatgatgtgatatatttcatttctgacacctagaatatatgagttttaatacgtttatgtttatgtttatgtttgtgacttcttgtccttctttttcctcttttgtttgttttgtcggtttctgtttttgtgattctgaatatttgactttgtcatttgtccatatatattctgtcaaccatctaactatatattctgtcaaaaatttatgagggatccgatccattaatcaaataagcatgaatctccctacatgtatcgcaaactcgacttagaatagtcgagttcaatgtgtttgaatattgaggattaaacaaatcatgttttaattagtggtgtttgtatacacgccatgattagttttatcatctaaattcattctacaatactaaacaaattaaatgcaggaggagcaagtggtataggcttggagacagcacgagtcttggctctccgaaaggtgcatgtcatcatcgccgcaagaaacatggagtctgcaaaggaagctaaacaaattatactacaagacaacgagtctgctcgagttgacataatgaagctcgacctttgttcagtgaagtctgttagatcgtttgttgaaaacttcctcgctctcgatcttcctctcaacatcttaatgtatgttgatcatcctcttcttttcattttaacagtgttttatcaattaactaatactaaaggtgattattaaaactgtgtcaaattcttaccacggagttgatacgctagtgtattccaaatagcgacataattggcttttgattttcagaaacaatgctggagttatgttctgccccttccaactgacacaagatggaattgagatgcagtttgcaacaaatcatcttggtatggagtgtttcaaaaacgatccataatatcataatttatttggttgccatttgtgacacaaattttgtgtaattttttcaggtcatttccttttgacaaaccttctacttgagaaaatgaaacaaaccgcaaaagccactggaattgagggcagaatcataaatctttcatcaattgctcatacctacacttatgaagaaggcattcgattggataatatcaatgatcaaattgggtatgcatgttaattaattgttacactttaattccaatgactactaccttttacaataaaaaaatttcccaatatttccataaatttttcagttactctgacaagaaggcttatggacagtccaagttagctaacatactacacgcaaatgagctttctcgtcgcttgaaggtaatctttttcatgtgacacaaataataatactatcaaaatactacatataggtctcattatatatttatatggcatacacaagaatttataatactcgtttctaaaattttaaccaccaaaagagaacatataaaaacattgtgttagagaatatatgtgttcttagtactcaaaaacataaaataatcataatgtaaattgagaataatttgaaaatgatcataaattttcatttgtaagttggatacgatgaatgtcaaatatatctaacaatttattaaacacttacaattgattgacactgttaaaaaaaaaaaatactttggtgcatacaaattatatcaatgtaaactattgtaataaataaatgttggtgagagatattagtaataatcataattagttgttatgcctactagtattatgttttggggccatgggcacgtatttaaaaggaattcattcaatttcaactaccacactacacacgtatgctttttcttacgttctgttttttttttttgacaatatagttcaatgaacttctttatttgttcataagaaacttttttggaggtaaccaaatttgtgcattaaataacaacgtttgattttttgacaggaagaaggtgtcaatatcacagccaactcagtacacccaggagtaataatgactcctcttatgagacactcttctttacttatgagtatgtcgtcaattattctcaaaaccgtacaaattattaacaacagttcaaacaaagaaatacagttagatattattttccttatttattattattattatatgtctgagtctaacacaataatgcaatttcaaacagacttcttgaagatgttcacattttacatatggaagaatgtcccacaggtatttattttaattcctccttattctacaatgttttattttaaataaataaatgcacacaatgaaagtttttgcagatgttaccacgacgcttatgttatttaaaatcttgattctaatcaagttacttaacaatatttgttgttttaatttttgttaatttgaaaattgcagggagctgcaacaacatgctatgttgctcttcatccaagcttgaaaggagtaactgggaagtactttttggattgtaatgagtttcaaccaagtgcttttgcgtcaaatggactattaggaagaaaactttgggattttagcaacaagttgatcaattcaatttcaaagtct

SEQ ID NO: 8619 - DNA, 1234 bp, Glycine max
tgtgctcagtatggtgggaatcttttcgttgattacagggagaccgggatgtagtggattcggatcttcctcaactgctgaacaggttatcgaaggaattgatgccagcaacctcactgcaatcatcacaggaggagccagtggcatagggttggagacagcacgtgttctggcaattcgaaaggcccatgtcataattgctgccagaaacatggagtctgcaaaggaagcgaaacaactcatacttgaggaagacgagtcagctcgtgtggacataatgaagctcgacctatgctcagtgaagtctgtcggaacctttgtggacaacttcattgctcttggtgttcctcttaacatcttaataaacaacgcgggagtcatgttctgcccttatcagcaaacggaagatgggattgagatgcagtttgcaaccaatcatcttgacaagatgaaacaaaccgcaaaagacactggaattgagggcaggatcataaatctttcatcaatagctcatgtctacacttacgaagaaggaattcgatttgataacatcaatgatgaagatggatactctgacaagaaggcctatggacagtccaagttagccaacatattacacacaaacgagctttctcgtcgcttacaggcagaaggtgttaacatcacggccaactcagtccacccaggggtgataatgactcctctcatgagacactcttctttacttatgaattttctgaagatgtttacctttttcgcatggaagaacatccctcagggagcagccacaacgtgctatgtcgctctacacccaagcttgaaaggggtaacggggaagtactttcgggattgtaatgagtgtcaaccaagtacacatgcttcaaacgaactcttaggaaggaaactgtgggattttagcaacaagatgattaattcactttcaaaagcttgattgattgcactatagtattaattagtaccaaagcctcgtcttcctcatatatatcagtgtatcaaaactcgttaattatgcttaatatacccatccaccctacagttataatcataagttctatatatgagggaggatatatcattatttctcatatgattcgtggttatcgatccttgactccatttgtattttgtacgcgtaatatagaggtcttatttatgtatcggacatgtataccatttaatttaaattaaaattaaggcgaaaaaaatatattca

SEQ ID NO: 8620 - DNA, 1313 bp, Glycine max
ggaaattaaactttaagctttgaacacagatttggttattctctatttgtgtgctcagtatggtgggaatcttttcgttgattacagggagaccgggatgtagtggattcggatcttcctcaactgctgaacaggttatcgaaggaattgatgccagcaacctcactgcaatcatcacaggaggagccagtggcatagggttggagacagcacgtgttctggcaattcgaaaggcccatgtcataattgctgccagaaacatggagtctgcaaaggaagcgaaacaactcatacttgaggaagacgagtcagctcgtgtggacataatgaagctcgacctatgctcagtgaagtctgtcggaacctttgtggacaacttcattgctcttggtgttcctcttaacatcttaataaacaacgcgggagtcatgttctgcccttatcagcaaacggaagatgggattgagatgcagtttgcaaccaatcatcttggtcattttctcttgacgaaacttcttcttgacaagatgaaacaaaccgcaaaagacactggaattgagggcaggatcataaatctttcatcaatagctcatgtctacacttacgaagaaggaattcgatttgataacatcaatgatgaagatggatactctgacaagaaggcctatggacagtccaagttagccaacatattacacacaaacgagctttctcgtcgcttacaggcagaaggtgttaacatcacggccaactcagtccacccaggggtgataatgactcctctcatgagacactcttctttacttatgaattttctgaagatgtttacctttttcgcatggaagaacatccctcagggagcagccacaacgtgctatgtcgctctacacccaagcttgaaaggggtaacggggaagtactttcgggattgtaatgagtgtcaaccaagtacacatgcttcaaacgaactcttaggaaggaaactgtgggattttagcaacaagatgattaattcactttcaaaagcttgattgattgcactatagtattaattagtaccaaagcctcgtcttcctcatatatatcagtgtatcaaaactcgttaattatgcttaatatacccatccaccctacagttataatcataagttctatatatgagggaggatatatcattatttctcatatgattcgtggttatcgatccttgactccatttgtattttgtacgcgtaatatagaggtcttatttatgtatcggacatgtataccatttaatttaaattaaaattaaggcgaaaaaaatatattca

SEQ ID NO: 8621 - DNA, 4006 bp, Medicago truncatula
atgtcgatcggagatgctttcttatgcttacttttcctcacaacttattcaatttcagttgcttctgctgattccatctatggctgcggtggattcgttcaggcgagttcatggttggtgaagtccaggaaacaaacagatgccaaattggattattcacatgtcactgttgagcttcaaacggtagatggattggtaaaggatagaacacaatgtgctcctaacgggtactattttattccggtttatgacaagggatcctttgtaattaaagttaatggacctgatgggtggtcatgggatcctgagaaggttcctgtggtagttgacaatcaaggttgcaacaacaatgaagatataaattttcgtttcacagggttggtcattaatttgttctctatatctggtagagttgtgggagctgcaggcggagatagctgtccagttaaaaatggaggtccttcaaatgtaaaagttgaactattgtctccttctggcgatcttgtgtcatcagtcttgacttcatcatcaggaagctacttgtttacaaatgtaattccaggattttttctacccacacagttcatcctaagaagtacaacaaggtatataaaacacaagtttagcaaaggacagtctatcatgcataacatggagatagaggaagatgtcaacgagaatctaagtagggtggatgaaatggagaacgctttgggtgtgatatacagtagaaaattacttctcaagtttgaaaggaaagtttattacacttctataagacccacaattttgtatggaaaatatgagctacgagcttcaaatcgtgatatgaaagttgaagttaaaggttcaacacaggtggaattgggctttggaaatggggtgattgatgacattttctttgtccctgggtatagtatcagtgggtctgttgttgcacagggaaatcctatattaggagtccatatattcttgtattcagaggacgtgtccgaagtagaatgtttgcaaggttctgctaatggtccacgacaagaagtagctctctgtcacgctgtatcagatgcagatggaaaatttgcattcaatttaataccttgtggaagttatgaactagtgccctactataagggtgaaaatacagtatttgatgtttcaccatctagtgtcccagttaatgttaagcatcaacatgtaacagtgcctcaaaaattccaggtacactatattatgggtaaacatgtggtaactggattttctgtcgggggtcgtgtagttgatggaaacgacatgggagtggagggtgtcaagatcatagttgatgggcatgaaaggtctattactgacaatcaaggttattacaagcttgatcaggttacgtccacacactataccattgaagcaaggaagaagcattacaaattcaagaaattggagaattatatggtattaccaaatatggcttcaatagaagacattgtcgccgtttcgtatgatctttgtggtttagttaggatggttagcagcggtcagaaagcaacggtggctttgactcatggacctgataatgtaaaaccacaaaagaaacaaacagatggaaatgggaatttctgctttgaggttcttcctggtgaatatcgcttgtcagctattgctgctactcccgataatgctgctggactcatgtttgctccatcttatattgatgttgcgatcaaaagtccattgttgaatgttgaattttcacaggctttggtcaatgtccgtggtgctgtagtctgcaaggagaaatgcgatccatctgtatctgtgactcttgtcaagcaggctgataaacataatgaagagagaaagacaattagcttgacctccgagcgtagtgaatttctgttttcagatgttattcctggaaaatacaggcttgaggtgaaacatagttcccctgaatcagtgaccatggaagataattggtgctgggagaagagcttcatagatgtaaatgttggagccgaggacttcgaaggaattgtttttgtccaaaaaggctactgggtcaatgttatctccactcatgatgttgatggttacataaatcaaccagatgggtcaactgtgaatttgaagattcggaaaggttcccagcatatatgcgttgaatttcccggaatacatgaatttagttttatcgactcatgtgtcttctttgggagctcatctgtgaaaattgacacatcaaatctattgcccatccatctaaaaggagaaaaacatcttattaaaggacaaataaatgtgcactccggctttcatgatgcattgcctgagaaaatagttgttgatatttatcatgatggagctggcgttggtgataatgccatggccatactcaagtcccacgggaaagatgaaacaaatacttctgtctttgagtattctgtttgggccaatccaggagaaaagcttacctttgttcctcgggactcgaggaatgatggagataaaaagcttttattttatcccagagaacatcatgtatcagtgacagatgataattgtcaagctcatattcctacattttcttgtcggttgggtgtatatatagaaggatcagtctcgcctcctctttctggtgttcatatcaggatttttgctgctggagacagcagtatcactggacttaaaagtggtgaactaatacttgaaacgaccaccggaactgatggctcctttgtagcaggtcctctgtatgatgatgttggttataatgttcaggcttcaaagcctggttatcatttaaaacaagttgggtctcattcctttagttgtcagaagcttggtcagatttcagtacatatacatcacaaagatgataataacgaactcattccttcagttctgttatctttgagtggtgataatggttatagaaacaactcagtatctggggctggaggagcattcctatttgatagtttgtttcctggaatgttctatctgcgtcctgttttgaaggaatatgctttctcacctccagcacaggcaattgagctcgagtcaggggagttcaaagaagttactttccaggccacgcgagtagcttacagtgctattggcttagtcactctgttatctggccaacccaaaggaggagtttcagttgaagcccggtcagtgtcaaaaggctattttgaggaaaccgtaacagattcgtctgggaattatcgtctgagaggactactgcctgatactgtctatgctatcaaagtctctaaaagggatgttatgggaagttctaatatagagcgtgcatctccagattctctttctgttaaggttggaactgaggatatcaagggtttggattttatagtttttgaggagccagatatgacaattgtaagttgtcatgttgaaggaaacggtacggatgagcttcgtaaacatctgatggtcgaaatcaggtctgctagtgagacaagcaagatcgaatcagtcttccccctgccaatttcgaacttcttccaagtgaagggcttatcgaagggcaggcaccttctacaacttcgatctggtctcccgtcaagctcacttagatttgattctgatatcattgaggttgacttggacaaaaatgttcaaacccatgtgggcccactgagatacaggattgatgatcagctgaagcaggagttgactcccgcaccagtatttcctcttataattgcatttctagttgttgcactatttatcagcatccccagattgaacgatttgtatcaagctacgatagacatacctgcaccgggaaccacatcgacttcaagaaaagatgtgaggaagccaacgttgcgaaagaaaacttactaagtctcgttgctacaaccaaaggaatacagtagtataacggctgctcttagttgggatagtttgacatcattcacgttctctcataggtttagatgtttttctttattaatttggaggcgtagatgcaaatggaatgtaa

SEQ ID NO: 8622 - DNA, 4006 bp, Medicago truncatula; identical to SEQ ID NO: 8621

SEQ ID NO: 8623 - DNA, 3884 bp, Glycine max
atgtcgatcggagatgcttttctgtgcttactgttcatcgcaacttgttggatttccgctgcttctgctgattccatctatggctgcggtggatttgtcgaggcgagctcatcgttggtgaagtcgaggaaacaaactgatgccaaattggactattccgatgtcacggttgagcttcaaactgtggatggactggtaaaggatagaacacaatgtgctcccaatggatactattttattccagtatatgacaagggttcctttgtaattaaaattaatggacctccaggatggacatgggatccagaaaaggttcctgtggttgttgacaataatggttgcaatggtaatgaagatataaactttcgtttcacaggattcactatatctggtagagttgtaggagctgtagggggagaaagttgttcagttaaaaatggaggtccttcaaatgtaaaagttgaactattgtctctttcgggggatcttgtctcttcagtcttgacttcatcgtcagggagttacttgtttacaaatataattccaggaaaatacgaactacgtgcttcaaatcctgatatgaaagttgaagttaaaggttcaacacaggttgaattgggctttggaaatggggtagttgatgatattttctttgtccctgggtatagtatcggtggatttgttgttgctcagggaaatccaatattaggagttcatattttcttgtattcagatgatgtttctgaagtagaatgtttgcaaggttctgctaatggtccacgacaagaagttgctctctgtcatgctgtatcagatgctgatgggaagttcacattcaattcaataccttgtggaagttatgaacttgtgccctactataagggtgaaaatacagtatttgatgtttcaccgcccagcgtctcagttaatgttaagcatcagcatgcaacagtgcctcaaaagtttcaggtaactggattttctgttggaggctgcgtagttgatggaaatggcatgggagtggagggggtcaaaatcatagttgatggtcatgaaaggtctattactgacaatcaaggatattacaagcttgatcaggttacatccacgcactataccatagaggcccaaaaggagcattacaaattcaagaaactggagaattatatggtattgccaaatatggcttcgatagaagatatcaatgccatttcatacaatctttgtggtttggttaggatggctagtggtgatctgaaagtgaaggtggctttgactcatggacctgataacgtgaaaccacaaaagaagcaaacagatgaaaatggaaacttctgctttgaggttcttcctggtgaatatcgcttgtcagccattgctgctactcctgagaatgctgctggactcatgtttgctccatcgtatattgatgtcgtggtcaaaagtcccatgttgaatattgaattttcacaagctttggtcaatattcatggtgatgtatcctgcaaggagaaatgtggtccgtttgtatctgttactctggtgagacaggctgataaacataatgaagagagaaagacaattagcttgaccaccaagagtagtgaatttctgttttcaaatgttattcctggaaaatacaggcttgaggtcaaacatagttcccctgaatcagtgaccttggaagataattggtgctgggaacagagcttcatagatgtaaatgttggtgctgaggacttagaaggaatcctttttgttcaaaaaggctactgggtcaatgttatctccactcacaatgttgatggttacctgactcaacctgatgggtcaaatgtgaatttgaaaattcggaaaggtttccagcatatatgtgtagaacaacctggtgtacatgaatttagttttgttgactcatgtatcttctttgggagttcatcagtgaaaattaatacatctgatcaattgcccatccatctaataggagagaagtatcttcttaatggacaaataaatgtgcagtctggctcacttgatgcattgcctgataatatagttgttgatattaaacatgatggagctggtgttattgattatgctacagccacatttaagtcccattcaaaagatcaaatggaggctgctatatttgagtattccgtttggaccaatctaggagaaaagcttaccttcattcctcgcgactcaaggaatgatgggcagaagaaacttttattttatcctagagaacatcaagtatcagtgactgatgataattgtcaagtttatattcctacattttcttgtcaactgggtgtatatattgaaggatcagtttcacctcctctttctggcgtccatatcagagtttttgctgctggagatagcagctttactacacttaaaagtggtgaattggttcttgaaacgaccactggtattgatggttcctttgtggcaggtcctctgtacgatgatattggttacaatgttgaggcttcaaagcctggatatcatttaaaacaagttgcgcctcattcttttacttgtcagaagcttagtcaaatttcagtacacatacatcacaaagatgattctaaagagcccattccttctgttctgttgtctttgagtggtgacaatggttatagaaacaactcagtatcaggagctggtgggacattcctgtttgacaatttgtttcctggaatgttttatttgcgtcctgttttgaaggagtatgctttctcacctccagcacaggcaatagatcttggagcaggggagttcaaagaagttgttttccaggccacacgcgtagcctacagtgctacaggtatagtgtctctcttgtctggtcaacccaaaggagaagtttcggttgaagcccggtcagagtcaaaaggctattttgaggaaactgtgacagattcatctggaaattatcgtctgagaggactactgcctgatactgactatgttgttaaagtggctaaaagggatgtgggcagttctaatatagagcgtgcatctccagattctattgctgtcaaggttggaactgaggatatcaagggattggattttatagtttttgaggagccggaaatgacaattataagttgccacgttgaaggaaatggtacagatgaactacataaacacctgatggtagaaatcaggtcagctagtgacctaaacaagatagagtcagtcttccccctgccaatttcaaacttcttccaagtgaagggcttatcaaaaggcagacaccttctaaagcttcaatctggtctcccatcaagctcgcttaaatttgaatctgatatcattgaggttgacttggagaaaaatgttcagatccatgttggtccaatgagatacaggattgaagatcagctgaagcaggagttgactccggcaccagtattccctcttatagttgcatttctagttgttgcactttttcttagcatgccaagattgaaggatttgtatcaagccacggtagacatacccaccccaggactcactgcggcttcaagaaaagacgtgaagaagccgctgttgcgaaagaagacttattaaatctcctttctaaccataggagtcatacggtagtataactgctcttagagtcttagttgagttactttgataactttcacgttctctaataggtgtggatgtttttctttatttatctggtggggcaaaatgcgatagaatgtaattaataattgttccttcaattttagtataatgtgattttactttttggctgaggagaaaacgcaaatagaagcaatatgtatttgttgctaatggatttttgttttatatttttgcatccaaatatattgagcttgaacgttttgagtttt

SEQ ID NO: 8624 - DNA, 4035 bp, Glycine max
gtttcgttctaaaatcccataaaccctcccagacctgggagtgaagtggctccattaaatacagaaaaatataaatattcgtatgattctccagatctgttcatccaccttaggttgaattcatcgccgagcatcagatccgaaatgtcgatcggagatgcttttctatgcttactattcatagcaacttgttcgatttcagctgcttctgctgattccatctatggctgcggtggatttgtcgaggcgagctcatcgttggtgaagtcgaggaaacaaactgatgtcaaattggactattccgatgtcacggttgagcttcaaactgtggatggactggtaaaggatagaacacaatgtgctccaaatggatactattttattccagtatatgacaagggttcctttgtaattaaaattaatggacctccaggatggacatgggatccagaaaaggttcctgtggtggttgacaataatggttgcaatggcaatgaagatataaacttccgtttcacagggttcactatatctggtagagttgtgggagctgttgggggagaaagttgttcagttaaaaatggaggtccttcaaatgtaaaagttgaacttttgtccctttcgggggatcttgtctcttcagtcttaacttcatcgtcagggagttacttgtttacaaatataattccaggaaaatatgaactacgcgcttcaaatcctgatatgaaagttgaagttaaaggttcaacacaggttgaattgggctttggaaatggggtagttgatgatattttctttgtccctgggtatagtatcagtggatttgttgttgctcagggaaatccaatattaggagtttatattttcttacattcagatgatgtttctgaagtagagtgtttgaaaggttctgctaatggtccacgacaaggagtagctctctgtcatgctgtatcagatgctgatgggaagttcacattcaattcaataccttgtggaagttatgaacttgtgccctactataagggtgaaaatacagtatttgatgtttcgccacccagcgtctcagttaatgttaagcaccagcatgcaacagtgcctcaaaagtttcaggtaactggattttctgttggaggccgtgtagttgatggaaatggcatgggagtggagggggtcaaaatcatagttgatggtcatgtaaggtctattgctgacaatcaaggatattacaagcttgatcaggttacatccacgcactataccatagaggcccaaaaggagcattacaaattcaagaaattggagaattatatggtattgccaaatatggcttcaatagaagacatcaatgccatttcatacaatctttgtggtttggttaggatggctagtggtggtctgaaagcgaaggtggctttgactcatggacctgataatgtgaaaccacaaaagaagcaaacagatgaaaatggaaacttctgctttgaggttcctcctggtgaatatcgcttgtcagccattgctgctactcctgagaatggtgctggactcatgtttgctccatcttatattgatgttgtggtcaaaagtcccctgttgaatattgaattttcacaagctttggtcaatattcatggtgctgtatcctgcaaggagaaatgtggcccatttgtatccgttactctggtgagacaggttgataaacacaatgaagagagaaagacaattagcttgaccaccgagagtagtgaatttctgttttcagatgttattcctggaaaatacagccttgaggtcaaacatagttcccctgaatcagtgaccttggaagataattggtgctgggaacagagcttcatagatgtaaatgttggtgctgaggacttagaaggaatcctttttgttcaaaaaggctactgggtcaatattatctccactcacaatgttgatggttacctgactcaacccgatgggtcaaatgtgaattttaaaattcagaaaggttctcagcatatatgtgtagaacaacctggcgtacatgaatttcattttgttgactcgtgtatcttctttgggagttcatcagtgaaaattaatacatctgatcaatcacccatccatctaacaggagagaagtatcttctcaatggacaaataaatgtgcagtctggctcacttgatgcattgcctgatagtatagttgttgatattaaacatgatagaactggtgttattgattatgctacagccatacttaagtcccatgtgaaagatgaaacgggggctgctatatttgagtattccgtttgggccaatctaggagaaaagcttacctttgttcctcaggactcaaggagtgatgggcagaagaaacttttattttatcctagagaacatcaagtatcagtcacagatgataattgtcaagtttatattcctacattttcttgtcaactgggtgcatatattgaaggatcagtttcacctcctctttctggcgtccatatcagaatttttgctgctggagacagcagcattagtacacttaaaagtggtgaattggttcttgaaacgaccactggtactgatggttcctttgtggcaggtcctctgtacaatgatattggttacaatgttgaggcttcaaagcctggatatcatttaaaacaagttgcacctcattcctttacttgtcagaagcttagtcaaatttcagtacacatacatcacaaagatgatgctaaagagcccattccttctgttctgttgtctttgagtggtgacaatggttatagaaacaactcagtatcaggagctggagggacattcctgtttgacaatttgtttcctggaatgttttatttgcgtcctgttttgaaggagtatgctttctcacctccagcacaggcaatagagcttggagcaggggagttcaaagaagtagttttccgggccacacgtgtagcctacagtgctacaggtatagtcactctcttgtctggtcaacccaaaggagaagtttcggttgaagcaaggtcagagtcaaaaggctattttgaggaaactgtgacagattcttctggaaattatcgtctgagaggactactgcctgatactgactatgttgttaaagtggctaaaagggacgtgggcagttctaatatagagcgtgcatctccagattctattgctgtcaaggttggaactgaggatatcaagggattggattttatagtttttgaggagccggaaatgacaattataagttgccacgttgaaggaaatggtacagatgaactacgtaaacacctgatggtagaaatcaggtcagctagtgacctaaacaagatagagtcagtcttccccctaccaatttcaaacttcttccaagtgaagggcttatcaaagggcagacaccttctaaagcttcaatctggtctcccatcaagctcacttaaatttgaatctgatctcattgaggtcgacttggagaaaaatgttcagatccatgttggcccactgagatactggattgaagatcagctgaagcaggagctgactccggcaccagtattccctcttatagttgcatttctagttgttgcactatttcttagcatgccaagattgaaggatttgtatcaagccacggtagacatacccacaccaggactcactgcggtttcaagaaaagacgtgaagaagccgatgttgcgaaagaagacttattaaatctcctttccaaccataggagtcatacggtagtataactgctcttgagagtcttagttgagttactttgatagctttcacgttctctgataggtttggatgtttttctttatttatctggtggggcaaaatgcaagataggatgtaattaataattgttccttcattgttggtataatatggttttactttttggctgaggagaaaacgtgaatagaagcaatatgtatttgttgcttctgaatttttgttttattttgtttttttgcagccaaatgtattgagcttgaacgttttgaccct

SEQ ID NO: 8625 - DNA, 4035 bp, Glycine max; identical to SEQ ID NO: 8624

SEQ ID NO: 8626 - DNA, 3927 bp, Vitis vinifera
atggcgattagagaggctttgatattctcgctgactgttatctatatcacttcactcgctgccgccgattccatccaaggctgtggtggattcgtcgaggcaagttcggatttgatcaagtcgaggaagccaactgatggaaaattggattattctcatattacggttgagcttcgcacaattgatggattggtgaaggacagaactcagtgtgccccaaatggttactatttcattcctgtctatgacaagggttcttttgtagtccaaatcaagggaccagaaggatggtcattggaccctgataaggttcctgttgttgttgatcatgctggttgtaatgccaatgaagatattaacttccgattcacagggttcacgatatctggaagagttgtgggagccgttggtggagaaagctgttcacttaaaaatggaggtccatctaatgtaaatattgagcttttgtctccttcaggggatctcatctcctctgttttaacatcatcagagggaagttactcattcaacaacatcattccaggaaattacaaattacaagcttcacatcctgatttgacggtcgaagttaggggttccacagaggtggaattagggtttggaaatggtttagttgatgacatcttctttgtccctggatatgacattaatgggtttgtagttgctcagggaaatccaatcctgggggttcatatttatttatattcaaatgatgtatcagaggttgattgtcctcagggttctggtaatgcccctggacaaggaaaatctctctgtcatgctgtttctgatgctgatgggatgttcacgtttaaatcattgccttgtggggtttatgagcttatacctttctacaagggtgaaaataccatttttgatgtttcaccactgtctgtgtcggtgtctgttgaacatcatcatgtaacggttgcccaaaagtttcaggtcactggattttctgttggtggccgcgttgttgatggaaatgatgcgggagtagatggtgttaaaattattgtagatggtcaggaaaggtccatcactgacacacaaggatattacaagcttgatcaggttacatcaaatcgctatacgatagaagccaagaaggagcattacacgttcacaaccttaaaggattttttggttctgccaaatatggcctcaattgaagatattagagcagcgtcctatgatgtatgtggtgttgttcgtatggttagtgctggttacaaagcaaaggtggccttgacacatggaccagagaatgttaaaccccaggtgaaacagactgatgaaactggaaatttctgctttgaggttccaccaggtgaataccgtttatctgctttggcagccactcctgagagtgctcctgggcttctctttttgccatcttatgttgatgttgcggtcaaaagtccattactgaaagttgaattttctcaggcacttgtcaatatacatggtgctgtagtctgcaaggagaagtgtggtccatctgtttcggttactcttgttaggttggctggcaaacataatgaagagagaaagacagtcagtctaactgatgagagtagtgaatttttgttttcaagcgtctttcctggaaaatacaggcttgaggtcaagcatctttctccaggagccgtgtctggggaagatagctggtgctgggaacagagtttcattgatgtggatgttggtgctgatggcataaaaggaattgtatttgtccagaaaggttattggattaatatagtttcctcccatgatgtagatgcttacatgactcaaccagatggttcatctgtgaatttgaagattaagaaaggcttgcagcatatttgtgtagaatctcctggagtacatgaactccactttgttgactcatgtattttctttgggagctcgtcgatgaagattgatacatcagatacattgcctatccatttgaaaggagataaatacctccttaaagggcatatccatgttcaatcaagctcactcagtggtgaatatgagttacctgaaagttttattgtggaggttttgaatagtgatggcactgtctttggtggtagtcctgccagacttatatccagtgaaaatgatcaaacaagtgcttctgtatatgagtattctgtatgggccaatcttggagaaaaacttacctttgttccttcagatgcaaggaataatggtgagaagaagatcttgttttatcctaggcaacaacatgtcttggtgacaaatgatggttgtcaagcttcaattcctccgttttctggtcgactgggcttgtacgttgaaggatcggtttcaccccctctttctggagtcaatatcaggattattgctgcaggagatagccccaatgctctatttaagaaaggtgacttggcactgggaactacaacagggacagatggtttctttgttgggggacctctatatgatgatataacttacagcatcgaggcttcaaagactggctatcatctgaaacaagttggacctaattccttctcttgtcagaagcttagccaaatttctgtgcatatatattctaaagatgatgctgaagagcctattccttctgtgctactatcattgagtggtgatgatggttataggaacaactctgtatctggaactggtggtgtttttctctttgatcacttatttcctggaagtttttatctgcgacctttactaaaggagtatgctttttcgcctccagcgcaggcaatagaacttggttctggggagtcaagagaagtcgttttccaagccactcgtgttgcttacagtgctacaggtacagtcaccttgttgtctggccagccaaaagaaggcgtttcagttgaagcccgatcagactccaaaggctattatgaggaaacagtaaccgattcatcaggaagttaccgtctaagagggcttcttcctgatacaacctatttaatcaaagtggtaaaaaaggatgacctcagtagctccagaattgagcgtgcatctccagaatctgtctctgttaaggttggatctgaggatatcaaggcattggactttctggtatttgaacagccagaaatgaccattttaagttgccatgttgaagggagtagaatcgaggaactacattcacatttacgagtggagattaagtccgctagtgacccatctaagatagagtctgtcttcccactcccgctttctaatttcttccaggtgaaggacttgcccaagggtaagcaccttttgcagctccaatctggcttcccatccaccacccacaaatttgagtccgaaattattgaggttgacttagagaaaaacacccaaattcatgtgggcccactcagatttaaagttgaagaggatcaccacaaacaggaattaactccagcacccgtgtttcctctcatcgttggagtttcagtgattgctctttttatcagtatgccaagattaaaggatttataccaaacaacgatgggaatgtcgatgtccggagccacctcaaccgcaaagaaagaagtgaggaaaccgattttaagaaagaagacttactaaaagctggagtgatagaaagtctttacattctcctttcaaagttttgggatcacgagcttgcttgcatggcgagcatgtgtaccgtttgatactgaccagagtttttatctttttacatggtcggaaaaatgcagaattaaatgtacccagtaaaatgagccttttccccactttcttttttctcttaaatttttcttgatccaagtcaaattttagctttgtaattataccttctttttagctgttgtgttttttcgtgatagtataggatgtccatgccttgtgacttcataagatttgcttaatgcaacttcaagtacgggcctt

SEQ ID NO: 8627 - DNA, 1030 bp, Glycine max
atgggtgcaaagaaatggtttaagataatagtcaaattgaagaaatcgaagaaagataaatccaaagaagaaaaggttatttcttttgaacagaccactgatgaaaattcaaatgaatactccaacgggaagcagagtactcgtgaagagtcaagtagcaatgccaatgaaggtttaatgatggaccggactgttccttcaaggttgatggatgacattgcagctactcggattcaaaatgcatttcgttcatttatggcaagaagaacattacaccatctaaggggagcagagaaattcgaagctttaattcaagatcacctggccagagagcaaacagcaactgcactaagctatatacattcatggagcagaacacaagagcaaattagagctcgaagaatctgtatgataacagaagccaggattaagcagaagaaattggaaacccagttaaaaattgaggccaagattcaggagctcgaggtggaatggtgcaatggttctgaaaccatggaagaaatcatttccaggttacatcagcgagaggaagcagcaattaagcgagagcgagccatggcatatgccttctcccatcagtggaggccaaactgtagccagtattttggtcaggcttcttatagccttggtaaggaaagttggggttggagctggaccgagcgttgggttgcggcacgtccttgggaagttcgggttcgaggtcagaccaccaaaacaacaaaactcaacggccatgggcaggtgcaaaaaaccaaattagacaagatgaaccaaaatgaaagcaaagtagccttggctaaacctacactatcaaacgggaaggaaaggaaaacggtacttcagggctgtcaaagaacaatgtatccaaatagcccattctaatttgatggtttatggtttcttcttgcacttctttgggggtttattttccatattttgcttggtgagaatctaccttttggtgtgtacgttccactaggagagacttcacttattgtctgcttttgca

SEQ ID NO: 8628 - DNA, 1318 bp, Glycine max
caatgtaccacgtctcttatcattaccacccaccactctcaatcctctccaagcaaaatccttgtgttttcttctctcatcctggtttgctgctggctgctttccattcttacctcaagagaaataagagaatgggtgcaaagaaatggtttaagataatagtcaaattgaagaaatcgaagaaagataaatccaaagaagaaaagatcactgatgaaaattcaaacgaatactccaacgggaagcagagtactcgtgaagagtcaagtagcattcccaatgaaggtttaatgatggacaggacagttccttcaaagttgatggatgatattgcagctactcggattcaaaatgcatttcgttcatttatggcaagaagaacattacaccatctaaggggtgcagagaaattcgaagctttgattcaagaccacctggccagggagcaaacagcaactgcactaagctatatacattcatggagcagaatacaagaacaaattagagttcgaagaatctgtatgataacagaagccaggattaagcaaaagaaattggaaacccagttaaaaattgaggccaagattcatgagctcgaggtggagtggtgcaatggttctgaaaccatggaagaaataatttcgaggttacatcagcgagaggaagcagcaattaagcgagagcgagccatggcgtatgccttctctcatcagtggagaccaaactgtagccagtattttggtcaggcttcttatagccttggtaaagaaagttggggttggagctggacggagcgttgggttgcggcacgtccctgggaagtccgggttcgagttcagaccaccaaaacaaagaatctcaatggccaggtgcaaaaaaccaaattggacaagatgaaccacaacgaaagcaaagtagccttggctaaacctaccctatcaaacgggaaggaaactgggaaaggaaaggaaaacggtacttcagggctgtcaaagaacaatgtatccaaatagcccattctaatttgatggtttagggtttcttcttgctcttcttttggagtttattttccatatttggcttcgtgagaatctaccatttggtgtgtacgttacactaggagacttcacttattgtctgcttttgcatggtgtatatgattatgaacatgaatctcctagttttggttgagacatgagagatgagagatgagaatggtattttatcatccctttcattccaggggcagttaatctttaccgcaagaaatttttatgctttacatatattggaagtgcaaaaaagcaaggaaattaaa

SEQ ID NO: 8629 - DNA, 1154 bp, Medicago truncatula; identical to SEQ ID NO: 8615

SEQ ID NO: 8630 - DNA, 1293 bp, Glycine max; identical to SEQ ID NO: 8611

SEQ ID NO: 8631 - DNA, 1373 bp, Glycine max
gcttccccaacatgcacatatatatatatatagtgatatatgattaagcctaaaaaggaaactgagctttgtgctttgaacacagatttggtttttctctatttgcgtgcgtgctagtatagtcgttgctgctcagtatggcgggaatcttttcgttggttactgggaggccgggactaagtggattcggatcttcctcaactgctgaacaagttactgaaggaattgatgccagcaatctcactgcaatcatcacaggaggagcgagtggcatagggttggagacagcacgtgttctggcaattcgaaaggtccatgtaataattgctgccaggaacatggagtctgcaaaggaagctaaacaactcatacttcaggaagacgagtcagcatgtgtggacataatgaagctcgacctatgctcattgaagtctgtcagaacctttgtggacaacttcattgctcttggtcttcctctcaacatcttaataaacaatgctggagtcatgttctgcccttatcagcaaacagaagatgggattgagatgcagtttgcaacaaattatcttggtcatttcctcttgacgaaccttcttcttgacaagatgaaacaaaccgcaaaagacactggaattgagggcaggatcgtaaatctgtcatcaattgctcatctctacacttacgaagaaggaattcgatttgataccatcaatgatgaagatggataccatgagaagaaggcctatggacagtccaagttagccaacatattacacacaaacgagctttctcgtcgcttacaggcagaaggtgttaacatcacggccaactcagtccacccaggggtgataatgactcctctcatgagacactcttctttactaatgaattttctgaagatgttctccttcatgatatggaagaacgtccctcagggagcagccacaacgtgctatgtcgctctacacccaagcttgaaaggggtaacggggaagtaccttcaggattgtaatgagtccccaccaagtgcacatgcgtcaaacgaactcttaggaaggaaactgtgggattttagcaacaagatgattaattcactttcaaaagcttgattgattgcactatagtatttgtgccaaaccctcgtcttcctcatatcagtgtatcaaaactcgttaattatgcttaatatacccatccaccctacagttataatcataagttctaaacatatgattcgtggtcattggtccttgactccatttgtattttgtacgcgtaatatagaggtcttatatactcttatttatgtatcaaacgtatcctttaaattaaaattaaggtaaaagaagtatgttaatgatgatttaggcgaa

SEQ ID NO: 8632 - DNA, 1599 bp, Glycine max; identical to SEQ ID NO: 8208

SEQ ID NO: 8633 - DNA, 1924 bp, Glycine max; identical to SEQ ID NO: 8207

SEQ ID NO: 8634 - DNA, 1437 bp, Glycine max; identical to SEQ ID NO: 8202

SEQ ID NO: 8635 - DNA, 2559 bp, Glycine max; identical to SEQ ID NO: 8201

SEQ ID NO: 8636 - DNA, 1924 bp, Glycine max; identical to SEQ ID NO: 8207

SEQ ID NO: 8637 - DNA, 1720 bp, Glycine max; identical to SEQ ID NO: 8139

SEQ ID NO: 8638 - DNA, 1479 bp, Glycine max; identical to SEQ ID NO: 8141

SEQ ID NO: 8639 - DNA, 1552 bp, Glycine max; identical to SEQ ID NO: 8189

SEQ ID NO: 8640 - DNA, 2016 bp, Glycine max; identical to SEQ ID NO: 8190

SEQ ID NO: 8641 - DNA, 1858 bp, Glycine max; identical to SEQ ID NO: 8191

SEQ ID NO: 8642 - DNA, 2030 bp, Glycine max; identical to SEQ ID NO: 8192

SEQ ID NO: 8643 - DNA, 1254 bp, Cucumis melo subsp. melo; identical to SEQ ID NO: 8193

SEQ ID NO: 8644 - DNA, 1627 bp, Vitis vinifera; identical to SEQ ID NO: 8194

SEQ ID NO: 8645 - DNA, 1757 bp, Arabidopsis thaliana; identical to SEQ ID NO: 8195

SEQ ID NO: 8646 - DNA, 1726 bp, Arabidopsis thaliana; identical to SEQ ID NO: 8196

SEQ ID NO: 8647 - DNA, 1720 bp, Glycine max; identical to SEQ ID NO: 8139

SEQ ID NO: 8648 - DNA, 2030 bp, Glycine max; identical to SEQ ID NO: 8192

SEQ ID NO: 8649 - DNA, 1858 bp, Glycine max; identical to SEQ ID NO: 8191

SEQ ID NO: 8650 - DNA, 2559 bp, Glycine max; identical to SEQ ID NO: 8201

SEQ ID NO: 8651 - DNA, 1437 bp, Glycine max; identical to SEQ ID NO: 8202

SEQ ID NO: 8652 - DNA, 1533 bp, Glycine max; identical to SEQ ID NO: 8152

SEQ ID NO: 8653 - DNA, 1533 bp, Glycine max; identical to SEQ ID NO: 8153

SEQ ID NO: 8654 - DNA, 1437 bp, Glycine max; identical to SEQ ID NO: 8202

SEQ ID NO: 8655 - DNA, 1924 bp, Glycine max; identical to SEQ ID NO: 8207

SEQ ID NO: 8656 - DNA, 2009 bp, Glycine max; identical to SEQ ID NO: 8144

SEQ ID NO: 8657 - DNA, 1662 bp, Glycine max; identical to SEQ ID NO: 8145

SEQ ID NO: 8658 - DNA, 1479 bp, Glycine max; identical to SEQ ID NO: 8141

SEQ ID NO: 8659 - DNA, 1720 bp, Glycine max; identical to SEQ ID NO: 8139

SEQ ID NO: 8660 - DNA, 2421 bp, Glycine max; identical to SEQ ID NO: 8149

SEQ ID NO: 8661 - DNA, 2478 bp, Medicago truncatula; identical to SEQ ID NO: 8150

SEQ ID NO: 8662 - DNA, 2544 bp, Medicago truncatula; identical to SEQ ID NO: 8151

SEQ ID NO: 8663 - DNA, 1599 bp, Glycine max; identical to SEQ ID NO: 8208

SEQ ID NO: 8664 - DNA, 1533 bp, Glycine max; identical to SEQ ID NO: 8153

SEQ ID NO: 8665 - DNA, 1533 bp, Glycine max; identical to SEQ ID NO: 8152

SEQ ID NO: 8666 - DNA, 1662 bp, Glycine max; identical to SEQ ID NO: 8145

SEQ ID NO: 8667 - DNA, 2009 bp, Glycine max; identical to SEQ ID NO: 8144

SEQ ID NO: 8668 - DNA, 1720 bp, Glycine max; identical to SEQ ID NO: 8139

SEQ ID NO: 8669 - DNA, 1479 bp, Glycine max; identical to SEQ ID NO: 8141

SEQ ID NO: 8670 - DNA, 1499 bp, Glycine max; identical to SEQ ID NO: 8168

SEQ ID NO: 8671 - DNA, 1720 bp, Glycine max; identical to SEQ ID NO: 8139

SEQ ID NO: 8672 - DNA, 1533 bp, Glycine max; identical to SEQ ID NO: 8152

SEQ ID NO: 8673 - DNA, 1533 bp, Glycine max; identical to SEQ ID NO: 8153

SEQ ID NO: 8674 - DNA, 2009 bp, Glycine max; identical to SEQ ID NO: 8144

SEQ ID NO: 8675 - DNA, 1662 bp, Glycine max; identical to SEQ ID NO: 8145

SEQ ID NO: 8676 - DNA, 1479 bp, Glycine max; identical to SEQ ID NO: 8141

SEQ ID NO: 8677 - DNA, 2421 bp, Glycine max; identical to SEQ ID NO: 8149

SEQ ID NO: 8678 - DNA, 2478 bp, Medicago truncatula; identical to SEQ ID NO: 8150

SEQ ID NO: 8679 - DNA, 2544 bp, Medicago truncatula; identical to SEQ ID NO: 8151

SEQ ID NO: 8680 - DNA, 1533 bp, Glycine max; identical to SEQ ID NO: 8153

SEQ ID NO: 8681 - DNA, 1533 bp, Glycine max; identical to SEQ ID NO: 8152

SEQ ID NO: 8682 - DNA, 1662 bp, Glycine max; identical to SEQ ID NO: 8145

SEQ ID NO: 8683 - DNA, 2009 bp, Glycine max; identical to SEQ ID NO: 8144

SEQ ID NO: 8684 - DNA, 650 bp, Arachis hypogaea
tactacaacaattacagtctttcgcaaccatggcaaatgctgcttcaggaatggcagtccatgatgactgcaagttgcggtttttggagctcaaggcaaaaaggactcacaggttcatagttttcaagattgaggagaatcagaagcaagtcattgtagagaagcttggtgagccagctcaaggctatgaagatttcactgcttgcctccctcctaatgagtgccgctatgctgtatatgatttcgagtacttgactgaaggcaatgttcctaaaagcaggattttcttcattgcttggtctcctgacacatcaagggttagaaataagatgatttatgcaagctccaaagacaggttcaagagagagctcgatgggattcaagtggagttgcaagcaactgatcctactgagatggatctcgatgtgttcaagagccgcgccaactaaacaactacaaatagcaggctttgtgctggggactgcagtgcggtgtgcccccttaaggctttacttttattgaaaatttttagtttcagggatggttatgttggctagttatggcctcaattttcccatgttgtggtataatgtctattacattttcaacaatctccgcatgttttgatctcatgatttgtgattttatac

SEQ ID NO: 8685 - DNA, 801 bp, Glycine max
ggattcccaaaatttctcattctccctttcctctccgaaccctcgatcactctcacgcgctcctatattcgctcctccaccgtcgctctctcgaacaaccacaacaccatcttcatcacatggcaaacgcagcatctggtatggcagtccatgatgactgcaagttgaggtttttggagctgaaggcaaaaaggacacaccgtttcatagtttttaagattgaggagcagcagaagcaggtcattgtggagaagcttggtgagcctgcccagggctatgaagatttcactgccagccttcctgctgacgagtgccgttatgctgtttatgattttgagtatctgactgaagggaatgtccctaaaagcagaatttttttcattgcgtggtcccctgacacatcaagggtgaggagcaagatgatttatgcaagctccaaagacagattcaagagggagctggatggaattcaagtagagttgcaagcaactgatcctactgagatgggtcttgatgtgttcaaaagccgtgccaactaaaatgattatataaaatagtaggctttctggtgggagcagcacccctgaagccttagttactcatatggaaaatatcctagtttgtgggatggtcaacttgggtagttatggtcccaaactctcaattttccaagttgtggcataaaattctattgcaccttttgacaagctttgcttgttccagtgtgttttattatgatttgtgatttatacaacctttgcgtttgagtgccattttagtcgtcttatcccttactagttg

SEQ ID NO: 8686 - DNA, 1025 bp, Glycine max
acagacaaccctcgatcactcccacgcgctcctatatcctctccttcaccgtcgctctctccaacgatcacaacaacatcgtcatcccatggcaaacgccgcatctggtatggcagtccatgatgactgcaagttaaggtttttggagctgaagacaaagaggacacaccgtttcatagtttttaagattgaggagcagcagaagcaggtcattgtggagaagcttggtgagccagcccaaggctatgaagatttcactgccagccttcctgctgatgagtgccgttatgctgtttatgattttgagtatctgactgaagggaatgtccctaaaagcagaatttttttcattgcatggtcccctgacacatcaagggtgaggagcaagatgatctatgcaagctccaaagacagattcaagagggagctggatggaattcaagtagagctgcaagcaactgatcctactgagatgggtcttgatgtgttcaaaagccgggccaactaaaatgattatagaaaatagtaggctttctggtgggagcagcactccttaagccttagttactcatggaaaatatcctagtttgtgggatggtcaacttgggtagttatggtcccaaactctctcaattttccaagttgtggcataaattctattgcaccttttaacaagctttgcttgttccagtgtgttttattatgatttgtgatttatacaaccttgcgtttgagtgccattttagtcgtcttatcccttactagttgaatttgtaactgtttgtgttatcagacaaaaaatggggtttcttcacttattgacactcgtcatccactaatgttttgtgacttgttctggccgatatatgctttcttttgtatgggcatacaaaggcatcttgttcatgctatattccttttttgttttatggtttggtggaatgagattttattcaactggttgattgttcttgaaaccagagtgtacttcattcgtagcaatagcatctaagcggtttatggtc

SEQ ID NO: 8687 - DNA, 930 bp, Medicago truncatula
cgctcctccacacacctttttccttcacatttctcgttctctttctctctctccgatcgaagaaaccatcacacctttctcctatatcttctccacaaccttcgctcccaatcaattctccaacaaccacaactaacccatggcaaatgcagcatctggtatggcagtccatgatgactgcaagttaaagtttatggaactcaaggcaaaaaggacacaccggttcatagtgtataagatcgaggagaaacagaagcaagtcattgtggaaaagcttggtgagccagcccaaggctatgaagatttcactgcatgccttcctgctgatgagtgtcgttatgctgtttatgattttgagtatctgacagaagagaatgtccccaaaagcagaatttttttcattggctggtcgcctgatacagcaagggtgagaagcaagatgatttatgcaagcaccaaagaaaggttcaagagggagctggatggaattcaaatagagttgcaggcaactgatcctactgaaatgggtcttgacgtgttcaaaagccgtgccaactaaataatgattctgaatagtacaggctttctggtgagggagctccccttaagccttagttagtcatattgagatatccatagtttgtgggttggtcaacttgactaggttatggtctaaaattttccaaaattgtggcataaagtgtattgcaccttcaacaggcttctcttgttcctgtgtattttgttatgatttgtgatttatacaatcttttcgtttgagtggcattttagtatatccttactgggtaaatttgtaactgttttgtgtgatgatcagacaacaaatggggttcgccttttttaatattgacactagtcattcactaatgccttttgacttcagtaatttcatttttttgtttttctggt

SEQ ID NO: 8688 - DNA, 856 bp, Medicago truncatula
gacatttctcgttctctttctctctctccgatcgaagaaaccatcacacctttctcctatatcttctccacaaccttcgctcccaatcaattctccaacaaccacaactaacccatggcaaatgcagcatctggtatggcagtccatgatgactgcaagttaaagtttatggaactcaaggcaaaaaggacacaccggttcatagtgtataagatcgaggagaaacagaagcaagtcattgtggaaaagcttggtgagccagcccaaggctatgaagatttcactgcatgccttcctgctgatgagtgtcgttatgctgtttatgattttgagtatctgacagaagagaatgtccccaaaagcagaatttttttcattggctggtcgcctgatacagcaagggtgagaagcaagatgatttatgcaagcaccaaagaaaggttcaagggggagctggatggaattcaaatagagttgcaggcaactgatcctactgaaatgggtcttgacgtgttcaaaagccgtgccaactaaataatgattctgaatagtacaggctttctggtgagggagctccccttaagccttagttagtcatattgagatatccatagtttgtgggttggtcaacttgactaggttatggtctaaaattttccaaaattgtggcataaagtgtattgcaccttcaacaggtttctcttgttcctgtgtattttgttatgatttgtgatttatacaatcttttcgtttgagtggcattttagtatatccttactgggtaaatttgtaactgttttgtgtgatgatcagacaacaaatgggggttcgcttttttatattgacactagtcatt

SEQ ID NO: 8689 - DNA, 884 bp, Medicago truncatula
gattgactcaactcaacgcaacccatttcaaagcaaagcaaacatatctgagttgtttgattgaagaaagaaagattccttctcctccgcttccaccgatcactcttctctctttcaattatggcaaatgcggcatccggtatggcagtccatgatgactgcaagttgaggtttatggagctcaaggcaaaaaggacacacaggttcatcatttacaagattgaggagaaacagaaacaagtcattgtggagaagcttggcgagcctgtccaaggctacgaagaatttgctgcctgccttcctgctgatgagtgccgctatgcggtctttgattatgagtttatgactgaaggcaatgttcccaaaagcaggatttttttcattgcatggtctcctgacacatcaagggttagaagcaagatgatttatgcaagctccaaagatagattcaagagagagcttgatggtattcagattgagttgcaagcaactgatcctactgagattggtcttgatgtgttcaaaagccgtgctagctaaacgatctccaacagtggctgccttttctgctggggtgagccccctaatgctttgttacttttatgaaaacttctagtttgtgtaatatggtcttaatatctcatgatttgtgatttatgcctcatttatgttgagtggcattttagtcctgtgcttataagttgaatttgtaactgttctgtgtgatgaaacaaaatatggggtctgtttcacttcaaaaaggctaatatgtcctttttctgtatggataggataggaaaagaaagcgcacctgttacttacaacatttatttttttgtttggtgttatgatatcctattctattggtcgattattattctttg

SEQ ID NO: 8690 - DNA, 705 bp, Gossypium hirsutum
atggccaacgctgcatcgggaatggctgtgcatgatgattgcaagttgaagttcttggagctcaaggcaaaaagaacccaccgcttcattgttttcaaaattgaggagaagcaaaagcaagttattgtggagaagcttggtgaaccaaccgaaagctatgaggattttactaaatgtctccccgctgatgaatgtcgatatgctgtgtacgattttgattttctaacggccgagaacgtaccgaagagcagaatctttttcatagcatggtctcccgacacgtcaaggatcaggagcaagatgatttacgccagctccaaagatagattcaagcgagaactggatggaattcaggtggaattgcaagcaacagatccaactgagatgggtctcgatgtgttcaaaagccgtgctaactgaatacggttcttttaggcatttgcaaccgggaagcttccttccttcctacagtatgtctttacttaagtgaaatgtttataggtttcgaaacggcaaactcgggatttccagagttatgccataagacttttatcagtcttgatgatgataaacccgtagtttcgggtatatgtgatttgttatctatagaacctatgtattgagtgcctttgtgtagtcttaatctctttcaacgctaaatgcaactgtttgtgagggttagacaacaaaaaaaaaaaaaaaaaa

SEQ ID NO: 8691 - DNA, 819 bp, Gossypium hirsutum
atggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactggacggaattcaggtggaattgcaagcaacagatccaactgagatgggtctcgatgtgttcaaaagccgtgctaactgaatacggttcttttaggcatctgcaaccgggaagcttccttccttcctacctacagtatgtctttacttaagtgaaatgtttataggtttcgaaacggcaaactcgggatttccgagttatgccataagacttttatcagtctcgatgatgataaacccgtagtttcgggtatatgtgatttgttatctatagaacctatgtgttgagtgcctttgtgtagtctttatctctttcaacgctaaatgcaactgtttgtgagggttagacgacacatttagttcgttttcaagtttttttttttttttaattttctttgaatattgacccttgtttattgtttcggagtgttaaagagggcatgcttttatgtctttcaagtcaaaaaaaaaaaaaaaaaaa

SEQ ID NO: 8692 - DNA, 527 bp, Cucumis melo subsp. melo
gctaacgcggcatcgggtatggctgttcatgatgactgtaagcttaaattcttggagctgaagaccaagagaacctacagattcattgtatataagattgaagagaagcaaaagcaagtcactgtggaaaaggttggcgagccaggtcaaagctatgaagacttcacagcctgtcttcctgctgatgaatgccgatatgccgtttatgattttgagtttctgacagaagggaatgttcccaagagcagaattttcttcattgcttggtaatgttatgatgaaaaatgaaacaaattctgtgtaactatctgtttctctctcaattaccatctttagcttccatcactcataatcactattttcttttcatgttgtaaaggtctcctgacacatcaaaggtaagaagcaagatgatctatgcaagttcgaaggacaagtttagaagagaattggatggcattcaaattgagctccaagctactgacccatctgaaatggatctcgatgtttttaaaagccgtgctaaa

SEQ ID NO: 8693 - DNA, 693 bp, Gossypium hirsutum
atggccaatgctgcatcgggaatggctgtgcatgatgattgcaagttgaagttccaagaacttaaggcaaaaagaacccaccgctttattgttttcaaaatcgaggagaagcagaagcaagttatcgtggagaagcttggtgagccaactgagagctatgaagattttactaaatgtcttcccgctgatgaatgtcgttatgctgtgtacgattttgattttctaacagccgagaacgtcccaaagagcagaatctttttcatcgcatggtctcccgatacatcaaggatcaggagcaaaatgatatatgctagctccaaagacagattcaagcgagaactggatggaatccaagtggaattgcaagcaacagatccaaccgagatgggtcttgatgtcttcaaaagccgtgcaaactgaatacagttcttttaggcttttgcaacggggaagcttccttccttccttcctacagtatgtcttttacttatgtgaaatgtttataggtttcgaaatggcaaaacttggacaattaccaatttccaagttttgccataaagacttttatcagtctcgatgatgataaacccgtagtttcgggtatttgtgatttgttatctatagtacctatggtttgagtggaaaaaaaaaaaaaaaaaaaaaaaaaaaaaaaaaaaaaaaaaaaaaaaaaaa

SEQ ID NO: 8694 - DNA, 1025 bp, Glycine max; identical to SEQ ID NO: 8686

SEQ ID NO: 8695 - DNA, 834 bp, Plantago major
cagctctacaccctctctctaaaaatatccaaagtctcacaccgtcttcttattttcagccccaaaaatttctcattttgattcgtgtctgtaatcccctgatcttctccgatcgatcctctccaccatggccaatgcagcgtcaggaatggcagtccatgatgactgcaaactaaagtttatggagttgaaaactaaacgaactcaccgcttcatagtatacaagattgaggagaagcaaaagcaggttatggtggaaacacttggggagccggttcaaacttatgaagatttcactgcaagcttacctgctgatgagtgtcgatatgcagtttttgattttgactacatgactgtcgacaatgtcccaaagagcaggattttcttcgttgcctggtcccccgacactgcgagggtgaggaacaaaatgatctacgccagctcaaaggacaggttcaagagggaactagatggcatccaggtggagctgcaagctactgatcctactgagatgggtcttgatgttttcaagagccgtgccaattaagtttctctggataaagcaaaatagcatgacataagcttgctctactctagaggagtgttaatagtctgtggaactatgtaccctcctaagctatggtatttgttctgttgttgaagtctcgtgatctaagatcaatttctgcgattttgatcttgttcaatgttttctgttggcttggattttatttgactgaattgtgcgggttggttaacctccgctggattgagtttttgtttcatgtgaaagcatgacttatcatattggccttctaaaaaaaaaaaaaaaaa

SEQ ID NO: 8696 - DNA, 926 bp, Glycine max
tctcatcatttccttccaatggcttccattcccaatctctcatctttcctacccacactctcccattcgaacccaaacaaccaatgcactctccctccaacctctctcttcggcaccagaatcaccctcctacgcgccacctcatcgtcccgttccctccccaacacaagttgcagtgccacgtcagcaaccgtgtcgtttagcctccccaccccgaaacccctttcggatacgcccgataaaaccccaaagtggtcggagagggctataaaatcgtatgcaatgggggaattggaagcgaggaagctcaagtatccaaacacgggaaccgaggcgattctcatggggattttggttgaaggaacaagtaatgctgcaaaattcttaagagctaatggaattactcttttgaaagcacgtgaagaaacagtagagctacttgggaaatctgatttgtttttcttcagccctgagcatcctcctttgactgaaccagcccagaaagcccttgattgggcaattgaggagaaattgaagtcagatcttggctactctaggttttgatgatggaaaagccaaagaactttctaaaaaaattgatggagatgtttgatttaagtttcaaaaggcaagcttaagaaatttcttgcagattgatggttgattaatacccgttgacccttggggttgcaagttcctcttagggaaaattaactatactccctcaagattatcaacaagtacctgtgttaatgttatttcaaatgctgtgtcgtacaccattttggggatgatgtatttcttattcttttttaatttatccaagttttgtggaagttaattttttagcagtgtgtgatggtggaattgcagtcacacactgcatcatctctagtctctaccctgttctgtaacttatcaccctg

SEQ ID NO: 8697 - DNA, 1376 bp, Glycine max
gaaaaagtgaaaatatctgaatgcacagatgccattatccgtgtgcgccaaccagttggattatgatgacctatctaacggcttctttctatctctataaatgcttaaagcgccacacactctcattactcacagtgatggataataatactatctccgacttgatccagttcaacgatttgatacccaagttaccgagcgaactcggactcgagtgcctcactcgtttgccccactcagcgcaccgagtcgccctccgagtctgcagccagtggcactgcctcctccaaagcgacgcgttttactcccacaggaagaaaaccggccacacccgaaaagtcacgtgcctcgttcaggcgcgtgaggatcaaccgcttcaggagaaaaacaacgcttcggttgcgtcggtttacgggataagcgtgttcgacccggagagcatgacatgggaccgggtcgacccggttccggattacccgtccgggctgccgctgttctgccagctggcgagctgcgacgggaagcttgtgctgatgggagggtgggaccccgcaagttacgagcctctgacggcagtgtttgtgtacgattttcgcacgagcgagtggcggcgggggaaggacatgccggagaagcggtcttttttcgccatcggggcgggggtgggccgggtttatgtagcgggagggcatgatgagaataagaacgcgctgagtacggcgtgggcttatgacccgaggagtgatgaatgggccgggttggacccgatgggccgagagagggacgagtgcgagggggtggtgattggggacgagttttgggttgtgagtggttattccacggagaggcaagggatgttcgatgggtcggcggaggtgttggatatcgggtcgggtgggtggagggaagaaaacgggttttgggaagagggtcagtgtcctcggtcatgtgttggggttgggaaagatgggagattggtgaattggagaggttgggatccggggctgagggttggggtatgtggggttgcggttgggtccagggttgtgttgagtggatccgattacgaaggtgcaccgcatgggttctatttggtggacaaccgtaaattgacaaagataaatgtgcctgagggtttctctgggtttgtccaatcggggtgctgtgttgaaatataagacacttgtaaagatgctacactacccttccagaaaacccaaatctgtgactaattttgttttcttttgctaaaatggagatttgtgcttttgaatttcccatacaaatgtaaatagtatatttgttttgctaatcgaaggaaggagtgttgaaaattacaacattgagattatccataataatactaagggccacta

SEQ ID NO: 8698 - DNA, 3345 bp, Glycine max
atggaatcatggatgtggtgtttccttctctgttcccatttgctcatcctttatttttcaccctctcattccttatgccacccccatgacaactctgccttgctccacttcaaaaactccttcactatttatgaagatccttattattcttattattgtgatcatggttattcaaagacgacaacatgggaaaatgggagagattgttgctcttgggctggagtcacctgccaccccatctcaggtcacgtcactgagctcgacctcagctgcagtggccttcacggcaatatccatccaaacagtacgcttttccatctttctcatcttcactcactcaaccttgctttcaatcatttgtatacatctcatttgtcatctctctttggtgggtttgtgagcctcacacatctcaacttgtctcattctgaatttgaaggggatattccttcccaaatctctcacctttccaaattagtctcacttgatctctcaaaaaatgcaacagttttaaaggtgcttcttttggattttacagatatgtcttccatttcaatcaggacactcaatatgtcttcttctttggtaactcttggtcttctagcaaatgggctaagcggaaagttgacagatggcattctttgtttaccaaatcttcagtacctatatctttcatttaatgaggaccttcatggtcagcagcttccagaaatgagttgcagcacaacttctcttggtttcttagatctttcaggttgtggtttccaagggtcaatccctccctctttctctaacctcacacatcttacttccctggatctctcagctaacaacctcaatggttcagtcccatcctcactcttaacccttccacggctaacctttctgaatctaaacaataaccaactcagtggtcaaatcccaaatatttttcctaagtcaaacaactttcacgaattgcatttgagttataacaacatagagggtgagatcccatcaacactttcaaatcttcaacatctcattatcttggatctgtcactttgtgatttccaaggttcaatccctccctctttctctaacctcatacttcttacttccctggatctctcatataaccacctcaacggttcagtcccatcctcgctcttaacccttccacggctaacttttctaaatctcaatgctaattgtctcagtggtcaaatcccaaatgtctttcttcagtcaaacaacattcacgaattggatttgagtaataacaaaatagagggtgagctgccatcaacactttcaaatcttcaacgtctcattctcttggatctttcacataataaatttattggtcaaatcccagatgtgtttgtcgggctaaccaaattgaatagtctcaatctttcggataacaatttaggaggcccaatcccatcttcattatttggcttaacacaattttcttacttggattgttctaataataaattggagggccccctgccgaacaaaataagagggttttcaaatctaacatcgttaaggttatatggcaacttcctgaatggaacaattccttcttggtgtttatctttgccatctttggtggatttatatctatcagaaaaccaattctcagggcatattagtgtaatctcatcatattcattggtgagattatctttatcccacaacaagttacaaggcaatattccagatacaattttcagccttgtaaaccttactgacttagatctatcatcaaacaatttaagcggatctgtcaactttccacttttctcaaagcttcaaaatttggaaagacttaatctttcacataataatcagttatcactaaatttcaaatccaatgtcaattatagtttttccagtttatggagtttggacttatcttctacgggtttaactgaatttccaaaattatcaggaaaagtcccaattttgaaattactccatttgtccaataatacacttaaaggtagagtaccaaattggttgcacgacacgaactcatcgttatatttattggacctctctcataacctattgacgcaatcattggaccaattctcatggaaccaacacctcgtttaccttgatcttagttttaactcaatcactgctggctcttcctcaatttgcaatgcaactgcaattgaggttctcaacttatctcacaacaagttgacaggaaccattccacaatgccttattaactcatcaaccctggaagttttggatctgcaactgaacaagcttcatggccctttgccaagtacctttgcaaagaactgtcagctcagaactctagatctcaatggcaaccaattattagaaggttttctgccagaatctttgtccaattgcattaatctggaggttttaaatcttggaaacaatcaaataaaggatgtgtttccccattggcttcaaactctaccagaattgaaagtattggttttgagagccaacaagttgtacggtcccattgagggttcaaagaccaagcatggattccccagtttagttatttttgatgtctcttccaacaacttcagcggctcaataccaaatgcctacataaaaaaatttgaagccatgaagaacgttgttctatatcccgattggcaatacatggaaatttctatttcttttgcagaaaccaactaccatgattctgtgactataacaacaaaagcaattactatgacaatggacagaattcgaaatgactttgtaagcattgatttatccaaaaacagatttgaaggagggattccaaatgccattggagagcttcattcactcagaggactcaacctttcccataacaggcttattggtcctattccccagtccatgggaaatttgagatacttagaatcattggatctctcctcaaatatgctcattggtgggatacctacagaattaagcaatttgaactttcttgaagtcctaaatctttccaataaccatcttgtgggagaaatacctcgaggacaacagttcaatacttttcccaatgattcctacaagggaaactctgggttatgtggactcccactgacaatcaaatgcagcaaggaccctgaacaacattctccaccttcaactaccttcaggagagaaccaggatttggatttggttggaaaccagtggctataggatatggatgtggagtggtctttggagtgggaatgggatgttgtgtattgttaataggaaagcctcaatggcttgtgagaatggtcggaggtaaactcaataaaaaggtgaaaaggaagacaaggatgagatctaatgaaaatggtagcagaatgaattag

SEQ ID NO: 8699 - DNA, 3310 bp, Glycine max
tatggaatcatggatgtggtgtttccttctctgttcccatttgctcatcctttatttttcaccctctcattccttatgccacccccatgacacctctgccttgctccacttcaaaaactcctccattattgatgaagatccttattattattcaaagacgagaacatgggaaaatgggacagattgttgctcttgggctggagtcacctgccaccccatctctggtcacgtcactgagctcgacctcagctgcagtggcattgtcggttatatcgatccaaacagtacgcttttccatctttctcatcttcactcactcaaccttgctttcaattattttgatgaatctccattgtcatctctctttggtgggtttgtgagtctcacgcatctcaacttgtctaattctgaatttgaaggggatattccttcccaaatctctcaccttttcaaattagtctcacttgatctctcatataattttttaaagttgaaggaagacacttggaagagattgctccaaaatgcaacagttttaagggtgcttcttttgaatgatggaacagatatgtcttccgtttcaatcaggacactcaatatgtcttcctctttggttactcttagtttgggatggacatggctaagaggaaacttgacagatggcattctctgtttaccaaatcttcagcacttggatctttcatttaatccggcccttaacggtcagcttccagaagtgagttatagaacaacttctcttgatttcttagatctttcacattgtggtttccaagggtcaatccctccatctttctccaacctcacacatctcacttccttgtatctctctcataacaaactcaacggttcaatccccccctctttctctaacctcacacatcttacttccctatatctctcacataacgacctcaacggttcaatccctccctctttctctaatctcacacatcttacttccctgtatctctcacataacgacctcaatggttcaatccctccctctttctctaacctcacacatcttacttccatggatctctcatacaacagcctcaacggttcagtcccatcctcactcttaacccttccacgactaacctttctgaatctagacaataaccacctcagtggtcaaatcccaaacgcctttcctcagtcaaacaactttcacgaattgcatttgagttataacaaaatagagggtgagctgccatcaacattttcaaatcttcaacatctcattcacctggatctttcacataataaatttattggtcaaatcccagatgtgtttgccaggctaaacaaattgaatactctcaatcttgagggaaacaattttggaggcccgatcccatcttcgttatttggctcaactcaactttctgagttggattgttctaataacaaattggagggccctctgcctaacaatatcacagggttttcaagcctaacatcgttaatgttatatggcaacttactgaatggggcaatgccttcttggtgtttatctttgccatctttgacgactttgaatctatcaggaaaccagttcacagggctgccagggcatataagtacaatctcatcatattccttggagagattgtctttatcccacaacaagttacagggaaacattccagaatcaattttcagacttgtaaaccttactgacttagatctatcatcaaataatttcagtggatctgtccactttccacttttctccaagcttcaaaatttgaaaaaccttgacctttcacagaataatcagttattacttaatttcaaatccaatgtcaagtataatttctcccgccttttatggagattggacttatcttctatggatttaactgaatttccaaaattatcaggaaaaatcccatttttggaatcactccatttgtccaacaacaaacttaaaggtagagtgccaaattggttgcatgaagcgagctcatggttatctgaattggacctctctcataaccaactgatgcaatcattggaccaattctcgtggaaccaacaactccgttaccttgatcttagttttaactcaatcactggtggcttctcttcctcaatttgcaatgcaagtgcaattcagattctcaacttgtctcacaacaagttgacaggaaccattccacaatgccttgctaactcatcatcgcttcaagttttggatctacaactcaacaagcttcatggcactttgccaagtacctttgcaaaggactgtcggctcagaactctggatctcaatggcaaccaattattagaaggttttttgccagaatctttgtccaattgcaatgatctggaggttttagatcttggaaacaatcaaataaaggatgtgtttccccattggcttcaaactctaccagaattgaaagtattggttttgagagccaacaagttgtacggtcccattgagggttcaaagaccaagcatggattccccagtttagtcatttttgatgtctcttccaacaacttcagcggcccgataccaaatgcctacataaaaaattttcaagccatgaagaaaattgttgttctagacaccgatcggcaatacatgaaagttccttcaaatgtttctgagtacgctgattctgtgactataacatcaaaagcaattactatgacaatggatagaattcgaaaggactttgtaagcattgatttatcgcaaaacagatttgaaggaaagattccaagtgtcattggggaacttcattcactcagagggctcaacctttcccataacagacttagaggtcctattcccaattccatgggaaatttaacaaatttagaatcattggatctctcctcaaatatgcttactggtcggatacctacaggattaaccaatttgaactttcttgaagtcctaaatctttccaataaccattttgtgggagaaatacctcaaggaaaacagtttagtactttttccaatgattcctatgagggaaacttagggttatgtggactcccattgacaacagaatgcagcaaggaccctaaacaacattctccagcttcactaacctttaggggagaacagggatttggatttggctggaagccagtggctataggatatggatgcggaatggtctttggagtgggaatgggatgttgtgtattgttaattggaaagcctcaatggattgtgagaatggttgggggtcaactcaataaaaaggtgaaaaggaagacaaggatgagatctaatgaaaatggtagcagaatgaattag

SEQ ID NO: 8700 - DNA, 3171 bp, Glycine max
atggaatcatggatgtggtgtttccttctctgttcccatttgctcatcctttatttttcaccctctcattccttatgccacccccatgacacctctgccttgctccacttcaaaaactccttcactattaatactagttatggccataatgaatatccttattattatcataaatgtgatactggttattcaaagacgagaacatgggaaaatgggacagattgttgctcttgggctggagtcacctgccaccccatctcaggtcatgtcactgacctcgacctcagctgcagtggccttcacggcaatatccatccaaacagtacgcttttccatctttctcatcttcactcactcaaccttgctttcaatcatttgtatcaatctcattggtcatctctctttggtgggtttgtgagcctcactcatctcaacttgtcttattctgaatttgaaggggatattcattcccaaatctctcacctttccaaattagtctcgcttgatctctcaggtaatgatttgttagagtggaaggaagacacttggaagagattgctccaaaatgcaacagttttaagggtgcttgttttggatggagcagatatgtcttccatttcaatcaggacactcaatatgtcttcctctttggttactcttagtcttcgatacagtgggctaagaggaaacttgacagatggcattctctgtttaccaaatcttcagcacttggatctttcaggaaactgggtccgtggaggccagcttgcagaagtgagttgcagcacaacttctcttgatttcttagctctttcagattgtgttttccaagggtcaatccctcccttcttctctaacctcacacatcttacttccctggatctctcatataacaacctcaacggtccaatccctccctctttcttcaacctcacacatctcacttccctagacctctcaggtatcaacctcaacggttcaatcccatcctcactcttaacccttccacggctaaactttctgaaactacagaataaccaactcagtggtcaaatcccagatgtctttcctcagtcaaacagctttcacgaattggatttgagtgataacaaaatagagggtgagctgccatcaacactttcaaatcttcaacatctcattttcttggatctttcatataataaattggatttgagtggtaacaaaatagagggtgagctgccatcaacactttcaaatcttcaacatctccttcacttggatctttcatataataaattggagggccctctgcctaacaatataacagggttttcaaacctaacatcgttaaggttaaatggaaacttactgaatgggacaattccttcttggtgtttatctttgccatctttgaagcagttagatctatcaggaaaccaactctctgggcatattagtgcaatctcatcatattccttggagacattgtctttatcccacaacaagttacaaggcaatattccagaatcaatttttagccttctaaaccttacactcttagatctatcatcaaacaatttaagtggatctgtcaaatttcatcatttctccaagcttcaaaatttgaaagaacttcaactttcacggaatgatcagttatcactaaatttcaaatccaatgtcaagtataatttctcccgtttatggagattggacttatcttctatggatttaactgaatttccaaaattatcgggaaaagtcccatttttggaatcactccatttgtccaataacaaacttaaaggtagagtgccaaattggttgcatgaaacgaactcattgttattggaattggacctctctcataacctattgacgcaatcattggaccaattctcgtggaagaaaccactcgcttaccttgatcttagttttaactcaatcactggtggcttctcttcctcaatttgcaatgcaagtgcaattgagattctcaacttatctcacaacatgttgacaggaaccattccacaatgccttgttaactcatcaacccttgaagttttggatctgcaactgaacaagcttcatggccctttgccaagtacctttgcacaggactgttggctcagaactctggatctcaatggcaaccaattattagaaggctttttgccagaatctttgtccaattgcatttatctggaggttttaaatcttggaaacaatcaaataaaggatgtgtttccccattggcttcaaactctaccagaattgaaagtattggttttgagagccaacaagttgtacggtcccattgagggttcaaagaccaagcatggattccccagtttagtcatttttgatgtctcttccaacaacttcagcggcccaattccaaaagcctacattaaaaaatttgaagccatgaagaacgttgttctagatgcctatagccaatacatagaagttccttttaatttattttatggacccaacgacagacccaacgacagacccaactacgctgattctgtgactataacaacaaaagcaattactatgacaatggtcagaattcgaaatgactttgtaagcattgatttatcgcaaaacagatttgaaggagagattccaggtgtcattggggagcttcattcactcagaggactcaacctttcccataacagacttattggtcctattccccaatccatgggaaatttgagaaacttagaatcattggatctctcctcaaatatgctcactggtcggatacctacagaattaagcaatttgaactttcttgaagtcctaaatctttccaataaccatcttgtgggagaaatacctcaaggaaaacagttcggtactttttccaatgattcctatgagggaaactctgggttatgtggactcccactgacaatcaaatgcagcaaggaccctgaacaacattctccaccttcaactaccttcaggaaagaaggaggatttggatttggttggaaagcagtggctataggatatggatgtggaatggtctttggagtgggaatgggatgttgtgtattgttaataggaaagcctcaatggcttgtgagaatggttggaggtaaactcaataaaaaggtgaaaaggaagacaagaatgagatctaatgaaaatggtagcagaatgaattag

SEQ ID NO: 8701 - DNA, 2442 bp, Glycine max
atggaattcatgtcctttggcctaggtatagatgtaaacctttgttcatgggaaaatgggacagattgttgctcttgggctggagtcacctgccaccccatctcaggtcacgtcactcagctcaacctcagctgcaatggcctttacggcaatatccatccaaacagtacgctttttcatctttctcatcttcactcactcaaccttgctttcaatgattttgatgaatctcatttgtcatctctctttggtgggtttgtgagcctcactcatctcaacttgtctaattcgtactttgaaggggatattccttcccaaatctctcacctttccaaattagtctcacttgatctctcagataacaacctcaacggttcaatcccatcctcactcttaaccctcacacatcttactttcttggatctctcatataaccaactcagtggtcaaatcccagatgtctttcctcagtcaaacagctttcacgaattgcatttgaatgataacaaaatagagggtgagctgccatcaacactttcaaatcttcaacatctcattctcttggatctttcagataataaattggagggccctctgcctaacaatataacagggttttcaaacctaacatcgttaaggttaaatggaaacttactgaatgggacaattccttcttggtgtttatctttgccatctttgaagcagttagatctatcaggaaaccaactctctgggcatattagtgcaatctcatcatattccttggagacattgtctttatcccacaacaagttacaaggcaatattccagaatcaatttttagccttctaaacctttattacttaggtctatcatcaaacaatctaagtggatctgtcaaatttcatcgtttctccaagcttcaatatttggaagaacttcacctttcatggaatgatcagttatcactaaatttcgaatccaatgtcaattataatttctctaatttaaggttgttgaacttatcttctatggttttaactgaatttccaaaattatcgggaaaagtcccaattttagaatcactctatttgtccaataacaaacttaaaggtagagtgccacattggttgcatgaaatatcgttatctgaattggacctctctcataacctattgacacaatcattgcaccaattctcgtggaaccaacaactcggttcccttgatcttagttttaactcaatcactggtgacttctcttcctcaatttgcaatgcaagtgcaattgagattctcaacttgtctcacaacaagttgacaggaaccattccacaatgccttgcaaactcatcatcccttctagttttggatctacaactgaacaagcttcatggcactttgccaagtatcttttcaaaggactgtcagctcagaactctggatctcaatggcaaccaattattagaaggtcttttgccagaatctatatccaattgcattcatctggaggttttagatcttggaaacaatcaaataaaggatgtgtttccccattggcttcaaactctaccagaattgaaagtattggttttgcgagccaacaagttgtacggtcccattgccggtttaaagatcaaggatggattccccagtttagtcatctttgatgtctcttccaacaacttcagcggcccaataccaaaagcctacatacaaaaatttgaagcgatgaagaacgttgttatagataccgatctgcagtacatggaaatttctttttcttatggtggaaacaagtacagtgattctgtgactataacaacaaaagcaattactatgacaatggatagaattcgaaatgactttgtaagcattgatttatcgcaaaacggatttgaaggagagattccaaatgccattggagagcttcattcactcagaggactcaacctttcccataacagacttattggtcctattccccaatccatgggaaatttgacaaacttagaatcattggatctctcctcaaatatgctcactggtcggatacctacagaattaaccaatttgaactttcttgaagtgctaaatctttccaataaccatcttgcgggagaaatacctcgaggacaacagttcaatactttttccaatgattcctacaagggaaacttggggttatgtggactcccattgacaacagaatgcagcaagggccctgaacaacattctccaccttcaactaccttgaggagagaagcaggatttggatttggttggaaaccagtggctataggatatggatgtggagtggtctttggagtgggaatgggatgttgtgtattgttaataggaaagcctcaatggcttgtgagaatggttggaggtaaactcaataaaaaggtgaaaaggaagacaaggatgagatctaatgaaaatggtagcagaatgaattag

SEQ ID NO: 8702 - DNA, 2946 bp, Glycine max
atggatgtggtgtttccttctctgttcccatttgctcatcctttatttttcaccctctcattccttatgccaccccatgacacctctgccttgctccacttcaaaaactccttcactatttatgaagatccttattattcttatttttgtgatcatggttattcaaagacgacaacatgggaaaatgggagagattgttgctcttgggctggagtcacctgccaccccatctcaggtcacgtcactcagctcgacctcagctgcaatggcctttacggcaatatccatccaaacagtacgcttttccatctttctcatcttcactcactcaaccttgctttcaatgattttgatgaatctaatttgtcatctctctttggtgggtttgagagcctcacgcatctcaacttgtcttcttctgactttgaaggggatattccttcccaaatctctcacctttccaaattagtctcgcttgatctctcatataatatattaaagtggaaggaagacacttggaagagattgctccaaaatgcaacagttttaagggtgattgttttggatggaaatgatatgtcttccatttcaatcaggacactcgatatgtcttcctctttggttactcttagtctaagacagactgggctaagaggaaacttgacagatggcattctctgtttaccaaatcttcaacacttggatctttcacttaattgggaccttaaaggtcagcttccagaagtgagttgtagaacaacttctcttgatttcttacatctttcatgttgtgatttccaagggtcaatccctccttctttctccaacctcatacatctcacttccctatatctctcacttaacaacctcaacggttcaatccctccctttttctctaactttacacatcttacttccttagatctctcagaaaacaacctcaacggttcaatccctccctctttctccaacctcatacatctcactttcctggacctctcacataacaacctcaacggttcaatccctccctctttctccaacctcatacatctcacttccctggacctttcaggtaacaacctcaacggttcaatccctccctttttctctaacttcacacatcttacttccttggatctctcagaaaacaacctgaatgggacaattccttcttggtgtttatctttgccatctttggtgggtttagatctatcaggaaaccaattctcagggcatattagtgcaatctcatcatattccttggagagattgattttatcccacaacaagttacaaggcaatattccagaatcaatttttagccttctaaaccttactgacttagatctatcatcaaacaatttaagtggatctgtcaaatttcatcatttctccaagcttcaaaatttgaaagaacttcaactttcacagaatgatcagttatcactaaatttcaaatcaaatgtcagttatagtttctccaatttattgagtttggacttatcttctatgggtttaactgaatttccaaaattatcgggaaaagtcccaatcttggaatcactctatttgtccaataacaaacttaaaggtagagtgccaaattggttccatgaaatatcgttatatgaattggacctctctcataacctattgacacaatcattggaccaattctcgtggaaccaacaactcggttaccttgatcttagttttaactcaatcactggtgacttctcttcctcaatttgcaatgcaagtgcaattgagattctcaacttgtctcacaacaagttgacaggaaccattccacaatgccttgctaactcatcatcccttcaagttttggatctacaactgaacaagcttcatggcactttgccaagtacctttgcaaaggactgttggctcagaactctggatctcaatggcaaccaattattagaaggttttttgccagaatctttgtccaattgcattaatctggaggttttagatcttggaaacaatcaaataaaggatgtgtttccccattggcttcaaattctaccagaattgaaagtattggttttgcgagccaacaagttgtacggtcccattgccggtttaaagaccaaacacggattccccagtttagtcatttttgatgtctcttccaacaacttcagcggcccaataccaaaagcctacattaaaacatttgaagcgatgaagaacgttgctctacatgcctatagccaatacatggaagtttctgtaaatgcttcttctggacccaactacactgattctgtgactataacaacaaaagcaattactatgacaatggacagaattcgaaatgactttgtaagcattgatttatcccaaaacagatttgaaggagagattccaagtgtcattggggaacttcattcactcagagggctaaacctttcccataacagacttattggtcctattccccaatccgtgggaaatttgagaaacttagaatcgttggatctctcctcaaatatgcttactggtgggatacctacagaattaatcaatttgaactttcttgaagtcctaaatctttccaataacaatcttgtgggagaaatacctcaaggaaaacagttcggtactttttccaatgattcctatgagggaaactcagggttatgtggactcccactgacaatcaaatgcagcaaggaccctgaacaacattctccaccttcaactaccttcaggagagaaggaggatttggatttggttggaaaccagtggctataggatatggatgtggaatggtctttggagttggaatgggatgttgtgtactgttaatgggaaagcctcaatggcttgtgagaatggttggaggtcaactaaataaaaaggtgaaaaggaagacaaggatgaaatctaatgaaaatggtagcataatgaattag

SEQ ID NO: 8703 - DNA, 2541 bp, Glycine max
atgcgtgagacgagaacatgggaaaatgggacagattgttgctcttgggctggagtcacctgccaccccatctctggtcacgtcactgagctcgacctcagctgcagtggtcttgtcggcaaaatccatccaaacagtacgcttttccatctttctcatcttcactcactcgaccttgctttcaatgattttgatgaatctcatttgtcatctctctttggtgggtttgtgagcctcactcatctcaacttgtctgctacgtactctgaaggggatattccttcccaaatttctcacctttccaaattagtctcacttgatctctcatataatatgttaaagtggaaggaagacacttggaagagattgctccaaaatgcaacagttttaagggtgcttcttttggatgaaaatgatatgtcttccatttcaatcaggacactcaatatgtcttcctctttggttactcttagtttggtatggactcagctaagaggaaacttgacagatggcattctctgtttaccaaatcttcagcacttggatctttcaattaattggtacaatagctacaataggtacaataggtacaataggtacaataaaggtcagcttccagaagtgagttgtagaacaacttctcttgatttcttagatatttcaaattgtggtttccaagggtcaatccctccctctttctccaacctcatacatctcacttccctgtatctctcatctaacaacctcaagggttcaatccctccctctttctctaacctcacacatctcacttccctggacctctcatataacaacctcaacggttcaatcccatccttctcatcatattccttgaagagattgtttttatcccacaacaagttacaaggaaatattccagaatcaatttttagccttctaaaccttactgacttagatctatcatcaaacaatttaagtggatctgtcaaatttcatcatttctccaagcttcaaaatttgggagtactttacctttcacagaatgatcagttatcactaaatttcaaatccaatgtcaagtataatttctcccgtttatggagattggacttatcttctatggatttaactgaatttccaaaattatcgggaaaagtcccatttttggaatcactccatttgtccaataacaaacttaaaggtagattgccaaattggttgcatgaaacgaactcattgttatatgaattggacctctctcataacctattgacgcaatcattggaccaattctcgtggaaccaacaactcgcaatcattgatcttagttttaactcaatcactggtggcttctcttcctcaatttgcaatgcaagtgcaattgcgattctcaacttgtctcacaacatgttgacaggaaccattccacaatgccttactaactcatcattccttcgagtcttggatctacaactgaacaagcttcatggcactttgccaagtacctttgcaaaggactgctggctcagaactctggatctcaatggcaaccaattattagaaggctttttgccagaatctttgtccaattgcatttatctggaggttttagatcttggaaacaatcaaataaaggatgtgtttccccattggcttcaaactctaccatatttggaagtattggttttgagagccaacaagttgtacggtcccattgcgggatcaaagaccaagcacggattccccagtttagtcatttttgatgtctcttccaacaacttcagcggcccaattccaaaagcctacattaaaaaatttgaagccatgaagaacgttgttcaagatgcctatagccaatacatagaagtttctttaaatttttcttatggatccaactacgttgattctgtgactataacaacaaaagcaattactatgacaatggatagaattcgaaatgactttgtaagcattgatttatcgcaaaaccgatttgaaggagagattccaagtgtcattggggagcttcattctctcagaggactcaacctttcccataacagacttattggtcctattccccaatccatgggaaatttgagaaacttagaatcattggatctctcctcaaatatgctcactggtgggatacctacagaattaagcaatttgaactttcttgaagtcctaaatctttccaataaccatcttgtgggagaaatacctcaaggaaaacagttcggtactttttccaatgattcctatgagggaaacttggggttatgtggactcccattgacaacagaatgcagcaaggaccctgaacaacattctccaccttcaactaccttcaggagagaaccaggatttggatttgggtggaaaccagtggctataggatatggatgtggaatggtctttggagtgggaatgggatgttgtgtattgttaataggaaagcctcaatggcttgtgagaatggttggaggtcaactaaataaaaaggtgaaaaggaagacaaggatgagatctaatgaaaatggtagcagaatgaattag

SEQ ID NO: 8704 - DNA, 2592 bp, Glycine max
atgaagaacgttgttatatatgccaatccgcaatacatggaaacttctgttattgttagtgacaccaacaacattgatcatgaaaccaactacgctgattctgtgactacgacaacatgggaaaatgggacagattgttgctcttgggctggagtcagctgcaaccccatctcaggtcacgtcactgagctcgacctcagctgcagtcgcctttacggcaatatccatccaaacagtacgcttttccatctttctcatcttcactcactcaaccttgctttcaatgattttaattattctcatttgtcatctctctttggtgggtttgtgagcctcactcatctcaacttgtctaattctcactttgaaggggatattccttcccaaatctctcacctttccaaattagtctcacttgatctctcatataatgggttaaagtggaaggaacacacttggaagagattgctccaaaatgcaacagttttaagggtgcttgttttggatcaaacagatatgtcttccatttcaatcaggacactcaatatgtcttcctctttggttactcttagtcttcgagagaatgggctaagaggaaacttgacagatggcagtctctgtttaccaaatcttcagcacttggatctttcatataatcgggcccttaaaggtaagcttccagaagtgagttgcagaacaacttctcttgatttcttagatctttcactttgtggtttccaagggtcaatccctccctctttctccaacctcatacatctcacttccctggacctctcaggtaacaacctcaacggttcaatccctccctctttctccaacctcatacatcttacttccttggatctctcatataacaacctcaacggttcaatcccatccttctcatcatattccttggagacattgtttttatcccacaacaagttacaaggcaatattccagaatcaatttttagccttctaaaccttactcacttagatctatcatcaaacaatttaagtggatctgtcaaatttcatcgtttctccaagcttcaaaatttggaaaaacttcacctttcatggaatgatcagttatcactaaatttcgaatccaatgtcaattatagtttctctaatttaaagttgttgaacttatcttctatggttttaactgaatttccaaaattatcgggaaaagtcccaattttagaatcactctatttgtccaataacaaacttaaaggtagagtgccacattggttgcatgaagtatcgttatctgaattgaacctttctcataacctattgacgcaatcattggaccaattctcatggaaccaacaactcggttaccttgatcttagttttaactcaatcactggtgacttctcttcctcaatttgcaatgcaagtgcaattgagattctcaacttgtctcacaacaagttgacaggaaccattccacaatgccttgcaaactcatcatcccttctagttttggatctacaactgaacaagcttcatggcactttgccaagtatcttttcaaaggactgtcggctcagaactctggatctcaatggcaaccaactattagaaggtcttttgccagaatctttgtccaattgcattgatctggaggttttagatcttggaaacaatcaaataaaggatgtgtttccccattggcttcaaactctaccagaattgaaagtattggttttgcgagccaacaagttgtacggtcccattgtcggtttaaagatcaagcatggattcccccgtttagtcatctttgatgtctctttcaacaacttcagcggcccaataccaaaagcctacatacaaaaatttgaagcgatgaagaacgttgttatagataccgatctgcagtacatggaaatttctattggagctaaaaagatgtacagtgattctgtgactataacaacaaaagcaattactatgacaatggacaaaattccaaaaggctttgtcagcattgatttatcaaaaaacggatttgaaggagagattccaaatgccattggagagcttcatgccctcagagggctcaacctttcccataacagaattattggtcctattccccaatccatgggaaatttgacaaacttagaatcattggatctctcctcaaatatgctcactggtgggatacctacggaattaagcaatttgaacttccttgaagtcctaaatctttccaataaccatcttgcgggagaaatacctcgaggacaacagttcagtacttttaccaatgattcctatgagggaaactcagggttatgtggactcccactgacaatcaaatgcagcaaggaccctgaacaacattctccaacttcaactaccttgaggagagaaggaggatttggatttggttggaaaccagtggctataggatatggatgtggaatggtctttggagtgggaatgggatgttgtgtattgttaataggaaagcctcaatggcttgtgagaatggtcggaggtaaacccaataaaaaggtgaaaaggaagacaaggatgagatctaatgaaaatggtagcagaatgaattag

SEQ ID NO: 8705 - DNA, 3111 bp, Medicago truncatula
atgagaatgtttcttctatgtttgcatcttttgcttttcctattttcatccttctcttcatgttcatcttctaatttgttatgtcatcctgaagatagctattccttgcttcaattcaagtcttccttcactacatatacaaactatgcttgtctggaacaacctcagaaaacatcaacatggaaaattgagacaaattgttgttcatggcatggtgtcacgtgcgacgctgtctctggtcgcgtgattggtctcgaccttggctgtgaatgccttcaaggtaaaatttatcctaacaacactctttttcatcttgctcatctccaatcactcaacctttctcacaatgatttcttcaactccaatttgcattctcagtttggtggatttaagagtcttacacatcttgacttgtcttcgtgtaactttcaaggcgaagttcctcctcaaatctcataccttttgcaattaacatcacttcgtctttctaaaaatgacgagttaagttggaaagaaaccactttgaagagacttgtgcaaaacgcaacaattttgcaagagttatatttggatgaaacagatatgacttcaatcaacccaaacttgttgaattcgatcttcaataaatcttcctctttgattagtcttagtcttcaaagaacaggattaagtggaaattggaaaaataacattctttgtttaccaaatattcaagagctagatatgtcaaagaatgataaccttgaaggtcaacttccagatttgagctgtagcacttctcttagaatcttggatctttcatattgtctattcaaagggccaattcctctttctttctctaacctcacatattttacttccctaagtctcatagagaacaaccttaatggttcaatcccatcctttcttttaatccttccaaatctaacatttttgtctctcaaagataattcactcataagcggtctaattccgaatgtatttcccgaatcaaatagatttcaagaactagatttgagcggtaacaaaattggaggtgatcttccaacatcactttcaaaccttcaacatctcgttaatttagacctgtcatccaattcattcagtggtcaaattccagacgtgttttacaaactaaccaaattacaagaactccgtctagataataatagactagacggacaaatcccgccatcattgtttaacttgtctcaacttgattactttgattgttcttataataaattaaagggtcctctacccaacaaaataacagggtttcaaaacttaggttatttactattaaataacaatttactaagtggaaaaattccttcatggtgtttatccataccatctttgacaatgttggatctatcaaataatcagtttactggaaatataagtgcagtctcatcatattctttgtggtatctaaaactatgcagcaacaagctacaaggcgatattcctgaatctattttcaaccttgtaaacctaactacactatgcctgtcatcaaacaacttgagtggtattgtcaattttaaatacttttccaaacttcaaaatttgaattctctgtccctttcacataatagtcaattatcaccgaactttgaatccaatgtcagttacaatttttctatcctgtcaatcttggaattgtcttctgtcggtttgattggattttcaaaattatcatcaggaaaattccctagtttgagatatcttgatttgtccaacaacaaactttatggaagagtgcccaattggttgcttgaaatagattcattacaatttttaggcctgtctcataacttgtttacatcgatggaccaattctcgagtaatcactggcacgacctatatggtcttgatcttagttttaacttattagccggtgacatctcttcgtcaatttgcaatagaacttcacttcaattgctcaacttggcacacaacaaattgacaggcaccattccacattgtcttgcaaacttatcatcccttcaagttttggatttacaaatgaacaaattttatggcactttaccaagtaacttttcaaagtactgtgaccttcgtactctgaatttcaacggaaacctattagaaggccttttgcctaaatctttgtccaactgtgaatacctagaggctttaaatcttggaggcaacaaaattaaagactattttccatcctggcttcaaactatgcaatatttggaagtactggttttgcgagagaataatttgtatggtcctattgccggtgtaaatatcaagcatccatttcctagtttaattatttttgatatttcatccaataacttcagtggcccactaccaaaagcctacatacaaaattttaaggccatgaaaaatgttattcaagttggagaaggtagtagctctcaatacatggaaaggatggaagtaggtgatatgacatactatgattctgtgactatgacagtgaaaggaaacagcattgtgatggtgaaaattccaatagtctttgtgaacattgatttttctcataacaattttgaaggagagattctgaatgttattggggagcttcactcactcaaagggcttaacctttcccataacagactcaccggtcctattcctcaatccgtaggaaacttgtcaaacatggaatcattggatctttcgtcaaatatactcactggtgtaattccttcagaattaatcaatctgaacggtattggagtattgaatctttctcataaccatctagtgggagaaatacctcaaggaaaacagttcaatacattttccaatgactcatatgaaggaaacttgggattatgcggatttcccttgtcaaagaaatgtgaacctgaacaacattctccgcttccacccaacaacctttggagtgaagagaaatttggatttggatggaaaccagtggctattggatatggatgtggaatggttattggaataggccttggatgttttgtgttgttaaccggaaagcctagatggcttgtgatgatggttggaggtcaacctaagcaaagagttacaaggaggataagagtgaggagaattcatggctcaaccatgaattag

SEQ ID NO: 8706 - DNA, 4044 bp, Medicago truncatula
atggagcagttattgaactgcacacaagctgacaggtttcagaaattaaccacagtgaaatcgccaatgctgttgcagttctggacaaatagtagcatgagacttgaagaatgtgaggtggagtgcttgaaggattgtttttgtaatacatatgcaaactctctcataaatggagggtctcatggttgcatgctttggtttggagacttgattgacattaggttgcttataagtgaagatagtgaggttactagccaagaggagttgtgtgatgtagccaagaaatattttgatgagttgttcaggcctaatgatggtgtccacaaacctgtcttggaactcattcatagtagagttactttggaatataaccagagtctgatacctattacaaagaaagggcttaagcaagatttatttcaaatgcatcaggataagtctcttggtccagacagtttcaatccgacgttctttcttatgtttttggtatctttattgaaatgctgccttgacaagtgtatttctcatgaagaatatgctttcgtggaggctattgaagtaattcatgcctcgaaaagggtggagtggcgatgcaagggtggagtggcatggcggattggtgatggtagtaatgttagaatcatgatggattcattgctcagaggagacaaaggaaaatggctgcaatcacaccaaaaccaagatcatgatctcgacgtggaattccacatatttttccattgtaccaatatcagacctgtggacatatccagagaagaaagaccaagggaaggttggattaagtgtaacgttaatgctaccttcattgcaactttttcttgctcaaacaaactggaaatctgcgagatgtcaacaatcaaaggggaagcaaaaacgcttcttgaagcaattcaaatggccatcaacaaggggctcgagagagtagtgtttgaacgcgactcacaactaaaattatccatggagaagtgcttgcttctgtctttaattcttttgttcttccattttccatcattctcttcttcatcttctttcaactcctccttatgtcatcatgatgagagctttgctttgcttcagttcaagtcctccttcactatagatactccttgtgttaaatctcctatgaaaacagcaacatggaaaaatgggactgattgctgctcatggcatggtgtcacgtgtgacaccgtatctggtcacgtcattggccttaaccttggctgtgaaggctttcaaggtatactccatcctaatagtacccttttccatcttgctcaccttcaaatgctcaacctttcgaacaattatttctctaacgatttctctggctcccattttcattctaagtttggcgggtttatgagtcttacacatctcgacttgtcttcttgtttctttcaagatgaaattccttctcaaatctcggacctttccaaattacaatcacttcatctttctgggaatgataagttagtttggaaagagactaccttgaagagacttgtgcaaaacgcaacaagtttaagggagctgtttttggattatacagacatgtctttgataagaccaaactccataaacttgctcttcaatcgatctttctctctggttactcttaatcttagagagacaatcttaagtggaaaattgaaaaagagcattctttgtttaccaagtattcaagagctagatatgtcatataatgaccaccttgaaggccaacttccagaattgagctgtagtacttctctcattactttggatctctcaggttgtggattccaagggtcaattcctctgtctttttctaaccttacacgtcttgcctccctacgtctgtcagggaaccacctaaacggttcaattccatccacaattttaaccttttcacatcttacctttctgtatctcgatgacaatgtactcaatggtcaaatcccggattcttttcatctgtcaaacaaatttcaaataatagatttgagtggtaacaagattggaggtgaactaccaacatcactttcaaaccttcgacatctcattaacttggatctttcatacaattcattaagcggtcaaattccagatgtatttggcgggatgaccaaactgcaagaactccgtctatattcaaacaatttagtaggacaaattccactttccttatttaagttgactcaacttgttagattcgattgttcatataataaattaagaggtccattgccaaataaaattacaggttttcaacagctagttcgttttcgtttaaatgacaaccgtctaaacggaacaattccttcctctttgttatctttgcctcgtttgctaaatttatatctatcaaacaatcaacttacagggcatatcagtgcaatctcgtcctattcgttagaggctctaaatctaggcggtaacaagctacaaggcaatattccagaatcaattttcaaccttgtaaatttagctgtattagatctatcatcaaacaacttgagtggtgttgtcaattttcaacactttggcaaacttcaaaatttgtattctttgtccctttcacagaatacacaattatcactaacctttgaatccaatgtcagttacaatttttctcatctaagggaattggatttgtcttctatcaacttgacaaactttcccatattatcagaaaaattcctaagtttggattattttgatttgtccaataacaatcttaatggaagggtgccaaattggttgtttgaaacagcagaatctttgaacctctctcaaaattgcttcacttcaatagaccaaatctcaaggaatgttgatcagcttggtagtcttgatcttagttctaacttactggaaggtgatatctctttgtcgatttgcagtatgaaatcacttcgatttctcaacttggcgcacaacaaattgaccggtatcattccacaatatcttgctaatttatcatccctacaagtcttggatctacaaatgaatagattttatggcgctttgccaagtaacttctcaaagtacagtgaccttcggagtctgaatctcaatggcaaccatatagaaggtcatttgcctaaatctttgtcccactgtaaaacgctggagtttctaaacctcggcagcaacaaaatagaagacaaatttcctgactggattcaaactttgcaagatttgaaagtgctagttttacgagataataagttgcatggtcacattgccaatttaaagatcaagaatccatttcccagtttagttatttttgatatctcgggaaataactttagtggtccgctaccaccgaaagactatttcaaaaagtatgaagccatgaaggctgttactcaagtgggagagaataccagtttgctatatgtacaagattcagcagggtcctatgattctgtgactgtggcaaacaaagggatcaatatgacattggtaaaaattccaataaactttgtaagtattgatttctcaagaaacaagtttaatggaggaattccaaatgatataggagaacttcacgcactcaaagggcttaacctttcacataacagactcactggtcctattcctcaatccatacaaaacttgacaaacttggaatcgttggatctctcgtcaaatatgctcactggtatgattcctgcagaattaaccaatttgaacagtcttgaagtcttggatctttccaataaccatcttgtgggagaaatacctcaaggaaagcaattcaatacatttacaaatgattcttataaagggaacttggggttatgtggattacccttgtcaaagaaatgtggaccggaacaacattctccaccttcagccaacaacttttggagtgaagagaaatttggctttggatggaaaccagtggcaattggttatggatgtggatttgtgtttggaataggccttggatattatatgtttttaattggaaagcctagatggtttgtgatgatatttggtggtcatcctaagagaagagtgaataggagaacataa

SEQ ID NO: 8707 - DNA, 1596 bp, Glycine max
atctcttcgacaacgtcgttcgattcaaaaccacttctttccctttttcctattttttttctctttttttattaaaaaaataaaaatgttgaagctttcgtgcaatggcttggaccgggctcactccctggcccaatgcggcttcgcgggccggcccgcctgcgccgtccctcgccggaggaggagcggcgtctccggattccggttgccggaaggcaggtcgatccgggtgtccgcggcggtgtcggcaaaggacggcgcggtggcgacccgggtagaggcggatcccggtacgctggcggaccggctgagggtggggagcttgacggaggatgggttgtcttataaggagaagttcattgtgaggagctacgaagttgggatcaataagactgccactgttgaaaccattgccaatctcttgcaggaggttggatgtaatcatgctcagagtgttggatattctactgatggttttgcaaccacccctacgatgagaaaattgcgtctcatatgggttactgctcgcatgcacattgaaatctacaaataccctgcttggagtgacattgttgagatagagacatggtgccaaggggaaggaagggttgggacaaggcgtgattttatactgaaagactatgcaactgatgaagttattggaagggcaacaagcaaatgggtaatgatgaatcaggacaccagacgactccagaaggtttctgatgatgttaaagaagagtatttggttttctgtcctcgagagcccaggttagctattccagaggcagatagtaatagcttgaagaaaataccaaaattggaagaccctgctcagtattccagacttggacttgtgccaagaagagcggatctggacatgaatcagcatgttaacaatgtcacctatattggatgggtgcttgagagcatgcctcaagaaatcattgatagccatgagttgcagagtattaccttggattacagacgagagtgcggacaacatgacatagtcgattccctcactagtgtggaagcgatacagggtggtgccgaggcagttccagaactgaaaggtacaaatggatctgccacggcaagggaagacaaacatgaacaccagcagtttctgcatctacttaggttgtctactgaaggacttgagataaaccggggacgaacagaatggagaaagaaagctccaagatgagaaccattatgtgtgcttccacccgaatccatgattctgtttttgtcttgtgttgtttcatgttaccagggttgtcttatcaattttcccttgatattttgcttagagtttgtgcgcttaatagggattgaagagttaaaatattgcttctgttttcttgtcatgctcaaaaatttaagttgtccaaatcccgtagttaggctatataggttgacatcaatctctgatccattagtatcagattccatgaatgtcattgtaccttaagggagcatagaaatccaggaagttggtatggatctgccatctactgcatgacttgaacaatgtgtgttaaaataatcattttgaaataattcaattagctaattattaatgttcttact

SEQ ID NO: 8708 - DNA, 1568 bp, Glycine max
gcttcttcccctttctcttctcatactcacccagctttcctttttattaaaaaataaaaaaaaatgttgaagctttcgtgcaatggcttggaccgggctcactcgctggcccaatgcggctttgcgggccggcccgcctgcgtcgtccctcgccggaggataagcggcgtctccggattctggtcgccgggcggcagggcgatccgggtgtcggcggcggtggtgtcggcgaaggatggcgcggtggcgacccgggtggaggcggagtccgggacgctggcggaccggctgagggtggggagcttgacggaggatgggttgtcttacaaggagaagttcattgtgaggagctacgaagttgggatcaataagactgccactgttgaaaccattgctaatctcttgcaggaggttggatgtaatcatgctcagagtgttggatattctactgatggttttgcaaccacccctacgatgagaaaattgcgtctcatatgggttactgctcgcatgcacattgaaatctacaaataccctgcttggagtgacgttgttgagatagagacatggtgccaaggtgaaggaagggttgggacaaggcgtgattttatactgaaagactatgcaagtgatgcagtcattggaagggcaacaagcaaatgggtaatgatgaatcaggacaccagacgactccagaaagtttctgatgatgttaaagaagagtatttggttttctgtcctcgagagcccaggttagcaattccagaggcagatagcaataacttgaagaaaataccgaaattggaagaccctgcccagtattccagaactggacttgtgccaagaagagcggatctggacatgaatcagcatgttaacaatgtcacctatattggatgggtgcttgagagcatgcctcaagaaatcattgatagtcatgagttgcagagtattaccttggattacagacgagagtgcggacagcatgacatagttgattccctcactagtgtggaagaaatccagggtggtgccgaggcagtttcagaactgaaaagtacaaatggatctgccatggcaagggaagacaaacatgaacaccagcagtttctgcatctacttaggttgtctactgaaggacttgagataaaccggggacgaacggaatggagaaagaaagctccaagatgagaaccattacgtgtgcttccacccaaatccatgattctgtttttgtctttcttgtgttgtttcacgttaccagggttgtcttatcaattttccctttatattttgcttagagtttgtgcccttaataggggattggagagttaaaattttgtcgctgttttcttgtcatgctcacaaatttaaattgttgtccaaatcctgtagttaggctaaataggttgacatcaatctctgatccattagcatcagattccatgaatgtcattgtaccttaagggagcatagaaatccaggaaattggtatggttctgtcatctactgtatgattcgaacaatgcgtgttgctaaaataatcattttaaaattattcaattagc

SEQ ID NO: 8709 - DNA, 1119 bp, Arachis hypogaea
atgttgaaggtttcatgcaacggctcagaccgggttcaattcatggcccaatgcgggttcgcgggtcagcccgcttccgttctcgttcgtcggaggagtgtatccgccgtcggattcggctatccgatgaacagggtattgtcggttcgcgcaatcgtgtcggaccgggacggggcggtggtgaaccgggtcggagcggaggcggggacgttggcggaccggctgcggcttgggagcttgacagaggatggactgtcttacaaggagaagttcattgtgaggagctatgaagttggaatcaataagactgccaccgttgaaaccattgctaatctcttgcaggaggttggatgtaatcatgctcaaagtgttggatattctactgatggtttcgcaacaactcccaccatgagaaaattaggcctcatatgggtcactgctcggatgcatattgaagtctacaaataccctgcttggagtgatgtagttgagatagagacatggtgtcaaggggaagggagggttggaatcagacgcgattttatactaaaagactatgcgaccgatcaagtcatcggaagagctacaagcaagtggttgatgatgaatcaggagactagaagactacaaaaggtgtctgacgatgttcgagaggaagttttaatttactgtcctcgggagcccaggttagcaattcctgaggaggacagcaattgcttgaaaaaaattccaaagttggaagatcctggtcaatattccaggcttagactcatgcctagaagagcagatctagacatgaatcagcatgttaacaatgtcacttatattggttgggttcttgagagcatgcctcaagaaatcattgatagccatgaactgcacagtatcaccttggattacagacgagagtgccaacgagacgacatagttgattccctcaccagcatcgagggcgacggggtgcttctggaagtcaatggcaccaacggatcctccgtagcatgggagcacggtcatgcctatcaacagtttctacatctgcttaaattgtccaccgacgaaggactcgagataaaccgaggacgaacagcatggagaaagaaagcttcaagattatga

SEQ ID NO: 8710 - DNA, 1463 bp, Vitis vinifera
taacctcctccggcaccataaatacacacatacccacacctttcaattggtatcagtttcgaatcctccaatgtcggtatcgatgctcaaggcgccatgcaatgcagccgaccaacttcaagccctagcccaatgccgcgcccacgtcgccccccgccgactgcctcgccgccggatctccggagtctccttctcagcacctcccaggactccggtggtggcggtgctggaccgggtggccgccgccgatggagagcagagccggttggcggtagcgggctccgggagcttggcggacaggctccggatggggagcttgacggaggatgggttgtcgtacaaggaaaggttcattgtgaggtgctatgaggtggggattaacaagactgcgactgttgaaaccattgctaatctcttgcaggaggtaggatgcaaccatgcccagagtgtcggattttcaacagatggttttgcgacaacccacaccatgagaaaattgcatctcatatgggtgactgctcgcatgcatattgaaatctacaaatacccagcttggagcgatgtgattgaaatagaaacatggtgccaaggggaaggaagaattggaactagacgtgattggattctcaaggactatgctactggtcaagttattgggagagcaacaagcaagtgggtgatgatgaaccaagatactagacgacttcagaaagtcagtgatgatgtccgggatgaattcttaatttactgtccacgagaactaagattagcattcccagacgaaaataatagcagcctgcagaaaatagcaaaactggaagatccttctcagtattccaggctaggacttgtgcctagaagagctgatctggacatgaaccagcatgtaaacaatgttacttacattggttgggtgctagagagcatgcctcaagagatcattgacacccatgagctgcaaaccatcaccttggattatagaagggaatgccaacatgatgacatagtggattccctcacaagttcagaatcaactgaggatgcaaaaaccattccagagcttcgaggaacaaatggatctgctactgcaacaaaaggtcaacaggactgctgtcagttcttgcatttgttgaggttgtctggtgagggtcttgaaataaacaggggccgtactgagtggaggaaaaaaactgcaagataagggtatctttcattttgcaatactttctcatcttaagtgggcttcatggtgatttcttcctactcttttttatttttcttgtttccttcccaagcaattttgctctggatttatgtttcttaggagctaagttgttgatttctgtcttctatcatatgcctagagtttgtcaaagtatttgtacttgaatatgaactttgatgggccaaactccaaaccccatgaatgaagttttgaatttataattctttttctttcttcc

SEQ ID NO: 8711 - DNA, 1110 bp, Jatropha curcas
atgatgttgaaggtaccgtgtaccgcgcccgaccaaatccaatccctagctcctcaatgtagattccttaaccagcatcgtagcagttcccatttcactcgccgcagagcaaacgctgtcgtttactcttcccctgtcgctaagatttctactcagcctgttgtttctgatggagtcactaaggttgaatccgggtgtgaaagcttggctgatcgccttcggttagggcacttgacggaggatggtttctcctataaggagaaatttatcgttaggagctatgaagttgggattaataaaactgctaccgttgagactatcgctaattttttgcaggaggttggctgtaatcatgctcagagtgttggattttcaactgatggatttgctacaacccccaccatgaggaagctgcatctcatatgggtaactgctcgcatgcacattgaaatatataaataccctgcctggagcgatgttgttgaaattgaaacatggtgccaaagtgaaggaagaattggaactagacgtgactggattctgaaggactatgccactggtcaagttatcgggagagccacaagcaagtgggtgatgatgaatcaagacactaggcggcttcagaaagtaactgatgatgtccgagatgaatacttagttttttgcccacgagaactcagattagcatttccagaggaaaataatcgaagcttgaagaaaatttcaaaattagaagatactactcaatattccaaacttggtcttgtgccaagaagagcagatctagacatgaatcaacatgttaataatgtaacttatatcggatgggttctagagagcatgcctcaagaaatcatcgacacccacgaattacaaacgatcaccttggattacagaagggaatgccaacatgatgatgtagttgattcgcttaccagtgcagaatctcttgagggtgctggtttagatcttcatgcaacaaatggatctgccactgcaattgcaggcgagcaagacagtcgtaacttcttacatttacttagattctcaagtgatggccttgaaattaaccgtggccgcaccgaatggagaaagaagccctccagatga

SEQ ID NO: 8712 - DNA, 1307 bp, Brassica rapa
gctcgcctcccacattttcttcttcgatcccgaaaagatgttgaagctctcgtgtaatgcgactgataagttacagaccctcttctcgcattctcatcaaccggatccggcacaccggagaaccgtctcctccgtgtcgtgctctcatctgaggaaaccggttctcgatcctttgcgagcgatcgtatctgctgatcaaggaagtgtgattcgagcagaacaaggtttgggctcactcgcggatcagctccgattgggtagcttgacggaggatggtttgtcgtataaggagaagttcatcgtcagatcctacgaagtggggagtaacaagaccgccactgtcgaaaccgtcgctaatcttttgcaggaggtgggatgtaatcatgcgcagagcgttggattctcgactgatgggtttgcgacaacaccgaccatgaggaaactgcatctcatttgggtcactgcgagaatgcatatagagatctacaagtaccctgcttggggtgatgtggttgagatagagacatggtgtcagagtgaaggaaggatcgggactaggcgtgattggattcttaaggatgttgctacgggtgaagtcactggccgtgctacaagcaagtgggtgatgatgaaccaagacacaagacggcttcagaaagtttctgatgatgttcgggacgagtacttggtcttctgtcctaaagaactcagattagcatttcctgaggagaataacagaagcttgaagaaaattccgaaactcgaagatccagctcagtattcgatgattgggcttaagcctagacgagctgatctcgacatgaaccagcatgtcaataatgtcacctatattggatgggttcttgagagcatacctcaagagattgtagacacgcacgaacttcaggtcataactctggattacagaagagaatgtcaacaagacgatgtggtggattcactcaccactaccacctcagagattggtgggaccaatggctctgcatcatcaggcacacaggggcaaaacgatagccagttcttacatctcttaaggctgtctggagacggtcaggagatcaaccgcgggacaaccctgtggagaaagaagccctccaatctctaagccatttcgttcttaagtttcctctatctgtgtcgctcgatgcttcacgagtctagtcaggtctcatttttttcaatctaaatttgggttagactagagaactggaattattggaatttatgagttttcgttcttgtttctgtacaaatcttgaggattgaagccaaacccatttcatctt

SEQ ID NO: 8713 - DNA, 2155 bp, Glycine max
gtctgtgatgggatcgaatgaagaaatgggtctggatcagctcccttccgctctggttgcgaccatcatgtccaaactggacattgcatccatctgttcattggcttccacctcatccaccttccgctcctgcgcccgacacatcctctcctttctccccactttccacctcctcgacattgcgccttcgggggagttgctgagacccttgctaccgcccaatccctacctcaccaatctcaagctcgattgcgctggcctcgacgattccgcaattgggttcttgctcaaaccctccttgcacgacctttctctccacaattgcgccgatttcagtggcagactcttgtccgagatcggcaaccgatgcaaccatctcaggtctctctatttgggctccgtggctgagaaaagagggagggcaattcatatttctgatctccaggagttactcaccggttgctcccacttggaagcactgattctgatgtttgacgtctctctctttctacgtcacaactttgctcgagtatgggcttctgcctcagagaaactcacttctcttgagattggctacatttcttcagtgacagtgactgaactgcttagcccaaatttgggatcccagctgccctcaaatcctgctcaaccatccatacttccaagcattcagaaactgtgtcttaatgtagactatataactgatgctatggttggtacaatatccaaaggtctcatgcttttgacccatttggatcttcaagatgcaccactgattgaaccaagaattacatttgacctaaccaatgctggtcttcaacaaattaatcaacttgggagattgaaacatctttcattggttcgaagccaagagttccaaattacctacttccgaagagtgaatgatctgggattacttctaatggctgacaagtgtgcaaacatggagagcatatgccttggtggcttttgtcgtgtcacagacactggtttcaaaactatcctgcattcttgcactcgcttatacaagcttaaggtcactcatgggactcatttaactgatctagtttttcatgatatttccgcaacatcccttactttaacacatgttagcttaagacggtgcaatctgttaactaaccatgctgttttgagtttggcatcaaacaaggtacttaaaattcttgacttgagagattgcaggagccttggggatgaagctctccaggccattggcactcttccaagactgaaaattttactattagatggctctgatataacagatgcaggacttttgtacttaagaccatctgttattagctcactgtatgcattgtcgcttcgagggtgcaagagacttacagataaatgcatcacagctctatttaatggctgctgtgtgctggaattacgagaactggatctatctaatcttcctaacctctcagataatggagttctgctgctggcaaaaagtcggattcccttttttgaactccgtatgcgacagtgccctctaattggtgatacttcagttatggcattagcttcaatgctggttgatgaggccaaacatggaagcagtttgcgattattggatctttttaactgtggtggcattacaccgcttgcttttcgctggttgaagaaaccatattttccaaggctcaaatggttgggagtgaccggaagtgttaatagagacatggtagatgctttagccagaagcagaccattcttacatgtggcatgccatggtgaggagcttggggctgatccctatggcacttcagatgggttatacacacatgattatgatgacgtggatgaatttgagcagtggcttcttgaagctgatattgatagtgactacgaagagatgggcgatgctgaaaataatgatgaaatggttatgtgattcgcttttaaactctcatgtgtctttatatgactgtatgtatatctatgtttgtctttatatgactatatgtatatctatgtttgtctgtaacctattctctggttagatgttgtttaccacaggttttagtaccccaagacttttgtatgatcctttcatgtatcttgctatggtttatttggataattttgtgtaaaagtttcgtgatttttgtattatttggattttttt

SEQ ID NO: 8714 - DNA, 1932 bp, Medicago truncatula
atggcgagtccggaggaggttaggttggatcaactccctcacgctctgcttgccaccatcatgaccaaactcgacgtcgcttccatctgttcattagccaccaccgcctccaccttccgctcttgcgccaaacacatcctttccttcctccctaatttccatctcatcgacgttgcgccatctggaaacttactcacgccgttgctgccacgtaatccgtatcttaagagtctcaaagttgattgtgatcgtcttgatgattcttcaatatctctattggtcaaaccctcacttcatgagctttctctgtataattgttctgatttcagtgggaaacttctttctgagatcggtactcaatgcaaggacctaagatctctttacttgggttcggttgcagaaaaaagagggaggtcaattcacatatctgatctggaggaattactcactggttgctcccagttagaagttttgattttgatgtttgatgtctctctctttctacgtcataacttggctcgagtttgggcttctgcgtctgagaaacttacttctcttgagattggatatatttcttcagttacagtgatcgaactgttcagttcaaatttgggatctcatcagccccttaatcctattcaaccatccatacttcctggaattcagaaattgtgtctttctgtgaactatataacagatgcaatggttaacacaatatccaaaggtctcgtctttttgacccatttggatcttcgtgatgcaccatttgttgaaccaagaattacatttgatctaaccaacgctggtcttcagcaaattaatcaacatgggagattgaaacatctttcattgatccgaagccaagagttcataatttgttactttcgaagagtgaatgatctaggattacttttaatggctgataagtgtgcaaacatggagagcatatgtcttggcggcttttgtcgtgtcacagacacaggaatcaaaactatcctgcattcttgctctcgtctatacaaacttaaggtcactcatgggactcaattaactgatctagtttttcatgatatctctgcaacatcccttactttaacacatgtgagcttaagatggtgcaagctcttaaccaatcattcagtttttagtttgacatcaaacaaggaacttaaagttcttgacttgagagattgtagaagccttggggatgaagctctccgagccattggcatacttttgagactaaagattttacttattgatggctctgatataactgatgctggactttcatacctacggtctaccgttattaattcactgtatgcattgtctcttcgagggtgcaagaggctcactgataaatgcataacagttctatttgatgggtgtggcaagttggaattaagagacttggatctatccaatcttcctaacctctcagataatggtgttctagagttggcaaaaagccgaattccttttttggatctccgaatgcgacaatgccctctaattggcgatacctcgatcatggctttagcttcaatgatgactgatgatgctggatggtatgaaagcggtctgcgcttgttggatatgtataactgtggtggcattacgccacttgcttttcgctggctaaagaaaccgtattttccaaggcttaaatggttgggagtgactggaagtgttaatagagacatggtagatgctttagctagaagtagacctttcttgtatgtggcatgcaatggtgaggaacttgggcccgacccttgtgatatgtcagatggcttatatacacatgattatgacgaggtggatgaatttgagcagtggcttctcgaagctgatattgatgaagctgatattgagaatgatgatgaagaaatggtcgatgctgaaaatgaggaagaaccgatcatgtag

SEQ ID NO: 8715 - DNA, 2218 bp, Vitis vinifera
atggcgaatagcgaagccgccggaggggctctggagcagttgccggcggcactgctggcaacgatcatgacgaagctcgacgtctcctcgattcgctccctagcgtccacgtgcactaccatccgctcatgcgcttctcaaatcttccacttcctccccaatttccatctcctcgatgttgcactctcaatcaacttgctgaggcctttgctgccaccaaatccttatcttaggagtttgaaagttgattgcagtaaacttgatgattcatcaattgaacatctggttcggccatctttgcatgagatttctctcctcaattgtgctgattttagtgggaggctgctttctctgattggaggtcaatgcaaggatttaaggtctctctacttgggttgtgtggctgagaaaagaggacgagcagtccatatttctaaccttgaggagttactctgtggttgcactgagttaaaaacactaagcctgatgttcgatatttcactatttcctcgttataattttgctcgagcctggtctttggcttcagagaatctcacaagtcttgagattggctatgtttcttcagttatggtgactgaactgctcagccctaatgtgggaccccatcagcccccaaatcatctccagccatccatattgccgagtcttcagagattgtgcctctcagtggattatattactgacactatggttgagacagtatctaaatgtctcatcaacttaactcatctggatcttcgagatgcacccatcattgaaccaagagtcacatttgacctcacaaactccggttttcaacagattaatcaacgtgggaagttgaaacacctctccttggttcgtagccaggagttcctaattacatacttcaaacgagttaacgatctaggaatcctcctaatggccgacagatgctctagtatggaaagtatatgtcttggtggcttttgtcgagtaacagattctggtttcaaaacaatcctgcactcgtgctcgaccttatacaagcttagggtgtctcatggaatgctattgactaatctggtttttcttgatatttcagcaacatccctttctttgacacatgtcagcttgagatggtgtaatcttttgagaaaccaggcagtcataagtttggcatccaacttggatcttagggttcttgacttgagagactgcagaaaccttggggatgaagccctccaagccatcagcactcttcataaattgaagattttactattggatgggtctgatattacagatgcgggtttgtcatacttgagagagggagtgataggctcactagtttcattgtccattagagggtgcaaaaggcttacggataaatgcatctctgctctatttgatccctcttccaaacaggagttgcaagaattggacctatctaatcttcctaacctatctgataatggaatattctcgctggctaaaagtcgtgttccaattcttgaactcaggatgcgacaatgtccactcataggtgacacttcaatcatggcgttagcctcaatgcaggttgacgatcatagatcacatggcagtagtttgcgggtgttggatctttataactgtggtggcattacatctctttctttccggtggttaaagaacccttactttcccagactgagatggttgggagtgacaggaagcgtgaacagagacatggtagacgctttagctagaagtagacccttcttgcatgtggcatgccatggtgaggagctagggactgaccactgggatggtttgtacatgcatgataatgaagaaatggatgaacttgaacagtggctgctcgaaggaggggatgagagtgacgatgaagagatggaagaagttgaaaacaatggagaaatggtcgagtgatttccaagacgagattgttgtacttttttatgtatttatttgttacttgttacttctccctcgccagttttatgtagaaaatttgactcttaaattatagactttacttcagacagtctcggcttggttttctgacttgaacctccatcagaaagcccttctgacagtgctgctccagatttgctgggccatcaggtttgattggaaaatttatcaattgatcctccatggatctttgcatgcttatgcggttacaaatcttgtataaactcagaattgtatatttgtggattcaaattttcaa

SEQ ID NO: 8716 - DNA, 2218 bp, Vitis vinifera
atggcgaatagcgaagccgccggaggggctctggagcagttgccggcggcactgctggcaacgatcatgacgaagctcgacgtctcctcgattcgctccctagcgtccacgtgcactaccatccgctcatgcgcttctcaaatcttccacttcctccccaatttccatctcctcgatgttgcactctcaatcaacttgctgaggcctttgctgccaccaaatccttatcttaggagtttgaaagttgattgcagtaaacttgatgattcatcaattgaacatctggttcggccatctttgcatgagatttctctcctcaattgtgctgattttagtgggaggctgctatctctgattggaggtcaatgcaaggatttaaggtctctctacttgggttgtgtggctgagaaaagaggacgagcagtccatatttctaaccttgaggagttactctgtggttgcactgagttaaaaacgctaagcctgatgttcgatatttcactatttcctcgttataattttgctcgagcctggtctttggcttcagagaatctcacaagtcttgagattggctatgtttcttcagtgatggtgactgaactgctcagccctaatgtgggaccccatcagcccccaaatcatctccggccatccatattgccgagtcttcagagattgtgcctctcagtggattatattactgacactatggttgagacagtatctaaatgtctcatcaacttaactcatctggatcttcgagatgcacccatcattgaaccaagagtcacatttgacctcacgaactccggttttcaacagattaatcaacgtgggaagttgaaacacctctccttggttcgtagccaggagttcctaattacatacttcaaacgagttaacgatctaggaatcctcctaatggccgacagatgctctagtatggaaagtatatgtcttggtggcttttgtcgtgtaacagattctggtttcaaaacaatcctgcactcgtgctcgaccttatacaagcttagggtgtctcatggaatgctattgactaatctggtttttcttgatatttcagcaacttccctttctttgacacatgtcagcttgagatggtgtaatcttttgagaaaccaggcagtcataagtttggcatccaacttggatcttagggttcttgacttgagagactgcaggaaccttggggatgaagccctccaagccatcagcactcttcataaattgaagattttactattggatgggtctgatattacagatgcgggtttgtcatacttgagagagggagtgataggctcactagtttcattgtccattagagggtgcaaaaggcttacggataaatgcatctctgctctatttgatccctcttccaaacaggagttgcaagaattggacctatctaatcttcctaacctatctgataatggaatattctcgctggctaaaagtcgtgttccaattcttgaactcaggatgcgacaatgtccactcataggtgacagttcaatcatggcattagcctcaatgcaggttgacgatcatagatcacatggcagtagtttgcgggtgttggatctttataactgtggtggcattacatctctttctttccggtggttaaagaacccttactttcccagactgagatggttgggagtgacaggaagcgtgaacagagacatggtagacgctttagctagaagtagacccttcttgcatgtggcatgccatggtgaggagctagggactgaccactgggatggtttgtacatgcatgataatgaagaaatggatgaacttgaacagtggctgctcgaaggaggggatgagagtgacgatgaagagatggaagaagttgaaaacaatggagaaattgtcgagtgatttccaagacaagattgttgtacttttttatgtatttatttgttacttgttacttctccttcgctagttttatgtagaaaatttgactcttaaattatagactttacttcagacagtctcggcttggttttctgacttgaacctccatcagaaagcccttctgacagtgctgctccagatttgctgagccatcaggtttgattggaaaatttatcaattgatcctccatggatctttgcatgcttatgcggttacaaatcttgtataaactcagaattgtatatttgtggattcaaattttcaa

SEQ ID NO: 8717 - DNA, 3564 bp, Glycine max
atggaccgacgctggccatggaagaaaaaatcgtcggacaaggctgtgcttgagaaagcagctgcggaattggactctgctgcgggtgctgctgcaactcaggtatgtgtattcactgtcaagccgagctacatccaaatctcggtagagtcatattcccatctgactggtttggaggatcaagtgaagacatatgaagaaaaagttcagacactggaggatgagatcaaggaattaaatgaaaaactgtcagcagctaattcagagataaataccaaggaaagcttggtaaaacagcatgctaaggtcgcagaagaggctgtctcaggctgggagaaggctgaagcagaagctttggcgttgaagaaccatctggaaactgtcactcttgcaaaacttactgctgaggatcaggcatcacagttagatggtgctcttaaagagtgtatgcgacagataagaaacctgaaggaagaacatgaacagaaaatacaggaagttactctcacaaaaactaagcaattggacaagattaagggtgagtttgaggctaagatagcgaactttgaacaggaactcctcaggtctgctgcagacaatgcggctctgtcaaggtccttgcaagagcgctctaacatgataatcaatttaagtgaagaaaaagctcatgctgaggctgaaattgagcttctcaagggcaacattgaatcttgtgaaagagaaatcaattcactcaaatatgagcttcatgttatttccaaagagcttgagattcgcaatgaagaaaagaacatgagtatgaggtctgcagaagctgctaacaagcagcacatggagggtgttaaaaaaattgctaaactagaggcagaatgccaaagattacgtggtctagtgcggaaaaagttacctggtcctgccgcacttgcgcaaatgaagctagaagttgaaagtcttggccgagaatatggagaaactcgattgaggaagtctcctgtcaaacctgctagttctcacatgtccacattggctgggttctcccttgataatgctcagaaattccacaaagataatgaatttcttacagagcgtttattggcaatggaagaagagacaaagatgctgaaagaagctttggcaaaacgtaacagtgagttgcaggcttcaaggagtagttttgctaaaactttgagcaaacttcaaattttggaagcacaggttcagacaaataatcagcagaagggatctcctcaatccatcatccatataaatcatgaaagcatttacagtcaaaatgcaagcaatgcaccaagcttcgtctccttgtctgaagatggaaatgatgatgtgggaagttgtgctgagtcttggtctacagcatttctctctgagttatcccaattccctaaagaaaagaatactgaggaattgagcaaatctgatgccactaagaagttggaactaatggatgactttctggaggtggagaaattggcttggttatcaaatgaatccagtggagtttcagttacttcaaacaatataacaaatgaaattgtggtcaatgatctatcagaggtcagtgctgggaaagatgttccctctaacacccaagagaacagtgagccaaatccattgccaagtgaggtttcttctgctgaggaattgtcagcacctgatccccaatctgatgttccagctggcttgtcgctagcagagcttcaatcaagaatatcatcagtttttgagtccttggctaaggatgctgacatggagaagatcctgaaggatattaaacacgctcttgaagaggcatgtggcacttccatccaggactctgtatctgccattccccatgatgtcaagccttctgatactacgtgtgatgagctgggtaatgctgaagatgctggctcaaatgcagaaaaagaaatttcgtcccagaaacctacagaatttgtgcagatgacttcggatttagaagccgcaacttctcaaattcatgactttgtcttgttcctagccaaagaagcaatgacagctcatgatatatcttctgatggagatggaataagccaaaagatgaaggagttctctgttacttttaataaagttacatgcaatgaagcaagtttgctgcagttcgttcttgacctgtctaatgttctagccaaagcaagtgaatttagatttaatatccttggttataagggtagagaagctgaaactaatagtcctgattgcatagataagattgctctgccagaaaataagttagttcaagacaattcatcaggagagagatttcaaaatggtcgttcacatattcttaatccctgttctgatcctgagattcctgatgatggaaatttggccccaggctatgaatcaaatgccacgtcacagaagttctcaatggagaactttgaagaattgaaattagagaaagagaaggcagttgttgatctgtcaaagtgtgttgaaaatcttgaaatgacaaagtctcgattactagagacagagcaacatctagctgaagttaaatcacaattgacttctgctcaaagatcaaacagcctggctgagacgcaactaaaatgtatgacagaatcatacaggtcaattgaagcacgcgcaaaggagtttgaaactgagcttaatcatctgcaaatgaagacagaaactctggagaatgaacttgaagatgaaaagagggctcatgaagaagctttggctaagtacaaggagctagaagaacaactacaaaggaatgagagctcagctgctgataatgacattaagactaagcaggagagagacttggaagctgctgctgaaaagttagctgagtgtcaggaaaccatatttcttcttggcaagcagttaaaatcgatgcatcctcaaacagagccaacggggcctccttattcaaaggctgaaggcttcgcagagcgtgaacctaatagcccaaattttcaggatcaagcagagatggacagtgctagttctgcatttgtgcaaagactgggtggagagtcccccttacatttttctaacagtttatacagtccatcagataatgagtcaaactttccagccatatcttctgtacagaatccaaaccacaggcctacaaagtcaacctcttcgtctgcttcttccactcctacaccggagaaacacaaccgaggtttcagtagattcttttcatcaaaaggaaaaaacggtcattgagcatgcatgaccgatgggaattcttgacttaagggaccacacagcaatggcatttggaaagcatcaaggttcaatccgcttcatgatttaacagaattgagtttttaggaggtttgtgtagttaaaggacaggatgccatgaatatcgggtgattcttgtatctaatggttgtacatggtaaacatgtcttttcttcttttcctttccattgttttgttctctgttctgtaatttaattagcaaacattgacatagcctctgaactattacaggatatgttgaatattgttgtatttcacaaatttatgcagcataccttgattctttaacaa

SEQ ID NO: 8718 - DNA, 3443 bp, Glycine max
atggatcgacgctggccttggaagaaaaaatcatctgaaaagtccgtgattgagaaagcaactactgcattggattcctccgatgcttctaacaaccaggataacaagaagaaaccaaactatgttcaaatttctgtggaatcctattcacatctgtctggtttggaagatcaagtgaagacatatgaggaaaaagttcagacactggaagatgagataaaggaaatgaatgaaaagctgtccgcagcaaactctgagatcaataccaaggaaagcatggtaaagcaacatgctaaagtggctgaagaagctgtatcaggctgggaaaaggctgaagctgaagctttggcattgaagaaccatctagaatctgtcacccttttaaaactcactgctgaggatcgcgcaacgcatttagatggtgctcttaaagagtgtatgcgacaaataagaaaccttaaggaagaacatgagcagaaaatacaggaagttgctctctcaaaaaccaagcaattagacaagattaagggggagctggaggcaaagatagtgaacttcgaacaggaacttcttagatctgctgctgaaaatggggccctgtcaaggtcattgcaggaatgctcaaacatgctaatcaaattaagtgaagaaaaggctcatgccgaggctgaaattgagcttcttaagggaaacatagaagcatgtgaaaaggaaattaattcacttaaatatgaacttcatgttgtttccaaagagcttgaaattcgcaatgaagaaaaaaacatgagtatgaggtctgcagaagctgctaacaagcagcatatggagggtgtgaaaaaaattgccaagttagaggccgagtgccaaagattacgtggtcttgtgaggaaaaagttacctggtcctgctgcacttgcacagatgaagctagaagttgaaagccttggccgagattttggagaaagtcgattaaggaagtctcctgtgaagcctgctacccctaatttgtctccattacctgatttctccttggagaatgtacagaaattccagaaggacaatgaatttcttacagagcgtttattggcaatggaagaagaaacaaagatgctgaaagaagctttggctaagcgtaacagtgagttgcaggcctcaaggagtatgtgtgctaaaacactgagcaaacttcaaagtttggaagcacaatctcagacaagtaaccagctgaaattatctccaaaatccatcgtccagttaactcatgaaagcatttataatcaaaatgcaagcagtgcaccaagcttggtctccatgtctgaagatggaaatgacgatgcagcaagttgtgctgaatcttggtcgacagcaatagtctctgggctatcccaatttcctagagaaaagtgcaatgaggaatcaaacaaatctgaagtcactaacaagttggaactaatggatgactttctggaggtggagaagttggctcgtttaaatccgctgccaaatcaagtgtcttctgatcctttgatgtcagcacctgattttcaatctgatcttagtggcttattattaacagaacttagatcaagaatattactggtttttgagtccttagctaaggatgctgacatagggaagattgtggaggatattaaacatgtgcttgaagattcgcatgacactaccatccaccactctgtggatgcccatccttctgacgctacatgtgataggaaggataatcctgaagatgctggcttaaaccttgaaaaggaagtcatttcatcccagcaacccaaaggatatgtgcagataacttcagatttggaagctgcaatttctcagattcatgactttgtattgttccttggcaaggaagcaatgacattccatgacgatgtatcttctgatggaaatgaaatgaggcaaaagattgaggagttctccatcacctttaataaagtattatgcaacaatgcaagtttgctacagtttgttcttgacctgtcctatgttctagataaagcaagtgagttcagatttaatgtccttggctacaggggcacagaagctgaaagtagcagtccagattgcatagataagattgctttgcctgaaaataagttagtacatgacaattcatctggagaaagatatcaaaatggttgttcccatattatcaatccatgttctaatcccgaggttcccgatgatggaaatttggtctcaggctataaagcagatgctgcatcacagaaactgtcaatagaggagtttgaagaattgaaactagagaaagagaaagtagtgattgatttgtcaaattgtacagaaaatcttgaaatgacaaagtctcaattgctagacacggagcaacttctggctgaagttaaatcacaattggcttctgctctaaaatcaaaaagcttggctgagacacagctaaagtgtgtggcagaatcatacaactcacttgaaacacgtgcccaggtcttggaaactgagctgaaccatctgcaaatcaagatagaatctctggagaatgaacttcaagatgaaaagagggctcatgaagttgctatggccaggagcaaggagctagaagagcagttacaaaggattgagtgctcggcagctgatgatgaccacaagacttcgcatgagagagatttgacagctgctgctgaaaagctagccgagtgtcaagaaaccatacttcttctgggcaagcagttaaattctctacgtccacaaactgagccaaatgactcattgtacagtaagataaatccaaaagatgaaggattcacagaagatgaacatactactaatcaaaattttcaagaattaggtcagttggagatggacagttctacttctgcttttgtgcaaagattgagttcggagtcccccttgcatttttccaacagtttatttagcccttcggacagcgagtccaccattccagccagatccccagttcagcattctaaatcaaaaccaaaacaccgacctaccaagtcagcctcttgttcagtttcttctgccactacacctgagaaacatgcacggggatttagtagattcttttcacctaaaggaaaatccggtcattgagctttgcacaggttctattagaattcataaaccgtaagccacatggtgatgacatatggaaagcaccaaagtccaaacccttcatgtttgacagaattgagtttttaaggaggtttgtgtaattaaggaggggataccatgagtgccatgtgatttttgtatgtattggttgtaccatatgttttcttcttttacttttcattgttttgccccctctgttctgtaatttaattagcaaaggacaaacgttgacatagtatctgaacttttacaggatatatcgaatatgttgaatttcacaaatttatacatgccttaattttttc

SEQ ID NO: 8719 - DNA, 3392 bp, Glycine max
atggatcgacgctggccttggaagaaaaaatcatctgaaaagtccgtgattgagaaagataacaagaagaaaccaaactatgttcaaatttctgtggaatcctattcacatctgtctggtttggaagatcaagtgaagacatatgaggaaaaagttcagacactggaagatgagataaaggaaatgaatgaaaagctgtccgcagcaaactctgagatcaataccaaggaaagcatggtaaagcaacatgctaaagtggctgaagaagctgtatcaggctgggaaaaggctgaagctgaagctttggcattgaagaaccatctagaatctgtcacccttttaaaactcactgctgaggatcgcgcaacgcatttagatggtgctcttaaagagtgtatgcgacaaataagaaaccttaaggaagaacatgagcagaaaatacaggaagttgctctctcaaaaaccaagcaattagacaagattaagggggagctggaggcaaagatagtgaacttcgaacaggaacttcttagatctgctgctgaaaatggggccctgtcaaggtcattgcaggaatgctcaaacatgctaatcaaattaagtgaagaaaaggctcatgccgaggctgaaattgagcttcttaagggaaacatagaagcatgtgaaaaggaaattaattcacttaaatatgaacttcatgttgtttccaaagagcttgaaattcgcaatgaagaaaaaaacatgagtatgaggtctgcagaagctgctaacaagcagcatatggagggtgtgaaaaaaattgccaagttagaggccgagtgccaaagattacgtggtcttgtgaggaaaaagttacctggtcctgctgcacttgcacagatgaagctagaagttgaaagccttggccgagattttggagaaagtcgattaaggaagtctcctgtgaagcctgctacccctaatttgtctccattacctgatttctccttggagaatgtacagaaattccagaaggacaatgaatttcttacagagcgtttattggcaatggaagaagaaacaaagatgctgaaagaagctttggctaagcgtaacagtgagttgcaggcctcaaggagtatgtgtgctaaaacactgagcaaacttcaaagtttggaagcacaatctcagacaagtaaccagctgaaattatctccaaaatccatcgtccagttaactcatgaaagcatttataatcaaaatgcaagcagtgcaccaagcttggtctccatgtctgaagatggaaatgacgatgcagcaagttgtgctgaatcttggtcgacagcaatagtctctgggctatcccaatttcctagagaaaagtgcaatgaggaatcaaacaaatctgaagtcactaacaagttggaactaatggatgactttctggaggtggagaagttggctcgtttgtcaaatgattccaatgtagatgccactgtttcaaacactgattttcaatctgatcttagtggcttattattaacagaacttagatcaagaatattactggtttttgagtccttagctaaggatgctgacatagggaagattgtggaggatattaaacatgtgcttgaagattcgcatgacactaccatccaccactctgtggatgcccatccttctgacgctacatgtgataggaaggataatcctgaagatgctggcttaaaccttgaaaaggaagtcatttcatcccagcaacccaaaggatatgtgcagataacttcagatttggaagctgcaatttctcagattcatgactttgtattgttccttggcaaggaagcaatgacattccatgacgatgtatcttctgatggaaatgaaatgaggcaaaagattgaggagttctccatcacctttaataaagtattatgcaacaatgcaagtttgctacagtttgttcttgacctgtcctatgttctagataaagcaagtgagttcagatttaatgtccttggctacaggggcacagaagctgaaagtagcagtccagattgcatagataagattgctttgcctgaaaataagttagtacatgacaattcatctggagaaagatatcaaaatggttgttcccatattatcaatccatgttctaatcccgaggttcccgatgatggaaatttggtctcaggctataaagcagatgctgcatcacagaaactgtcaatagaggagtttgaagaattgaaactagagaaagagaaagtagtgattgatttgtcaaattgtacagaaaatcttgaaatgacaaagtctcaattgctagacacggagcaacttctggctgaagttaaatcacaattggcttctgctctaaaatcaaaaagcttggctgagacacagctaaagtgtgtggcagaatcatacaactcacttgaaacacgtgcccaggtcttggaaactgagctgaaccatctgcaaatcaagatagaatctctggagaatgaacttcaagatgaaaagagggctcatgaagttgctatggccaggagcaaggagctagaagagcagttacaaaggattgagtgctcggcagctgatgatgaccacaagacttcgcatgagagagatttgacagctgctgctgaaaagctagccgagtgtcaagaaaccatacttcttctgggcaagcagttaaattctctacgtccacaaactgagccaaatgactcattgtacagtaagataaatccaaaagatgaaggattcacagaagatgaacatactactaatcaaaattttcaagaattaggtcagttggagatggacagttctacttctgcttttgtgcaaagattgagttcggagtcccccttgcatttttccaacagtttatttagcccttcggacagcgagtccaccattccagccagatccccagttcagcattctaaatcaaaaccaaaacaccgacctaccaagtcagcctcttgttcagtttcttctgccactacacctgagaaacatgcacggggatttagtagattcttttcacctaaaggaaaatccggtcattgagctttgcacaggttctattagaattcataaaccgtaagccacatggtgatgacatatggaaagcaccaaagtccaaacccttcatgtttgacagaattgagtttttaaggaggtttgtgtaattaaggaggggataccatgagtgccatgtgatttttgtatgtattggttgtaccatatgttttcttcttttacttttcattgttttgccccctctgttctgtaatttaattagcaaaggacaaacgttgacatagtatctgaacttttacaggatatatcgaatatgttgaatttcacaaatttatacatgccttaattttttc

SEQ ID NO: 8720 - DNA, 1904 bp, Glycine max
agagagagagagagatttagaagggtgacgagaaaatgggtggtggaggtgaagaagggaacaatttggaattcactcccacttgggttgttgctgttgtttgttctgtgatcgttgctgcttcatttgctgctgaaaggtttcttcactatggagggaagtttctcaagaggaagaatcagaagccactctatgaagccctgcaaaaaattaaagaagagttgatgctattgggctttatttctctgctactgacaataacacaaaatgggataatcagaatttgtgttccagtgggttggactcaccatatgcttccttgcagtctaaaggataatggaaaggaagaattaacaaaaaccacatcacattttcagacttttttctctttctctgatatttctggcactgctaggcgccttttagctgagagtgagagtgagaatgaggatcaccaaccagcaacaggagaaaaacttggacactgtgctaggaagggcaaggttcctctattatctgtggaggcactgcatcaccttcatacatttatttttgtcctagctgtggcccatgtcacattttgtgttctcactgttgtttttggagggctaaaaatacgtgagtggaaacactgggaagactctattggcaatgacaataaaaatgaaacacaaccagttttggaacccacagtgactcatgttcaccaacatgcttttatccagaatcattttactggtcttggcaaagattctgctgttctgggttgggtgaaatcatttttcaagcaattttatgggtctgtgaccaaattagattatgtgacattaaggcttggtttcattatgacccactgcaaaggaaatccaaagtttaattttcataaatacatgatccgtgcccttgaagatgatttcaagaaagttgttggtataagttggtatctttggatctttgtggtcatcttcatgttgcttaatgtccatggctggcacgcatatttctggatttctttcattcctctcattcttctacttgctgtgggtgctaagttagagcatgtaataattcaattagctcatgaagtagctgagaagcattcagccatagaaggtgaattagtggtccaaccaagagatgatcacttttggtttaatcggccccacattgtcctcttcttgattcatttcatcctcttccaaaatgcttttgagattgcatttttcttttggatatgggttatatatggctttgactcctgtataatgggacgggttcgttatattgttccaagactcattattgggatatttattcagttactatgtagctatagtaccctgccactttatgcaatcgttacacagatgggaacacactttaagaaggccgtatttgatgaacaagtgcaagcacgccttgttggttgggctcaaaaggcaaagaaaaaaggacaaagaggtgataatagccactctggccaaggaagttctcatgtaggtgctggaattcaactaggatcagtgttcaagaggccatctgtcccagaagacaatgttattgtcccaagaaatgatggacccgaatgagtgtggatataccctagccaagatgcacaaaaaaaatgttttggaaccatattatgtgggcgcttgtcaccacataacgagggctagcgaaaacgtgatcctagaatcagtattagctttgatatcatgaataatgtaagaaacctaactcaacccaaaaattagcttaagaggttaaggttgctcctcacttatatattctaatgtgggattacttttaaccaatgtgaaacttgaattatttctaacacttcattatttcatgaaggtttaaatatatttttaacctctaataaattagtaaattttttgttt

SEQ ID NO: 8721 - DNA, 1823 bp, Glycine max
agcacaattaaaattttgaatgtgacgagttattgaaccaaaagggtattgaatagtttctactttccacacagaaaaattgaaattaacacaatagaagagagaggaagagattatatatatagggatatagagagaggtttagaagagtgaagagaaaatgggtggtggaggtgaagaagggaacaatttggaattcactcccacttgggttgttgctgttgtttgttctgtgattgttgctgcttcgtttgctgctgaaaggtttcttcattatggagggaagtttctcaagaggaagaatcagaagccactctatgaagccctggaaaaaatcaaagaagagttgatgctgttgggctttatttctctgctactgacaataacacaaaatgggatcatcagaatttgtgttccagtgggttggactcaccatatgcttccttgcagtctaaaggataaagaaaaggaagaatcaacaaaaaccacatcacattttcagacatttttctctttctctgatatttctggcactgctaggcgccttttagctgagagtgagagtgagaatgaggatcaccaaccagcaacaggagaaaaactttgtgctaggaagggcaaggttcctctattatctgtggaggcactgcaccaccttcatacctttatttttgtcctagctgtggcccatgtcacattttgtgttctcactgttgtctttggagggttaaaaatacgtgagtggaagcactgggaagactctattggcaatgacaataaaaatgaaacacaaccagttttggaaccaacagtgactcatgttcaccaacacgcttttatccagaatcgttttactggtcttggcaaagattctgctgttctgggttgggtgaaatcattcttcaagcaattttatggatctgtgaccaaattagattatgtgacattaaggcttgggttcattatgacccactgcaaaggaaatccaaagtttaatttccataaatacatgattcgtacccttgaagatgatttcaagaaagttgttggtataagctggtatctttggatctttgtggtcatctttatgttgctgaatgtccatggttggcacgcatatttctggatttctttcattcctctcattcttctacttgctgtgggtactaagttggagcatgtaataatccaactagctcatgaagtagctgagaagcattcggccatagaaggtgaattagttgttcaaccaagagatgaccacttctggtttaatcgtccgcacattgtcctcttcctgattcacttcatcctcttccaaaatgcttttgagattgcatttttcttttggatatgggttacatatggctttgactcctgtataatggggcgggttcgttacattgttccaaggctcattattggggtatttattcagttactatgtagctatagtaccctgccactttatgcaatcgttacacagatgggaactcactttaagaaggccatatttgatgaacaagtgcaagcacgccttgtaggttgggcacaaaaggcaaagaaaaaaggacaaagaggtgataatagcctctctggccaagaaagttctcgtgcaggtgctggaattcaactaggatcagtgttcaggagggaatctgcctcagaagacaatgttattgtcccaagaaatgatggatccgaatgagtgtggaatgtggatataccgtagccaagatgtacacacgtacaaaaaaatgttttggcaccatattatatatttttaattgtaattttgcttagtatcaaatcagcaatgaacc

SEQ ID NO: 8722 - DNA, 1869 bp, Glycine max
aatgtaaagtttcgttattaaaaatgaaaataagaaagtgtggtgagaaaggaagaatgtgagacagagaggggaatggagcgtgagtaaatgaaagatggagatggtgactgttgactaatttaagggagcagaaagacaaaacgacagacagattggagagagaatgagtggcggaggagaagagggagcaactctggagttcactccgacgtgggttgtggccgccttttgcacagtcatcgtcgccatttccctcgccgctgagcgcctccttcattatggcggaaagtttctcaaagccaaggaccagaagccgctctacgaagctctccagaagatcaaagaagagctgatgcttttggggttcatttccctgcttttgacggttacacaaaacggcattaccaaaatctgcgttcgaccctctttgacgctccacatgctcccgtgtaatctccacgacgctccagcaaaccacgaatctcatttccagacatttttccctggaacagccaggcgccttctctctggggaacactccacccccgagtccgcctctaaaattggttattgctctcgcaagcacaaggtgcctttattatctgtggaagcacttcaccaccttcacatcttcatttttgtcctcgctgtcgtacacgtctccttttccgtgctcaccgttgtctttggaggcgccagaatacgtcagtggaaacactgggaagattctattgcaaaacagaactacgagactgaccgagttctcaaaccaaaggtcactcaggttcaccagcatgattttatcaggggtcgttttgctggttttggcaaagactctgctatagtcggttggttgctatcctttctaaagcaattttatggatctgtgacaaaatcagattatgtgacattgcgacatggtttcattatgacccactgcaggacaaatccgaagtttaattttcacaagtacatgattcgtgccctcgaagatgatttcaagcaagttgttggtataagttggtatctttggctctttgtggttatcttcttgttacttaatatcaatggttggcatacgtatttctggattgcttttattcctgtcattcttttacttgctgtgggcactaagctggagcacataataacccaactagctcatgaagtagctgagaagcatgctgccatagaaggtgatttagttgtgcagccatcagatgatcacttttggtttcaccggccccgtgttgtcctctttttgattcactttatccttttccaaaatgcttttgagatagcattttttttctggatatgggttacatatggatttgactcctgtataatgggacaagttcgatacattgttccaaggcttgttattggggtatttattcaggtactatgtagctacagcaccctgccactgtatgcaattgttacgcagatgggaactcactataagcgggcaatatttaatgatcatttgcaacaaaacattgttggttgggcacagaaggcgaagaagaggaaaggactaaaagctgatggcaatcctggccaaggaagttctcaggagagtgctaatacaggaatccagcttgggtcaattttcaagaaggcaactgctccaggagacagttcttctgcccccaaagctgacggaatcagctcagtgtagctatttaagtgaagatttacagtcttattttgtaaagttgctcacagattgcagttttctttatattattttctttgctaacataatgtagcattgtgggacatgtgtttgacttggtgtacgcataaggtcgaagtactatatgagtagatgctagtaatgctattgtcatttctaagatc

SEQ ID NO: 8723 - DNA, 1554 bp, Medicago truncatula
atgagtggtggaggtgaaggaggagaagaagaaaacacacttgagttcacaccgacgtgggtagttgccggtgtatgcactgtgattgttgccatttcacttgcggtggagcgtcttcttcactatggtggaaagttccttaaaagtaaagaccaaaagtcactttacgaagctcttcagaagatcaaagaagagttgatgcttttgggtttcatttctcttcttcttactgtttctcaaaatcgtcttaccaaaatatgtgttcctcccggtgtattgcgtcacatgcttccatgtagtcttgaggacaaaaaagaatcacattcgcattcagctttctcttttcctggtagaattgcaagacgtcttctcgcagatcgcctccttgcagaatcggaatcagcagaagaacctcttaaaactggtttctgcggtcgcaagaacaaggttcctttattatctgtcgaagctttgcatcacctccacatcttcatttttgttctcgctgttgtccacgtcactttctccgttctcactgttgtttttggtggcgcaagaatacgtcagtggaagcactgggaagactctattgcaaaggagaattatgatactaacaaagttctcaaaccaaagttgactcatgttcaacaacatgagtttatcaagggccgcttttctggtttcggcaaagactctgctctcattggttggttgcaatcctttttcaagcaattttatggctctgtgacaaaatcagattatgtcacattaagacttggtttcattacgacccactgcaagacaaacccaaagtttaattttcacaagtacatgattcgtgcccttgaagatgatttcaagcaagttgtcggcataagttggtatctttggctctttgtggtcatcttcttgttgttaaatatcaatggttggcatacatatttctggattgctttcgttcctgttattcttttactttccgtgggaacaaagctggagcatgtaataacccaactagctcatgaagtagctgaaaagcatgcagccatagaaggtgacttagttgtacaaccatcagataatcacttttggtttcatcggcctcacatcgttctcttcttgattcactttatcctcttccaaaatgcttttgagatagcattttttttctggatatgggttacatatggatttgactcctgtataatgggacaagttcgttacattgttccaaggctcgttattggggtatttattcaggtactatgtagctacagcaccctaccactctacgcagttgttacacagatgggaagtcactttaagagggcaatatttaatgaccatgtgcaagtgggcattgttggctgggcagagaaggtaaaaaagaagaaagcactaaaagctgatggccagcctagccaaggaagttctcatattcatgagggtagtactggtagtagtactggaattcagcttggttcagttttccagaagagggcatcagctcccgaagacactacttctgtaactaaacctgaggggtccaactga

SEQ ID NO: 8724 - DNA, 1443 bp, Glycine max
atggaagaagaagctcctccagtgccacctgcaccgcccatagtggccatgctgccatcccctggcatgggccacctaatcccaatgatcgagttcgccaagcgagcggtgcgctaccataacctggccgtcaccttcgtcatccccactgacggcccaccttctaaagcccaaaaggccgtcttccaggccctcccggactccatttcccacaccttcctccctccggtcaatctctccgactttccaccgggcaccaaaattgaaaccctgatctcccacaccgtcctcctctccctcccttccctccgccaagccttccactccctctcctccacatacaccctcgccgccgtcgtcgtcgacctcttcgccaccgacgccttcgacgtcgccgccgaattcaatgcctccccctacgtcttctacccctccacagccaccgtcctctccatcgccctccacctccccaccctcgacaagcaggtccagtgcgagttccgagacctcccggaaccggtcaccatccccggttgcattcctcttcccgtcaaggactttctagacccggttctggagcgcaccaacgaggcctacaagtgggtcctacaccactccaagcgctaccgagaagccgagggaatcatcgagaacagcttcgccgaactcgaaccgggcgcctggaacgagctgcagagggaacaaccgggacggcctccggtttatgcggtcgggccgcttgtgagaatggaacccggtcccgccgactccgagtgcttgaggtggttggacgagcagccacgtggcagcgtgttgtttgtttccttcggaagcggtgggaccctctccagcgcccagatcaacgaactggctctcgggttggaaaatagccagcaacggttcttgtgggtggtgaagagcccaaacgatgcaatagccaacgcgacttacttcaacgcggagagccacgaggatcccttgcagttcttaccagaagggttcgtggagagaacaaaaggaaggggctttttggttaagtcatgggctccgcagccacaggttctggcccatcaatcaacgggaggattcttgagccattgcggctggaactctatactggagagcgtggtgaacggcgtgcctttaatagcctggcctctgttcgcggagcagaggaccaacgcgtttatgctcatgcatgaagtcaaggtggcgctgaggcccaaagttgccgaggacactggacttgtccagagccaggaaatagccagcgttgtcaagtgcctcatggaaggccatgaagggaagaagcttcgttaccgaatcaaggatctcaaggaggctgcggctaaggctctctctccaaatggttcctccaccgaccatatctccaatttggttctcaagtggaccaacaaaaccaccatctctactagtggctag

SEQ ID NO: 8725 - DNA, 1431 bp, Glycine max
atggaagtctcaaaagaagaagctcgagtggcacccgcaccggccctagtggcgatgctgccatcccctggcatgggccacctaatcccaatgatcgagttcgcaaagcgagtggtgtgctaccataacctggcggtgagcttcgtgatccccactgacggcccaccttcaaaagcccaaaaggcagttctggaggcccttccggactcaatttcccacaccttcctccctccggtcaatctctccgacttcccgccggacaccaaaatcgaaaccctgatctcccacaccgtcctccgctcccttccttccctccgccaagcattccactccctctccgccacaaacaccctctccgccgtcgtcgtagacctcttctccaccgacgccttcgacgtcgccgccgaattcaatgcctccccctacgtcttctatccctccactgccaccgtcctctccttgttcttccacctccccaccctcgaccagcaggtccagtgcgagttccgagacctcccagaaccggtcagcatccccggttgcattcctcttcccggcaaggacctgttggacccggttcaggaccgcaaaaacgaggcctacaagtggatcctacaccactgcaagcgatacaaagaagccgaggggataatcgggaacagcttcgaggagctcgaaccgggagcctggaacgagctgcagaaggaagaacaagggaggcctccggtttacgcggtgggaccgcttgtaagaatggaagcaggtcaggccgactcggagtgcttgaggtggctggacgagcagccacgtggaagtgttttgtttgtttccttcggaagcggtgggacactctcgagtgcacagatcaacgagctggctctcgggttggaaaaaagtgagcaacggtttctgtgggtggtgaagagcccaaacgaagaaatagccaacgcgacgtacttcagcgccgagagccaagcggatcccttgcagttcttaccggaagggttcgtggagagaacaaaaggaagagggtttttggttcagtcttgggctccgcagcctcaggtattgggccatccatccacgggtgggttcttgacccactgcggctggaactctattctggagagcgtggtgaacggtgtgcctttcatagcctggcctctgttcgcggagcagaggaccaacgcctttatgctcacgcatgacgtcaaggtggcgctgaggcccaacgttgcagagagtggcttggtggagagacaggagatagccagcctagtcaagtgcctcatggaaggtgaacaagggaagaagcttcgttaccgaatcaaggatatcaaggaggctgcggctaaggctctcgctcaacatggttcctccaccaccaacatctccaatttggctctcaagtggacccacaaattcaactag

SEQ ID NO: 8726 - DNA, 1538 bp, Clitoria ternatea
acatattcttccaaatggaaaccccaaaggaactacaacctccacccgccatgttggccgtcgtgccaaccccaggcatgggtcacttgattccattgattgagttttcgaagcgattggtacgctatcataacctcgccgtcaccttcgtcattcccacagaaatcccaccgtcaaaggcccaaaccaccgtcctcaaagcccttccggactccatttcccacatcttcctccctccggtgaccctctccgacctcccaccggaaaccaaaatcgaaacccgcatttccctcaccgtcctccgctctctccccgccctccgccaggccttccgctccctcaccgccgcgcacaccgtctccgccgtagtcgttgacctctttggcaccgacgtgttcgacgtcgccgccgaattcaatgtccctccttacatctactacccttccaccgccatggtcctctccctctttctccagctccccaaactcgaccaagaggttcactgcgagttccacgaactccccgagccggttaaaatccccggttgcgttccggttaacggttcagatttgctcgacccggttcaggaccggaagaacgacgcttacaagtgggtccttcatcatgccaagaggtacagtgaagcggaggggattatagagaacagtttcctggagctggaaccgggagctatcaaggagttgcagaaggaggaaccggggaagccgccggtttacccggtgggaccgattgtgaacatggattgcggtggaagcggggagaggggttcggagtgtctgaggtggttggatgagcagccggacgggagtgttctttttgtgtcgtttgggagcggtgggaccctctcgagtggtcagatcaatgagctggctcatgggttggagatgagtgagcaacgttttctgtgggtcgttagaagcccccatgataaattcgccaacgcttcctatttcagtgccgagaacccctctgattccctcggtttcttgcctaaagggttcttagagaggaccaagggaaggggccttgttgtcccatcctgggctcctcagccccagattttggcccatgggtccaccggtgggttcctgacccactgtgggtggaactctactctcgagagcgtggtgaatggggtacccttggtggcctggcctctgtatgcggaacaaaagatgaatgcggttatgctcacccgtgatgtcaaagttgcactcagaccatgtgtcggtgaaaacggattagtggaaaggcaagaaattgcgagtgttgttaagtgcctcatggaaggtgaggaagggaagaagcttcgttaccgaatcaaggatctcaaagacgcagctgctaaagccattgctgaaaacggcccctccactcaccatatctcccatttagctctcaagtggaccaataaaccaactgtatcaaattaaaattttaattttaatttatattattacctgtactcaacataaataatgataagtacaaaattaattaaaaaaaaaaaaaaaaaa

SEQ ID NO: 8727 - DNA, 3886 bp, Glycine max
tggcgttttcgtcttccctcgcattcttcagaacacagagagagggatggcgagcgattcgattcagcagagcgaagcccaagtggcgctaatcctgggcccggactcggcccacctggaatccctaatctcccaattgatgtcttcctccaacgaccagcgctcccaggcggagtccctcttcaacctctgcaagcaggcccgccctgaggccctcttattgggcctggcccacctcctccactcctccccgaacccggagacccgcaccatgtccgccatcctcctccgccgccacctcacgcgccaccacgactccttcctctggcctctcctctcccccccggcccgctcctccctccactccctcctcctctcctccctccacaacgagcccctcaaatccatcaccaagaagctctgcgacaccgtctccgagctcgccgccgccaccctccccgacgactctgccgcctggcccgacctcctccccctcctcttccagtgggtcacctcccccgaccccaggctccaagaaatctcgctccttattttcgcccaattggctcattacatcggccaaaccctactccctcaaatctccactctccactccgtcttcctccgctcccttcactcctccacccccgccgacgtccgcatcgccgccctcgccgccgccatcaacttcatccaatgcctcacgaattcctccgacagagaccgcttccaagacctcctccctctcatgatgcagaccctcaccgaggcgctgaactccggccaggaggccgtcgctcaggaggcgcttgagcttctcatcgagctcgctggcaccgagccgcgcttcctccggcgacaaattgtcgacgtcgtggggtccatgttacaggtcgcagaagctgagactttggaggaaggaacacggcacttggcgattgagtttgtggttactctcgccgaggcaagggagcgtgctcccggcatgatgaggaagtttccacagtttgtgaggaagctttttggtgtgttgatgaatttggtgcttgatatcgaggatgatcctgcgtggcacggtgcagtggatgaggatgaggacgccggcgagacgagtaactatggctttggacaggagtgtctggataggctttcgatttcgctcggtgggaacaccattgtgccggttgcctctgagttgctgcccacctacttggctgctcctgagtgggaaaagcaccatgctgcgctcattgctcttgcgcaaatcgccgagggttgttccaaggttatgataaagaatctggagcaggtattgtcaatgattttgaattcatttcgtgatcctcaccctcgagtgcgatgggcagctataaatgcaattgggcagttgtccacggatttggggccagacttgcaggttaaatttcaccacttagtgcttccggctttggctggagccatggatgattttcaaaatccaagagtacaggctcatgctgcttctgcagtgctaaatttcactgagaattgtaccccagatatcctaacaccttacttagatgggattgtgagcaaacttttggtactcctgcagaatgggaagcaaatggttcaagaaggggctttgacagccttagcatctgttgcagattcttcagaggtgcaatttcagaagtattatgatgctgtgatgccatacttaaaagctattttggtgaacgcaaatgataaatctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgttacaagcatgggcacggctttgcaagtgccttgggcaggattttctcccatatatgggttttgtgatgcctcctttgctccagtctgcacaacttaagcccgatgtgaccattacatcagcggattctgatactgaatttgatgaagatgatgacagcattgaaacaattacacttggggataaaaggataggcattaagactagtgtgttggaggagaaggccactgcttgtaacatgctatgttgctatgctgatgagttgaaggaaggattttttccttggattgaccaggttgctttcacattggttcctcttcttaaattttacttccatgaagaagttaggaaggcagcagtttcagccatgccggaactgttgtcctcggcaaaatcagctgtagtgaagggacaatcacaaggtcgtgatgagacttatgtgaaacagctttctgattatataataccaaatttggtggaggctttacacaaggagccagaagtagaaatttgtgcaagcatgttggatgcattgaatgaatgcatacaggtctctggatcacatctagatgaaaagcaagttcggagcattgttgatgagattaaacaagtccttacggccagttcatcaagaaaacatgaaagagcagagagggccaaagaagaggactttgatgctgaagaaagagaactactcaatgaagaaaatgagcaagaagaggagctttttgatcaagttggtgattgcttgggaactttgataaaaacattcaggacatctttcttgcctttctttgatgagctgtcctcatacctaacacctttgtttggtaaagacaaaacctcagaggaaaggagaattgccatttgtatatttgatgatgttgctgagcacggtcgtgaagccgctcttaaatattatgattcttttcttccattcttactcgaagcttgcaatgatgaatatcccgatgttcgacaggctgctgtttatggtgttggtgtttgtgctgagtttggtggatctgttttcagcccccttgttggagaggcactttcaaggttagatgctgtgataaggcatccaaatgcactacatgctgataacataatggcatatgacaatgccgtctcagctcttggaaaaatatgccaattccatcgtgatagcataaatgcagcacaggttgttcctgcctggctaagttgcttgcctataaaaggtgatttaattgaagctaaggttgtgcatgaccaactttgttcaatggttgaaagatctgatagagaacttataggtcccaacaatcaatatctttccaaaattgttgcagtttttgccgagattttatgtgcgggaaatgatctggctaccgaacagactgttagtaggatgattaatttattgaggcagcttcaacagactttaccaccttctacccttgcttcaacctggtcatccttgcagcctcagcagcagcttgcacttcagtccatcctatcatcctagtagttttggtcagaagatgcgtgtctattgtcatgggatgtcatagttaccttttcagaagctgctttgtcaggtcaaattcattccttagcatcattggagtgtctttttttgagaagcagctgcgtctggttcgtgtttcatgattgctgattccatacttggttatgcaagccaggacttgaggtatggctttgtcacagaggcagagcattgttgagttggtttggatgggaaacagttttggtgtgaaatgtgtatactgtgttatagtcagaaggaattctcaaatgaacagtgactcgatcctgtctgtggatgatggggacgaggcgtgaccctgagtcatgcatggctcaggcaaatcgcatagcattcttttgtttatttttgagttgtaacagttttgatgggtcatttcttttggatgttggaagcaaattgtcatagttaaattaatttgtatatctgcatgcttctttc

SEQ ID NO: 8728 - DNA, 3834 bp, Glycine max
atgagtatcaataaacagagcgaagcccaagtggcgctaatcctgggcccggactcggcccacctggaatccctaatctcccaattgatgtcttcctccaacgaccagcgctcccaggcggagtccctcttcaacctctgcaagcaggcccgccctgaggccctcttattgggcctggcccacctcctccactcctccccgaacccggagacccgcaccatgtccgccatcctcctccgccgccacctcacgcgccaccacgactccttcctctggcctctcctctcccccccggcccgctcctccctccactccctcctcctctcctccctccacaacgagcccctcaaatccatcaccaagaagctctgcgacaccgtctccgagctcgccgccgccaccctccccgacgactctgccgcctggcccgacctcctccccctcctcttccagtgggtcacctcccccgaccccaggctccaagaaatctcgctccttattttcgcccaattggctcattacatcggccaaaccctactccctcaaatctccactctccactccgtcttcctccgctcccttcactcctccacccccgccgacgtccgcatcgccgccctcgccgccgccatcaacttcatccaatgcctcacgaattcctccgacagagaccgcttccaagacctcctccctctcatgatgcagaccctcaccgaggcgctgaactccggccaggaggccgtcgctcaggaggcgcttgagcttctcatcgagctcgctggcaccgagccgcgcttcctccggcgacaaattgtcgacgtcgtggggtccatgttacaggtcgcagaagctgagactttggaggaaggaacacggcacttggcgattgagtttgtggttactctcgccgaggcaagggagcgtgctcccggcatgatgaggaagtttccacagtttgtgaggaagctttttggtgtgttgatgaatttggtgcttgatatcgaggatgatcctgcgtggcacggtgcagtggatgaggatgaggacgccggcgagacgagtaactatggctttggacaggagtgtctggataggctttcgatttcgctcggtgggaacaccattgtgccggttgcctctgagttgctgcccacctacttggctgctcctgagtgggaaaagcaccatgctgcgctcattgctcttgcgcaaatcgccgagggttgttccaaggttatgataaagaatctggagcaggtattgtcaatgattttgaattcatttcgtgatcctcaccctcgagtgcgatgggcagctataaatgcaattgggcagttgtccacggatttggggccagacttgcaggttaaatttcaccacttagtgcttccggctttggctggagccatggatgattttcaaaatccaagagtacaggctcatgctgcttctgcagtgctaaatttcactgagaattgtaccccagatatcctaacaccttacttagatgggattgtgagcaaacttttggtactcctgcagaatgggaagcaaatggttcaagaaggggctttgacagccttagcatctgttgcagattcttcagaggtgcaatttcagaagtattatgatgctgtgatgccatacttaaaagctattttggtgaacgcaaatgataaatctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgttacaagcatgggcacggctttgcaagtgccttgggcaggattttctcccatatatgggttttgtgatgcctcctttgctccagtctgcacaacttaagcccgatgtgaccattacatcagcggattctgatactgaatttgatgaagatgatgacagcattgaaacaattacacttggggataaaaggataggcattaagactagtgtgttggaggagaaggccactgcttgtaacatgctatgttgctatgctgatgagttgaaggaaggattttttccttggattgaccaggttgctttcacattggttcctcttcttaaattttacttccatgaagaagttaggaaggcagcagtttcagccatgccggaactgttgtcctcggcaaaatcagctgtagtgaagggacaatcacaaggtcgtgatgagacttatgtgaaacagctttctgattatataataccaaatttggtggaggctttacacaaggagccagaagtagaaatttgtgcaagcatgttggatgcattgaatgaatgcatacaggtctctggatcacatctagatgaaaagcaagttcggagcattgttgatgagattaaacaagtccttacggccagttcatcaagaaaacatgaaagagcagagagggccaaagaagaggactttgatgctgaagaaagagaactactcaatgaagaaaatgagcaagaagaggagctttttgatcaagttggtgattgcttgggaactttgataaaaacattcaggacatctttcttgcctttctttgatgagctgtcctcatacctaacacctttgtttggtaaagacaaaacctcagaggaaaggagaattgccatttgtatatttgatgatgttgctgagcacggtcgtgaagccgctcttaaatattatgattcttttcttccattcttactcgaagcttgcaatgatgaatatcccgatgttcgacaggctgctgtttatggtgttggtgtttgtgctgagtttggtggatctgttttcagcccccttgttggagaggcactttcaaggttagatgctgtgataaggcatccaaatgcactacatgctgataacataatggcatatgacaatgccgtctcagctcttggaaaaatatgccaattccatcgtgatagcataaatgcagcacaggttgttcctgcctggctaagttgcttgcctataaaaggtgatttaattgaagctaaggttgtgcatgaccaactttgttcaatggttgaaagatctgatagagaacttataggtcccaacaatcaatatctttccaaaattgttgcagtttttgccgagattttatgtgcgggaaatgatctggctaccgaacagactgttagtaggatgattaatttattgaggcagcttcaacagactttaccaccttctacccttgcttcaacctggtcatccttgcagcctcagcagcagcttgcacttcagtccatcctatcatcctagtagttttggtcagaagatgcgtgtctattgtcatgggatgtcatagttaccttttcagaagctgctttgtcaggtcaaattcattccttagcatcattggagtgtctttttttgagaagcagctgcgtctggttcgtgtttcatgattgctgattccatacttggttatgcaagccaggacttgaggtatggctttgtcacagaggcagagcattgttgagttggtttggatgggaaacagttttggtgtgaaatgtgtatactgtgttatagtcagaaggaattctcaaatgaacagtgactcgatcctgtctgtggatgatggggacgaggcgtgaccctgagtcatgcatggctcaggcaaatcgcatagcattcttttgtttatttttgagttgtaacagttttgatgggtcatttcttttggatgttggaagcaaattgtcatagttaaattaatttgtatatctgcatgcttctttc

SEQ ID NO: 8729 - DNA, 3874 bp, Glycine max
ttggtcttccctcgctttcttcagagagagagcaagcgatggcgagtgatccgatgcaacaagtggccctaatcctgggcccggactcagcccagctggaatccctaatctcccaattgatgtcttcgtccaaccaccaccgctcccaggcggagtccttattcaacctctgcaagcaggcccgcccggaggccctccttttgggcctggcccatctcctccactcctccccgaaccccgagagccgcaccatgtccgccatcctcctccgccgccacctcacgcgccaccacgactccttcctctggcccctcctctcccctcccgcccgctcctccctccactccctcctcctctcctccctccacaacgagcctctcaaatcaatcaccaagaagctctgcgacaccgtctcagagcttgccgccgccaccctccccgacgacgccgccgcctggcccgacctcctccccctcctcttccagtgggtcacctcccccgacccgaggctccaagaaatctcgctcttgatattcgctcaattggctcattacatcggccaaaccctactccctcaaatttccactctccactccgtcttcctccgctccctccactcctccaccccctccgacgtccgcatcgccgccctcgctgccgccatcaacttcatccaatgcctcaccaactcctccgacagagaccgcttccaggacctcctccctctcatgatgcagaccctcacggaggcactgaactccggccaggaggccgtcgctcaggaggctctcgagcttctcatcgagctcgccggcactgagccgcgcttcctccggcgacaaatcgccgatgtcgtcggttccatgctgcaggtggcagaggccgaggccttggaggaaggaacacggcacttggcgattgaatttgtcgttactctcgctgaggcgagggagcgtgctcctggaatgatgaggaagctgccacagtttgtgagaaagctttttggtgtgttgatgaatttgttgcttgatatcgaggatgatcctgcgtggcacggtgcagaggatgaggaagaggacgcgggcgagacgagtaactatggctttgggcaggagtgcttggataggctctcgatttcactcggcgggaacaccattgtgccggttgcctctgagctgttgcccacctacttgtctgctcctgagtgggagaagcaccatgctgccctcattgcgcttgcccaaattgcagagggttgttcgaaggttatgataaagaatctggagcaggtattgtcaatgattttaaattcatttcacgatcctcaccctcgagtgcaatgggcagctataaatgcaattgggcagttgtccacggatttggggccagacttgcaggttaaatttcaccacttagtgctgccggctttggctggagctatggatgattttcaaaatccaagagtacaggctcatgctgcttctgcagtgctaaatttcactgagaattgtacctcagatatcctaacaccttacttagatgggattgtgagcaaacttttggtactcctgcagaatgggaagcaaatggttcaagaaggagcattgacagccttagcatctgttgctgattcttcacaggagcaatttcagaagtattatgatgctgtgatgccatatttaaaagctattctggtgaatgcaaacgataagtctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgctacaagcatgggcgcggctttgcaagtgccttgggcaggattttctcccatacatgggttttgtcatgcctcctttgctccagtctgcgcaacttaagcccgatgtgaccattacatcagcggattctgatactgaatttgatgaagaagatgacagcattgaaacaatcacacttggggataaaaggattggcattaagactagtgtcttggaggagaaggctaccgcttgtaacatgctatgttgctatgctgatgagttgaaggaaggatttttcccttggattgaccaggttgctttcacattggttcctcttcttaaattttacttccacgaagaagttaggaaggctgcagtttcagccatgccagaactgttgtcctcggcaaaatcagctgtagagaagggacagtcgcaaggtcgtgataagacttacgtaaaacagttgtctgattatataataccaaatttggtggaggctttacacaaggagccagaagtagaaatttgtgcaagcatgttggacgcattgaatgaatgcatacaggtctctgaatcacatctagatgaaaagcaagttcggagcattgttgatgagattaaacaagtccttacggccagttcatcaagaaaacatgaaagagcagagagggccaaagaagaggactttgatgctgaagaaagagaactactcaaagaagaaaatgagcaagaagaggaactttttgatcaagttggtgattgcttgggaactttgataaagacattcagggcatctttcttgcctttctttgatgatctgtcctcatacctaactcctatgtttggtaaagacaaaacctcagaggaaaggagaattgccatttgtatatttgatgatgttgctgagcatggtcgtgaagctgctcttaaatattatgattcttttcttccattcttactagaagcttgcaatgatgaatatccagatgttcgacaggctgctgtttatggtgttggtgtttgtgctgagtttggtggatctgttttcaaaccccttgttggagaggcactttcaaggttagatgctgtgataaggcatccaaatgcactacattctgataacataatggcatatgacaatgctgtttcagctcttggaaaaatatgccaattccatcgtgatagcataaatgcagcacaggttgttcctgcctggctaaattgcttgcctataaaaggtgatttaattgaagccaaggttgtgcatgaccaactttgttcaatggttgaaagatcggatagagaacttataggtcccaacaatcaatatctttccaaaattgttgcagtttttgccgagattttatgtgcgggaaataatctggcaaacgaacagactgttagtcggatgattaatttattgaggcagcttcaacagactttaccaccttctacacttgcttcaacctggtcatccttgcagcctcagcagcagcttgcacttcagtccatcctatcatcctagtagttttggatcgtcaccttcagaagatgcgtgtctattgtcatgggatgtcatagttaccttttcagaagctgctttgtcaggtcaaattcattcctttggcatcttcggagtgtctttttttgaagcagctgtgtctggttcgtgtttcatgattgttgaatccatacttggttttgcaagccaggacttgagtaaggctttgttgcagaggcagagcagtgtcgagttggttggataggaaacagttttggtgtgaaatgtgcatactgtgttatagtcagaaggaattctcaaatgaacagtggctcgatcctgtctgtggatgatggggacgaggcgtgatcctgagtcatgcacgactcaggtaaatcgcatagcattcttttgtttattttgagttgtaacagttttgatgggtcatttcttttggaagttggaaacatattgtcatagtttaattaatttgtatatctgcatgtttctttccc

SEQ ID NO: 8730 - DNA, 3762 bp, Medicago truncatula
atggcgttgaacgatcaaaatcaagcacaaatggctctaattctaggaccagattcaacccacttcgaatccctaatcacaaacctcatgtccaccatcaacgaccaacgttcccaagctgaaaatctcttcaatctctgcaaacaaacctatcccgattccttaatcctcaaactctcccatcttctccacacttcctctaaccccgaaacacgaaccatgtccaccatcctcctccgtcgtcatctcacgcgccaccacgacgactctttcatctacccacacctctccccttcaactcaatccactctccgttctctccttctctcatctctccatcaagaaccaatcaaatccatcgttaagaagctatgcgacaccgtttcggaactcgcttctgctcttctctctgatgacctgtcttcttggcctgacttgcttccgcttctttttcaatgggttacttccaatgatgctaggcttcaggagattgcgttgcttgtttttgcgcaattggcgcattatattggtgaaaccctacttcctcaattgtctactcttcattctgttttccttcgttgtctcagtgctgctacttcctcttcggatgttcgtatcgctgcccttgctgccagtatcaatttcgttcagtgtctctccaattcatccgaccgtgacaggtttcaggatttgctgcccctcatgatgcagacattgaccgaggcattgaattctggtcaagaggcaactgcacaggaggcacttgagcttctcattgagcttgctgggactgagccacgtttcctgcggaggcaaattgttgacattgttggcgccatgctgcagattgctgaggctgagtcgttagaagaagggactcgccatttggctattgagtttgtcgttacacttgctgaggctagagagcgtgctcctgggatgatgaggaagttaccgcagtttgtaaagaagttgtttggtgtgctaatgaatttgttgttggatattgaggatgatcctgcttggcatgctgcggtgagcgaggatgatgatgctggtgagactagtaactacggatttggtcaggaatgtttggatagactttcaattgctttgggcgggaacacgattgtgccagttgcgtctgaattgttgcctacttatttggctgcacctgaatggcaaaaacaccatgctgcactcgttgcacttgcacaaattgcagagggttgttcaaaggtgatgacaaagaacttggagcatgtattatcaatggttttgaattcatttcctgatccaaaccctcgggtgcggtgggcggctataaatgcaatcgggcaattgtccacagatttggggccagacttgcaggataaatatcaccacttagtgcttccggcattagctggagccatggatgattttcaaaatcctcgagtacaggctcatgctgcttctgcagtgctaaatttcactgagaattgcaccccggatattttggtaccttatttggatgggattgtgagcaaacttcttgtactccttcagagtggaaagcagatggttcaagagggtgctttgacagctttagcatcggtcgctgattcttcacaggagaaatttcagaagtattatgatgctgtgattccatacctaaaagcaattttgttgaatgcaaatgataaatctaatcgtatgcttcgtgccaaagcaatggagtgtattagtctggtaggtatggctgttggaaaagagaagttcagggacgatgccaaacaggttatggatgtcttgatgtcactgcaacaatctcaactggattctgatgatccaaccgcgagttacatgttacaagcgtgggctaggctttgcaagtgcctcgggcaggacttcctcccatacatggggtttgtcatgcctcccttgctccagtctgcacaacttaagcctgatgtgtcaattacatcagcagattctgacgctgaatttgatgaagatgatgacagcattgaaaccattactctcggggataaaagaataggcattaagaccagtgtcttggaggagaaggctacagcatgtaacatgttatgttgctacgctgacgagttgaaggaaggcttttttccttggattgaccaggttgcttccacattggttcctctccttaaattttacttccatgaagaagttaggaaggcagcagcttcagctatgccagaactgttgtcttcagcaaaatgggctatagagaaggggcagtcacaaggccgtgatgcaacttacctaaaacaattgtctgattatataattccaaatttggtggaagctttacacaaggagccagaggtcgaaatttgtgcaagcatgttgggcgcactgaatgaatgcatacaggtatcaggaccacatctagatgaaaagcaagtaaggagcattgtggatgagattaaacaagtcatcactgccagttcatccagaaagcatgaaagagcagagagagccaaagaagaggactttgatgctgaagaaagagaactactcaaggaagaaaatgagctagaagaagaactttttgatcaaattggcgattgcttggggactttgacaaaaacatttagggcgtcttttttgcctttctttgaagagctttcgtcatacctaatacctatgtttggtaaagacaaaacctcagaggaaaggagaatagccatttgtatatttgatgacattgctgagcactgccgcgaagcagctcataaatattatggttcgtttcttccattcttgcttgaagcttgcaatgatgagtgttcagatgttcgacaggcagctgtttatggggttggtgtttgtgccgagtttggtggatctgttttcaaaccccttgttggagaggcactttcaaggttaaatgctgtgataacacatccaaatgcacagcattctgataatgtaatggcatatgataatgctgtttcagctcttggaaaaatatgccagttccaccgtgatagcataaatgcagcacaggttgttccagcctggctaagttgcttgcctataaaaggtgatttaatcgaggctaaggttgtgcatgaccttctttgttcaatggttgaaagatcagataaagaacttataggtcataacaatcaatatctttccaagatcgttgcaatttttgccgagatattatgtgcggggactgatttagcaactgaacaaactgtgagtcggatgattaatttattgagacaacttcaacaaactttgccgccttctacccttgcttcaacctggtcatcgttgcaccctcaacaacaacttgcacttcagtccatcctatcatcctaattgttttggattcttgcgtccatttccttcagaagacgcgtgtctgttgtcatgggatgtcacagttgccctttgtaaagaagctgctgtgtctggtcaattttgttccttagcattgtagtgcttttcagaccaacagatgcacctggtttgtgtttcttgattgctgaaccatatttggtaatccaagtatcaactgcttgacttgtgtggcatggatttgttgctgggaggtgttgagttggttagattgagaaacagttttggtgtcgaatgtgtatgtatatttaagtgttatagttaaaaggaattttttgtgtcgaaggaatgggcattatgcctcgatcctgtacgtggatgaggcatgttacctttagtcatgcttgatacagtaaaccacatggt

SEQ ID NO: 8731 - DNA, 3958 bp, Vitis vinifera
atggatcccgagtcgactcaactccagcaagctcaactcgccgctatcctcggccccgatccagggcccttcgaaaccctaatctcccacctcatgtccacctccaatgaccagcgctcccacgctgaactccttttcaatctctgcaaacagtccgatccaaactcgctgtctttgaaactcgcccatcttcttcagttctctcctcacatcgaggctcgagccatggccgcgattctcctcagaaagcaactgactcgggatgattcctacctctggccgcggctcagtgcgtccactcagtcatcgctgaaatcaattttgttagggtgtattcagcgggaggatgcgaagagtatttcgaagaagctgtgcgacaccgtttccgagttggcgtcgtcgattctgccggagaacgggtggccggagctgttgccgtttatgtttcagtgcgtgacctccgattcggcgaagcttcaggaggcggcgttcttgattttcgcgcagttggcgcagtacatcggggaaaccctagttcctcatattaagcatctgcactcggtgtttttgcagagtctgacgtcgtcgtcgagctccgatgtgaaaatcgcggccttgagcgctgcgattaatttcattcagtgcttgtcgagttcggcggaccgggatcggtttcaggacttgttgccggcgatgatgcgcacgctaacagaggcattgaattgtgggcaggaggcgacggcgcaagaggcgctcgagttgttgatcgaattggccgggacggagccgcggtttctgagacggcagttggtggatgtggtggggtctatgttacagattgcggaggctgagagcctggaggaggggacgcggcatttggcggtggagttcgtgataacactggcggaggcgagggagcgcgcacctgggatgatgaggaagttgccgcagtttataagtaggctttttgctatattgatgaagatgctgttggatattgaggatgatccagcgtggcatagtgcggatagcgaggacgaggatgcgggtgagagcagtaattacagtgttgggcaagagtgtttggataggttagctatttcattgggtgggaatacgattgtacctgttgcttcagagcttttgccggcatatttggctgcgccggagtggcaaaagcaccacgcagctctgattgctcttgctcagatcgcagaaggctgttcaaaggtaatgataaaaaatttggagcaagtggtgacaatggttttgaatacattccaagatcctcatcctcgtgtccgatgggcagctattaatgccattgggcaactgtccacagacttgggcccagatttgcaagttcagtaccatcaacgagtgctaccggctctagctgcatctatggatgacttccagaatccacgggtgcaggcacatgctgcttcagctgtgctcaacttcagtgagaactgcactccagatattttaacgccatatttagatggaattgttggcaaattactagtacttctacagaatggaaaacaaatggtgcaagagggggccttgactgctttagcgtctgttgctgattcatctcaggaacatttccaaaaatactatgatgcagttatgccttacctaaaagcaatattgatgaatgccactgacaagtctaaccgcatgcttcgtgccaaagccatggagtgcatcagtttggttggcatggctgttggaaaagataagttcagggatgatgcaaagcaggttatggaagtacttatgtcattgcaaggatctcaaatggagacagatgacccaacaacaagctacatgctacaagcttgggccagactctgcaagtgcctgggacaagacttcctcccttacatgagtgttgtcatgccccctttgcttcaatctgctcaacttaaacctgatgtaaccattacatctgctgattcagacaatgaaatcgaagaatctgatgatgaaagtatggagaccattactcttggggataaacgaatagggatcaagactagtgtcctggaggagaaagccaccgcttgcaacatgctatgttgctatgccgatgagttgaaggaagggttctttccatggattgatcaggttgctccaactttagttccacttctcaaattttatttccacgaagaagttaggaaagctgctgtttctgccatgccagagctactgcgttcagcaaaattagctgtggagaaaggtctagctcaaggtcgtaatgagtcatatgttaagcaattgtctgactatataataccagctttggtggaagctttgcataaggaacctgatacagaaatatgcgcaagtatgctagatgcactaaatgaatgcttgcagatatctggacgaattctagatgaaagccaagtgagatctattgtggatgagataaaacaggtgattacagctagctcaagtagaaaaagagagagagcagagaggaccaaagctgaggactttgatgctgaggagggagaattgctcaaagaagaaaatgagcaagaagaagaagtttttgatcaagtgggtgaaattttgggaactttgatcaagacattcaaggcatctttcttgccattctttgatgagttagcttcatatctcacacctatgtggggcaaagataaaacagccgaagagagaaggattgcaatctgcatctttgatgatgttgcagagcaatgtcgtgaagcggctcttaaatattatgatacatatcttcctttcctcttggaagcttgcaatgatgataattcagatgttcggcaggcagctgtatacggacttggtgtttgtgcagagttcgggggtgctgcatttaaacctcttgttggagaggctctttcaaggctaaatgtcgtaatacggcatcctaatgcactgcaaccagataatgtaatggcatatgataatgctgtttctgctctaggaaaaatttgccagtttcatcgtgacagtattgattcagctcaggttgttcctgcctggttgagttgcttgccaataaagggtgatttgatcgaggccaaagttgttcatgaccaactttgttcaatggttgaaatgtcagatagggaacttctgggacctaacaatcaataccttcctcaaattgttgcagtatttgctgaggttctatgtgcgggtaaggatcttgcaacagagcaaaccataagccggatgataaacttgctgagacaacttcagcagacgctaccaccttccaccttggcctcaacttggtcatccttgcagccccagcagcagcttgcattacaatcaatcctctcatcttagcatctctcaactgacaaaaagggcttcttgctgtgcatggaagaactgttatgtccggtctggtcagtcggcttgtgtttagtataaatataaatatatattatttgttacccattcttttccataagatggtcccatcattcgtttttgcattatgttttacacaacctggcgtctgtccgtttggtttgagcatgaaaagccaacaatgaggattgaaatgaacccccctttttttgtagaatgtgtatattacgagtgttatatagtgggttcttgcttccaaacaaaaagggaaaaagggaaaaggggaaggtgattgtggttcttgtgaggtattgtgagtttctctttctttcagtgggtgaggtctgagaggattgtttgtgaggcaattcttacagcagttttggtcggattgtgttttatttggttttacctttgttttttttttggggcatacattttgattgtgaaatatttggactggaaaaaatcataaatggtgattcttttcttgcagttattattttttttttcaaaatccgaatcctggtgggcaatggcataagaatgaagtagaatcctctgtttggaattttattta

SEQ ID NO: 8732 - DNA, 3897 bp, Vitis vinifera
atggcttccgatcctactcctcttcagctaaaccaaatcgcggcgattctcggccctgatccagttcacttcgaagccctaatctcccacctcatggccaccgccaacgaccaacgctctcaggccgaggctctcttcaatctctgcaagcaaactcatcccgattctctcgttctcaaacttgcgatccttcttcagtcatctccgcatcctgaagcgcgagcaatggccgcgattctactcagaaagcaactcactcgagatgattcttacctatggccaaatctctctgccaccactcaggcgaatctcaaatcgattcttcttgactgtgttcaacgcgagaccgccaaaacgatatcaaaaaagttatgtgacactgtttcagaacttgcttctgggattttgcctgacggaggatggcctgagctattaccgttcatgtttcagtgcgttacttcatcgaactttaagctgcaagaggcggcgctgttaattttcgctcaattgtcgcagtacataggagaaaccctacttccgcatttggatactcttcactctgtgtttttgcagagtttggcttcatccatgaattctgatgttcgcatcgcggctcttggggcggcgatcaacttcattcagtgcttgtccaatgcggcggagcgggataagtttcaggaccttttgccattgatgatgcagacattgactgaggcgttgaattccagccaagaagcaactgcccaagaggcactggaattgttaattgagttagctgggacggagcccagatttctacggcgccaattggtggaagtggtgggttcaatgttgcaaattgcagaagcggagttgttggaggagggtacgcggcatctagccgtggaatttgttatcactttggctgaagcacgagagcgtgccccgggaatgataaggaagctgccacaatttatacaaaggttatttgcgatactgatgaagatgctgctggatatcgaggatgatcccgtatggcacagtgcagaggaggagcatgaggatgcgggtgagactagtaattatagtgttggacaggagtgtttggataggctctccatttctcttggtgggaataccattgtgccggtggcttctgaattgttgccggcttacttggcagctcctgaatggcaaaaacaccatgctgccctcattgcccttgctcaaattgcagagggttgctccaaggtgatgataaaaaatctagaacagatagtatcaatggtcttgaactcatttcaagatccacatcccagggtacgatgggcagctattaatgccattggacagttgtcaacggatttaggcccagagctacaagttaaatatcatcaacggctactgcctgcactagctgcagcaatggatgattttcagaatccccgagtacaggcccatgctgcttcagcagttctcaatttcagtgaaaattgcaccccagatatcttaaccccatacttagatggaattgtgagcaaactgcttgtactcctacagaatgggaagcaaatggttcaggagggggctttgacagctttagcatcagttgctgattcatcacaggtgcatttccagaagtactatgatgccgtaatgccttacctgaaagctattttagtgaatgcaaatgacaaatctaatcgtatgcttcgggctaagtcaatggagtgcattagtttggttggaatggctgttgggaaagagaagtttagggatgatgcaaagcaggttatggatgtacttatgtcattgcaaggatctcagatggaggcagatgatccaacaacaagctacatgttacaagcatgggccagactttgcaagtgccttggccaggatttccttccttacatgaatgttgtcatgccccccttgcttcaatctgctcagcttaagcctgatgttaccattacatctgcagattcggatgctgatatttatgactctgatgatgatagcattgagactattacacttggggataaaaggatagggatcaaaactagtgttttggaagaaaaggccacagcttgcaacatgctatgttgctatgctgatgaattaaaggaagggttttttccatggatcgatcaggttgctcctacattggttcctcttcttaaattttattttcacgaggaagttaggaaggctgctgtttcagccatgccggagctgttgcgatcagctaaattagctgtggagaaggggcagtctcaaggccggaatgagtcctatattaagcaattatctgattacataataccagccctggtggatgcgctacacaaggagcctgagacagagatctgtgcaagcatgttggattcgttgaatgaatgcatacagatttctggaccacttttggatgaaggccaagtgaggtccattgtggatgagataaagcaggtgatcacagccagctcatctagaaagagagagagagcagaaagggccaaagcagaggactttgatgcagaagaaggggaactgctaaaagaagaaaatgagcaagaagaagagctctttgatcaaatcggtgattgcttgggcactttgatcaaaaccttcaagtcttctttcttgcctttctttgatgagctttcatcttacctgatgcctatgtggggtaaagataaaacggccgaagagagaagaattgccatttgtatatttgatgatgttgctgagcaatgtcgagaatcagctcttaaatactatgatacttaccttcctttcctattggaagcctgcaatgatgagaacccacatgttcgtcaggcagctgtttatggaataggtgtttgtgcagaatttggtgggtctgcattcaaacctcttgttggagaggctctttccaggctggatgttgtaataagacactctaatgcacgggattcagataatgtaatggcttatgataatgctgtttccgcacttggaaaaatatgccagttccatcgcgatagtatagatgccgtgcagattgttcctgcttggttaagttgcttgcctttaaaaggtgatttgattgaggccaaagttgtgcatgaccaactatgttcaatggtggaaaggtcagatagggaacttttggggcccaacaatcaatatcttcccaaaatagttgcagtctttgctgaggtcctatgtgctggtaaagacctggcaactgaggaaaccacaagccgaatgattaatctgctgaggcaacttcggcagacattgtcgccctctgccctggcatcaacgtggtcatccttgcagcctcagcaacagctcgcgctgcagtccatcctatcaacttagttaatttcacaatggtgagtgtgatgttccaagattcccttgtgagatgctgctgtgtcgggtcggtccggtttgctttgtttgctgtgtgttaggtagtccattcttttccataatatgattcataattggttgggcaatgttacacatttgtaccaatgcagcagtgtgcattattgcttgattgctctgagggtgacgtgaaaaatatacgagttttggtgtagaatgtgtatattaaagtggtattcatcatccagtcctccctcgaaaggagaggaaaaaaagaaacgaaaagatcaatagttcatagtttgtggctctgtttgaacggtcggtgtgtgaatgcgatgttgaggctcgtttgtcaagcaaaatcagttttggtgatttttggacacacttctatacagtttctatccttttttctttggggaagtttcatgtctatttttagattgccggtgaggttttgtatagcttttctttattgggttattatctttactttcatgttttggttctgaaacaattaaggtggattca

SEQ ID NO: 8733 - DNA, 4077 bp, Glycine max
gaagagtggcgacgcaagtcagtctctcatcacatcatcatcaaaaaccaaaaaccctaaccccccggtgtgttttctcgtcgtcgctcttcttcttctctgtcgtcgccgccgccgccgccatggatcctgaggtgcagcaatcgcaggtcgccgccattcttggcgccgatccctcccccttccagacactgatctcgcacctcatgtcctcctccaacgagcaacgctcccacgcagagactcttttcaacctctgcaagcaaaccgatcccgataacctctccttaaagcttgcacatctccttcactcctcgccgcaccaggaggcacgggccatgtccgccatcctcctccggaaacagctcacccgcgacgactcttacctctggccgcgcctctcccctcagacgcagtcttccctcaaatcgctcctcctctcctcgattcaatcggaaaacatcaaatccatctccaagaagctctgcgacaccatctctgaactcgcctctggtattttacccgacaacgcctggccggagcttcttcctttcatgttccagtgtgtttcctccgattcccctaagcttcaggaatccgcgtttttaatcttcgcgcagttgtcgcagtacatcggcgattccctcactcctcacatcaagcacctccacgatatctttttacagtgcctcacgaacgctaccgttaaccctgacgtccgaattgcggcgcttaacgccgttatcaatttcatccagtgcttatccggttccgccgatcgcgaccgcttccaggacctgctgcccgcgatgatgcggacgttgaccgaggcgcttaattccggccaggaggccaccgctcaggaggcgctcgagcttctcatcgagctcgccgggaccgagccgaggtttctgcggaggcagcttgtggatgtcgttggtgctatgttgcagattgctgaggccgagtcgcttgaggaagggactcggcatttggcgattgagtttgtgattaccctcgcggaggcgagggagcgcgcccccgggatgatgaggaagttgccgcagtttattagtaggttgttcaccatactcatgaaaatgcttcttgatatcgaggatgatcctgcgtggcacagtgctgagactgaggatgaggatgctggtgaaaccagtaattatagtgtgggacaagagtgcttggataggctctctatatctttgggtggaaacaccattgttcctgttgcgtctgaacagttgcctgcttacttggctgctcccgaatggcagaaacgccatgctgcacttattgcacttgctcagatagctgagggctgctcaaaggtcatgataaagaatttggagcaagtggtggctatggtcctgacttccttccctgaccaacacccccgtgtaaggtgggcagctattaatgcaattgggcagctgtctactgatttgggtcctgatttgcaagttaaatatcatcaaggagtgttgccagcactagctggtgccatggatgattttcagaaccctcgtgtgcaggcacatgctgcttcagcagttctcaacttcagcgagaactgcacacctgatatcttaacgccatacttggatggaatagttagcaaactacttgtacttcttcagaatggtaagcagatggtgcaagaaggtgccttaactgctttggcatcagttgctgattcttctcaggaacacttccaaaaatattatgatgctgtaatgccatatctgaaagctatattggttaatgcaaccgacaagtctaaccgtatgcttcgtgctaagtccatggagtgtataagtttagttggaatggctgttgggaaggagaagtttagggctgatgctaagcaggttatggaagttcttatgtcccttcaagtatctcaaatggagacagatgatccaacaacaagttacatgctacaggcatgggctagactctgcaaatgtctgggacaagattttcttccttacatggagtttgtcatgcctccactacttcaatctgctgcacttaagcccgatgtaaccattacatcagcagattcagacaatgatattgaggattctgatgatgaaagtatggagactattactcttggggacaagcgaattggaatcaagactagtgttctagaggaaaaagctacagcatgtaacatgctttgttgctatgctgatgagctgaaggaaggattctttccatggattgatcaggttgctggaactttagttccactccttaaattttatttccacgaggaggttagaaaagcagctgtttcagcaatgccggagctattacgatctgcaaaattagctattgagaagggacaatctcaaggtcgggacgtaacctatttgaaatttttgactgacagtatcatcccagctttggtggaagcattgcacaaggaacctgacacagagatttgtgcaagcatgttggattcattaaatgaatgcttacagatatctggaatgcttttggacgaaagccaggtcagatccatcgtggatgagataaaacaggtgatcacagctagttcaagtagaaaacgagagagagcagagaggacccaagctgaagattttgatgctgaagagggggacctgattaaagaggaaaatgaacaagaggaagaagtttttgatcaagtgggtgagatattaggaactttaatcaaaaccttcaaagccaacttcttgcctttctttgatgaactatcatcatatctgacacctatgtggggaagggacaagactcctgaagagagaagaattgcaatttgtatttttgatgatgttgcagagcagtgtcgtgaagctgctattaagtattatgatacctatctcccattcctgttggaggcttgtaatgatgagactcctgatgtcagacaggcagctgtgtatggtctcggtgtttgtgcagagtttggtggatctgtgttcaaacctctggttggagaggctcttttgaggttaaatgctgtgatccagcatcctaatgctcttcattcagataatgtaatggcatatgacaatgccgtttccgctctgggaaaaatttgccaatttcatcgtgacagtattgattctgcccaggtagttcctgcatggctaaactgtttgccaatcaaaggtgatttgattgaggccaaagttgtgcatgatcaactttgttcaatggctgagagatctgacagtgagctgttgggtccaaacaatcaataccttccaaaaatagtttcagtgtttgctgaggttttatgtgctggtaaggaccttgcaacagaacagacagctggtcgtatggttaatttactcagacagctccagcaaactttaccaccctctacacttgcttctacttggtcatctttgcagccccagcaacagcttgcattgcaatctatcctttcttcatagttttcattgctttgctgcatatccatcatttcttcatagcatctggcttggcagttggtgtcttgctctttttgggaacaagctttttccagtttggtggtctccatatttgttacccattctttttaccatacggtggtttccatcattcattcttgcatggtgttctatagcaacatggcttcagttttgagattgcagagtcaattgtgattggaaagggaactttctgtagaatgtgtatattatgagtgttaatagtgcgattgagtccaaaagaggaggttagggaattgtggcgtgggagcttctcgttgtattcctctattgttttttcttaccatattgcgtgagaatatagggttgtctgtggggcaattcttgcagttttggccgattgtattggttttatttccttatcagtatgaagttgtaccatatgaaatttgaatgctatttattaacttttcagacaattgtttcttcaaacaacaatttgttcttaatctgggtcttgcaatttttaaattttttttttcgtgtttgtaagatttggatccccatgtaaaaagatatgtgaagtgtgggtgtatccacccttgatttcaaa

SEQ ID NO: 8734 - DNA, 4067 bp, Medicago truncatula
caaacccctttttcttcctaaaccaaacccatagtgcggcaacatcattcatcattctaaattctacccgcgagcgtatataaaaaacacaagtaacgaatcgtaattctcattctcatcattgaatcaaaagagcgaaaccctaaaactatttttcgctcttcttctctctcgccgccacaatcatcatcatcgtcatggatcccgagtcaactcagttgcaacaatcccaactcgcggcgattctcggcgccgatccatcaccgtttgagactctgatctcacacttgatgtcttccaccaacgaagaacgttctcaagccgaagctctcttcaacctctgcaaacaaaccgatccagacgcactcgttttgaagctaggtcatcttcttcattcttcacctcatcaagaagctcgcgctatgtctgctattcttcttcggaagcaactcacgcgtgatgattcattcctctggcctcgtctttcgtccaacactcaagcttctctcaaatcgcttctgctttcatcgattcaatccgagaatgcgaaatcgatttcgaagaagctttgtgatacaatctctgaactcgcttccagtattttaccagataacggttggcctgaattgcttccgtttatgtttcagtgcgtttcgtctgattcggccaaattacaagaatctgcgtttttgattttcgctcaattgtcgcagtatattggtgattctctcacgccgcatatcaaacaccttcatgatatttttcttcagtgtcttactagctctgctgttaatcctgatgtcagaattgctgctttgaatgctgttattaattttattcagtgtttatctggttccgccgatcgagataggtttcaggatttgttacctgcgatgatgactacgctgacggaggcgttgaattcaggtcaagaggcgactgctcaagaggcgcttgagttgcttattgagctggcagggactgagccgaggtttttgaggaggcagattgttgatgttgttggggcaatgcttcagattgcggaggcagagtcgttggaggaagggaccaggcatttggctattgagtttgtgattactcttgctgaagctagggagcgtgctcctggtatgatgaggaagatgccgcagtttattagtaggttgtttgctattctgatgaagatgcttttagatattgaggatgatccggcgtggcacactgcggatactgaggatgaggatgctggtgaatctagcaactatagtgttggacaggagtgtttggataggttatctatatctttgggaggaaatacgatcgttcctgttgcttctgaacaattacctgcgtatttggctgcaccggagtggcaaaaacgccatgctgcattgattgctcttgctcagatagccgagggaagttcaaaggtcatgataaaaactttagagcaagtggtggctatggtattgaattcctttcctgatcaacatccccgtgtaaggtgggcagccattaatgcaattggacaattgtctaccgatttgggtccggatttgcaagttcaatatcatcaaggggtgatgccagccctagctgctgccatggatgattttcagaatcctcgcgtacaggctcatgctgcttcagcagtgctcaacttcagtgagaattgcacgcctgaaattttaacgccatacttggatggaatagttagcaaattgcttgtacttcttcagaatggtaaacaaatggtgcaagagggagccttaactgctttggcatcagttgctgattcatctcaggaacacttccagaaatattatgatgctgtcataccgtacctgaaggctatattggtcaatgcaactgacaagtctaaccgcatgcttcgtgctaagtctatggaatgcataagtttggttggaatggctgtcgggaaggagaaatttagggctgatgctaagcaggtcatggaagttcttatgtccttgcaaggatcacaaatggagacagatgatccaacaacaagttacatgctacaggcatgggctagactctgcaagtgtcttgggcaagattttcttccttatatggaatttgtcaaaccacctttgcttcagtctgcctcacttaaacctgatgttaccatcacatttgctgattcagacaatgatatagatgattctgatgatgaaagtatggagactatcactctcggtgacaaaagaattggaatcaagactagtgttctagaggaaaaagctacagcatgtaacatgctttgttgttatgccgatgagttgaaagaaggattctttccatggattgatcaggttgcaggaactttggttccactccttaaattttatttccacgaggaagttagaaaagctgccgtttcagcaatgccggaactattacgatctgcaaagttagccattgagaaagggcaatctcaaggtcgggatgtgagctatttgaagtttctgactgacagtatcatcccagctttggtggaagcattgcataaggaacctgacacagaaatttgtgcaagtatgttggattcagtaaatgaatgcttacagatctcggggatgcttttggatgaaaagcaggtcaagtcaattgttgaagaggtaaaacaggtgatcacagctagttcaagtagaaaaagagagagagcagagagggcccaagctgaagattttgatgctgaagagggggagctaattaaagaggaaaacgagcaggaggaagaagtttttgaccaagtgggcgagatattgggaactttgatcaaaaccttcaaagcatccttcttgcctttctttgaagaattgtcatcttatttgactcctatgtggggaagggacaagactcctgaagagagaaggattgcaatttgcatttttgatgatgttgcagagcagtgtcgtgaaggagctattaagtattatgatacgtatcttccatttttgttggaggcatgtaatgatgaaactccagatgttagacaggcagcagtatacggcctcggtgtttgtgctgagtttgggggttctgtgttcaagcctcttgttggagaggctctatcgaggttaaatgctgtgatccaacatcctaatgcgcttcatccagataatgtaatggcatatgacaatgcagtttctgctctgggaaaaatttgccaatttcaccaggacagtattgactctgcccaggtagttccggcatggttgaactgtctgcccataaaaggtgatttgattgaggctaaagttgttcatgatcaactttgttctatggcggagaggtctgacagctctctcttagggccaaacaatcaataccttcccaaaatagtagcggtatttgcagaggttttatgtgctggtaaagacctggcaacagaacaaacagctggccgaatggttagtttactcagacagctccaacaaacattaccgcctgctacccttgcttccacctggtcatctttgcagccgcaacaacagcttgctttacaatccatcctttcttcatagtttgctgtttgcaattcatcgtttctccatagcatctgggttggcagttggtgtctcgcacttttttggggaacaagctttttccagtttggtggtctatatatttgttacccattctttttgccataagatggtttccatcattcattcttgcatatggtgtttttatagcagcatggcttcagttttgagaatgcagagtcaattgtgaatgtgtatattgagtgttcatggtgcgattgagtccaaaaggaggttaggcagttgttgcatcggagcttcacgtgctattcctctttttattttgttcttgccgtattgcgtgagaatatagggttgtctgtggggcaattcgtgcagttttggcctgttgtattgtttttttcttcttctttcttttctttctttttctcttctttctgatatcagattcagaagtgtatcatatgaattaccgatgttatttatcaagtttgctgacattttatttatccaagtaataatttgccgtcgatc

SEQ ID NO: 8735 - DNA, 3874 bp, Glycine max; identical to SEQ ID NO: 8729

SEQ ID NO: 8736 - DNA, 3886 bp, Glycine max; identical to SEQ ID NO: 8727

SEQ ID NO: 8737 - DNA, 1443 bp, Glycine max; identical to SEQ ID NO: 8724

SEQ ID NO: 8738 - DNA, 1526 bp, Glycine max
atctccttcagcggtgtttatagtttaacccaaaaaatcaccgaattctgatcggatcaccgcagtgccccactctccaccaccgcgccatcgcaaaccctagatggacctactgaagcaagagcttctcaagaagcgccaatccctggcgcaagacaccggcggcaagaaattcttcaagcgctccgagatccagcagaaggaaatccagaaactccgggagcaagagaagcgcgaattggaagccaagtcacagaagcgcctcgcaacgtcctccgacaacgctgccaccgctccgtcctcctcatccaccgcctccgcctcggcctcttccacaatcgcatcctcctccgccgcctccctcaccaacgagcaaaacatcgacaacctcgtcctcccaaagcccgaagtcatccgccgcctccgcttcctcaagcagccggtcacgctcttcggcgaagacgacgacgccaggctggaccgcctgaagtatgtcctcaaggccggcgtcttcgaggttgacagcgacatgacggaggggcagaccaacgatttcctgcgcgacatcgcggagctcaggaagcgccagaagaccgggattctcggcgagaggaagcgccagaaggccgacgacggcgccgctgaggaccgcgagggcggcgccggagatgatgacttgagtgactgcggcggctccgatggtgccgatgcggacaaggacttgaagcggatgaaggcgaatttcgaggagctttgcgatgaggataagattctggtgttctttaagaagctgttgaatgagtggaagcaggagttgcgcgagatgcctgaggcggagaagcgcacggccaaggggaagtccatggttgccactttcaagcagtgtgcgcgttacttgaacccgctgtttaagttttgcaggaagaaggttcttccggatgacattcgacaggcgttattgttgatggttgaatgctgtatgaggcgagattatctggctgcaatggaccattatatcaagctggctatcgggaatgcaccctggcctattggtgtcactatggttggtattcacgaaagatctgcccgtgaaaagatctacaccaacagtgttgctcacatcatgaatgatgagaccactcgcaaatacttgcaatctgtgaagagattaatgacattttgccaacgccgttatccgacattgccttctaaagccgttgagttcaatagtttggcaaatggcagtgatttgcattcacttctagcagaagagagatttagtgggggcaatcaggcggcatctgaagagaggcttaggataatgcctgctccaagagacagctagtcatttatgttttgctggaatgacatcatcgtatgatgcatactatatatatgtttaattgctagatacaatctgtttgtgtttcttactgattgtataaaagaaaatgcatcttttaaaatggcaaaacatgaaaaattctgatgttgtgtacgtcgccaatatttttgttccagccagc

SEQ ID NO: 8739 - DNA, 1727 bp, Glycine max
tccttcgatggttccttgtgagttcccaaatcctataaaatccgatgataataaccatgcaaaatggagataagtaaatccgtccttgttccggccagttgccatccctggccccaacccctttcatttttaaattttttttgtctcccaaaacgcggtcgttctattgttcttcctctacaacggtgtttatagtttaacccaaattaccgaattctgatcggatcatctctaaaccctagatggaccttctgaagcaagagcttctcaagaagcgccaatccctggcgcaagacaccggcggcaagaaattcttcaagcgctccgagatccagcagaaggaaatccaaaaactccgccagcaagagaagcgcgaattggaagccaagtcactaaagcgcctcgcaacatcctccgacaccgccgccaccgccccgtcctcttcatccaccgcctcctcctcggcctcgtccactatcgcctccgcctccgcctccctcaccgacgagcaaaacatcgacaacctcgtgctcccgaaacccgaggtcatccgccgcctccgcttcctgaagcagccggtcacgctcttcggagaagacgatgacgccaggctggaccgcctcaagtacgtcctcaaggccggcgtcttcgaggtcgacagcgacatgacggaggggcagaccaacgatttcctgcgagatattgcggagctgaggaagcgccagaagaccgggatcctcggcgagaggaagcgccagaaggccgacgacggtgccgctcaggaccgtgagggtggagccggagatgatgacttgagcgactgcggcagctccgaaggtgccgaagcggacaaggacttgaagcggatgaaggcgaatttcgaggagctttgcgatgaggataagattctggtgtttttcaagaagctgttgaatgagtggaagcaggagttgcgcgagatgcctgaggcggagaagcgcacggccaaggggaagtccatggttgccacgtttaagcagtgtgcgcgttacttgaatccgctgtttaagttttgcaggaagaaggttcttccggatgacattcgccaggcgctattgctgatggttgaatgctgtatgaagagagattatctagctgcaatggaccattatatcaagctggccattgggaatgcaccctggcctattggtgtcactatggttggtattcacgaaagatctgcccgtgaaaagatctacaccaacagtgttgctcacatcatgaatgatgagaccactcgcaagtacttgcaatctgtgaagagattaatgacattttgccaacgccgttatccgacattgccttctaaagctgttgagttcaatagtttggcaaatggcagtgatttgcattcacttctagcagaagagagatttagtgggggcaatcaggcttctgaagagaggcttaggataatgcctgctccaagagacatctagtttttaatgttttgctgaaatgacatcatcgtatgatgcatactatatatgtttaattgctagatacagtctgtttgtgtctcttattgattgtataaaaggaaatgcatcttttaaaatggcgaaaacatgtaaaattctgatggtgtcttcaaagaggctgttgcttcctgcaacaccaagttgtttcgggcatccttttcagaacgttttttttctttacttttcggattggtcattttggaagcc

SEQ ID NO: 8740 - DNA, 1452 bp, Vitis vinifera
atggatctcctgaagcaagagctcttgaagaagcgccaatctctagcccaagaagcgggcggcaagaggttcttcaagcgctccgaaattgaacagagaaacatccagaagcttcgcgagcaggaaaagcgtgagttggaggctaaagccctccgccacaataatggcaccgcatcctcttccaccgccgccgccgcctcggccacctctactccatcttccgatgccaaacctgacctcacatcctcatcttctaaagccataaccgatgaacagaaaatcgacgagatggttctcccgaagcaagaggtcatccggcggctcagattcctgaaacagcctattactctgttcggcgaagacgacaccgcgcggcttgatcggttgaagtatgtgctcaaagctgggatctttgaggtcgacagcgacatgacggagggccaaaccaatgattttcttagggatattgcggagctgaggaagcggcagaagacagggattttgagcgatcggaagcggaagagtccggaggatggggtcgaggatggggaggggggcggtggagatgatgatttgagcggtgatgggggttcttcgggggtggatgctgataaggatttgaagcggatgaaggcgaattttgaggagttgtgtgatgaggataagattctggtttttttcaagaggcttttgatcgagtggaatcaggagttgaatgagaagcaggagggggagaagaggacggccaaggggaagtctatggtggccacgtttaagcagtgtgcacgatatttgaatccgcttttcaaattctgccggaaaaaggttctccaagatgatatccggcaagcattgctggtggtggttgaatgctgtatgaagcgagattatctagctgcaatggaccaatatatcaagttggcaatcgggaatgcaccctggcctattggtgttactatggttggtatccatgaacggtctgcccgtgagaagatctacacaaacagtgtggcccacattatgaatgatgagacaactcgtaagtatctgcaatcaatcaaaagattgatgacattttgccaacgacgctacccaaccatgccatccaaagccgttgagttcaacagtttggcaaatggtagtgacttacaatcactgctagcagaggagaggttttctgggggaaatcaagcttcagaggaaaggcttcacctaatggctcctccaaaggagagctagttatcatgtatagaaaaccgatatgtggcttagttatgattgaattttcctagtttcttgtaatgtaagtgtctaatgcttagggatgttcagtaacaagagaatatgaaactgactgaaaggcagtgattggaaacaattcagtgaccttcatatcctcttttgtaagaaattatctcaattataatcacccacattaaatgttgatgatga

SEQ ID NO: 8741 - DNA, 1443 bp, Arabidopsis thaliana
aaatttcattatctcccgtcgtcgcgaccttctcagacaacagaaccaaatcctcggcggcgattgaagaaacctttccgatggatctgctcagggaagagattctgaagaaacgtaagagtctagctgaggaatctggtggtaagaagttcttcaagcggtctgagatcgagcagaagaaaatccagaagcttcgagaggaagaacgacgcgagcacgagcttaaggctcagcggagagccgccgccgccgcttccggtggagatggaaaatcatccggctctgctcctggttcttctaacgcagctacgtctgcgtcttccaaatcctctgcatcggacgctgctgctatcgccgattcaaaagccctaaccgacgaaaacctaattctcccgaggcaggaagtgattcgtcgtttgagattccttaagcagccgatgactctcttcggagaagatgatcaatcgcggctcgatcgactcaagtacgttttgaaggaaggattgttcgaggttgatagtgatatgactgaaggacagacgaatgatttcttgcgtgacatcgcagagcttaagaagaggcagaagagtggtatgatgggagataggaagaggaagagtagagatgagagaggaagagacgaaggtgatagaggtgaaacaagggaagatgaacttagtggtggtgaatcgagtgatgttgatgctgataaagatatgaaacgtttgaaagctaactttgaggatctatgcgatgaggataagatccttgtgttttataagaagctgttgattgaatggaaacaggagcttgatgcgatggagaacactgagaggagaactgcaaaagggaaacagatggtagccacttttaagcagtgtgctaggtatctagttcctctcttcaacttatgcaggaagaagggtttaccagctgacattcgtcaagctttaatggtgatggttaaccactgcataaagcgagactaccttgctgcaatggaccactacatcaaactagctatcgggaacgcgccatggcctattggagtgactatggttggtattcacgaacgttcagctcgagagaagatttacaccaacagtgttgctcacatcatgaacgatgaaaccactcgcaagtatcttcagtcagttaaaagactgatgactttctgtcaaagacgttatccaactatgccttctaaagccgttgagttcaatagcttagccaacggaagcgacttacagtctttgctagccgaagagagattctttggtggtaatcgtgaacaggtctcagaggagagactccggctcatgccttctcagagcgaaagctagtcttactgtgttttctgctttgttgtgtttttatttttgtatcaaaacgttgactctgtattatcgtctatttaaaacgttgacctgattgtctagtctt

SEQ ID NO: 8742 - DNA, 1485 bp, Glycine max
caactcaacaactaaactttgaacttgatagatactgtgagtgtttttgttcctcaatcaatctaattctctcaatggcttcttctctctccaccaaaccattctcatcaaccgacgctctctccgccttcgcttctctcaatcccgatctccgatccttctcccccggctacctccgtctctcactccatcctcgtcttcccaagagacttcacataccggctgctgggagtatctatggaaatcactttcttgtttcaacatatggagaatcacatggaggaggtgttggttgtattattgatggatgtcctcctcaccttcctctctccgaagctgatatgcaattggatcttgacaaaaggaggccatgtcaaagcctaattacaactcctagaaaggaaactgatacatgtaaaatattttcaggagtttctgaaggacttactactgcaactccaattcatgtatttgtacccaatactgatcaaagacgacatgactatactgagatggcagtagcttataggccttcccatgcagatgctacctatgacatgaaatatggtgtcacatccgttcaaggtggtggtagatcttctgcaagagaaacaattggaagggttgcttctggtgctgttgctaagaaaatccttaaagacttttctggaactgagattcttgcctatgtctctcaagtttataatattgttcttccacacgaccttattgatcatgacactctgactcttgatcagattgagagtaacattgttcgatgtccagacccggaatatgcagagaagatgatatctgcaattgatgctgtgcgactgataggtgattctgctggaggtgttgtaacatgcattgtgagaaactgtccacgtggtctcggttcaccagtatttgacaaacttgaagctgaactagctaaagctgctatgtcattgcctgcaaccaagggctttcagtttggtagtgggtttgcaggcacctttttgactgggagtgaacataatgatgagttctatatagatgaacatggaaacacaagaacaagaacaaatcgctctggtgggatacagggtggaatttccaatggggaaatcattaatatgagaatagctttcaagccaacatcaacaattggaaagaagcacaatactgtgactcgagatacaaaagaaacagagtttatagcccgtggtcgccatgatccttgtgttgtcccaagagctgtacctatggtagaagcaatggtagctttggttcttgtggaccaattgatggcacaatatgcgcagtgtaatctttttcccgtaaactcagatttgcaagaacccttggtgcccatactacggccagaagaagcgctcctctgaagaggaagggggtccataaatcagtaattggcctttgataaaatcttccttatggctagtgtttaattgacacggttaattcactttgatgacaagtcca

SEQ ID NO: 8743 - DNA, 1863 bp, Glycine max
gagagaatggtggtaggtggtaggtggtagccaaattgtacataatttacactcattgccaccaaccaacctttttcctttttctctctcaagtctcaactcaacaaccgaacttgatagatactgtgagtgtttttgttcctcaatcaatctaattctcccatttctcttccaatggcgtcttctctttccaccaaaccattctcagccgacgctctctccgccttcgcttctctcaattccgatctcggatccctctcccccgcctacctccgactctcactccgtcctcgtcttcccaagagacttcacatacaggcggctgggagtacctatggaaatcactttcgtgttacaacatatggggaatcacatggaggaggtgttggttgtgttattgatggatgtcctcctcgccttcctctctctgaagctgatatgcaagtggatcttgacagaaggaggccaggtcagagccgaattacaactcctagaaaggagactgatacatgtaaaatattttcaggagtttccgaaggaatcactactggaactccaattcatgtatctgtacccaatactgatcaaagaggacatgactatagcgagatggcagtagcttataggccctcccatgcagatgctacctatgacatgaagtatggtgtcagatcagttcagggtggtggtagatcttctgcaagagaaacaattggaagggttgcttctggtgctgttgctaagaaaatccttaaagaattttctggaactgagattctggcctatgtctctcaagttcataagattgttcttccagaggaccttattgatcatgacactctgactcttgatcagattgagagtaacattgttcgatgtccagacccggagtatgcagagaagatgatatctgcaattgatgctgtgcgagtgagaggtgattctgttggtggtgttgtgacatgcattgtgaggaactgtccacgaggtctcggttcaccagtatttgacaaacttgaagctgagctggctaaagctgcaatgtcattgcctgcaaccaagggctttcagtttggtagtgggtttgcaggcacctttttgactgggagtgaacacaatgatgagttctatatagatgaacatggaaacacaagaacaagaacaaatcgctctggtgggatacagggtggaatttccaatggggaaatcattaatatgagaatagctttcaagccaacatcaacaattggaaagaagcaaaagactgtgactcgagataaaaaagaaacagagtttatagcccgtggtcgccatgatccttgtgttgtcccaagagctgtacctatggtagaagcaatggtagctttggttcttgtggaccaattgatggcacaatatgcgcagtgtaatctttttcccgtaaactcagatttgcaagaacccttggtgcccatactacggccagaagaagcgctcctctgaagaggaagggggtccataaatcagtaattggcctttgataaaatcttccttatggctagtgtttaattgacacggttaattcactttgatgacaagtccaagtgaacattgtggcagatatttttgcgggtgcaatctatcgttttgtattaatgtaagttaaactatgttttcttttcctctcttcttctattttcattctgagggtgaacattgtttctagtaaaccttgttgcaaaagcagagatagatgtattcttaaagtgaactgatattaaaaattgtaagaaacgtatcagtttttggtcttaataagtgttgctctgctttgcaataaatgaaagctttggcaactttaactggctgttcacattatgcatt

SEQ ID NO: 8744 - DNA, 1764 bp, Vitis vinifera
ctgttactttcttggatataaatataaatagccactcccaggccccaaccacccaccccgcgctgccttagtattgcacccacctggttttctctcttcgcctgcccctgtctttccaatggcgtcttccctctcttccaagcctttccttacttctccctcaactgatggagcctccggttttggatcccttcgcaagctctcttttccctccgtccgctacgcgatccgtccgacgcatcgtcgtactctcgaaatacaggcagctgggagtacatatggaacatatttccgtgttacgacatatggagaatctcatggaggtggtgttggttgcataattgatggatgtcctcctcgccttcccctcacagaggctgatatgcaaatagatcttgatagaaggaggccaggtcagagccgaattactacaccaaggaaagagactgatacttgccgaatatattctggagttgctgaaggaatgactactggatcaccaataatggtaaatgtacctaatactgatcagagaggaaatgattatacagaaatgtccaaagcgtataggccttcacatgcagatgctacttatgacttcaagtatggtgtgaggtcggtgcagggtggtggtagatcttcagcgagagaaaccattgggagagttgcagctggagctgttgctaaaaaaatactcaaaaatttttctggaactgaggttcttgcttatgtctctcaagtgcacaaggttgtacttcctgaggatttggttgaccacgaaactctggcactcgatcagatagagagtaatattgtgaggtgcccagatcctgaatatgcagagaagatgattgctgcaattgatgccgttcgtgtgaggggagattctgttggaggtgttgtaacttgcattgtgaggaatatcccacgtggccttggatcaccagtctttgataaacttgaagctgagttggctaaagctgctttgtcattacctgcaacaaagggctttgaatttggcagtggttttgcaggtacatttatgactgggagtgaacataatgatgagttcttcacggatgcacatggacgaatcaggacaagaactaatcgctctggtgggatacagggcggaatatcaaacggggaaatcataaacataagaataggtttcaagccaacatctacaattggaaagaaacagcacactgttactagagataaacaagagacagagctaatagctcgtggccgccatgatccatgtgttgttccacgagcggtaccaatggtggaagctgcagtagccctggtgcttgtggatcagttgatggcacagtatgcacaatgtgagctgtttcccatcaatccagctttacaagaacccttggagttccgggatcctgagctggctggcactcacatttaaaaggtacaagcagtttgtagcatgttctccatcataccctgccaatcttctggacttcatatcaatgctaaattctagtgttatgagaagtttttgtacttgtaagagtgagatttgaaatttcaatttattttccttttcttgttataatctctcaaaagctagagatcatatttcaaatgttgtattgctcaatgtacaagcaagtgactagtttggccatggaaggttccttggttatcaaaaaataaaaataaaattgtacaagtgactatataaaacgataaatttctcaatagaaggtgaataaatagctgtgacctttacttctttca

SEQ ID NO: 8745 - DNA, 1312 bp, Vitis vinifera
attggcgtcttccctctcttccaagcctttccttacttctccctcaactgatggagcctccggtttcggatcccttcgcaagctctcttttccctccgtccgctacgcgatccgtccgacgcatcgtcgtactctcgaaatacaggcagctgggagtacatatggaacatatttccgtgttacgacatatggagaatctcatggaggtggtgttggttgcataattgatggatgtcctcctcgccttcccctcacagaggctgatatgcaaatcgatcttgatagaaggaggccaggtcagagccgaattactacaccaaggaaagagactgatacttgccgaatatattctggagttgctgaaggaatgactactggatcaccaataatggtaaatgtacctaatactgatcagagaggaaatgattatacagaaatgtcaaaagcgtataggccttcacatgcagatgctacttatgacttcaagtatggtgtgaggtcggtgcagggtggtggtagatcttcagcgggagaaaccattgggagagttgcagctggagctgttgctaaaaaaatacttaaaaatttttctggaactgaggttcttgcttatgtctctcaagtgcacaaggttgtacttcctgaggatttggttgaccacgaaactctggcactcgatcagatagagagtaatattgtgaggtgcccagatcctgaatatgcagagaagatgattgctgcaattgatgccgttcgagtgaggggagattctgttggtggtgttgtaacttgcattgtgaggaatgtcccacgtggccttggatcaccagtctttgataaacttgaagctgagttggctaaagctgctttgtcattacctgcaacaaagggctttgaatttggcagtggttttgcaggtacatttatgactgggagtgaacataatgatgagttcttcacggatgcacatggacgaatcaggacaagaactaatcgctctggtgggatacagggcggaatatcaaatggggaaatcataaacataagaataggtttcaagccaacatctacaattggaaagaaacagcacactgttactagagataaacaagagacagagctaatagctcgtggccgccatgatccatgtgttgttccacgagcggtaccaatggtggaagctgcagtagccctggtgcttgtggatcagttgatggcacagtatgcacaatgtgagctgtttcccatcaatccagctttacaagaacccttggagttccgggatcctgagctggctggcactcacatttaa

SEQ ID NO: 8746 - DNA, 1643 bp, Fagus sylvatica
aaaaatttcaccaacccatttctctctctctgtttctctcttgtgttctttgtgagagagtgatccatggcatcctcgtctctctcaacgaagccatttcttggagcctcaagaattcacagcttctctcgactgccttcagatcttcgtccctccctacacatctctttccgtacatctacccccaagaagctccagattcaggctgctggtagtacacatggaaactattttcgtgtaacgacttttggagaatctcatgggggaggtgttggttgtatcattgatggatgccctcctagacttcccctatcagaagctgatatgcaagttgaccttgacagaaggaggccaggtcagagtcggattactacgccaaggaaggagactgatacgtgtagaatactttcaggcgtttctgaaggaatgactactggcacaccaatagctgtacttgttcccaatactgatcagagaggacatgattacagcgaaatgtcaatagcttataggccttctcatgcagatgcaacttatgacatgaaatatggtgtcagagcagtgcagggtggtggtagatcttcagcaagagaaactattggaagagttgctgctggggctgttgccaagaaaatccttaagagcctcgcaggaacagagatatttgcttatgtctctcaagttcacaaggttgtacttcccgaggatttggttgatccttacactctgacacttgatcagattgagagtaatattgttaggtgcccagatccagaatatgctgaaaagatgattgctgctatagatgctgtccgtgtgagaggggattctattggtggtgttgtcacatgcattgtgaggagatgcccacgagggcttggttcgccagtttttgacaagcttgaagctgagctggctaaagctgccatgtcattacctgcaacgaagggtttcgagtttggcagtggctttgcaggtactacgttgtgtgggagcgaacataatgatgagttcttcactgatgaaaatggaagaatcaggacaagaaccaaccgctctggcgggatacagggaggaatctcaaatggggaagtcataaatatgagagtagctttcaagccaacagctactatttcaaggaagcagcaaacagtgactcgagagaaaaaagaaatagaactcattgctcgtggccgccatgatccttgtgttgttccgcgagctgtaccaatggtagaagcaatggtagctctggtgcttgcagatcaattgatgtcacaatatgcgcaatgtaatctatttccaatcaatccagatctacaagaacccttttcattgccaaggtttgagccagcccatgtacccttttgaaagatgacaaagcacagctatagcattatttagtcattgccctccacccaaatttacttcatgggggcaaattttcccacaatatgaggcttgcaatgtctattagaaggatagttcaatgttcattttccgctttttaggtgtgtattacctatttcttaatccatgaaattcagggtttcatgttgtatgaaaaggcaaggttaatgttgtatgaattgtttgtttttcaatgtgctttattgctgacaaaaaaaaaaaaaaaaaaaaaa

SEQ ID NO: 8747 - DNA, 603 bp, Medicago truncatula
  misc_feature (3)..(3): n is a, c, g, or t
atnatacctgtcaatattcgggcagctgggagtacgtatggtaaccactttcgggttacaacatatggagaatctcatggaggaggtgttggatgtgtcattgatggatgtcctcctcgcatccctctctctgaagctgatatgcaagaggatcttgacagaaggaggccaggtcaaagccgaattacaactcctagaaaggagactgatacatgtaaaatattttcaggagtttcggaaggagttactacaggaactccaatccacgtatttgtgcccaatactgatcaaagaggaaatgattatagcgagatgtcattagcttataggccttcccatgcagatgcaacctatgacatgaagtatggtgtcagatcagttcagggtggtggtagatcttctgctagggaaaccattggaagggttgcttctggtgctgttgctaagaaaatccttaaaaattttgcaggaactgaggtgtgttacttgtttcacgagtttagccatactaatattcttgcctatgtctctcaagtgcacaagattattcttcccgaagacttaattgaccatgagacactgacacttgatcaggtacaatag

SEQ ID NO: 8748 - DNA, 2274 bp, Glycine max
atggcttccctcaccccaggcattctgctgaaaatgctgcaggccatgaacaccaacacccgcgtcaccggcgaccaccgctccccgctcctccaggtcatcggcatcgtccccgccctcgccggctccgacctctggtccaaccagggcttctatttaaacctctccgactccgtcaactccacctacgtcctcctctcccaccccgacaccgacctcatcctctccaaccgcctccagctcggccagttcgtccacgtcgaccgcttccacttcgactcccctctcccctccgtctccaacctccgccctctcgctggccgccaccccttcctcggcaccccggagcccctcattgctcgcatctccccctccacccgccacttcctcatccaacccctctcagactccgaactagaccccctctccctcctctccctcaacaacaacaacaaatccccaatccctaaccctaaccctaacccaaaccataaccatgaagagcataaacaacatcacaaagacagcagcaaagaacgaatctccagagaccctctcgcgcctcgcgacaacaacttaccgccgcagagattctcatccccggccaccgccaagagatcgcagtcggcgggaaggaataagattgtttccaccacggcggagagggatccatcaccggcggggaaggggaagaggtccgcgtctccggtgccgtccaagtgtgtggttccgagcctcgtttcggcgcgcgaggaaaaccggaaggtgtcgagggagccggcgattatcgtgccgtcgaggtaccggcagccttctccgaccgggaggaagcagccgtcgtcgagtccgcggcggacatcactttctcccgggaggaggttgtctgggggacttaaggtttcgccgctggtggcggactcctccgtgaagaagaagatggccaccattgtcgccggaatctcgaaggtctccgatgcgctggttgggtccaagagtgccaggaagaattgggatgagcaactgccggccacgcctgttgaagctggtggttctaagagtaaggttgatgcacaagcaattttgcgtactcaggctgcaatgtcaaggcggttaagtgatgtgagtggtcaaaaaccgggtagcaatgattcttcgagcaatgagaaaactaaagctgtttctcctcaaagttgtgttcttgaagacaaatccaattttgcagcaatgggtatcaccattcatgagaagaaatggactgatggaagtgttccattagatgctgtttctgggaaccttgcaaggcttggaaaggaagcaatgcaaaggaagatcctcgcttctaccgctgctgctgaagcattagaggaggccaatgctactgaatgtattataagaaatttaagcatgttttcagacctctgctcagtttgccaggccaggaatcctttgccaaccatagacagattcttcactatctatgatgatgttctgaaatcaactgcaatggttgaatctgttgccagcagacataattctgagacacctgatgaaggcattccaacaaaacactcaaaatcactttctttttgggttgaagctgcgttggccactgatctccagatagtatcccttcttactggcacaaccgtggatcctccatcgacactgcaaaaaagcttatcaaaaagacagtctctcggtgcagctaagaaccttaaggttcgttcatcaccacagtccagtctgagtactggtgtgtggacaggaggtagtggaatgaaagagacagtggagcttggagcaaatttgctgtctgaaatgcaaatgtggtttctacgttttgtggaagagtcccttgatgcaggattcaaagtgtttggagagtgtacagctgatgggaaaaaagcattgcccctggatggtggctccattgctgttgttttgtcacacttgaagcgtgtaaatgcatggctggaccgtgtggtttccaaaggggatgactcacttacagaaaagattgagaaattgaagagaaagatctacggatttgttattcagcatgtaggaacaacttttgatagttctgcttcctctgcttcatcatgaatttatgagtttgagtttattccccatttaactatggaccttgaaatcgataaaaggaagtgcttcttctgtcattaaaattattattgtatttcggtgtgggtgagataatggactgaaatgtatgtttacacataaagattgagcaggtgtcatagcttgattatt

SEQ ID NO: 8749 - DNA, 2168 bp, Glycine max
atggcttccctcaccccaggcattctcctgaaaatgctgcaggccatgaacaccaacacccgcgtcaccggcgaccaccgctcccctctcctccaggtcatcggcatcgtccccgctctcgccggctccgacctctggtccaaccagggcttctatttaaacctctccgactccctcaactccacctacgtcctcctctcccaccccgacaccgacctcatcctctccaaccgcctccagctcggccagttcgtccacgtcgaccgcttccacttcgactcccctctcccctctgtctccaacctccgccccctcgccggccgccaccccttcctcggcaccccggagcccctcatcacccgcatctccccctcctctcgccacttcctcatccaacccctctccgattccgaacttgaccccctctcccacctctccctcaacaacaacaataataaatccccaatccctaaccctaaccccaaccctaaccctgaagaaccaaaacaacatcacaatcacaaagacagcaccaaagaacgaataatctccagagaccctctcgcgcctcgcgacaacaacttaccgcctcagagattctcatctccggcgaccgccaaaaggtcacagtccgccgggaggaataagagtgttattactacggcggcggagagggatccctctcccgcggggaaggggaagaggtccgcgtctccggtgccttccaagtgtgtggttccgagcctcgtctcggcgcgggaggagaaccggaaggtgtcgaaggagccggcgattatcgtgccgtcgaggtaccggcagccttctccgaccgggaggaagcagccgtcgccgagtccacggcgaacttcgctttctcccgggaggaggttgtccgggggacttaaggtttcgccgctggtggtggactcctccgggaagaagaagatggccaccattgtcgccggaatctcaaaggtctccgatgcgttggttggatccaagagtgcccggaagaattgggatgagcaaccgccggccacgcctgttgaagctggtggttccaagagtaaggttgatgcacaagcaattttgcgtactcaggctgcgatgtcaaggcggttaagtgacgtgagtggtaaaaaaccaggtagtaatgattcttcgagcaatgagaaaactaaagctggttctcctcaaagttgtgtccttgaagagaaatccaattttgcagcaacgggtttcaccattcatgagaagaaatggactgatggaagtgttccattagatgctgtgtctgggaaccttgctaggcttggaaaggaagcaatgcaaaggaagatccttgcttctactgctgctgctgaagcgttagaggaggccaatgctactgaatgtattataagaaatttaagcatgttttcagacctctgctcagtgtgccaggccagaaatccattgccaaccatagacagattcttcactatctatgatgatgttctgaaatcaactgcaacagttgaatccgttgccagcagacataattctgagacacctgatgaaagcattccaacagaacactcaaaatcactttctctttgggttgatgctgccttggccactgatctccagatagtgtcccttcttactggcacaaccacggatcctccatcgacactgcaaaaaagcttatcaaaaagacactctctcggtgcagctaagaaccaaaaggttccttcatcaccacaatccagtctgagtattggtgtgtggacaagaggtagtggaatgaaagagacagtagagcttggagcaaatttgctgtctgaaatgcaaatgtggtttctacattttgttgaagagtcccttgatgcaggattcaaagtgtttggagagtgtacagctgatgggaaaaaagcattgcccctggatggtggctccattgctgttgttttgtcacacttgaaacgtgtaaatgcatggctggaccgtgttgtttccaaaggggatgactcacttacagaaaagattgagaaattgaagagaaagatctacggatttgttattcagcatgtaggaacaacttttgatagttctgtttcctctgcttcatcatgaatttttgagtttatctcccatttaacttatggaccttgaaatcgatgaaagga

SEQ ID NO: 8750 - DNA, 1431 bp, Glycine max; identical to SEQ ID NO: 8725

SEQ ID NO: 8751 - DNA, 1443 bp, Glycine max; identical to SEQ ID NO: 8724

SEQ ID NO: 8752 - DNA, 1768 bp, Medicago truncatula
ctctgcctcctttacagacagaccataataaaaactcttttctttgttctatatataattattccattcctcttcatacatactctcaacattacaacaacaattctcaattctcacccacccaaaatactaaacgcatcattttcatttccatggaactctcaaaacaagaaccattatctaaaccaccacctatggtggttatgctaccatcaccaggcatgggacatcttataccaatgattgaatttgccaaaagaattattattcttaatcaaaatcttcaaatcaccttcttcattcccaccgaaggtccaccttcaaaagctcaaaaaacagttcttcaatctctaccaaagttcatttcacatactttccttccaccagtttccttctcagaccttccaccaaactccgggatagagacaatcatctccctcactgtcctccgttctctcccttctctccgtcaaaacttcaacactctctctgaaactcatactatcactgctgttgtcgtcgacctctttgggacagacgcttttgacgtcgctagagaattcaacgtccctaaatatgtcttctacccttcaactgccatggctctttctcttttcctttaccttcctcgtcttgacgaggaagttcactgcgagtttagagaattgactgaacctgtgaaaattcccggttgtattcctattcacggtaaatatttactagaccctcttcaagacaggaagaacgatgcttaccaaagtgtctttcgcaacgcgaagagatacagagaagcagatggacttatagagaatagttttcttgaacttgaaccgggtccaatcaaggagttactaaaggaagaaccaggaaaacctaagttttacccggttggaccattagtaaagagagaagtagaagtaggtcaaattggaccgaactcagagagtttgaaatggttagataatcaaccacatgggagtgttctgtttgtttcttttggaagtggtgggaccctctctagtaaacagatagttgaattggcacttggcttggaaatgagtgagcaacggtttttatgggttgttagaagtccaaatgataaagttgctaatgcttcttacttcagtgctgaaacagattctgatccatttgattttttaccaaatggatttttggagagaactaaaggaaggggtctagttgtgtcatcttgggccccacaaccacaggttttggcacatgggtcaactggtgggtttttaactcattgtggttggaattcagttctagaaagtgttgttaatggggtgcctttagtggtttggccactttatgcagagcaaaagatgaatgctgttatgttaactgaggatgttaaggttgggttgagaccaaatgttggtgagaatgggttggttgagagattggaaattgctagtgttgttaagtgtcttatggaaggtgaagaagggaaaaagcttcgttatcaaatgaaggatcttaaagaggcagcttctaaaactcttggtgagaatggaacttccacaaaccatatctccaatttagctctcaagtggaccaacaaatccactgtaataaattaaattaaattaaaaagttgtagtagcttatattagctacaatagcaacatcttgttatataattttcttattaattagtatgtgtatttgaaataatgtaacgctaacacatgtctttcgacatatgttattaattttgattttagtatattaacattttcctttg

SEQ ID NO: 8753 - DNA, 1718 bp, Medicago truncatula
gattccattcctcttcatacatactctcaacatcacaacaacaattctcaattctcacccacccaaaatactaaacgcatcattttcatttccatggaactctcaaaacaagaaccattatctaaaccaccacctatggtggttatgctaccatcaccaggcatgggacatcttataccaatgattgaatttgccaaaagaattattattcttaatcaaaatcttcaaatcaccttcttcattcccaccgaaggtccaccttcaaaagctcaaaaaacagttcttcaatctctaccaaagttcatttcacatactttccttccaccagtttccttctcagaccttccaccaaactccgggatagagacaatcatctccctcactgtcctccgttctctcccttctctccgtcaaaacttcaacactctctctgaaactcatactatcactgctgttgtcgtcgacctctttgggacagacgcttttgacgtcgctagagaattcaacgtccctaaatatgtcttctacccttcaactgccatggctctttctcttttcctttaccttcctcgtcttgacgaggaagttcactgcgagtttagagaattgactgaacctgtgaaaattcccggttgtattcctattcacggtaaatatttactagaccctcttcaagacaggaagaacgatgcttaccaaagtgtctttcgcaacgcgaagagatacagagaagcagatggacttatagagaatagttttcttgaacttgaaccgggtccaatcaaggagttactaaaggaagaaccaggaaaacctaagttttacccggttggaccattagtaaagagagaagtagaagtaggtcaaattggaccgaactcagagagtttgaaatggttagataatcaaccacatgggagtgttctgtttgtttcttttggaagtggtgggaccctctctagtaaacagatagttgaattggcacttggcttggaaatgagtgggcaacggtttttatgggttgttagaagtccaaatgataaagttgctaatgcttcttacttcagtgttgaaacagattctgatccatttgattttttaccaaatggatttttggagagaactaaaggaaggggtctagttgtgtcatcttgggccccacaaccacaggttttggcacatgggtcaactggtgggtttttaactcattgtggttggaattcagttctagaaagtgttgttaatggggtgcctttagtggtttggccactttatgcagagcaaaagatgaatgctgttatgttaactgaggatgttaaggttgggttgagaccaaatgttggtgagaatgggttggttgagagattggaaattgctagtgttgttaagtgtcttatggaaggtgaagaagggaaaaagcttcgttatcaaatgaaggatcttaaagaggcagcttctaaaactcttggtgagaatggaacttccacaaaccatatctccaatttagctctcaagtggaccaacaaatccactgtaataaattaaattaaattaaaaagttgtagtagcttatattagctacaatagcaacatcttgttatataattttcttattaattagtatgtgtatttgaaataatgtaacgctaacacatgtctttcgacatatgttattaattttgattttagtatattaacaaagaaaaaaaaaaaaaaaa

SEQ ID NO: 8754 - DNA, 687 bp, Glycine max
atgaccatcggcaccctccgtcgattctttcttccatgtttcttcccttccaagcctcaacccaccgttcctttctccgatcaccaccacccacccacaaagaaccggccttcctcgccggcttcttcgacgtcgtcttccaccgctgcttcggcggctccgccgcgtccctcgaagtcgatggtgatcggaaccatcttcggtaaccgccgcggccacgtgtggttctgcatccagcacgaccgtctttcttcaaagccttcccttcttcttgagctgccgctctccaccgaccaccttgtccgcgaaatgcggaacggcatcgtccgcatcgccctcgaatgctccgccgccgccaacgcctgccccctccgctccgtccccctctggaccgccttctgtaacggcaagaagaccggcttcgccgcccgccgccgcgccggagaccgcgtccgcaacatcctccgcaccatgcagtgcgtctccgtcggcgccggcgtcatcccctccggcttcgcctcctccgccgccgcagcctccgaggaactcatgtacatgcgcgccaacttcgaacacgtggtgggcaacgccgattccgaatcgtttcatctcatcaaccccgacgagtgccccggccaggaactcagtgtgttccttctccgatccagacttggtgccactcgctga

SEQ ID NO: 8755 - DNA, 696 bp, Glycine max
atgaccatcgacgccctccgtcggttctttcttccatgtttcttcccttccaagcctcaatccaccatccctttctccgaccaccaccaccaccctccagccaccaagaacaaccacccttcctcgccagcttcttcgacgtcatcttccaccgctgcttcgacggctccgccgcgtccctcgaagtcgatggtgatcggaaccatcttcggtaaccgccgcggccacgtgtggttctgcatccagcacgaccgtctttcttcaaaaccttcccttcttcttgagctgccgctctccaccgaccacctcgtccgagaaatgcggaacggcgtcgtccgcatcgcccttgagtgctccgcagccaccaacgccagccccctccgctccgtccccctctggactgccttttgcaacggcaagaagaccggcttcgccgcccgccgccgcgccggagaccgcgtccgcaacatcctccgcaccatgcagtgcgtctccgtcggtgccggcgtcatcccctccggcttcgcctccgcctccgccgcctcctccgaggagctcatgtatatgcgcgccaatttcgagcacgtggtgggtaacgccgactccgaatcgtttcatctcatcaaccccgacgagtgccccggccaggaactcagtctgttcttgctccggtccagactcggtgccactcgctga

SEQ ID NO: 8756 - DNA, 1694 bp, Arabidopsis thaliana
gaccacaagagccatttgcaattaggcataatatatgtcctaactcaccaaccccctcaaaattgccaccaacttcaaatttctctcctttaaacctttctcaatcatctttcttctgccttggaatcctgatcatggcgtcgtcttctctcacttcgaaatccattctcggatccaccaaactcggttcttcttctcttccctcggagctccgtcgtctctcttctcccgccgttcagatctctctccgtacccaaaccaggaagaacttccagatacaagctactggaagttcatatgggactcattttcgagtttcaacttttggagaatcacatggaggaggagttggttgtatcattgatggttgtcctcctcgtattccacttactgaatctgatttgcaattcgatctcgatagaaggaggcctggtcagagcaggatcacaactcctagaaaagagactgatacttgccggatatcgtctggagtctctgaaggaatgacgacaggaacacctatccatgtgtttgtaccaaacacagatcagagaggacttgattacagtgaaatgtcggttgcctatagaccatcgcatgctgatgcaacttatgacatgaagtatggtgtcagatcagtgcagggtggaggaagatcttcagctagagagaccattggaagagttgctcctggagctttggccaagaaaattttgaagcaatttgcaggaactgagattcttgcctatgtctcgcaagttcaccatgttgtacttccagaagaattggtagaccacgagaatttaacactcgaacagatagaaaataacattgtcagatgccctaatcccgagtatgcggaaaagatgatagctgcgattgatgctgtcaggacaaaagggaactctgttggtggtgttgtgacctgcattgttcggaatgctccacgtgggcttggtacaccggttttcgataaacttgaagcagaactggcaaaagcttgtatgtcgctacctgcaactaagggatttgagtttggaagcggctttgcaggtacctttttgactggtcttgaacacaatgatgagttctataccgatgaaaatggaagaatacgtaccagaaccaaccgatctggtggaattcagggagggatctcaaatggtgaaataataaacatgagagtagccttcaagccaacatcaacaattggaaggaagcaaaatacggtaaccagagacaaggtagaaaccgaaatgattgcgcgtggtcgtcatgatccttgtgttgttccacgagctgtgccaatggtggaagcaatggtggctctagttcttgtggatcaattgatggcgcaatacgcacaatgccatttgtttccaataaatccagagttgcaggaacctctccagatagagcagccgcaaaatgctactgctttgtaagcaaatctcgagaagataaagagtcatagagagtgagagttcgcttttgttgtgtgattattatgctgaataaaaaaatgttaattttgtgcccaccagaaaaacaaagaacatgattttttataagaggatttgcttctatatcattcagctaaatgtgattttaccacgaacataaactattttctataatttttttggtgtaaaaccaaacacttttctacaacatacatgatacatgtaaatata

SEQ ID NO: 8757 - DNA, 2462 bp, Arabidopsis thaliana
gatacaagctactggaagttcatatgggactcattttcgagtttcaacttttggagaatcacatggaggaggagttggttgtatcattgatggttgtcctcctcgtattccacttactgaatctgatttgcaattcgatctcgatagaaggtattttgaggaagaagaaagctcttactatataatatgatcgtttgatttacatgttggtttgctttattaggaggcctggtcagagcaggatcacaactcctagaaaagagactgatacttgccggatatcgtctggagtctctgaaggtctagttatacattctatttcatagtttgagtttgattttgtttctcagccgttgttctaattgttgatatccataaatttgcaggaatgacgacaggaacacctatccatgtgtttgtaccaaacacagatcagagaggacttgtaagttttttttacttctctatgcatataactgtactcgatattgttaactagacttttgctatttgcattagaaagacaacagttttgaagtatagaaagcctgtagattctaacctttgaggaactcactggattttcaggattacagtgaaatgtcggttgcctatagaccatcgcatgctgatgcaacttatgacatgaagtatggtgtcagatcagtgcaggtatctttttctgttaaattactcacatgctacttttcttggtaaggttttatgtgttcaaaggcattgttcagcttaacataccttaagcgttattcttttcaagggtggaggaagatcttcagctagagagaccattggaagagttgctcctggagctttggccaagaaaattttgaagcaatttgcaggaactgaggtgtgtttactttctgattttgcaaatgacactgctctcaaagaatcaatttacattgaactttttatatcccttctcatgtttggttcttctttcatctctctattttttctatcttagtatatccttgcaaataagatgccccttattaactcagtgacccaattctaatgattcacgcaactctttaaagtttgcttctggacttgcttatgtttgtctctgttgtttttttgtgtctccagattcttgcctatgtctcgcaagttcaccatgttgtacttccagaagaattggtagaccacgagaatttaacactcgaacaggtgcaaatcctttttcaaagtataatttacatgttgttttttgagtagttttcatactgtaacggaggtaaaacccattttggtgacctggttcttgctgtcaattttctgcaactttcatccaccgttataactattttcttaatagtatttcttcttattaaggttcttctggtgatattcttacctcattttgtttattttacagatagaaaataacattgtcagatgccctaatcccgagtatgcggaaaagatgatagctgcgattgatgctgtcaggacaaaagggaactctgttggtggtgttgtgacctgcattgttcggaatgctccacgtgtatgaactcactataccatgagcttaatctgtgcgtcctcatgtagtttgattaatgaacttcagtgaatgcttatttaaactactattcgcaggggcttggtacaccggttttcgataaacttgaagcagaactggcaaaagcttgtatgtcgctacctgcaactaagggatttgagtttggaagcggctttgcaggtatagaaagttatacttttctctcctttgtccaatctaaaatcaacctcctttggagctgtataaatcatacgcaaatgaacccgcaggtacctttttgactggtcttgaacacaatgatgagttctataccgatgaaaatggaagaatacgtaccagaaccaaccgatctggtggaattcaggttagttaagtcttgtatttaatatgtcaataataaactacatttctcctgagagaattcctaatattggtcaatttgtatagggagggatctcaaatggtgaaataataaacatgagagtagccttcaagccaacatcaacaattggagtaagtttgtgataaactcatgcaggatctttataaacataacaaatgtcagcttgagatcattgatgttttctttccaatgcgcagaggaagcaaaatacggtaaccagagacaaggtagaaaccgaaatgattgcgcgtggtcgtcatgatccttgtgttgttccacgaggtgattatatacaccgaatccaaaccattgaatcaattcactttattattcgggattttgattttgtgtttgtttgcagctgtgccaatggtggaagcaatggtggctctagttcttgtggatcaattgatggcgcaatacgcacaatgccatttgtttccaataaatccagagttgcaggaacctctccagatagagcagccgcaaaatgctactgctttg

SEQ ID NO: 8758 - DNA, 696 bp, Glycine max; identical to SEQ ID NO: 8755

SEQ ID NO: 8759 - DNA, 687 bp, Glycine max; identical to SEQ ID NO: 8754

SEQ ID NO: 8760 - DNA, 1478 bp, Glycine max
atggctcgaaaaccccttctcaagcaaaccctagccacactcttccttctcttcgtcctctacgcaatcttcaacgccttcttccagcccaccgattcctccgccttcgacgccgccgccaccttctcctccgcctcctccgttctcctctccggcgcaaccaccaaatcccccgccatcaatgtcttcctctacgatcttccccgcaggttcacctccgacgtcatccatcaccacgcgctggcgcgtggtggcgcctcacgcgtcacccctgatgacgacgcggcggcgcccaagtaccccggccaccagcacatggcggagtggtacctcttcgcggatctctcccgagccgagtccgaacgcgcaggctcgggctcgcccgtggttctggtcgcggatcccgaggaggcggatttgttcttcgtgccgttcttctcgtcgctgagtttgattgtgaacccggttcgaccgcccgggtcaaattccggttcggagaaaccggtttacagcgacgaggagaaccaggaggcgctggtggagtggctggagaagcaggagtattggaagaggaacagtgggagggatcacgtgattgtggcttcggatccgaatgcgatgtaccgggtcatcgatcgggtaaggaacgctgtcttgctggtgtcggattttgggaggctgagacccgaccagggatcgctggtgaaggatgtggttgtgccctactcccaccgtatcagaacttaccagggtgatgccggtgttgaagatcgtaacaccttgttattttttatgggaaaccggtatcgcaaagagggagggaaaattcgtgatatactctttaaaattctagaaaatgaaaaggatgtcataataaagcatggagcacaatccagagagagtcggcgggcagcttcacaaggaatgcatacatctaaattctgtttacatcctgcaggagatactccatcagcctgccgactgtttgatgctatagttagcttgtgcattccagtgattgtcagtgataatattgagttgccttttgaagatactatagactacagaaagcttgctgtatttatagaaacttcttctgctataaagccaggatatttggtctcaaaattgagagcactgaccccagatagagtcttggcatatcagaaagagctaaaggaggttaagcgatattttgaatacgaagaacctgatggaacggttaatgagatttggcgccaagtttcgaaaaaactacccctgattaaattgatgattaaccgtgagaaaaggttgtttggaaaacaagtggagtgctcttgcgtatgtacaaaccagactgctgttagaaccctatagcacttatccctctatccagtttggcattccatgaaatctgtggctcagttttgtcaggatacatttcaaggtgatgagtacatttaaatcagggatcagggataatgatagttgcgaat

SEQ ID NO: 8761 - DNA, 1456 bp, Glycine max
atggcgcgaaaaccccttctgaagcaaaccctagctacgctctttctcttcttcgtgctttatgcaatcttcaacgccttcttccaccccaccgattcctccgccttcgacgccgccgccaccttctcctccgcctcctctgtcctcctctccgctggcaccaccaaatccttatacgtcaaggttttcctctacgatctcccgcgaaggttcacctccggcgtaatccaccaccacacgcttgcgcgtggtagtggtggtgttggtggcagcgcctcacgcgccacccccgatgacgtggcggatgcgctaaagtaccccgggcaccagcatatggcggagtggtacctcttcgcggatctctcccgagccgagtccgaacgtgcaggctcgggctcgccagtggttcgggtcgcggatcccgaagaagcagatttgttcttcgttccgttcttctcatcgctgagtctcatcgtgaacccggttcgaccgccagggtcgaattccggtttggagaaaccggtttacagcgacgaggagaatcaggaggcgctggtggagtggctggagaagcaggagtattggaagaggaacaatgggagggatcacgtgattgtggcttctgatccaaatgcgatgtaccgagtcatcgatcgggtcagaaacgctgtattgcttgtttcggatttcgggaggttgagacccgaccagggatcgctggtgaaggatgtggttgtgccctactcgcaccggatcagaacgtacccgggtgatgtcggtgttgaagatcgtaaaaccttgttgtttttcatggggaatcggtaccggaaagagggagggaaaattcgtgatttactctttcaaattctagaaaatgaaaaggatgtcataataaagcatggagcacaatccagagagagtcggcgggcagcttcacatggaatgcatacatcaaagttctgtttacatccggcaggagatactccatcagcctgccgactgtttgatgctatagttagcttgtgcattccagtgattgtcagtgataatatcgagttgccttttgaagacactatagactacagaaagattgctgtatttgtagaaacttcttcagctataaagccaggacatttgctctcaaaattgagagcagtgaccccagatagagtcttggaatatcagaaaaaactaaaggaggttaagcgatattttgaatacgaagaacccgatggaacgataaatgagatttggcgccaagtttcgaaaaaactaccccttattaaattgatgattaaccgtgagaaaaggctgtttggaaaggaagtggagtgctcttgcgtatgtacaaaccagactgcagttattagaaccctatagcacttatccctctatcaagtttggcattccatgaaatctgtggctcactcagttttgtgaggacatttcaaggtga

SEQ ID NO: 8762 - DNA, 1656 bp, Medicago truncatula
gaaatagcgtaagaaaggtgaagaaagtggcgatgccgtatacaaaaaacatggacgaagaagaaacaacgaaaaacaaaggaaaaaaacccaaacacactttccaaacactattctccacgatgacacgaaaaccagttttcaaacaaaccctaatcatcttcttcgttctcttacttctctacgctctcttcaacaccttcttccaaccaaccgattcttccaccttcgattcctccaccttctctttcaactccgccacttcctccgttctcctctcctccgccgcttccaaatcccctgcggtcaaggtttacctctacgatctccccaaaaggtttacctacggagttattcaccaccattccctcgcgcgtggctcacgcgctaatacggatgaaaaggatgttacgtcgttcaagtatcccggtcatcaacatatggcggagtggtacttgttttctgatctatctcgacccgactcggaacgttccggttctcctgttgttagggtttcagatccagaagaagctgatttgttttttgttccgtttttttcatcgttgagtttgattgtgaacccggttcgaccggctggttcgggttccgtaccggagaaaactgcttacagcgacgaggagaatcaggaagcattgatggagtggctggagatgcaggagttttggaagaggagcaaaggaagggatcatgtgattgttgcgtcggatccgaatgcaatgtaccgggttgttgatcgggttaagaactgtgttttgcttgtttcggattttggaaggttgagacctgatcagggatccttggtgaaggatgtgattgtgccgtattcgcatcggataagaacttatgatggtggcattggtgttgataagcgcaacaccttgttattttttatgggaaatcgatatcgtaaagagggagggaaaattcgagacacgctctttcaaattctagagaaagaagatgatgtaataataaagcatggagcacaatccagagaaagtaggcgggcagcatcacagggaatgcacacatcaaagttctgcttacatcctgccggggatactccatcagcctgtcgattgtttgatgcgatagtcagcttgtgtgttccggtgattgtcagtgatagtattgagttgccttttgaagatactatagactatagaaagattgctgtatttgtggaaactgctgctgctatacagccaggatatttggtgtcaattttgagaggcatggccccagatagaatcgtggaatatcagaaagaactaaaagaggtgaagcgatactttaaatatgatgaaccagacgggacagtgaatgagatttggcgccaaatttcaaaaaaactacccttgatcaaattgatgattaaccgcgagaaacgactgtttacaaaggaacctgattgctcttgcgtatgtacaaaccagactgccattggaactttatagcactaacaattggatttggcatcccatgaactctggcttggttttgacgggacattctgagttgatgagaaaattaaggataatgatagttgtaaatgtagtttctgtcatatttctcataagagtggcttggagataattgttgacaaccacggtttactcaactcatgtcccaatc

SEQ ID NO: 8763 - DNA, 2199 bp, Glycine max
atggtggcatcgttgcacttgcacatcagaagaatcgtctttaggaacgcacatcccagacttcactcaacactcactaaaccccagctcaaggccctcgttctcgaccactactcccatggcaagttcgccaaccttatccaaaacgttgtcgcgtcgccccccgtcctcctcactgcatgccaaaacctctccccctcctttccccccccggaccgcttcagcatcccggccacgtgccttgagctcctcgaaaaccgcttcgacgtggcatcatgctgcctcccactaactccctctttcgttttgcccaacttgaagctcaaggtcgtcattgaggccattcgaatggttatggaaatcgtctacgacgaccgcttcgtcaccttttgctacggtggccgcgtcggaatgggacgacacacagccataaggtacttaaaaaactccctcgagaaccctacttggtggttcaccgtcaggttcaagcctcacaggtttcaacatttccatgtcgagaagctctgttctgttattgaacgcaaagtcaacgattccgttttcattgatttgataaagaggttgtttcaatgtaaggctttggtcattgaattgggtgcggattggttaggaaggggacttcctcaggaatgtggcttgtgctccattttgatcaatgtttattttgatgcctttgataaagagattcaagagatgcgtcttcgggagaatcgagagaaccgggaattggatccgaagattattgcttcgggtttgtattctgatgtgttttacaagccggtgaaggtgtatgcggtgaggtacttggatgagatactccttgccacatcagggtccaagatgttggccttggagttgaggacgggggttgtcaagactttggaacttggattgggtttgcgtgttgataaggtgaataccgcgattcatagcgcggtgtcggagaagattgagtttcttgggatggaattgcaggctgttctgccttccattttgcgcccgccaatgtcggagaaagcaatcagggcacggaagaagtacctcaggcagaaggaagtcagggctcttgaattgagaaatgctagagcaaggaacagaaggaaactggggttgaagatatttagtcatgtttataaaaagatcaagcaaagtgacgggtttaaatttgactttagtattgaaaaccaggtccgagaaatttttagatcttgggctgatgaagtagtgcaagagttcttggggaatatagatgagtgtcaagaatggcatcgaagtctatcagctggcgatttcctacagttgagacacattagaaatcaattaccacctgagcttgttgatgcttatgataagttccaagagcaggtagatcaacatttgaatcctataaaagctaggaaggcgatagaggaagaagaaagaagagtaaaggaagaagaggaacaaaattattcaaaaggaacagttgaggatttgacaaagctctgtatgaaagttgaggcaccagaaatactcataagaaaggctgtgaagttggttgggtttacaaatcatatgggtcgtccacgaccaattgaatttcttgttgcacttgaggatgccgatattatcaagtggtatgctggcatagcaagaaggtggcttgattatttctgctgttgccacaacttcaagacagtcaaaactattgtaacttatcatttaaggttctcctgtatcttgacattagcagagaagcatgaatccaccaagcgtgaagtgataaagcatttcagcaaagatttgagagtctatgatatgaatggaaatcatgaagtgcattttcctacagaaagagaggttaagatgatgggagatagaaatctttctgatccaaaaccagtagatggggctttatctttggctgtagtaaggttggcatctgatgagcctccatgtcattgcattgcccatttctgtgacaagacaactactgtcttttatcgggtccatttgctgcaaaacagattgaatgtcagcccattggacaaagaaaaatgggtacaagggatgggtgtaattcatgaaagcctaaaccgtaagtgcctccctctctgtactgatcatgtaaatgatttgtacatggggagaatcacacttcaagacattgactgttcttattgtgtggatgtggactga

SEQ ID NO: 8764 - DNA, 2217 bp, Glycine max
atggcttcatatgtatccatggtggcatcgttgcacttgcacataagaagaatcgtctttgggaacgcacatcccagacttcactcaacactcactaaaccccagctcaaggccctcgttctcgaccactactcccatggcaagttctccaaccttatccaaaacatcgtcgcttcgccccctgtcctccacaccgcatgccaaaacctctccccctcctttcccccccctgactgcttcagcattccggccacgtgccgggagctcctcgaaaaccgcttcgacgtggcatcatgctgcctcacactaactccctctttcgttttgcccaacttgaagctcaaggtcgtcattgaggccattcgaatggttcttgaaatcgtctacgacgaccgcttcgtcaccttttgctatggtggccgcgtcggaatgggacgacacaccgccataaggtacttaaaaaactccctcgagaaccctacttggtggttcactgtcaggttcaagcctcacaggtttcagcatttccatgtcgagaagctctgttctgttattgaaagcaaagtcaaggattccattttcattgatttgataaagaggttgtttcaatgtaaggctttggtcattgaattgggtgcggattggttaggaaggggacttcctcatgaatgtggcttgtgctccattttgatcaatgtttattttgatgcctttgataaagagattcaagagatgcgtcttcgggagaatcgagagaaccgggaattggatccgaagattattgcttcgggtttgtattctgatgtgttttacaagccggtgaaggtgtatgcggtgaggtacttggatgagatactccttgccacatcagggtccaagatgttggccttggagttgaggatgggggttgtcaagactttggaacttggattgggtttgcgtgttgataaggtgaataccgctattcatagcgcggtgtcggagaagattgagtttcttgggatggaattgcaggctgttccgccttccattttgcgcccgccaatgtcggagaaagcaattagggcacggaagaagtacctcaggcagaaggaagtcagggctcttgaattgagaaatgctagagcaaggaacagaaggaaactggggttgaagatatttagtcatgtttataaaaagatcaagcaaagtgatgggtttaaatttgactttagtattgaaaaccaggtccgagaaatttttagatcttgggctgatgaagtagtgcaagagttcttggggaatatagatgagtgtcaagaatggcatcgaagtctatcagctggcgatttcctacagttgagacacattagaaatcaattaccacctgagcttgttgatgcttatgataagttccaagagcaggtagataaacatttgaatcctatagaagctaggaaggcgatagaggaagaagaaagaagagtaaaggaagaagaggaacaaaattattcaaaaggaacagttgaggatttaacaaagctctgtatgaaagttgaggcacccgaaatactcatacgaaaggctgtgaagttggttgggtttacaaatcatatgggtcgtccaaggccaattgaatttcttgttgcacttgaggatgccgatattatcaagtggtatgctggcatagcaagaaggtggcttgattatttctgctgttgccacaacttcaagacagtcaaaactattgtaacttatcatttaaggttctcctgtatcttgacattagcagagaagcatgaatccaccaagcgtgaagtgataaagcatttcagcaaagatttgagagtctatgatatgaatggaaatcatgaagtgtattttcctacagaaagagaggttaagatgatgggagatagaaatctttctgatccaaaaccagtagatggagctttatctttggctgtagtaaggttggcatctgatgagcctccatgtcattgcattgcccatttctgtgacaagacaactaccgtcttttatcgggtccatttgctgcaaaacagattgaatgtcagcccattggacaaagaaaaatgggtacaagggatgggtgtaattcatgaaagcctaaaccgtaagtgcctccctctctgtactgatcatgtaaatgatttgtacatggggagaataacacttcaagacattgactgttcttattgtgtggatgtggactga

SEQ ID NO: 8765 - DNA, 1259 bp, Glycine max
aagatcagttgtaatcgcatcgtagatagatagatagaataataagttgggttcaccgttcaccctcaccagcaccaccaccactccatggcactctccttccgacccctcatccacccccgcttcaccgaccggtcactctttcagttcctcccacccaagcctcccccttttcctcctcctccgccaccctccgtcctcctccccctcacgcgccgccgcggcggcttcatctcctcctgcctctccgacgacgccgtctccacgcgcaacttcgaccgtggcttcaccgtgatcgccgccatgctccgccgcatcgagcccctcgacaactccgccatctcgaaaggcgtgtcccccgccgcccgagactccatgaagcagaccatttccaccatgctcggattgctcccctccgaccacttcgctgtcaccgtcaccgtctccaaacaccccctccaccgcctcctcttctcctccatcgtcacagggtacactctatggaatgcggagtacaggatgtctctggcgaggaatctggatatgtcgggttctaggaatgaggggtcagattgtgaaacatgttcagaggttttggaggtgaaggatgtagcaaaaacagtgggtgatgagaaaatcgatgttgttaatgatttggaaagttgcagcagcagtggtagcttgaaagaatttggagatttgccttctcaggctctgagttacattcagcagttggagtctgagttgacaagtgtgatggaggaactgaatgcccagaagcaggaaatgatgcaattagaatatgacaagggaaaatggaataatttgttggaatatcttcggtctctggatcctgatatggtgactgaattgtcccggccttcatcattagaagtggaggatataattcaccaacttgttcagaacatattgagaagattctttgtggatgatgctagctctagttttatggaacaatcagtggaaggaaacgtagacaatcgcacagacagtgatgagcttagtaatacagtagccacttctcgtgattacctagcaaagttgcttttctggtgcatgttattgggtcatcacttaagagggttggaaaatagattgcatctgagctgtgttgttggactgttgtagagaaggtgataggcatgtatattcttttttcttcctctatttccatttcatcctttttcccttctcatataaatttttctgttcaatgaaaaactctgaaataatcacct

SEQ ID NO: 8766 - DNA, 1262 bp, Glycine max
ccgcagcagcaccattccaatttccatggcactctcctttcgccccgtcatccacccccgcgtcaccgaccggtcactctttcagttcctcccacccaagcctccccctcttccaacttcgccacctccctccgttctcctccccctcacgcgtcgccgcggcggcttccttccctcctgcctctccgacgacgccgtctccacccgcaacttcgaccgcggcttcaccgtgatcgccgccatgctccgccgcatcgagcccctcgacaactccgccatctccaaaggcgtgtcccccgccgccagagactccatgaagcagaccatctccaccatgctcggattgctaccctccgatcacttcgccgtcaccatcaccgtctccaaacaccccctccaccgcctcctcttctcctccatcgtcaccgggtacactctatggaatgcggagtacaggatgtctctgacaaggaacttggatatatcaggttccagggatgaggggtcagattgtgaaacgcgttcagaggttttggaggttaaggatggagcaaaaacagtaggtgatgagaaaattgaggttgttaatgatttggaaagttgcagctgcagtggtaacctgaaagaatttggagatttgcctcctcaggctctgagttacattcagcagttgcagtctgagttgacaagtgtgacagaggaactgaatgcccagaagcaggaaatgatgcaattagaatatgacaagggaaaatggaacaatttgttggaatatcttcggtctctggatcctaatatggtgactgaactgtcccggccttcatcattagaagtggaggatataattcaccaacttgttcagaacatattgagaagattctttgtggatgatggtagctctagttttatggaacaatcagtggaaggaaatgtagacaatcgcgcgggcagtggtgatgagcttagtaatacgatagccacttctcgtgattacctagcaaagttgcttttctggtgtatgttattgggtcatcacttgagagggttggaaaatagattgcatctgagctgtgttgttggactattgtagagaaggtgataggcatgtatattcttttcttcctcttttttcttttcaccccttctcccttctcccttctcatataaatttttctgttcaatgaaaaactgagtgtgaaataatcacatgctctccttgcttctggcactctttcacttgattcatcataccaagcattgaa

SEQ ID NO: 8767 - DNA, 2168 bp, Glycine max; identical to SEQ ID NO: 8749

SEQ ID NO: 8768 - DNA, 2274 bp, Glycine max; identical to SEQ ID NO: 8748

SEQ ID NO: 8769 - DNA, 1802 bp, Glycine max
ccaagtgtcgtcccaatatgacaacttgcaaacccaatacaaaaaaacaaaatactcgaaattattgttattgctagacagaagagttgaaaaacaaaagaaaagcctaacctcaatctcttgttctagttcttaatcttgttgttctactatggaggaagaaagcacttcagcggaatccaatccttcttcgagcgaccgcatcaaactaaacgtgggcggaaagctcttcgagacgacgttctccacgctccgttctggcggcccggactcgctcctcttcgcgctctcgaaccgccgatccgccgacccgagccccgtcttcatcgaccgcgacccggagatcttctccgtcctcctctccctcctccgcacctcccaccttccctccgccgcgcgccgcttctccaagcacgagctcgccgacgaggccctcttctacggcatcgactcccacctccgggcggccgctgcccctccccccttctctggcatcgacgcggccctctccgcttccctccgccccgcctcggagggcctcccctcctctttcgtcgcctccccctccggcggcgtctggatcgcccacggcggccaaatctcctgctacgatcccatcctcacccacgccgccaccgtccgcacgcacctcgacgaaattgactccatctgcagagtctggcccgagatcgccgccgtcgggtccaaatccgacaccggcctccacttctacaacttctccggcagccgccacgttggatccgtccactggaccgatccgctcgatcctcgaatcttcaaagccagcgtcaacgccataacaagctcctcaaactccgttttcgcttcgttcgattgtccgcacagagagaattgcataatcgaagtcgataaggagaagcttctgatcgcgaatcagttcgctcggcaatcagggaaccaggcgaagaacatggttccccgaaagctgacgtggattccggcgaccggagttctcgtcggaagcgcggtcaccggcggcgcgttcggttactccggctacgtccggttgtgggacccgagatccggggacgtggtctgggagacaaacgagcctggtggttcgggacggagcagcaggtttggggattcgtttgctgacgtggaggcggacgtggaagggttgttgctgttcaagctgtgttctaagtccggggatttggctatggcggatatgcggtttttgaaggacgatccttgggtttatatgaaagagaagaaccctagtttggtgagttgtggtgaagtgaggaatagtgtggtgcattgttatagggggcaagtgtttgtggctagagaaggagcattggaggtttggtcaagggcggaacaaaaggaaaatagtgagggaaatgctgaagggttttttaggaggaattttgtggataagagggaggattcagagagaggggttataaagaagattgaaggtggtggggataggttgtttgttagtagggaagatgttgagggtattgaagtgtgggagagttctcattctgcaggagcaatttctgttttgtgacagtgagccaaatttttagttagctaggatttcagcattacacgaataaaatgtaatttttttttataagcgatgaataaaccatgacttcatgcaactttgatactagtgtatagacaaatgcctcactgaactttctttgccttcaaaacatggggcagtatttgctgcattttgttaactatgtatgtcatcttaatatattatacttttgttaaatccatttcttctagaaaga

SEQ ID NO: 8770 - DNA, 1738 bp, Medicago truncatula
aggaacaagatagtaagcatttggatttcaaaaatggaggaagaaagcacttcccaaaccaccacagactccaacgtaactgaccgcataaaactcaacgttggcggtaagctcttcgaaacaactctttccacaatccggtccggcggtccagactctctccttttcgcattatcaaaccgtttttccaacgacccaaacccggttttcatagaccgcgacccagaaatcttctccgtcttcctctctctcctccgcaccaaccaccttccctccactgcccgccgcttctccaaacaagaactcgccgacgaagctctcttctatggtattgactctcatctccgaaatgctacttctccacctccgttctccggcatcgacgcttccatcgttgcctccgtccgacctgcatcggaaggattgtcttctactttcaccgctgcggagaacggttccgtttggattgctcacggtggtcaactctccagctacgactggaatctaatccattccgcaaccgttcgtactcacctcgatgagatcaattcaatttgcagagtctggccggagattgccgccgttggaactgaatctgatgctggattacacttctacaatttctccggtagtcgccacgttggttctgttcattggagcgatccttccgatccgagaatcttcaaagcgcgagtcaacgcgataaccgcatcggataattcggtttttgcttcattcgattgtcctcatagagagaattgcatcctcgaggttgataaagctaagctccagatcgtgtcgcagttaggtcgacaatccgggaaccaagcaaaaaacatggttccggggaaattgacgtttgttccgacgactggagtgctcgttggaagtgcggtaacaggtggagcatttggttattcgggatatatccgtgtttgggaccctaggtctggtgaagtggtttgggaaacaaacgaaccgggtgcgggtaggagtagtagatttggtgattcattttctgctatagatgttgatgttgaaaaattattactatttaagctttgttcaaagtctggtgatttagctatggcggatatgcgtcgtttgggtgatgatccttgggtttacttgaaggagaagaatcctagtttatggacagatgggggtgatgggagtactagtagtgtggtgaattgttacaaagggcaagtttttgtgggcagaggcggggagttggaggtttggtcaagggtgaaagaggtggtagaatgtgagagtgagagggatagggagagtgatggtgagggagtttatagaaggaattttgttgataagagagaggattcggagaaaggtgtgattgtgaagattgaaggtggtggggataggttgttcattagtagagaagatgttgaaggtattgaagtgtgggagagttcccattatgctggagctatttctgtattgtgaccttgggattgaatttgatagttagggttggcttgggttaccttgttgtaagattcttcttcttccatatggaatttgttaatgtttgacattttgtgaatagccataatttgatgcaatttaaatttctgtctcctgcatttgttgtaatattagctctagtatcatgaataaaccacaatgggtccgaaatgagttccttaatgatgttcaagatcaatgaatatttggggcaagtgtaatacattattaacactaaatttatttt

SEQ ID NO: 8771 - DNA, 1338 bp, Glycine max
  misc_feature (376)..(376): n is a, c, g, or t
  misc_feature (1123)..(1123): n is a, c, g, or t
atggaggaagaaggaacatcaacgaaatccaacccttctttgagggagcgcataaatctaaacgtgggcgggaagctcttcgagacgatgctctccatgctccactccaatgacccgaattcgctcctcttctccctatccaaccgccgattggctgacccgagccccatcttcatcgaccgtgacctggagatcttatccatcctcctctccctactccgcacctctcacctcccctctgctgtgcaccacttctccaagcacgagcttggcgacgaggctctcttctacggcatcgacgcccacctctgtgctgctgccgcaactccccccttctctgacatcgacgttgccctcttcgcctcccttcgcccancctccgagtgcctcccctcctcttttgtcgttgccccctccagcgctgtctagatcgcccatggtggccaaatctcctattgcgaccctatcctcacccacgccaccaccacccgcacacaccttgacaaaatcgactccatctacaaagtctagctagaaattgccatcgttggttccaaatccgacgtcagcctccatttctacaacttatctgacaaccgccacatcggatcagtccactggactgatttgctcaatcctcgaatcttcaaatccagcatcaacgccattaccagttctacaaattatgtcttcgctttatttgactgtccttacggagagaatttcataatcgaagtcgataaagagaagcttcagactgggaagctgatgtggattctggcaatcagagttctcgtcaaaagcgcggtcaccggcagtgtgttcggttacttcagctacgtccggttataggacccaaggttcggggaggtggtttgggagatgaacgaacctggcggttcgggacagagcagcaggtttggggattcatttgttgacgtggaagggttgcttctgttcatgctgtgttcgaagtctggggatttggctatggcggatatgcggtttttgaaggacgatccttgggtttatttgaaggagaaaaaccctagtttggtgagttatggtgaagtaaggaatattgtggtgcattgttataggggacaagtgtttgtggctaaangaagagcattggaggtttggtcaagtgtggaacaaagggaaaatagtgggagtggtgctgaagggttttatagaagggattttatggataagagagaggattcagagagaggggttataaagaagattgaaggtggtgggtataggttgtttgttagtagggaagatgttgagggtattgaagtgtgggagagattggcaaatttagttaggtaa

SEQ ID NO: 8772 - DNA, 1456 bp, Glycine max; identical to SEQ ID NO: 8761

SEQ ID NO: 8773 - DNA, 1478 bp, Glycine max; identical to SEQ ID NO: 8760

SEQ ID NO: 8774 - DNA, 1720 bp, Glycine max; identical to SEQ ID NO: 8139

SEQ ID NO: 8775 - DNA, 1479 bp, Glycine max; identical to SEQ ID NO: 8141

SEQ ID NO: 8776 - DNA, 1858 bp, Glycine max; identical to SEQ ID NO: 8191

SEQ ID NO: 8777 - DNA, 2030 bp, Glycine max; identical to SEQ ID NO: 8192

SEQ ID NO: 8778 - DNA, 1254 bp, Cucumis melo subsp. melo; identical to SEQ ID NO: 8193

SEQ ID NO: 8779 - DNA, 1627 bp, Vitis vinifera; identical to SEQ ID NO: 8194

SEQ ID NO: 8780 - DNA, 1757 bp, Arabidopsis thaliana; identical to SEQ ID NO: 8195

SEQ ID NO: 8781 - DNA, 1726 bp, Arabidopsis thaliana; identical to SEQ ID NO: 8196

SEQ ID NO: 8782 - DNA, 1720 bp, Glycine max; identical to SEQ ID NO: 8139

SEQ ID NO: 8783 - DNA, 2030 bp, Glycine max; identical to SEQ ID NO: 8192

SEQ ID NO: 8784 - DNA, 1858 bp, Glycine max; identical to SEQ ID NO: 8191

SEQ ID NO: 8785 - DNA, 1533 bp, Glycine max; identical to SEQ ID NO: 8152

SEQ ID NO: 8786 - DNA, 1533 bp, Glycine max; identical to SEQ ID NO: 8153

SEQ ID NO: 8787 - DNA, 2009 bp, Glycine max; identical to SEQ ID NO: 8144

SEQ ID NO: 8788 - DNA, 1662 bp, Glycine max; identical to SEQ ID NO: 8145

SEQ ID NO: 8789 - DNA, 1479 bp, Glycine max; identical to SEQ ID NO: 8141

(The sequence listing continues in the following parts.)

What is claimed is:

1. A method of improving drought or salt tolerance of a soybean plant, the method comprising:

transforming a soybean plant with an exogenous DNA construct comprising a plant-expressible promoter operably linked to the miRNA precursor polynucleotide having the nucleic acid sequence as set forth in SEQ ID NO: 11889 which encodes the mature miRNA sequence as set forth in SEQ ID NO: 33, growing the transformed plant under drought or salt stress conditions, and wherein over-expression of said miRNA precursor polynucleotide encoding said miRNA sequence in said transformed soybean plant improves drought or salt tolerance of the transformed soybean plant as compared to a control soybean plant lacking said exogenous DNA construct and grown under the same growth and said stress conditions.

* * * * *